(12) United States Patent
Mathur et al.

(10) Patent No.: US 8,119,385 B2
(45) Date of Patent: Feb. 21, 2012

(54) NUCLEIC ACIDS AND PROTEINS AND METHODS FOR MAKING AND USING THEM

(75) Inventors: Eric J. Mathur, San Diego, CA (US); Cathy Chang, San Diego, CA (US)

(73) Assignee: BP Corporation North America Inc., Houston, TX (US)

( * ) Notice: Subject to any disclaimer, the term of this patent is extended or adjusted under 35 U.S.C. 154(b) by 689 days.

(21) Appl. No.: 11/817,403

(22) PCT Filed: Mar. 3, 2006

(86) PCT No.: PCT/US2006/007642
§ 371 (c)(1),
(2), (4) Date: May 7, 2008

(87) PCT Pub. No.: WO2006/096527
PCT Pub. Date: Sep. 14, 2006

(65) Prior Publication Data
US 2010/0011456 A1    Jan. 14, 2010

Related U.S. Application Data

(60) Provisional application No. 60/658,984, filed on Mar. 4, 2005.

(51) Int. Cl.
*C12N 9/48* (2006.01)
*C12N 9/50* (2006.01)

(52) U.S. Cl. .................................. 435/212; 530/350
(58) Field of Classification Search .................. None
See application file for complete search history.

(56) References Cited

OTHER PUBLICATIONS

Mount, Bioinformatics, Cold Spring Harbor Press, Cold Spring Harbor New York, 2001, pp. 382-393.*
Spencer et al., "Whole-Genome Sequence Variation among Multiple Isolates of *Pseudomonas aeruginosa*" J. Bacteriol. (2003) 185: 1316-1325.
Database Sequence GenBank Accession No. BZ569932 Dec. 17, 2002.
Omiecinski et al., "Epoxide Hydrolase—Polymorphism and role in toxicology" Toxicol. Lett. (2000) 112: 365-370.

* cited by examiner

*Primary Examiner* — James Martinell
(74) *Attorney, Agent, or Firm* — Kalim S. Fuzail

(57) ABSTRACT

The invention provides polypeptides, including enzymes, structural proteins and binding proteins, polynucleotides encoding these polypeptides, and methods of making and using these polynucleotides and polypeptides. Polypeptides, including enzymes and antibodies, and nucleic acids of the invention can be used in industrial, experimental, food and feed processing, nutritional and pharmaceutical applications, e.g., for food and feed supplements, colorants, neutraceuticals, cosmetic and pharmaceutical needs.

4 Claims, 4 Drawing Sheets

NUCLEIC ACIDS AND PROTEINS AND METHODS FOR MAKING AND USING THEM

REFERENCE TO SEQUENCE LISTING SUBMITTED VIA EFS-WEB

This application includes an electronically submitted sequence (SEQ ID) listing. The entire content of this sequence listing is herein incorporated by reference for all purposes. The sequence listing is identified on the electronically filed .txt file as follows:

| File Name | Date of Creation | Size (bytes) |
|---|---|---|
| 2009-08-24-SequenceListing (D2170-1N).txt | Aug. 24, 2009 | 38,547,757 bytes |

FIELD OF THE INVENTION

This invention relates to molecular and cellular biology and biochemistry. In one aspect, the invention provides polypeptides, including enzymes, structural proteins and binding proteins (e.g., ligands, receptors), polynucleotides encoding these polypeptides, and methods of making and using these polynucleotides and polypeptides. In one aspect, the invention is directed to polypeptides, e.g., enzymes, structural proteins and binding proteins, including thermostable and thermotolerant activity, and polynucleotides encoding these enzymes, structural proteins and binding proteins and making and using these polynucleotides and polypeptides. The polypeptides of the invention can be used in a variety of pharmaceutical, agricultural and industrial contexts, including the manufacture of cosmetics and nutraceuticals.

Additionally, the polypeptides of the invention can be used in food processing, brewing, bath additives, alcohol production, peptide synthesis, enantioselectivity, hide preparation in the leather industry, waste management and animal degradation, silver recovery in the photographic industry, medical treatment, silk degumming, biofilm degradation, biomass conversion to ethanol, biodefense, antimicrobial agents and disinfectants, personal care and cosmetics, biotech reagents, in corn wet milling and pharmaceuticals such as digestive aids and anti-inflammatory (anti-phlogistic) agents.

BACKGROUND

The invention provides isolated and recombinant polypeptides, including enzymes, structural proteins and binding proteins, polynucleotides encoding these polypeptides, and methods of making and using these polynucleotides and polypeptides. The polypeptides of the invention, and the polynucleotides encoding the polypeptides of the invention, encompass many classes of enzymes, structural proteins and binding proteins. In one aspect, the enzymes and proteins of the invention include, e.g. aldolases, alpha-galactosidases, amidases, e.g. secondary amidases, amylases, catalases, carotenoid pathway enzymes, dehalogenases, endoglucanases, epoxide hydrolases, esterases, hydrolases, glucosidases, glycosidases, inteins, isomerases, laccases, lipases, monooxygenases, nitroreductases, nitrilases, P450 enzymes, pectate lyases, phosphatases, phospholipases, phytases, polymerases and xylanases. The invention also provides isolated and recombinant polypeptides, including enzymes, structural proteins and binding proteins, polynucleotides encoding these polypeptides, having the activities described in Table 1, Table 2 or Table 3, below. The enzymes and proteins of the invention have utility in a variety of applications.

SUMMARY

The invention provides isolated or recombinant nucleic acids comprising a nucleic acid sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention, e.g., including SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, and all nucleic acids disclosed in the SEQ ID listing, which include all odd numbered SEQ ID NOs: from SEQ ID NO:1 through SEQ ID NO:26,897, over a region of at least about 10, 15, 20, 25, 30, 35, 40, 45, 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1800, 1850, 1900, 1950, 2000, 2050, 2100, 2200, 2250, 2300, 2350, 2400, 2450, 2500, or more residues, encodes at least one polypeptide having an enzyme, structural or binding activity, and the sequence identities are determined by analysis with a sequence comparison algorithm or by a visual inspection. In one aspect, the enzymes and proteins of the invention include, e.g. aldolases, alpha-galactosidases, amidases, e.g. secondary amidases, amylases, catalases, carotenoid pathway enzymes, dehalogenases, endoglucanases, epoxide hydrolases, esterases, hydrolases, glucosidases, glycosidases, inteins, isomerases, laccases, lipases, monooxygenases, nitroreductases, nitrilases, P450 enzymes, pectate lyases, phosphatases, phospholipases, phytases, polymerases and xylanases. In another aspect, the isolated and recombinant polypeptides of the invention, including enzymes, structural proteins and binding proteins, and polynucleotides encoding these polypeptides, of the invention have activity as described in Table 1, Table 2 or Table 3, below.

In one aspect, the invention also provides isolated or recombinant nucleic acids with a common novelty in that they are all derived from a common source, e.g., an environmental source, mixed environmental sources or mixed cultures. The invention provides isolated or recombinant nucleic acids isolated from a common source, e.g. an environmental source, mixed environmental sources or mixed cultures comprising a polynucleotide of the invention, e.g., an exemplary sequence of the invention, including SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, and all nucleic acids disclosed in the SEQ ID listing, which include all odd numbered SEQ ID NOs: from SEQ ID NO:1 through SEQ ID NO:26,897, over a region of at least about 10, 15, 20, 25, 30, 35, 40, 45, 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1800, 1850, 1900, 1950, 2000, 2050, 2100, 2200, 2250, 2300, 2350, 2400, 2450, 2500, or more residues, encodes at least one polypeptide having an enzyme, structural or binding activity, and the sequence identities are determined by analysis with a sequence comparison algorithm or by a visual inspection. In one aspect, the enzymes and proteins of the invention include, e.g. aldolases, alpha-galactosidases, amidases, e.g. secondary amidases, amylases, catalases, carotenoid pathway enzymes, dehalogenases, endoglucanases, epoxide hydrolases, esterases, hydrolases, glucosidases, glycosidases, inteins, isomerases, laccases, lipases, monooxygenases, nitroreductases, nitrilases, P450 enzymes, pectate lyases, phosphatases, phospholipases, phytases, polymerases and xylanases. In another aspect, the isolated and recombinant polypeptides of the invention, including enzymes, structural proteins and binding proteins, and polynucleotides encoding these polypeptides, of the invention have activity as described in Table 1, Table 2 or Table 3, below.

In alternative aspects, the isolated or recombinant nucleic acid encodes a polypeptide comprising an exemplary sequence of the invention, e.g., including sequences as set forth in SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, and all polypeptides disclosed in the SEQ ID listing, which include all even numbered SEQ ID NOs: from SEQ ID NO:2 through SEQ ID NO: 26,898. In one aspect these polypeptides have an enzyme, structural or binding activity. In one aspect, the enzymes and proteins of the invention include, e.g. aldolases, alpha-galactosidases, amidases, e.g. secondary amidases, amylases, catalases, carotenoid pathway enzymes, dehalogenases, endoglucanases, epoxide hydrolases, esterases, hydrolases, glucosidases, glycosidases, inteins, isomerases, laccases, lipases, monooxygenases, nitroreductases, nitrilases, P450 enzymes, pectate lyases, phosphatases, phospholipases, phytases, polymerases and xylanases. In another aspect, the isolated and recombinant polypeptides of the invention, including enzymes, structural proteins and binding proteins, and polynucleotides encoding these polypeptides, of the invention have activity as described in Table 1, Table 2 or Table 3, below.

In alternative aspects, the enzyme, structural or binding activity comprises a recombinase activity, a helicase activity, a DNA replication activity, a DNA recombination activity, an isomerase, a trans-isomerase activity or topoisomerase activity, a methyl transferase activity, an aminotransferase activity, a uracil-5-methyl transferase activity, a cysteinyl tRNA synthetase activity, a hydrolase, an esterase activity, a phosphoesterase activity, an acetylmuramyl pentapeptide phosphotransferase activity, a glycosyltransferase activity, an acetyltransferase activity, an acetylglucosamine phosphate transferase activity, a centromere binding activity, a telomerase activity or a transcriptional regulatory activity, a heat shock protein activity, a protease activity, a proteinase activity, a peptidase activity, a carboxypeptidase activity, an endonuclease activity, an exonuclease activity, a RecB family exonuclease activity, a polymerase activity, a carbamoyl phosphate synthetase activity, a methyl-thioadenine synthetase activity, an oxidoreductase activity, an Fe—S oxidoreductase activity, a flavodoxin reductase activity, a permease activity, a thymidylate activity, a dehydrogenase activity, a pyrophosphorylase activity, a coenzyme metabolism activity, a dinucleotide-utilizing enzyme activity, a molybdopterin or thiamine biosynthesis activity, a beta-lactamase activity, a ligand binding activity, an ion transport activity, an ion metabolism activity, a tellurite resistance protein activity, an inorganic ion transport activity, a nucleotide transport activity, a nucleotide metabolism activity, an actin or myosin activity, a lipase activity or a lipid acyl hydrolase (LAH) activity, a cell envelop biogenesis activity, an outer membrane synthesis activity, a ribosomal structure synthesis activity, a translational processing activity, a transcriptional initiation activity, a TATA-binding activity, a signal transduction activity, an energy metabolism activity, an ATPase activity, an information storage and/or processing activity, and/or any of the polypeptides activities as set forth in Table 1, Table 2 or Table 3, below.

In one aspect, the sequence comparison algorithm is a BLAST version 2.2.2 algorithm where a filtering setting is set to blastall −p blastp −d "nr pataa" −F F, and all other options are set to default.

Another aspect of the invention is an isolated or recombinant nucleic acid including at least 10, 15, 20, 25, 30, 35, 40, 45, 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1800, 1850, 1900, 1950, 2000, 2050, 2100, 2200, 2250, 2300, 2350, 2400, 2450, 2500, or more consecutive bases of a nucleic acid sequence of the invention, sequences substantially identical thereto, and the sequences complementary thereto.

In one aspect, the isolated or recombinant nucleic acid encodes a polypeptide having a enzyme, structural or binding activity, that is thermostable. The polypeptide can retain activity under conditions comprising a temperature range of between about 37° C. to about 95° C.; between about 55° C. to about 85° C., between about 70° C. to about 95° C., or, between about 90° C. to about 95° C.

In another aspect, the isolated or recombinant nucleic acid encodes a polypeptide having an enzyme, structural or binding activity, which is thermotolerant. The polypeptide can retain activity after exposure to a temperature in the range from greater than 37° C. to about 95° C. or anywhere in the range from greater than 55° C. to about 85° C. The polypeptide can retain activity after exposure to a temperature in the range between about 1° C. to about 5° C., between about 5° C. to about 15° C., between about 15° C. to about 25° C., between about 25° C. to about 37° C., between about 37° C. to about 95° C., between about 55° C. to about 85° C., between about 70° C. to about 75° C., or between about 90° C. to about 95° C., or more. In one aspect, the polypeptide retains activity after exposure to a temperature in the range from greater than 90° C. to about 95° C. at about pH 4.5.

The invention provides isolated or recombinant nucleic acids comprising a sequence that hybridizes under stringent conditions to a nucleic acid comprising a sequence of the invention, e.g., an exemplary sequence of the invention, including SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, and all nucleic acids disclosed in the SEQ ID listing, which include all odd numbered SEQ ID NOs: from SEQ ID NO:1 through SEQ ID NO:26,897, or fragments or subsequences thereof. In one aspect, the nucleic acid encodes a polypeptide having a enzyme, structural or binding activity. The nucleic acid can be at least about 10, 15, 20, 25, 30, 35, 40, 45, 50, 75, 100, 150, 200, 250, 300, 350, 400, 450, 500, 550, 600, 650, 700, 750, 800, 850, 900, 950, 1000, 1050, 1100, 1150, 1200 or more residues in length or the full length of the gene or transcript. In one aspect, the stringent conditions include a wash step comprising a wash in 0.2×SSC at a temperature of about 65° C. for about 15 minutes.

The invention provides a nucleic acid probe for identifying a nucleic acid encoding a polypeptide having a enzyme, structural or binding activity, wherein the probe comprises at least about 10, 15, 20, 25, 30, 35, 40, 45, 50, 55, 60, 65, 70, 75, 80, 85, 90, 95, 100, 150, 200, 250, 300, 350, 400, 450, 500, 550, 600, 650, 700, 750, 800, 850, 900, 950, 1000 or more, consecutive bases of a sequence comprising a sequence of the invention, or fragments or subsequences thereof, wherein the probe identifies the nucleic acid by binding or hybridization. The probe can comprise an oligonucleotide comprising at least about 10 to 50, about 20 to 60, about 30 to 70, about 40 to 80, or about 60 to 100 consecutive bases of a sequence comprising a sequence of the invention, or fragments or subsequences thereof.

The invention provides a nucleic acid probe for identifying a nucleic acid encoding a polypeptide having a enzyme, structural or binding activity, wherein the probe comprises a nucleic acid comprising a sequence at least about 10, 15, 20, 30, 40, 50, 60, 70, 80, 90, 100, 150, 200, 250, 300, 350, 400, 450, 500, 550, 600, 650, 700, 750, 800, 850, 900, 950, 1000 or more residues having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to a nucleic acid of the invention. In one aspect, the sequence identities are determined by analysis with a sequence comparison algorithm or by visual inspection. In alternative aspects, the probe can comprise an oligonucleotide comprising at least about 10 to 50, about 20 to 60, about 30 to 70, about 40 to 80, or about 60 to 100 consecutive bases of a nucleic acid sequence of the invention, or a subsequence thereof.

The invention provides an amplification primer pair for amplifying a nucleic acid encoding a polypeptide having a enzyme, structural or binding activity, wherein the primer pair is capable of amplifying a nucleic acid comprising a sequence of the invention, or fragments or subsequences thereof. One or each member of the amplification primer sequence pair can comprise an oligonucleotide comprising at least about 10 to 50, or more, consecutive bases of the sequence, or about 12, 13, 14, 15, 16, 17, 18, 19, 20, 21, 22, 23, 24, 25, 26, 27, 28, 29, 30 or more consecutive bases of the sequence.

The invention provides amplification primer pairs, wherein the primer pair comprises a first member having a sequence as set forth by about the first (the 5') 12, 13, 14, 15, 16, 17, 18, 19, 20, 21, 22, 23, 24, 25, 26, 27, 28, 29, 30, 31, 32, 33, 34, 35, 36 or more residues of a nucleic acid of the invention, and a second member having a sequence as set forth by about the first (the 5') 12, 13, 14, 15, 16, 17, 18, 19, 20, 21, 22, 23, 24, 25, 26, 27, 28, 29, 30, 31, 32, 33, 34, 35, 36 or more residues of the complementary strand of the first member.

The invention provides polypeptide-, enzyme-, protein-, e.g. structural or binding protein-encoding nucleic acids generated by amplification, e.g., polymerase chain reaction (PCR), using an amplification primer pair of the invention. The invention provides polypeptide-, enzyme-, protein-, e.g. structural or binding protein-encoding nucleic acids generated by amplification, e.g., polymerase chain reaction (PCR), using an amplification primer pair of the invention. The invention provides methods of making a polypeptide, enzyme, protein, e.g. structural or binding protein, by amplification, e.g., polymerase chain reaction (PCR), using an amplification primer pair of the invention. In one aspect, the amplification primer pair amplifies a nucleic acid from a library, e.g., a gene library, such as an environmental library.

The invention provides methods of amplifying a nucleic acid encoding a polypeptide having an enzyme, structural or binding activity, comprising amplification of a template nucleic acid with an amplification primer sequence pair capable of amplifying a nucleic acid sequence of the invention, or fragments or subsequences thereof.

The invention provides expression cassettes comprising a nucleic acid of the invention or a subsequence thereof. In one aspect, the expression cassette can comprise the nucleic acid that is operably linked to a promoter. The promoter can be a viral, bacterial, mammalian or plant promoter. In one aspect, the plant promoter can be a potato, rice, corn, wheat, tobacco or barley promoter. The promoter can be a constitutive promoter. The constitutive promoter can comprise CaMV35S. In another aspect, the promoter can be an inducible promoter. In one aspect, the promoter can be a tissue-specific promoter or an environmentally regulated or a developmentally regulated promoter. Thus, the promoter can be, e.g., a seed-specific, a leaf-specific, a root-specific, a stem-specific or an abscission-induced promoter. In one aspect, the expression cassette can further comprise a plant or plant virus expression vector.

The invention provides cloning vehicles comprising an expression cassette (e.g., a vector) of the invention or a nucleic acid of the invention. The cloning vehicle can be a viral vector, a plasmid, a phage, a phagemid, a cosmid, a fosmid, a bacteriophage or an artificial chromosome. The viral vector can comprise an adenovirus vector, a retroviral vector or an adeno-associated viral vector. The cloning vehicle can comprise a bacterial artificial chromosome (BAC), a plasmid, a bacteriophage P1-derived vector (PAC), a yeast artificial chromosome (YAC), or a mammalian artificial chromosome (MAC).

The invention provides transformed cell comprising a nucleic acid of the invention or an expression cassette (e.g., a vector) of the invention, or a cloning vehicle of the invention. In one aspect, the transformed cell can be a bacterial cell, a mammalian cell, a fungal cell, a yeast cell, an insect cell or a plant cell. In one aspect, the plant cell can be a cereal, a potato, wheat, rice, corn, tobacco or barley cell.

The invention provides transgenic non-human animals comprising a nucleic acid of the invention or an expression cassette (e.g., a vector) of the invention. In one aspect, the animal is a mouse, a rat, a pig, a goat or a sheep.

The invention provides transgenic plants comprising a nucleic acid of the invention or an expression cassette (e.g., a vector) of the invention. The transgenic plant can be a cereal plant, a corn plant, a potato plant, a tomato plant, a wheat plant, an oilseed plant, a rapeseed plant, a soybean plant, a rice plant, a barley plant or a tobacco plant.

The invention provides transgenic seeds comprising a nucleic acid of the invention or an expression cassette (e.g., a vector) of the invention. The transgenic seed can be a cereal plant, a corn seed, a wheat kernel, an oilseed, a rapeseed, a soybean seed, a palm kernel, a sunflower seed, a sesame seed, a peanut or a tobacco plant seed.

The invention provides an antisense oligonucleotide comprising a nucleic acid sequence complementary to or capable of hybridizing under stringent conditions to a nucleic acid of the invention. The invention provides methods of inhibiting the translation of a polypeptide, enzyme, protein, e.g. structural or binding protein message in a cell comprising administering to the cell or expressing in the cell an antisense oligonucleotide comprising a nucleic acid sequence complementary to or capable of hybridizing under stringent conditions to a nucleic acid of the invention. In one aspect, the antisense oligonucleotide is between about 10 to 50, about 20 to 60, about 30 to 70, about 40 to 80, or about 60 to 100 bases in length, e.g., 10, 15, 20, 25, 30, 35, 40, 45, 50, 55, 60, 65, 70, 75, 80, 85, 90, 95, 100 or more bases in length.

The invention provides methods of inhibiting the translation of a polypeptide, enzyme, protein, e.g. structural or binding protein message in a cell comprising administering to the cell or expressing in the cell an antisense oligonucleotide comprising a nucleic acid sequence complementary to or capable of hybridizing under stringent conditions to a nucleic acid of the invention. The invention provides double-stranded inhibitory RNA (RNAi, or RNA interference) molecules (including small interfering RNA, or siRNAs, for inhibiting transcription, and microRNAs, or miRNAs, for inhibiting translation) comprising a subsequence of a sequence of the invention. In one aspect, the RNAi is about 15, 16, 17, 18, 19, 20, 21, 22, 23, 24, 25, 26, 27, 28, 29, 30, 31, 32, 33, 34, 35, 40, 45, 50, 55, 60, 65, 70, 75, 80, 85, 90, 95, 100 or more duplex nucleotides in length. The invention provides methods of inhibiting the expression of a polypeptide, enzyme, protein, peptide, e.g. structural or binding protein in a cell comprising administering to the cell or expressing in the cell a double-stranded inhibitory RNA (iRNA, including small interfering RNA, or siRNAs, for inhibiting transcription, and microRNAs, or miRNAs, for inhibiting translation), wherein the RNA comprises a subsequence of a sequence of the invention.

The invention provides isolated or recombinant polypeptides encoded by a nucleic acid of the invention. In alternative-aspects, the polypeptide can have a sequence as set forth in SEQ ID NO:2, SEQ ID NO:4, SEQ ID NO:6, SEQ ID NO:8, SEQ ID NO:10, etc., and all polypeptides disclosed in the SEQ ID listing, which include all even numbered SEQ ID NOs: from SEQ ID NO:2 through SEQ ID NO:26,898 (the exemplary sequences of the invention), or subsequences thereof, including fragments having enzymatic and/or substrate binding activity. The polypeptide can have an enzyme, structural or binding activity.

In alternative aspects, the enzyme, structural or binding activity comprises a recombinase activity, a helicase activity, a DNA replication activity, a DNA recombination activity, an isomerase, a trans-isomerase activity or topoisomerase activity, a methyl transferase activity, an aminotransferase activity, a uracil-5-methyl transferase activity, a cysteinyl tRNA synthetase activity, a hydrolase, an esterase activity, a phosphoesterase activity, an acetylmuramyl pentapeptide phosphotransferase activity, a glycosyltransferase activity, an acetyltransferase activity, an acetylglucosamine phosphate transferase activity, a centromere binding activity, a telomerase activity or a transcriptional regulatory activity, a heat shock protein activity, a protease activity, a proteinase activity, a peptidase activity, a carboxypeptidase activity, an endonuclease activity, an exonuclease activity, a RecB family exonuclease activity, a polymerase activity, a carbamoyl phosphate synthetase activity, a methyl-thioadenine synthetase activity, an oxidoreductase activity, an Fe—S oxidoreductase activity, a flavodoxin reductase activity, a permease activity, a thymidylate activity, a dehydrogenase activity, a pyrophosphorylase activity, a coenzyme metabolism activity, a dinucleotide-utilizing enzyme activity, a molybdopterin or thiamine biosynthesis activity, a beta-lactamase activity, a ligand binding activity, an ion transport activity, an ion metabolism activity, a tellurite resistance protein activity, an inorganic ion transport activity, a nucleotide transport activity, a nucleotide metabolism activity, an actin or myosin activity, a lipase activity or a lipid acyl hydrolase (LAH) activity, a cell envelop biogenesis activity, an outer membrane synthesis activity, a ribosomal structure synthesis activity, a translational processing activity, a transcriptional initiation activity, a TATA-binding activity, a signal transduction activity, an energy metabolism activity, an ATPase activity, an information storage and/or processing activity, and/or any of the polypeptides activities as set forth in Table 1, Table 2 or Table 3, below.

Exemplary polypeptide or peptide sequences of the invention include SEQ ID NO:2, SEQ ID NO:4, SEQ ID NO:6, SEQ ID NO:8, SEQ ID NO:10, etc., and all polypeptides disclosed in the SEQ ID listing, which include all even numbered SEQ ID NOs: from SEQ ID NO:2 through SEQ ID NO:26,898, and subsequences thereof and variants thereof. Exemplary polypeptides also include fragments of at least about 10, 15, 20, 25, 30, 35, 40, 45, 50, 75, 80, 85, 90, 95, 100, 150, 200, 250, 300, 350, 400, 450, 500, 550, 600 or more residues in length, or over the full length of an enzyme. Exemplary polypeptide or peptide sequences of the invention include sequence encoded by a nucleic acid of the invention. Exemplary polypeptide or peptide sequences of the invention include polypeptides or peptides specifically bound by an antibody of the invention.

In one aspect, the polypeptide, enzyme, protein, e.g. structural or binding protein, is thermostable. The polypeptide, enzyme, protein, e.g. structural or binding protein can retain activity under conditions comprising a temperature range of between about 1° C. to about 5° C., between about 5° C. to about 15° C., between about 15° C. to about 25° C., between about 25° C. to about 37° C., between about 37° C. to about 95° C., between about 55° C. to about 85° C., between about 70° C. to about 75° C., or between about 90° C. to about 95° C., or more. In another aspect, the polypeptide, enzyme, protein, e.g. structural or binding protein can be thermotolerant. The polypeptide, enzyme, protein, e.g. structural or binding protein can retain activity after exposure to a temperature in the range from greater than 37° C. to about 95° C., or in the range from greater than 55° C. to about 85° C. In one aspect, the polypeptide, enzyme, protein, e.g. structural or binding protein can retain activity after exposure to a temperature in the range from greater than 90° C. to about 95° C. at pH 4.5.

Another aspect of the invention provides an isolated or recombinant polypeptide or peptide including at least 10, 15, 20, 25, 30, 35, 40, 45, 50, 55, 60, 65, 70, 75, 80, 85, 90, 95 or 100 or more consecutive bases of a polypeptide or peptide sequence of the invention, sequences substantially identical thereto, and the sequences complementary thereto. The peptide can be, e.g., an immunogenic fragment, a motif (e.g., a binding site), a signal sequence, a prepro sequence or an active site.

The invention provides isolated or recombinant nucleic acids comprising a sequence encoding a polypeptide, enzyme, protein, e.g. structural or binding protein having any of the activities as set forth in Tables 1, 2 or 3, and a signal sequence, wherein the nucleic acid comprises a sequence of the invention. In one aspect, the isolated or recombinant polypeptide can comprise the polypeptide of the invention comprising a heterologous signal sequence or a heterologous preprosequence, such as a heterologous enzyme or non-enzyme signal sequence. The invention provides isolated or recombinant nucleic acids comprising a sequence encoding a polypeptide, enzyme, protein, e.g. structural or binding protein having any of the activities as set forth in Tables 1, 2 or 3, wherein the sequence does not contain a signal sequence and the nucleic acid comprises a sequence of the invention. In one aspect, the invention provides an isolated or recombinant polypeptide comprising a polypeptide of the invention lacking all or part of a signal sequence.

In one aspect, the invention provides chimeric proteins comprising a first domain comprising a signal sequence of the invention and at least a second domain. The protein can be a fusion protein. The second domain can comprise an enzyme. The enzyme can be a non-enzyme.

The invention provides chimeric polypeptides comprising at least a first domain comprising signal peptide (SP), a prepro sequence and/or a catalytic domain (CD) of the invention and at least a second domain comprising a heterologous polypeptide or peptide, wherein the heterologous polypeptide or peptide is not naturally associated with the signal peptide (SP), prepro sequence and/or catalytic domain (CD). In one aspect, the heterologous polypeptide or peptide is not an enzyme. The heterologous polypeptide or peptide can be amino terminal to, carboxy terminal to or on both ends of the signal peptide (SP), prepro sequence and/or catalytic domain (CD).

The invention provides isolated or recombinant nucleic acids encoding a chimeric polypeptide, wherein the chimeric polypeptide comprises at least a first domain comprising signal peptide (SP), a prepro domain and/or a catalytic domain (CD) of the invention and at least a second domain comprising a heterologous polypeptide or peptide, wherein the heterologous polypeptide or peptide is not naturally associated with the signal peptide (SP), prepro domain and/or catalytic domain (CD).

The invention provides isolated or recombinant signal sequences (e.g., signal peptides) consisting of or comprising a sequence as set forth in residues 1 to 14, 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 28, 1 to 30, 1 to 31, 1 to 32, 1 to 33, 1 to 34, 1 to 35, 1 to 36, 1 to 37, 1 to 38, 1 to 40, 1 to 41, 1 to 42, 1 to 43, 1 to 44, 1 to 45, 1 to 46 or 1 to 47, of a polypeptide of the invention, including the exemplary polypeptides of the invention (including SEQ ID NO:2, SEQ ID NO:4, SEQ ID NO:6, SEQ ID NO:8, SEQ ID NO:10, etc., and all polypeptides disclosed in the SEQ ID listing, which include all even numbered SEQ ID NOs: from SEQ ID NO:2 through SEQ ID NO:26,898). In one aspect, the invention provides signal sequences comprising the first 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70 or more amino terminal residues of a polypeptide of the invention.

In one aspect, the enzyme, structural or binding activity comprises a specific activity at about 37° C. in the range from about 1 to about 1200 units per milligram of protein, or, about 100 to about 1000 units per milligram of protein. In another aspect, the polypeptide, enzyme, protein, e.g. structural or binding protein activity comprises a specific activity from about 100 to about 1000 units per milligram of protein, or, from about 500 to about 750 units per milligram of protein. Alternatively, the enzyme, structural or binding activity comprises a specific activity at 37° C. in the range from about 1 to about 750 units per milligram of protein, or, from about 500 to about 1200 units per milligram of protein. In one aspect, the enzyme, structural or binding activity comprises a specific activity at 37° C. in the range from about 1 to about 500 units per milligram of protein, or, from about 750 to about 1000 units per milligram of protein. In another aspect, the enzyme, structural or binding activity comprises a specific activity at 37° C. in the range from about 1 to about 250 units per milligram of protein. Alternatively, the enzyme, structural or binding activity comprises a specific activity at 37° C. in the range from about 1 to about 100 units per milligram of protein.

In another aspect, thermotolerance comprises retention of at least half of the specific activity of the enzyme, structural or binding protein at 37° C. after being heated to the elevated temperature. Alternatively, thermotolerance can comprise retention of specific activity at 37° C. in the range from about 1 to about 1200 units per milligram of protein, or, from about 500 to about 1000 units per milligram of protein, after being heated to the elevated temperature. In another aspect, thermotolerance can comprise retention of specific activity at 37° C. in the range from about 1 to about 500 units per milligram of protein after being heated to the elevated temperature.

The invention provides the isolated or recombinant polypeptide of the invention, wherein the polypeptide comprises at least one glycosylation site. In one aspect, glycosylation can be an N-linked glycosylation. In one aspect, the polypeptide can be glycosylated after being expressed in a *P. pastoris* or a *S. pombe*.

In one aspect, the polypeptide, enzyme, protein, e.g. structural or binding protein can retain activity under conditions comprising about pH 6.5, pH 6, pH 5.5, pH 5, pH 4.5 or pH 4. In another aspect, the polypeptide, enzyme, protein, e.g. structural or binding protein can retain activity under conditions comprising about pH 7, pH 7.5 pH 8.0, pH 8.5, pH 9, pH 9.5, pH 10, pH 10.5 or pH 11. In one aspect, the polypeptide can retain an enzyme, structural or binding activity after exposure to conditions comprising about pH 6.5, pH 6, pH 5.5, pH 5, pH 4.5 or pH 4. In another aspect, the polypeptide can retain enzyme, structural or binding activity after exposure to conditions comprising about pH 7, pH 7.5 pH 8.0, pH 8.5, pH 9, pH 9.5, pH 10, pH 10.5 or pH 11.

In one aspect, the polypeptide, enzyme, protein, e.g. structural or binding protein of the invention has activity at under alkaline conditions, e.g., the alkaline conditions of the gut, e.g., the small intestine. In one aspect, the polypeptide, enzyme, protein, e.g. structural or binding protein can retain activity after exposure to the acidic pH of the stomach.

The invention provides protein preparations comprising a polypeptide of the invention, wherein the protein preparation comprises a liquid, a solid or a gel.

The invention provides heterodimers comprising a polypeptide of the invention and a second protein or domain. The second member of the heterodimer can be a different enzyme, a different enzyme or another protein. In one aspect, the second domain can be a polypeptide and the heterodimer can be a fusion protein. In one aspect, the second domain can be an epitope or a tag. In one aspect, the invention provides homodimers comprising a polypeptide of the invention.

The invention provides immobilized polypeptides having enzyme, structural or binding activity, wherein the polypeptide comprises a polypeptide of the invention, a polypeptide encoded by a nucleic acid of the invention, or a polypeptide comprising a polypeptide of the invention and a second domain. In one aspect, the polypeptide can be immobilized on a cell, a metal, a resin, a polymer, a ceramic, a glass, a micro electrode, a graphitic particle, a bead, a gel, a plate, an array or a capillary tube.

The invention provides arrays comprising an immobilized nucleic acid of the invention. The invention provides arrays comprising an antibody of the invention.

The invention provides isolated or recombinant antibodies that specifically bind to a polypeptide of the invention or to a polypeptide encoded by a nucleic acid of the invention. These antibodies of the invention can be a monoclonal or a polyclonal antibody. The invention provides hybridomas comprising an antibody of the invention, e.g., an antibody that specifically binds to a polypeptide of the invention or to a polypeptide encoded by a nucleic acid of the invention. The invention provides nucleic acids encoding these antibodies.

The invention provides method of isolating or identifying a polypeptide having enzyme, structural or binding activity comprising the steps of: (a) providing an antibody of the invention; (b) providing a sample comprising polypeptides; and (c) contacting the sample of step (b) with the antibody of step (a) under conditions wherein the antibody can specifically bind to the polypeptide, thereby isolating or identifying a polypeptide having an enzyme, structural or binding activity.

The invention provides methods of making an anti-polypeptide, anti-enzyme, or anti-protein, e.g. anti-structural or anti-binding protein, antibody comprising administering to a non-human animal a nucleic acid of the invention or a polypeptide of the invention or subsequences thereof in an amount sufficient to generate a humoral immune response, thereby making an anti-polypeptide, anti-enzyme, or anti-protein, e.g. anti-structural or anti-binding protein, antibody. The invention provides methods of making an anti-polypeptide, anti-enzyme, or anti-protein, e.g. anti-structural or anti-binding protein, immune comprising administering to a non-human animal a nucleic acid of the invention or a polypeptide of the invention or subsequences thereof in an amount sufficient to generate an immune response.

The invention provides methods of producing a recombinant polypeptide comprising the steps of: (a) providing a nucleic acid of the invention operably linked to a promoter; and (b) expressing the nucleic acid of step (a) under conditions that allow expression of the polypeptide, thereby producing a recombinant polypeptide. In one aspect, the method can further comprise transforming a host cell with the nucleic acid of step (a) followed by expressing the nucleic acid of step (a), thereby producing a recombinant polypeptide in a transformed cell.

The invention provides methods for identifying a polypeptide having enzyme, structural or binding activity comprising the following steps: (a) providing a polypeptide of the invention; or a polypeptide encoded by a nucleic acid of the invention; (b) providing an enzyme, structural or binding activity substrate; and (c) contacting the polypeptide or a fragment or variant thereof of step (a) with the substrate of step (b) and detecting a decrease in the amount of substrate or an increase in the amount of a reaction product, wherein a decrease in the amount of the substrate or an increase in the amount of the reaction product detects a polypeptide having a enzyme, structural or binding activity.

The invention provides methods for identifying a polypeptide, enzyme, protein, e.g. structural or binding protein, substrate comprising the following steps: (a) providing a polypeptide of the invention; or a polypeptide encoded by a nucleic acid of the invention; (b) providing a test substrate; and (c) contacting the polypeptide of step (a) with the test substrate of step (b) and detecting a decrease in the amount of substrate or an increase in the amount of reaction product, wherein a decrease in the amount of the substrate or an increase in the amount of a reaction product identifies the test substrate as a polypeptide, enzyme, protein, e.g. structural or binding protein, substrate.

The invention provides methods of determining whether a test compound specifically binds to a polypeptide comprising the following steps: (a) expressing a nucleic acid or a vector comprising the nucleic acid under conditions permissive for translation of the nucleic acid to a polypeptide, wherein the nucleic acid comprises a nucleic acid of the invention, or, providing a polypeptide of the invention; (b) providing a test compound; (c) contacting the polypeptide with the test compound; and (d) determining whether the test compound of step (b) specifically binds to the polypeptide.

The invention provides methods for identifying a modulator of a enzyme, structural or binding activity comprising the following steps: (a) providing a polypeptide of the invention or a polypeptide encoded by a nucleic acid of the invention; (b) providing a test compound; (c) contacting the polypeptide of step (a) with the test compound of step (b) and measuring an activity of the polypeptide, enzyme, protein, e.g. structural or binding protein, wherein a change in the enzyme, structural or binding activity measured in the presence of the test compound compared to the activity in the absence of the test compound provides a determination that the test compound modulates the enzyme, structural or binding activity. In one aspect, the enzyme, structural or binding activity can be measured by providing a polypeptide, enzyme, protein, e.g. structural or binding protein, substrate and detecting a decrease in the amount of the substrate or an increase in the amount of a reaction product, or, an increase in the amount of the substrate or a decrease in the amount of a reaction product. A decrease in the amount of the substrate or an increase in the amount of the reaction product with the test compound as compared to the amount of substrate or reaction product without the test compound identifies the test compound as an activator of enzyme, structural or binding activity. An increase in the amount of the substrate or a decrease in the amount of the reaction product with the test compound as compared to the amount of substrate or reaction product without the test compound identifies the test compound as an inhibitor of enzyme, structural or binding activity.

The invention provides computer systems comprising a processor and a data storage device wherein said data storage device has stored thereon a polypeptide sequence or a nucleic acid sequence of the invention (e.g., a polypeptide encoded by a nucleic acid of the invention). In one aspect, the computer system can further comprise a sequence comparison algorithm and a data storage device having at least one reference sequence stored thereon. In another aspect, the sequence comparison algorithm comprises a computer program that indicates polymorphisms. In one aspect, the computer system can further comprise an identifier that identifies one or more features in said sequence. The invention provides computer readable media having stored thereon a polypeptide sequence or a nucleic acid sequence of the invention. The invention provides methods for identifying a feature in a sequence comprising the steps of: (a) reading the sequence using a computer program which identifies one or more features in a sequence, wherein the sequence comprises a polypeptide sequence or a nucleic acid sequence of the invention; and (b) identifying one or more features in the sequence with the computer program. The invention provides methods for comparing a first sequence to a second sequence comprising the steps of: (a) reading the first sequence and the second sequence through use of a computer program which compares sequences, wherein the first sequence comprises a polypeptide sequence or a nucleic acid sequence of the invention; and (b) determining differences between the first sequence and the second sequence with the computer program. The step of determining differences between the first sequence and the second sequence can further comprise the step of identifying polymorphisms. In one aspect, the method can further comprise an identifier that identifies one or more features in a sequence. In another aspect, the method can comprise reading the first sequence using a computer program and identifying one or more features in the sequence.

The invention provides methods for isolating or recovering a nucleic acid encoding a polypeptide, enzyme, protein, e.g. structural or binding protein, from an environmental sample comprising the steps of: (a) providing an amplification primer sequence pair for amplifying a nucleic acid encoding a polypeptide, enzyme, protein, e.g. structural or binding protein, wherein the primer pair is capable of amplifying a nucleic acid of the invention; (b) isolating a nucleic acid from the environmental sample or treating the environmental sample such that nucleic acid in the sample is accessible for hybridization to the amplification primer pair; and, (c) combining the nucleic acid of step (b) with the amplification primer pair of step (a) and amplifying nucleic acid from the environmental sample, thereby isolating or recovering a nucleic acid encoding a polypeptide, enzyme, protein, e.g. structural or binding protein from an environmental sample. One or each member of the amplification primer sequence pair can comprise an oligonucleotide comprising an amplification primer sequence pair of the invention, e.g., having at least about 10 to 50 consecutive bases of a sequence of the invention.

The invention provides methods for isolating or recovering a nucleic acid encoding a polypeptide, enzyme, protein, e.g. structural or binding protein from an environmental sample comprising the steps of: (a) providing a polynucleotide probe comprising a nucleic acid of the invention or a subsequence thereof; (b) isolating a nucleic acid from the environmental sample or treating the environmental sample such that nucleic acid in the sample is accessible for hybridization to a polynucleotide probe of step (a); (c) combining the isolated nucleic acid or the treated environmental sample of step (b) with the polynucleotide probe of step (a); and (d) isolating a nucleic acid that specifically hybridizes with the polynucleotide probe of step (a), thereby isolating or recovering a nucleic acid encoding a polypeptide, enzyme, protein, e.g. structural or binding protein from an environmental sample. The environmental sample can comprise a water sample, a liquid sample, a soil sample, an air sample or a biological sample. In one aspect, the biological sample can be derived from a bacterial cell, a protozoan cell, an insect cell, a yeast cell, a plant cell, a fungal cell or a mammalian cell.

The invention provides methods of generating a variant of a nucleic acid encoding a polypeptide having an enzyme, structural or binding activity comprising the steps of: (a) providing a template nucleic acid comprising a nucleic acid of the invention; and (b) modifying, deleting or adding one or more nucleotides in the template sequence, or a combination thereof, to generate a variant of the template nucleic acid. In one aspect, the method can further comprise expressing the variant nucleic acid to generate a variant the polypeptide, enzyme, protein, e.g. structural or binding protein. The modifications, additions or deletions can be introduced by a method comprising error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, Gene Site Saturation Mutagenesis (GSSM), synthetic ligation reassembly (SLR) or a combination thereof. In another aspect, the modifications, additions or deletions are introduced by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation and a combination thereof.

In one aspect, the method can be iteratively repeated until a polypeptide, enzyme, protein, e.g. structural or binding protein having an altered or different activity or an altered or different stability from that of a polypeptide encoded by the template nucleic acid is produced. In one aspect, the variant the polypeptide, enzyme, protein, e.g. structural or binding protein is thermotolerant, and retains some activity after being exposed to an elevated temperature. In another aspect, the variant the polypeptide, enzyme, protein, e.g. structural or binding protein has increased glycosylation as compared to the polypeptide, enzyme, protein, e.g. structural or binding protein encoded by a template nucleic acid. Alternatively, the variant the polypeptide, enzyme, protein, e.g. structural or binding protein has an enzyme, structural or binding activity under a high temperature, wherein the polypeptide, enzyme, protein, e.g. structural or binding protein encoded by the template nucleic acid is not active under the high temperature. In one aspect, the method can be iteratively repeated until a polypeptide, enzyme, protein, e.g. structural or binding protein coding sequence having an altered codon usage from that of the template nucleic acid is produced. In another aspect, the method can be iteratively repeated until a polypeptide, enzyme, protein, e.g. structural or binding protein gene having higher or lower level of message expression or stability from that of the template nucleic acid is produced.

The invention provides methods for modifying codons in a nucleic acid encoding a polypeptide having an enzyme, structural or binding activity to increase its expression in a host cell, the method comprising the following steps: (a) providing a nucleic acid of the invention encoding a polypeptide having an enzyme, structural or binding activity; and, (b) identifying a non-preferred or a less preferred codon in the nucleic acid of step (a) and replacing it with a preferred or neutrally used codon encoding the same amino acid as the replaced codon, wherein a preferred codon is a codon over-represented in coding sequences in genes in the host cell and a non-preferred or less preferred codon is a codon under-represented in coding sequences in genes in the host cell, thereby modifying the nucleic acid to increase its expression in a host cell.

The invention provides methods for modifying codons in a nucleic acid encoding a polypeptide having an enzyme, structural or binding activity; the method comprising the following steps: (a) providing a nucleic acid of the invention; and, (b) identifying a codon in the nucleic acid of step (a) and replacing it with a different codon encoding the same amino acid as the replaced codon, thereby modifying codons in a nucleic acid encoding a polypeptide, enzyme, protein, e.g. structural or binding protein.

The invention provides methods for modifying codons in a nucleic acid encoding a polypeptide having an enzyme, structural or binding activity to increase its expression in a host cell, the method comprising the following steps: (a) providing a nucleic acid of the invention encoding a polypeptide, enzyme, protein, e.g. structural or binding protein, polypeptide; and, (b) identifying a non-preferred or a less preferred codon in the nucleic acid of step (a) and replacing it with a preferred or neutrally used codon encoding the same amino acid as the replaced codon, wherein a preferred codon is a codon over-represented in coding sequences in genes in the host cell and a non-preferred or less preferred codon is a codon under-represented in coding sequences in genes in the host cell, thereby modifying the nucleic acid to increase its expression in a host cell.

The invention provides methods for modifying a codon in a nucleic acid encoding a polypeptide having an enzyme, structural or binding activity to decrease its expression in a host cell, the method comprising the following steps: (a) providing a nucleic acid of the invention; and (b) identifying at least one preferred codon in the nucleic acid of step (a) and replacing it with a non-preferred or less preferred codon encoding the same amino acid as the replaced codon, wherein a preferred codon is a codon over-represented in coding sequences in genes in a host cell and a non-preferred or less preferred codon is a codon under-represented in coding sequences in genes in the host cell, thereby modifying the nucleic acid to decrease its expression in a host cell. In one aspect, the host cell can be a bacterial cell, a fungal cell, an insect cell, a yeast cell, a plant cell or a mammalian cell.

The invention provides methods for producing a library of nucleic acids encoding a plurality of modified polypeptides, enzymes, proteins, e.g. structural or binding proteins, active sites or substrate binding sites, wherein the modified active sites or substrate binding sites are derived from a first nucleic acid comprising a sequence encoding a first active site or a first substrate binding site the method comprising the following steps: (a) providing a first nucleic acid encoding a first active site or first substrate binding site, wherein the first nucleic acid sequence comprises a sequence that hybridizes under stringent conditions to a nucleic acid of the invention, and the nucleic acid encodes a polypeptide, enzyme, protein, e.g. structural or binding protein, active site or a polypeptide, enzyme, protein, e.g. structural or binding protein, substrate binding site; (b) providing a set of mutagenic oligonucleotides that encode naturally-occurring amino acid variants at a plurality of targeted codons in the first nucleic acid; and, (c) using the set of mutagenic oligonucleotides to generate a set of active site-encoding or substrate binding site-encoding variant nucleic acids encoding a range of amino acid variations at each amino acid codon that was mutagenized, thereby producing a library of nucleic acids encoding a plurality of modified the polypeptide, enzyme, protein, e.g. structural or binding protein, active sites or substrate binding sites. In one aspect, the method comprises mutagenizing the first nucleic acid of step (a) by a method comprising an optimized directed evolution system, Gene Site Saturation Mutagenesis (GSSM), synthetic ligation reassembly (SLR), error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, and a combination thereof. In another aspect, the method comprises mutagenizing the first nucleic acid of step (a) or variants by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation and a combination thereof.

The invention provides methods for making a small molecule comprising the steps of: (a) providing a plurality of biosynthetic enzymes capable of synthesizing or modifying a small molecule, wherein one of the enzymes comprises an enzyme encoded by a nucleic acid of the invention; (b) providing a substrate for at least one of the enzymes of step (a); and, (c) reacting the substrate of step (b) with the enzymes under conditions that facilitate a plurality of biocatalytic reactions to generate a small molecule by a series of biocatalytic reactions.

The invention provides methods for modifying a small molecule comprising the steps: (a) providing a enzyme encoded by a nucleic acid of the invention; (b) providing a small molecule; and, (c) reacting the enzyme of step (a) with the small molecule of step (b) under conditions that facilitate an enzymatic reaction catalyzed by the enzyme, thereby modifying a small molecule by an enzymatic reaction. In one aspect, the method comprises providing a plurality of small molecule substrates for the enzyme of step (a), thereby generating a library of modified small molecules produced by at least one enzymatic reaction catalyzed by the enzyme. In one aspect, the method further comprises a plurality of additional enzymes under conditions that facilitate a plurality of biocatalytic reactions by the enzymes to form a library of modified small molecules produced by the plurality of enzymatic reactions. In one aspect, the method further comprises the step of testing the library to determine if a particular modified small molecule that exhibits a desired activity is present within the library. The step of testing the library can further comprises the steps of systematically eliminating all but one of the biocatalytic reactions used to produce a portion of the plurality of the modified small molecules within the library by testing the portion of the modified small molecule for the presence or absence of the particular modified small molecule with a desired activity, and identifying at least one specific biocatalytic reaction that produces the particular modified small molecule of desired activity.

The invention provides methods for determining a functional fragment of a polypeptide, enzyme, protein, e.g. structural or binding protein, comprising the steps of: (a) providing a polypeptide, enzyme, protein, e.g. structural or binding protein, wherein the enzyme comprises a polypeptide of the invention, or a polypeptide encoded by a nucleic acid of the invention, or a subsequence thereof; and (b) deleting a plurality of amino acid residues from the sequence of step (a) and testing the remaining subsequence for an enzyme, structural or binding activity, thereby determining a functional fragment of a polypeptide, enzyme, protein, e.g. structural or binding protein. In one aspect, the polypeptide, enzyme, protein, e.g. structural or binding protein activity is measured by providing a polypeptide, enzyme, protein, e.g. structural or binding protein, substrate and detecting a decrease in the amount of the substrate or an increase in the amount of a reaction product.

The invention provides methods for whole cell engineering of new or modified phenotypes by using real-time metabolic flux analysis, the method comprising the following steps: (a) making a modified cell by modifying the genetic composition of a cell, wherein the genetic composition is modified by addition to the cell of a nucleic acid of the invention; (b) culturing the modified cell to generate a plurality of modified cells; (c) measuring at least one metabolic parameter of the cell by monitoring the cell culture of step (b) in real time; and, (d) analyzing the data of step (c) to determine if the measured parameter differs from a comparable measurement in an unmodified cell under similar conditions, thereby identifying an engineered phenotype in the cell using real-time metabolic flux analysis. In one aspect, the genetic composition of the cell can be modified by a method comprising deletion of a sequence or modification of a sequence in the cell, or, knocking out the expression of a gene. In one aspect, the method can further comprise selecting a cell comprising a newly engineered phenotype. In another aspect, the method can comprise culturing the selected cell, thereby generating a new cell strain comprising a newly engineered phenotype.

The invention provides methods of increasing thermotolerance or thermostability of a polypeptide, enzyme, protein, e.g. structural or binding protein, polypeptide, the method comprising glycosylating a polypeptide, enzyme, protein, e.g. structural or binding protein, wherein the polypeptide, enzyme, protein, e.g. structural or binding protein comprises at least thirty contiguous amino acids of a polypeptide of the invention; or a polypeptide encoded by a nucleic acid sequence of the invention, thereby increasing thermotolerance or thermostability of the polypeptide, enzyme, protein, e.g. structural or binding protein. In one aspect, the polypeptide, enzyme, protein, e.g. structural or binding protein specific activity can be thermostable or thermotolerant at a temperature in the range from greater than about 37° C. to about 95° C.

The invention provides methods for overexpressing a recombinant polypeptide, enzyme, protein, e.g. structural or binding protein, in a cell comprising expressing a vector comprising a nucleic acid comprising a nucleic acid of the invention or a nucleic acid sequence of the invention, wherein the sequence identities are determined by analysis with a sequence comparison algorithm or by visual inspection, wherein overexpression is effected by use of a high activity promoter, a dicistronic vector or by gene amplification of the vector.

The invention provides methods of making a transgenic plant comprising the following steps: (a) introducing a heterologous nucleic acid sequence into the cell, wherein the heterologous nucleic sequence comprises a nucleic acid sequence of the invention, thereby producing a transformed plant cell; and (b) producing a transgenic plant from the transformed cell. In one aspect, the step (a) can further comprise introducing the heterologous nucleic acid sequence by electroporation or microinjection of plant cell protoplasts. In another aspect, the step (a) can further comprise introducing the heterologous nucleic acid sequence directly to plant tissue by DNA particle bombardment. Alternatively, the step (a) can further comprise introducing the heterologous nucleic acid sequence into the plant cell DNA using an *Agrobacterium tumefaciens* host. In one aspect, the plant cell can be a potato, corn, rice, wheat, tobacco, or barley cell.

The invention provides methods of expressing a heterologous nucleic acid sequence in a plant cell comprising the following steps: (a) transforming the plant cell with a heterologous nucleic acid sequence operably linked to a promoter, wherein the heterologous nucleic sequence comprises a nucleic acid of the invention; (b) growing the plant under conditions wherein the heterologous nucleic acids sequence is expressed in the plant cell. The invention provides methods of expressing a heterologous nucleic acid sequence in a plant cell comprising the following steps: (a) transforming the plant cell with a heterologous nucleic acid sequence operably linked to a promoter, wherein the heterologous nucleic sequence comprises a sequence of the invention; (b) growing the plant under conditions wherein the heterologous nucleic acids sequence is expressed in the plant cell.

The invention provides feeds or foods comprising a polypeptide of the invention, or a polypeptide encoded by a nucleic acid of the invention. In one aspect, the invention provides a food, feed, a liquid, e.g., a beverage (such as a fruit juice or a beer), a bread or a dough or a bread product, or a beverage precursor (e.g., a wort), comprising a polypeptide of the invention. The invention provides food or nutritional supplements for an animal comprising a polypeptide of the invention, e.g., a polypeptide encoded by the nucleic acid of the invention.

In one aspect, the polypeptide in the food or nutritional supplement can be glycosylated. The invention provides edible enzyme delivery matrices comprising a polypeptide of the invention, e.g., a polypeptide encoded by the nucleic acid of the invention. In one aspect, the delivery matrix comprises a pellet. In one aspect, the polypeptide can be glycosylated. In one aspect, the polypeptide, enzyme, protein, e.g. structural or binding protein activity is thermotolerant. In another aspect, the polypeptide, enzyme, protein, e.g. structural or binding protein activity is thermostable.

The invention provides a food, a feed or a nutritional supplement comprising a polypeptide of the invention. The invention provides methods for utilizing a polypeptide, enzyme, protein, e.g. structural or binding protein, as a nutritional supplement in an animal diet, the method comprising: preparing a nutritional supplement containing a polypeptide, enzyme, protein, e.g. structural or binding protein, comprising at least thirty contiguous amino acids of a polypeptide of the invention; and administering the nutritional supplement to an animal. The animal can be a human, a ruminant or a monogastric animal. The polypeptide, enzyme, protein, e.g. structural or binding protein can be prepared by expression of a polynucleotide encoding the polypeptide, enzyme, protein, e.g. structural or binding protein in an organism selected from the group consisting of a bacterium, a yeast, a plant, an insect, a fungus and an animal. The organism can be selected from the group consisting of an *S. pombe, S. cerevisiae, Pichia pastoris, E. coli, Streptomyces* sp., *Bacillus* sp. and *Lactobacillus* sp.

The invention provides edible enzyme delivery matrix comprising thermostable recombinant polypeptide, enzyme, protein, e.g. structural or binding protein of the invention. The invention provides methods for delivering a polypeptide, enzyme, protein, e.g. structural or binding protein, supplement to an animal, the method comprising: preparing an edible enzyme delivery matrix in the form of pellets comprising a granulate edible carrier and thermostable recombinant polypeptide, enzyme, protein, e.g. structural or binding protein, wherein the pellets readily disperse the polypeptide, enzyme, protein, e.g. structural or binding protein contained therein into aqueous media, and administering the edible enzyme delivery matrix to the animal. The recombinant polypeptide, enzyme, protein, e.g. structural or binding protein can comprise a polypeptide of the invention. The polypeptide, enzyme, protein, e.g. structural or binding protein can be glycosylated to provide thermostability at pelletizing conditions. The delivery matrix can be formed by pelletizing a mixture comprising a grain germ and a polypeptide, enzyme, protein, e.g. structural or binding protein. The pelletizing conditions can include application of steam. The pelletizing conditions can comprise application of a temperature in excess of about 80° C. for about 5 minutes and the enzyme retains a specific activity of at least 350 to about 900 units per milligram of enzyme.

In one aspect, invention provides a pharmaceutical composition comprising a polypeptide, enzyme, protein, e.g. structural or binding protein, of the invention, or a polypeptide encoded by a nucleic acid of the invention. In one aspect, the pharmaceutical composition acts as a digestive aid.

The details of one or more aspects of the invention are set forth in the accompanying drawings and the description below. Other features, objects, and advantages of the invention will be apparent from the description and drawings, and from the claims.

All publications, patents, patent applications, GenBank sequences and ATCC deposits, cited herein are hereby expressly incorporated by reference for all purposes.

BRIEF DESCRIPTION OF DRAWINGS

The following drawings are illustrative of aspects of the invention and are not meant to limit the scope of the invention as encompassed by the claims.

Like reference symbols in the various drawings indicate like elements.

DETAILED DESCRIPTION

Figure 1:
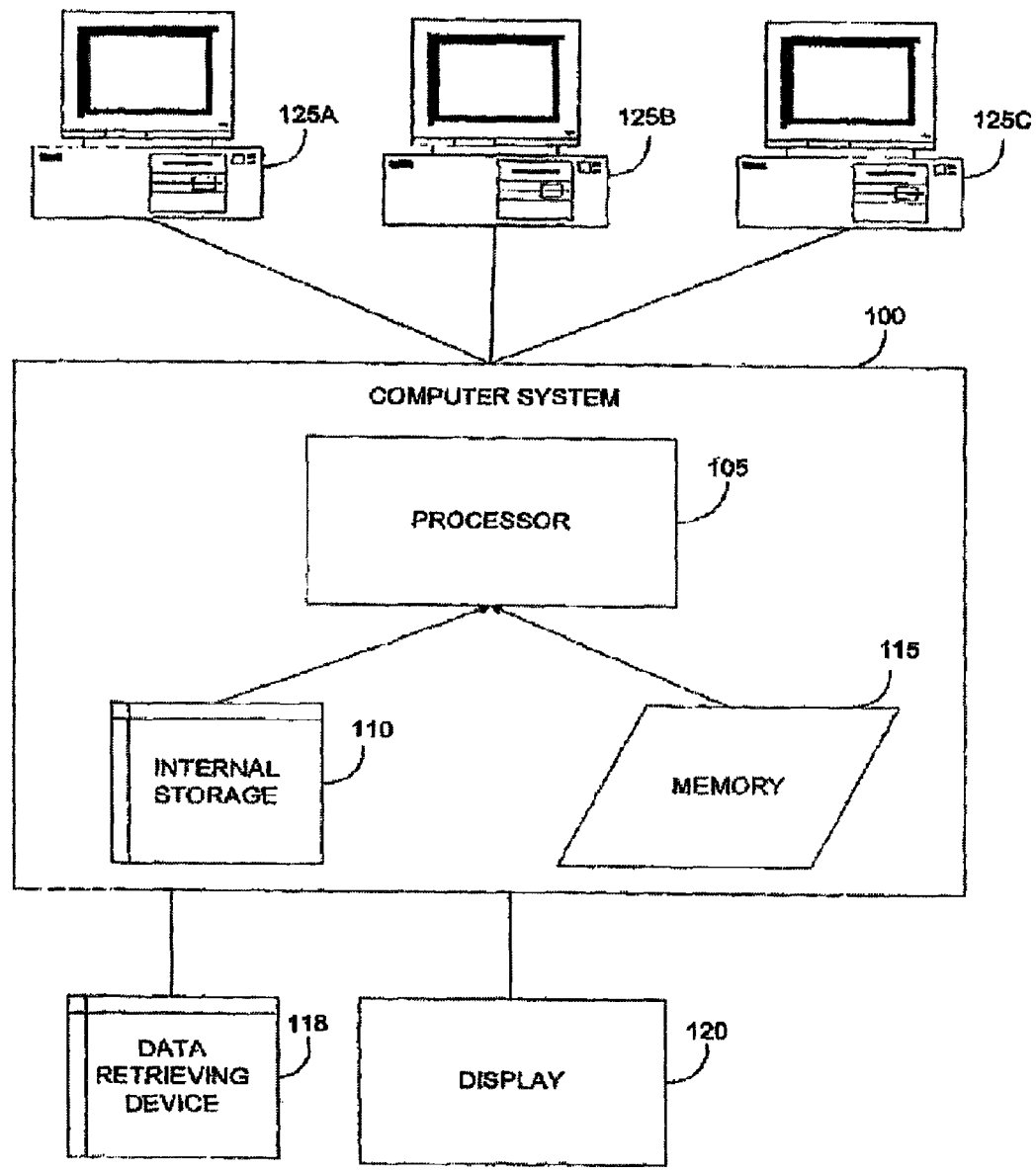
FIG. 1 is a block diagram of a computer system.

The invention provides isolated and recombinant polypeptides, including enzymes, structural proteins and binding proteins, polynucleotides encoding these polypeptides, and methods of making and using these polynucleotides and polypeptides. The polypeptides of the invention, and the polynucleotides encoding the polypeptides of the invention, encompass many classes of enzymes, structural proteins and binding proteins. In one aspect, the enzymes and proteins of the invention comprise, e.g. aldolases, alpha-galactosidases, amidases, e.g. secondary amidases, amylases, catalases, carotenoid pathway enzymes, dehalogenases, endoglucanases, epoxide hydrolases, esterases, hydrolases, glucosidases, glycosidases, inteins, isomerases, laccases, lipases, monooxygenases, nitroreductases, nitrilases, P450 enzymes, pectate lyases, phosphatases, phospholipases, phytases, polymerases and xylanases, which are more specifically described below. The invention also provides isolated and recombinant polypeptides, including enzymes, structural proteins and binding proteins, polynucleotides encoding these polypeptides, having the activities described in Table 1, Table 2 or Table 3, below.

Aldolases

In one aspect, the invention provides aldolases, polynucleotides encoding them, and methods of making and using these polynucleotides and polypeptides. In one aspect, the invention is directed to polypeptides, e.g., enzymes, having an aldolase activity, including thermostable and thermotolerant aldolase activity, and polynucleotides encoding these enzymes, and making and using these polynucleotides and polypeptides. In one aspect, the aldolase activity comprises catalysis of the formation of a carbon-carbon bond. In one aspect, the aldolase activity comprises an aldol condensation. The aldol condensation can have an aldol donor substrate comprising an acetaldehyde and an aldol acceptor substrate comprising an aldehyde. The aldol condensation can yield a product of a single chirality. In one aspect, the aldolase activity is enantioselective. The aldolase activity can comprise a 2-deoxyribose-5-phosphate aldolase (DERA) activity. The aldolase activity can comprise catalysis of the condensation of acetaldehyde as donor and a 2(R)-hydroxy-3-(hydroxy or mercapto)-propionaldehyde derivative to form a 2-deoxysugar. The aldolase activity can comprise catalysis of the condensation of acetaldehyde as donor and a 2-substituted acetaldehyde acceptor to form a 2,4,6-trideoxyhexose via a 4-substituted-3-hydroxybutanal intermediate. The aldolase activity can comprise catalysis of the generation of chiral aldehydes using two acetaldehydes as substrates. The aldolase activity can comprises enantioselective assembling of chiral β,δ-dihydroxyheptanoic acid side chains. The aldolase activity can comprise enantioselective assembling of the core of [R-(R*,R*)]-2-(4-fluorophenyl)-b,d-dihydroxy-5-(1-methylethyl)-3-phenyl-4-(phenylamino)-carbonyl]-1H-pyrrole-1-heptanoic acid (Atorvastatin, or LIPITOR™), rosuvastatin (CRESTOR™) and/or fluvastatin (LESCOL™). The aldolase activity can comprise, with an oxidation step, synthesis of a 3R,5S-6-chloro-2,4,6-trideoxy-erythro-hexonolactone.

Alpha-Galactosidases

In one aspect, the invention provides alpha-galactosidases, polynucleotides encoding them, and methods of making and using these polynucleotides and polypeptides. In one aspect, the invention is directed to polypeptides, e.g., enzymes, having an alpha-galactosidase activity, including thermostable and thermotolerant alpha-galactosidase activity, and polynucleotides encoding these enzymes, and making and using these polynucleotides and polypeptides.

An alpha galactosidase hydrolyses the non-reducing terminal alpha 1-3,4,6 linked galactose from poly- and oligosaccharides. These saccharides are commonly found in legumes and are difficult to digest. As such, alpha-galactosidases can be used as a digestive aid to break down raffinose, stachyose, and verbascose, found in such foods as beans and other gassy foods.

Amidases

In one aspect, the invention provides amidases, polynucleotides encoding them, and methods of making and using these polynucleotides and polypeptides. In one aspect, the invention is directed to polypeptides, e.g., enzymes, having an amidase activity, including thermostable and thermotolerant amidase activity, and polynucleotides encoding these enzymes, and making and using these polynucleotides and polypeptides. In one aspect, the amidases of the invention are used in the removal of arginine, phenylalanine or methionine from the N-terminal end of peptides in peptide or peptidomimetic synthesis. In one aspect, the enzyme of the invention, e.g. an amidase, is selective for the L, or "natural" enantiomer of the amino acid derivatives and is therefore useful for the production of optically active compounds. These reactions can be performed in the presence of the chemically more reactive ester functionality, a step which is very difficult to achieve with nonenzymatic methods. The enzyme is also able to tolerate high temperatures (at least 70° C.), and high concentrations of organic solvents (>40% DMSO), both of which cause a disruption of secondary structure in peptides, which enables cleavage of otherwise resistant bonds.

Secondary Amidases

In one aspect, the invention provides secondary amidases, polynucleotides encoding them, and methods of making and using these polynucleotides and polypeptides. In one aspect, the invention is directed to polypeptides, e.g., enzymes, having a secondary amidase activity, including thermostable and thermotolerant secondary amidase activity, and polynucleotides encoding these enzymes, and making and using these polynucleotides and polypeptides.

Secondary amidases include a variety of useful enzymes including peptidases, proteases, and hydantoinases. This class of enzymes can be used in a range of commercial applications. For example, secondary amidases can be used to: 1) increase flavor in food, in particular cheese (known as enzyme ripened cheese); 2) promote bacterial and fungal killing; 3) modify and de-protect fine chemical intermediates 4) synthesize peptide bonds; 5) and carry out chiral resolutions. Particularly, there is a need in the art for an enzyme capable of hydrolyzing Cephalosporin C.

Amylases

In one aspect, the invention provides amylases, polynucleotides encoding them, and methods of making and using these polynucleotides and polypeptides. In one aspect, the invention is directed to polypeptides, e.g., enzymes, having an amylase activity, including thermostable and thermotolerant amylase activity, and polynucleotides encoding these enzymes, and making and using these polynucleotides and polypeptides.

In one aspect, the polypeptides of the invention can be used as amylases, for example, alpha amylases or glucoamylases, to catalyze the hydrolysis of starch into sugars. In one aspect, the invention is directed to polypeptides having thermostable amylase activity, such as alpha amylases or glucoamylase activity, e.g., a 1,4-alpha-D-glucan glucohydrolase activity. In one aspect, the polypeptides of the invention can be used as amylases, for example, alpha amylases or glucoamylases, to catalyze the hydrolysis of starch into sugars, such as glucose. The invention is also directed to nucleic acid constructs, vectors, and host cells comprising the nucleic acid sequences of the invention as well as recombinant methods for producing the polypeptides of the invention. The invention is also directed to the use of amylases of the invention in starch conversion processes, including production of high fructose corn syrup (HFCS), ethanol, dextrose, and dextrose syrups.

Commercially, glucoamylases are used to further hydrolyze cornstarch, which has already been partially hydrolyzed with an alpha-amylase. The glucose produced in this reaction may then be converted to a mixture of glucose and fructose by a glucose isomerase enzyme. This mixture, or one enriched with fructose, is the high fructose corn syrup commercialized throughout the world. In general, starch to fructose processing consists of four steps: liquefaction of granular starch, saccharification of the liquefied starch into dextrose, purification, and isomerization to fructose. The object of a starch liquefaction process is to convert a concentrated suspension of starch polymer granules into a solution of soluble shorter chain length dextrins of low viscosity.

The amylases of the invention can be used in automatic dish wash (ADW) products and laundry detergent. In ADW products, the amylase will function at pH 10-11 and at 45-60° C. in the presence of calcium chelators and oxidative conditions. For laundry, activity at pH 9-10 and 40° C. in the appropriate detergent matrix will be required. Amylases are also useful in textile desizing, brewing processes, starch modification in the paper and pulp industry and other processes described in the art.

Amylases can be used commercially in the initial stages (liquefaction) of starch processing; in wet corn milling; in alcohol production; as cleaning agents in detergent matrices; in the textile industry for starch desizing; in baking applications; in the beverage industry; in oilfields in drilling processes; in inking of recycled paper and in animal feed. Amylases are also useful in textile desizing, brewing processes, starch modification in the paper and pulp industry and other processes.

Carotenoid Pathway Enzymes

The invention provides novel enzymes, and the polynucleotides encoding them, involved in carotenoid (such as lycopenes and luteins), astaxanthin and/or isoprenoid synthesis. The invention also provides novel genes in the carotenoid, astaxanthin and isoprenoid biosynthetic pathways comprising at least one enzyme of the invention. For example, alternative aspects, the invention provides one or more nucleic acid coding sequences (CDSs, or ORFs) encoding all, or at least one, enzyme(s) involved in a desired biosynthetic pathway for carotenoids, astaxanthins and/or isoprenoids. The nucleic acid coding sequence(s) can be expressed through an expression plasmid, vector, engineered virus or any episomal expression system, or, can be integrated into the genome of the host cell. In one aspect, the enzyme(s) involved in the biosynthetic pathway system comprise a novel combination of enzymes. In another aspect, the enzyme(s) involved in the biosynthetic pathway system comprise at least one novel enzyme of the invention—where nucleic acids used in the system encode a novel enzyme of the invention.

Carotenoids are natural pigments which have antioxidant and anti-carcinogenic activity. They are free radical scavengers, and as such, strong antioxidants. Carotenoids have a conjugated backbone structure and are very rigid molecules, having a backbone consisting of 9 to 11 alternating single/double bonds and have very similar electro-optical properties as polyacetylene. Astaxanthins are abundant naturally occurring carotenoids. They contain an internal unit similar to beta-carotene but have two terminal carbonyl and hydroxyl functionalities. These compounds are useful for food and feed supplements, colorants, neutraceuticals, cosmetic and pharmaceutical needs. Isoprenoids are compounds biosynthesized from or containing isoprene (unsaturated branched chain five-carbon hydrocarbon) units, including terpenes, carotenoids, fat soluble vitamins, ubiquinone, rubber, and some steroids. Biosynthetic pathways for carotenoids, astaxanthins and isoprenoids are known; most of these published pathways are derived from one organism or a combination of genes from a few species.

Catalases

In one aspect, the invention provides catalases, polynucleotides encoding them, and methods of making and using these polynucleotides and polypeptides. In one aspect, the invention is directed to polypeptides, e.g., enzymes, having a catalase activity, including thermostable and thermotolerant catalase activity, and polynucleotides encoding these enzymes, and making and using these polynucleotides and polypeptides.

In processes where hydrogen peroxide is a by-product, catalases of the invention can be used to destroy or detect hydrogen peroxide, e.g., in production of glyoxylic acid and in glucose sensors. Also, in processes where hydrogen peroxide is used as a bleaching or antibacterial agent, catalases of the invention can be used to destroy residual hydrogen peroxide, e.g. in contact lens cleaning, in bleaching steps in pulp and paper production, and in the pasteurization of dairy products. Further, such catalases of the invention can be used as catalysts for oxidation reactions, e.g. epoxidation and hydroxylation.

Dehalogenases

In one aspect, the invention provides dehalogenases, polynucleotides encoding them, and methods of making and using these polynucleotides and polypeptides. In one aspect, the invention is directed to polypeptides, e.g., enzymes, having a dehalogenase activity, including thermostable and thermotolerant dehalogenase activity, and polynucleotides encoding these enzymes, and making and using these polynucleotides and polypeptides.

Environmental pollutants consist of a large quantity and variety of chemicals; many of these are toxic, environmental hazards that were designated in 1979 as priority pollutants by the U.S. Environmental Protection Agency. Microbial and enzymatic biodegradation is one method for the elimination of these pollutants. Accordingly, methods have been designed to treat commercial wastes and to bioremediate polluted environments via microbial and related enzymatic processes. Unfortunately, many chemical pollutants are either resistant to microbial degradation or are toxic to potential microbial-degraders when present in high concentrations and certain combinations.

Dehalogenases, e.g. haloalkane dehalogenases, of the invention can cleave carbon-halogen bonds in haloalkanes and halocarboxylic acids by hydrolysis, thus converting them to their corresponding alcohols. This reaction can be used for detoxification involving haloalkanes, such as ethylchloride, methylchloride, and 1,2-dichloroethane (e.g., detoxification of toxic composition, e.g., pesticides, poisons, chemical warfare agents and the like comprising haloalkanes).

The present invention provides a number of dehalogenase enzymes useful in bioremediation having improved enzymatic characteristics. The polynucleotides and polynucleotide products of the invention are useful in, for example, groundwater treatment involving transformed host cells containing a polynucleotide or polypeptide of the invention (e.g., the bacteria Xanthobacter autotrophicus) and the haloalkane 1,2-dichlorethane as well as removal of polychlorinated biphenyls (PCB's) from soil sediment.

The haloalkane dehalogenase of the invention are useful in carbon-halide reduction efforts. The enzymes of the invention initiate the degradation of haloalkanes. Alternatively, host cells containing a dehalogenase polynucleotide or polypeptide of the invention can feed on the haloalkanes and produce the detoxifying enzyme.

Endoglucanases

In one aspect, the invention provides endoglucanases, polynucleotides encoding them, and methods of making and using these polynucleotides and polypeptides. In one aspect, the invention is directed to polypeptides, e.g., enzymes, having an endoglucanase activity, including thermostable and thermotolerant endoglucanase activity, and polynucleotides encoding these enzymes, and making and using these polynucleotides and polypeptides.

In one aspect, the enzymes of the invention have a glucanase, e.g., an endoglucanase, activity, e.g., catalyzing hydrolysis of internal endo-β-1,4- and/or β-1,3-glucanase linkages. In one aspect, the endoglucanase activity (e.g., endo-1,4-beta-D-glucan 4-glucano hydrolase activity) comprises hydrolysis of 1,4- and/or β-1,3-beta-D-glycosidic linkages in cellulose, cellulose derivatives (e.g., carboxy methyl cellulose and hydroxy ethyl cellulose) lichenin, beta-1,4 bonds in mixed beta-1,3 glucans, such as cereal beta-D-glucans or xyloglucans and other plant material containing cellulosic parts.

Endoglucanases of the invention (e.g., endo-beta-1,4-glucanases, EC 3.2.1.4; endo-beta-1,3(1)-glucanases, EC 3.2.1.6; endo-beta-1,3-glucanases, EC 3.2.1.39) can hydrolyze internal β-1,4- and/or β-1,3-glucosidic linkages in cellulose and glucan to produce smaller molecular weight glucose and glucose oligomers. Glucans are polysaccharides formed from 1,4-β- and/or 1,3-glycoside-linked D-glucopyranose. Endoglucanases of the invention can be used in the food industry, for baking and fruit and vegetable processing, breakdown of agricultural waste, in the manufacture of animal feed, in pulp and paper production, textile manufacture and household and industrial cleaning agents. Endoglucanases are produced by fungi and bacteria.

Beta-glucans are major non-starch polysaccharides of cereals. The glucan content can vary significantly depending on variety and growth conditions. The physicochemical properties of this polysaccharide are such that it gives rise to viscous solutions or even gels under oxidative conditions. In addition glucans have high water-binding capacity. All of these characteristics present problems for several industries including brewing, baking, animal nutrition. In brewing applications, the presence of glucan results in wort filterability and haze formation issues. In baking applications (especially for cookies and crackers), glucans can create sticky doughs that are difficult to machine and reduce biscuit size. In addition, this carbohydrate is implicated in rapid rehydration of the baked product resulting in loss of crispiness and reduced shelf-life. For monogastric animal feed applications with cereal diets, beta-glucan is a contributing factor to viscosity of gut contents and thereby adversely affects the digestibility of the feed and animal growth rate. For ruminant animals, these beta-glucans represent substantial components of fiber intake and more complete digestion of glucans would facilitate higher feed conversion efficiencies. It is desirable for animal feed endoglucanases to be active in the animal stomach.

Endoglucanases of the invention can be used in the digestion of cellulose, a beta-1,4-linked glucan found in all plant material. Cellulose is the most abundant polysaccharide in nature. Enzymes of the invention that digest cellulose have utility in the pulp and paper industry, in textile manufacture and in household and industrial cleaning agents.

Epoxide Hydrolases

In one aspect, the invention provides epoxide hydrolases, polynucleotides encoding them, and methods of making and using these polynucleotides and polypeptides. In one aspect, the invention is directed to polypeptides, e.g., enzymes, having an epoxide hydrolase activity, including thermostable and thermotolerant epoxide hydrolase activity, and polynucleotides encoding these enzymes, and making and using these polynucleotides and polypeptides. The polypeptides of the invention can be used as epoxide hydrolases to catalyze the hydrolysis of epoxides and arene oxides to their corresponding diols.

Epoxide hydrolases catalyze the hydrolysis of epoxides and arene oxides to their corresponding diols. Epoxide hydrolases from microbial sources are highly versatile biocatalysts for the asymmetric hydrolysis of epoxides on a preparative scale. Besides kinetic resolution, which furnishes the corresponding vicinal diol and remaining non-hydrolyzed epoxide in nonracemic form, enantioconvergent processes are possible. These are highly attractive as they lead to the formation of a single enantiomeric diol from a racemic oxirane.

Microsomal epoxide hydrolases are biotransformation enzymes that catalyze the conversion of a broad array of xenobiotic epoxide substrates to more polar diol metabolites, see, e.g., Omiecinski (2000) Toxicol. Lett. 112-113:365-370. Microsomal epoxide hydrolases catalyze the addition of water to epoxides in a two-step reaction involving initial attack of an active site carboxylate on the oxirane to give an ester intermediate followed by hydrolysis of the ester. Soluble epoxide hydrolase play a role in the biosynthesis of inflammation mediators.

Epoxide hydrolases of the invention can be used in the detoxification of epoxides or in the biosynthesis of hormones. Additionally, epoxide hydrolases of the invention can efficiently process several substrates, leading to enantiomerically enriched-epoxides (the unreacted enantiomer) and/or to the corresponding vicinal diols.

Esterases

In one aspect, the invention provides esterases, polynucleotides encoding them, and methods of making and using these polynucleotides and polypeptides. In one aspect, the invention is directed to polypeptides, e.g., enzymes, having an esterase activity, including thermostable and thermotolerant esterase activity, and polynucleotides encoding these enzymes, and making and using these polynucleotides and polypeptides.

Many esterases are known and have been discovered in a broad variety of organisms, including bacteria, yeast and higher animals and plants. A principal example of esterases are the lipases, which are used in the hydrolysis of lipids, acidolysis (replacement of an esterified fatty acid with a free fatty acid) reactions, transesterification (exchange of fatty acids between triglycerides) reactions, and in ester synthesis.

The major industrial applications for lipases include: the detergent industry, where they are employed to decompose fatty materials in laundry stains into easily removable hydrophilic substances; the food and beverage industry where they are used in the manufacture of cheese, the ripening and flavoring of cheese, as antistaling agents for bakery products, and in the production of margarine and other spreads with natural butter flavors; in waste systems; and in the pharmaceutical industry where they are used as digestive aids.

Alternatively, esterases of the invention can be used in detergent compositions. In one aspect, the esterase can be a nonsurface-active esterase. In another aspect, the esterase can be a surface-active esterase. The esterase can be formulated in a non-aqueous liquid composition, a cast solid, a granular form, a particulate form, a compressed tablet, a gel form, a paste or a slurry form.

In another aspect, the invention provides fabrics or clothing comprising an esterase of the invention. In another aspect, esterases of the invention are used to treat a lipid-containing fabric.

In another aspect, the invention provides foods and drinks comprising an esterase of the invention. The invention also provides cheeses comprising an esterase of the invention. Additionally, the invention provides methods for the manufacture of cheese comprising the following steps: (a) providing a polypeptide having an esterase activity, wherein the polypeptide comprises a polypeptide of the invention, or, a polypeptide encoded by a nucleic acid of the invention; (b) providing a cheese precursor; and (c) contacting the polypeptide of step (a) with the precursor of step (b) under condition wherein the esterase can catalyze cheese manufacturing processes. In one aspect, the method can comprise the process of ripening and flavoring of cheese.

In another aspect, the invention provides margarines and spreads comprising an enzyme of the invention. The invention provides methods for production of margarine or other spreads with natural butter flavors comprising the following steps: (a) providing a polypeptide having an esterase activity, wherein the polypeptide comprises a polypeptide of the invention, or, a polypeptide encoded by a nucleic acid of the invention; (b) providing a margarine or a spread precursor; and (c) contacting the polypeptide of step (a) with the precursor of step (b) under condition wherein the esterase can catalyze processes involved in margarine or spread production.

The invention provides methods for treating solid or liquid waste products comprising the following steps: (a) providing a polypeptide having an esterase activity, wherein the polypeptide comprises a polypeptide of the invention, or, a polypeptide encoded by a nucleic acid of the invention; (b) providing a solid or a liquid waste; and (c) contacting the polypeptide of step (a) and the waste of step (b) under conditions wherein the polypeptide can treat the waste. The invention provides solid or liquid waste products comprising a polypeptide of the invention.

The invention provides methods for aiding digestion in a mammal comprising (a) providing a polypeptide having an esterase activity, wherein the polypeptide comprises a polypeptide of the invention, or, a polypeptide encoded by a nucleic acid of the invention; (b) providing a composition comprising a substrate for the polypeptide of step (a); (c) feeding or administering to the mammal the polypeptide of step (a) with a feed or food comprising a substrate for the polypeptide of step (a), thereby helping digestion in the mammal. In one aspect, the mammal is a human.

The invention provides pharmaceutical compositions comprising a polypeptide and/or a nucleic acid of the invention, e.g., a pharmaceutical composition for use as a digestive aid in a mammal comprising a polypeptide having an esterase activity, wherein the polypeptide comprises a polypeptide of the invention, or, a polypeptide encoded by a nucleic acid of the invention. In one aspect, the mammal comprises a human. The enzymes of the invention are used in the manufacture of medicaments.

The invention provides bakery products comprising a polypeptide of the invention. The invention provides antistaling agents for bakery products comprising a polypeptide having an esterase activity, wherein the polypeptide comprises a polypeptide of the invention, or, a polypeptide encoded by a nucleic acid of the invention.

The invention provides methods for hydrolyzing, breaking up or disrupting a ester-comprising composition comprising the following steps: (a) providing a polypeptide of the invention having an esterase activity, or a polypeptide encoded by a nucleic acid of the invention; (b) providing a composition comprising a protein; and (c) contacting the polypeptide of step (a) with the composition of step (b) under conditions wherein the esterase hydrolyzes, breaks up or disrupts the ester-comprising composition.

Alternatively, the invention provides methods for liquefying or removing ester-comprising compositions comprising the following steps: (a) providing a polypeptide of the invention having an esterase activity, or a polypeptide encoded by a nucleic acid of the invention; (b) providing a composition comprising a protein; and (c) contacting the polypeptide of step (a) with the composition of step (b) under conditions wherein esterase removes or liquefies the ester-comprising compositions.

Hydrolases

In one aspect, the invention provides hydrolases, polynucleotides encoding them, and methods of making and using these polynucleotides and polypeptides. In one aspect, the invention is directed to polypeptides, e.g., enzymes, having a hydrolase activity, e.g., an esterase, acylase, lipase, phospholipase or protease activity, including thermostable and thermotolerant hydrolase activity, and polynucleotides encoding these enzymes, and making and using these polynucleotides and polypeptides. The hydrolase activities of the polypeptides and peptides of the invention include esterase activity, lipase activity (hydrolysis of lipids), acidolysis reactions (to replace an esterified fatty acid with a free fatty acid), transesterification reactions (exchange of fatty acids between triglycerides), ester synthesis, ester interchange reactions, phospholipase activity (e.g., phospholipase A, B, C and D activity, patatin activity, lipid acyl hydrolase (LAH) activity) and protease activity (hydrolysis of peptide bonds). The polypeptides of the invention can be used in a variety of pharmaceutical, agricultural and industrial contexts, including the manufacture of cosmetics and nutraceuticals.

In one aspect, the polypeptides of the invention are used in the biocatalytic synthesis of structured lipids (lipids that contain a defined set of fatty acids distributed in a defined manner on the glycerol backbone), including cocoa butter alternatives (CBA), lipids containing poly-unsaturated fatty acids (PUFAs), diacylglycerides, e.g., 1,3-diacyl glycerides (DAGs), monoglycerides, e.g., 2-monoglycerides (MAGs) and triacylglycerides (TAGs). In one aspect, the polypeptides of the invention are used to modify oils, such as fish, animal and vegetable oils, and lipids, such as poly-unsaturated fatty acids. The hydrolases of the invention having lipase activity can modify oils by hydrolysis, alcoholysis, esterification, transesterification and/or interesterification. The methods of the invention can use lipases with defined regio-specificity or defined chemoselectivity in biocatalytic synthetic reactions.

In another aspect, the polypeptides of the invention are used to synthesize enantiomerically pure chiral products.

Additionally, the polypeptides of the invention can be used in food processing, brewing, bath additives, alcohol production, peptide synthesis, enantioselectivity, hide preparation in the leather industry, waste management and animal degradation, silver recovery in the photographic industry, medical treatment, silk degumming, biofilm degradation, biomass conversion to ethanol, biodefense, antimicrobial agents and disinfectants, personal care and cosmetics, biotech reagents, in increasing starch yield from corn wet milling and pharmaceuticals such as digestive aids and anti-inflammatory (antiphlogistic) agents.

The major industrial applications for hydrolases, e.g., esterases, lipases, phospholipases and proteases, include the detergent industry, where they are employed to decompose fatty materials in laundry stains into easily removable hydrophilic substances; the food and beverage industry where they are used in the manufacture of cheese, the ripening and flavoring of cheese, as antistaling agents for bakery products, and in the production of margarine and other spreads with natural butter flavors; in waste systems; and in the pharmaceutical industry where they are used as digestive aids.

Oils and fats are an important renewable raw material for the chemical industry. They are available in large quantities from the processing of oilseeds from plants like rice bran oil, rapeseed (canola), sunflower, olive, palm or soy. Other sources of valuable oils and fats include fish, restaurant waste, and rendered animal fats. These fats and oils are a mixture of triglycerides or lipids, i.e. fatty acids (FAs) esterified on a glycerol scaffold. Each oil or fat contains a wide variety of different lipid structures, defined by the FA content and their regiochemical distribution on the glycerol backbone. These properties of the individual lipids determine the physical properties of the pure triglyceride. Hence, the triglyceride content of a fat or oil to a large extent determines the physical, chemical and biological properties of the oil. The value of lipids increases greatly as a function of their purity. High purity can be achieved by fractional chromatography or distillation, separating the desired triglyceride from the mixed background of the fat or oil source. However, this is costly and yields are often limited by the low levels at which the triglyceride occurs naturally. In addition, the purity of the product is often compromised by the presence of many structurally and physically or chemically similar triglycerides in the oil.

An alternative to purifying triglycerides or other lipids from a natural source is to synthesize the lipids. The products of such processes are called structured lipids because they contain a defined set of fatty acids distributed in a defined manner on the glycerol backbone. The value of lipids also increases greatly by controlling the fatty acid content and distribution within the lipid. Lipases can be used to affect such control.

Phospholipases are enzymes that hydrolyze the ester bonds of phospholipids. Corresponding to their importance in the metabolism of phospholipids, these enzymes are widespread among prokaryotes and eukaryotes. The phospholipases affect the metabolism, construction and reorganization of biological membranes and are involved in signal cascades. Several types of phospholipases are known which differ in their specificity according to the position of the bond attacked in the phospholipid molecule. Phospholipase A1 (PLA1) removes the 1-position fatty acid to produce free fatty acid and 1-lyso-2-acylphospholipid. Phospholipase A2 (PLA2) removes the 2-position fatty acid to produce free fatty acid and 1-acyl-2-lysophospholipid. PLA1 and PLA2 enzymes can be intra- or extra-cellular, membrane-bound or soluble. Intracellular PLA2 is found in almost every mammalian cell. Phospholipase C (PLC) removes the phosphate moiety to produce 1,2 diacylglycerol and phospho base. Phospholipase D (PLD) produces 1,2-diacylglycerophosphate and base group. PLC and PLD are important in cell function and signaling. Patatins are another type of phospholipase thought to work as a PLA.

In general, enzymes, including hydrolases such as esterases, lipases and proteases, are active over a narrow range of environmental conditions (temperature, pH, etc.), and many are highly specific for particular substrates. The narrow range of activity for a given enzyme limits its applicability and creates a need for a selection of enzymes that (a) have similar activities but are active under different conditions or (b) have different substrates. For instance, an enzyme capable of catalyzing a reaction at 50° C. may be so inefficient at 35° C., that its use at the lower temperature will not be feasible. For this reason, laundry detergents generally contain a selection of proteolytic enzymes (e.g., polypeptides of the invention), allowing the detergent to be used over a broad range of wash temperature and pH. In view of the specificity of enzymes and the growing use of hydrolases in industry, research, and medicine, there is an ongoing need in the art for new enzymes and new enzyme inhibitors.

Glucosidases

In one aspect, the invention provides glucosidases, polynucleotides encoding them, and methods of making and using these polynucleotides and polypeptides. In one aspect, the invention is directed to polypeptides, e.g., enzymes, having a glucosidase activity, including thermostable and thermotolerant glucosidase activity, and polynucleotides encoding these enzymes, and making and using these polynucleotides and polypeptides.

Alpha-glucosidases of the invention can catalyze the hydrolysis of starches into sugars. Alpha-glucosidases can hydrolyze terminal non-reducing 1,4 or 1,6 linked α-D-glucose residues in starch, with release of α-D-glucose.

Alpha-glucosidases of the invention can be used commercially in the stages liquefaction and saccharification of starch processing; in wet corn milling; in alcohol production; as cleaning agents in detergent matrices; in the textile industry for starch desizing; in baking applications; in the beverage industry; in oilfields in drilling processes; in inking of recycled paper and in animal feed. Alpha-glucosidases of the invention are also useful in textile desizing, brewing processes, starch modification in the paper and pulp industry and other processes.

Glycosidases

In one aspect, the invention provides glycosidases, polynucleotides encoding them, and methods of making and using these polynucleotides and polypeptides. In one aspect, the invention is directed to polypeptides, e.g., enzymes, having a glycosidase activity, including thermostable and thermotolerant glycosidase activity, and polynucleotides encoding these enzymes, and making and using these polynucleotides and polypeptides. Glycosidase enzymes of the invention can have more specific activity as glucosidases, α-galactosidases, β-galactosidases, β-mannosidases, β-mannanases, endoglucanases, and pullulanases.

α-galactosidases of the invention can catalyze the hydrolysis of galactose groups on a polysaccharide backbone or hydrolyze the cleavage of di- or oligosaccharides comprising galactose. β-mannanases of the invention can catalyze the hydrolysis of mannose groups internally on a polysaccharide backbone or hydrolyze the cleavage of di- or oligosaccharides comprising mannose groups. β-mannosidases of the invention can hydrolyze non-reducing, terminal mannose residues on a mannose-containing polysaccharide and the cleavage of di- or oligosaccaharides comprising mannose groups.

Guar gum is a branched galactomannan polysaccharide composed of β-1,4 linked mannose backbone with a-1,6 linked galactose sidechains. The enzymes required for the degradation of guar are β-mannanase, β-mannosidase and α-galactosidase. β-mannanase hydrolyses the mannose backbone internally and β-mannosidase hydrolyses non-reducing, terminal mannose residues. α-galactosidase hydrolyses α-linked galactose groups.

Galactomannan polysaccharides and the enzymes of the invention that degrade them have a variety of applications. Guar is commonly used as a thickening agent in food and is utilized in hydraulic fracturing in oil and gas recovery. Consequently, galactomannanases are industrially relevant for the degradation and modification of guar. Furthermore, a need exists for thermostable galactomannases that are active in extreme conditions associated with oil drilling and well stimulation.

There are other applications for these enzymes in various industries, such as in the beet sugar industry. 20-30% of the domestic U.S. sucrose consumption is sucrose from sugar beets. Raw beet sugar can contain a small amount of raffinose when the sugar beets are stored before processing and rotting begins to set in. Raffinose inhibits the crystallization of sucrose and also constitutes a hidden quantity of sucrose. Thus, there is merit to eliminating raffinose from raw beet sugar. α-Galactosidase has also been used as a digestive aid to break down raffinose, stachyose, and verbascose in such foods as beans and other gassy foods.

β-Galactosidases of the invention can be used for the production of lactose-free dietary milk products. Additionally, β-galactosidases of the invention can be used for the enzymatic synthesis of oligosaccharides via transglycosylation reactions.

Pullulanase is well known as a debranching enzyme of pullulan and starch. The enzyme of the invention can hydrolyze α-1,6-glucosidic linkages on these polymers. Starch degradation for the production or sweeteners (glucose or maltose) is a very important industrial application of this enzyme. The degradation of starch is developed in two stages. The first stage involves the liquefaction of the substrate with α-amylase, and the second stage, or saccharification stage, is performed by β-amylase with pullalanase added as a debranching enzyme, to obtain better yields.

Endoglucanases of the invention can be used in a variety of industrial applications. For instance, the endoglucanases of the invention can hydrolyze the internal β-1,4-glycosidic bonds in cellulose, which may be used for the conversion of plant biomass into fuels and chemicals. Endoglucanases of the invention also have applications in detergent formulations, the textile industry, in animal feed, in waste treatment, oil drilling and well stimulation, and in the fruit juice and brewing industry for the clarification and extraction of juices.

Inteins

In one aspect, the invention provides inteins, polynucleotides encoding them, and methods of making and using these polynucleotides and polypeptides. In another aspect, the invention provides a chimeric protein comprising at least three domains, wherein the first domain comprises at least one enzyme domain or a binding protein domain, the second domain comprises at least one intein domain and a third domain comprising a detectable moiety domain, at least one intein domain is positioned between at least one enzyme or binding protein and at least one detectable moiety domain, and the intein domain has at least one cleavage or splicing activity.

In one aspect, the detectable moiety domain comprises a detectable peptide or polypeptide. The detectable peptide or a polypeptide can be a fluorescent peptide or polypeptide. The detectable peptide or a polypeptide can be a bioluminescent or a chemiluminescent peptide or polypeptide. In one aspect, the bioluminescent or chemiluminescent polypeptide comprises a green fluorescent protein (GFP), an aequorin, an obelin, a mnemiopsin or a berovin. In one aspect, the detectable moiety domain comprises an enzyme that generates a detectable signal. The enzyme that generates a detectable signal can comprise an alpha-galactosidase, an antibiotic (e.g., chloramphenicol acetyltransferase) or a kinase. The detectable moiety domain can comprise a radioactive isotope.

In one aspect, the chimeric protein is a recombinant fusion protein. In one aspect, the intein domain splicing activity results in cleavage of the enzyme domain from the intein domain and detectable domain. The intein domain splicing activity can result in cleavage of the enzyme domain from the intein domain and detectable domain and cleavage of the detectable domain from the intein domain. In one aspect, the intein domain splicing activity results in cleavage of the detectable domain from the intein domain. In one aspect, the intein domain has only splicing activity. The intein domain can have only cleaving activity.

In one aspect, at least one domain is separated from another domain by a linker. The linker can be a flexible linker. The intein domain can be separated from the detectable moiety domain and the enzyme domain by a linker.

Isomerases

In one aspect, the invention provides isomerases, e.g. xylose isomerases, polynucleotides encoding them, and methods of making and using these polynucleotides and polypeptides. In one aspect, the invention is directed to polypeptides, e.g., enzymes, having an isomerase activity, e.g. xylose isomerase activity, including thermostable and thermotolerant isomerase activity, e.g. xylose isomerase activity, and polynucleotides encoding these enzymes, and making and using these polynucleotides and polypeptides.

In one aspect, the invention provides xylose isomerase enzymes, polynucleotides encoding the enzymes, methods of making and using these polynucleotides and polypeptides. The polypeptides of the invention can be used in a variety of agricultural and industrial contexts. For example, the polypeptides of the invention can be used for converting glucose to fructose or for manufacturing high content fructose syrups in large quantities. Other examples include use of the polypeptides of the invention in confectionary, brewing, alcohol and soft drinks production, and in diabetic foods and sweeteners.

Laccases

In one aspect, the invention provides laccases, polynucleotides encoding them, and methods of making and using these polynucleotides and polypeptides. In one aspect, the invention is directed to polypeptides, e.g., enzymes, having a laccase activity, including thermostable and thermotolerant laccase activity, and polynucleotides encoding these enzymes, and making and using these polynucleotides and polypeptides.

In one aspect, the invention provides methods of depolymerizing lignin, e.g., in a pulp or paper manufacturing process, using a polypeptide of the invention. In another aspect, the invention provides methods for oxidizing products that can be mediators of laccase-catalyzed oxidation reactions, e.g., 2,2-azinobis-(3-ethylbenzthiazoline-6-sulfonate) (ABTS), 1-hydroxybenzotriazole (HBT), 2,2,6,6-tetramethylpiperidin-1-yloxy (TEMPO), dimethoxyphenol, dihydroxyfumaric acid (DHF) and the like.

Laccases are a subclass of the multicopper oxidase super family of enzymes, which includes ascorbate oxidases and the mammalian protein, ceruloplasmin. Laccases are one of the oldest known enzymes and were first implicated in the oxidation of urushiol and laccol. In one aspect, reactions catalyzed by laccases of the invention comprises the oxidation of phenolic substrates. The major target application has been in the delignification of wood fibers during the preparation of pulp.

Lipases

In one aspect, the invention provides lipases, polynucleotides encoding them, and methods of making and using these polynucleotides and polypeptides. In one aspect, the invention is directed to polypeptides, e.g., enzymes, having a lipase activity, including thermostable and thermotolerant lipase activity, and polynucleotides encoding these enzymes, and making and using these polynucleotides and polypeptides.

In one aspect, the lipases of the invention can be used in a variety of pharmaceutical, agricultural and industrial contexts, including the manufacture of cosmetics and nutraceuticals. In one aspect, the lipases of the invention are used in the biocatalytic synthesis of structured lipids (lipids that contain a defined set of fatty acids distributed in a defined manner on the glycerol backbone), including cocoa butter alternatives (CBA), lipids containing poly-unsaturated fatty acids (PUFAs), diacylglycerides, e.g., 1,3-diacyl glycerides (DAGs), monoglycerides, e.g., 2-monoglycerides (MAGs) and triacylglycerides (TAGs). In one aspect, the polypeptides of the invention are used to modify oils, such as fish, animal and vegetable oils, and lipids, such as poly-unsaturated fatty acids. The lipases of the invention can modify oils by hydrolysis, alcoholysis, esterification, transesterification and/or interesterification. The methods of the invention use lipases with defined regio-specificity or defined chemoselectivity in biocatalytic synthetic reactions. In another aspect, the polypeptides of the invention are used to synthesize enantiomerically pure chiral products.

The invention provides lipase enzymes, polynucleotides encoding the enzymes, methods of making and using these polynucleotides and polypeptides. The polypeptides of the invention can be used in a variety of pharmaceutical, agricultural and industrial contexts, including the manufacture of cosmetics and nutraceuticals. In one aspect, the polypeptides of the invention are used in the biocatalytic synthesis of structured lipids (lipids that contain a defined set of fatty acids distributed in a defined manner on the glycerol backbone), including cocoa butter alternatives, poly-unsaturated fatty acids (PUFAs), 1,3-diacyl glycerides (DAGs), 2-monoglycerides (MAGs) and triacylglycerides (TAGs), such as 1,3-dipalmitoyl-2-oleoylglycerol (POP), 1,3-distearoyl-2-oleoylglycerol (SOS), 1-palmitoyl-2-oleoyl-3-stearoylglycerol (POS) or 1-oleoyl-2,3-dimyristoylglycerol (OMM), long chain polyunsaturated fatty acids such as arachidonic acid, docosahexaenoic acid (DHA) and eicosapentaenoic acid (EPA).

In one aspect, the invention provides synthesis (using lipases of the invention) of a triglyceride mixture composed of POS (Palmitic-Oleic-Stearic), POP (Palmitic-Oleic-Palmitic) and SOS (Stearic-Oleic-Stearic) from glycerol. This synthesis uses free fatty acids versus fatty acid esters. In one aspect, this reaction can be performed in one pot with sequential addition of fatty acids using crude glycerol and free fatty acids and fatty acid esters. In one aspect, stearate and palmitate are mixed together to generate mixtures of DAGs. In one aspect, the diacylglycerides are subsequently acylated with oleate to give components of cocoa butter equivalents. In alternative aspects, the proportions of POS, POP and SOS can be varied according to: stearate to palmitate ratio; selectivity of enzyme for palmitate versus stearate; or enzyme enantioselectivity (could alter levels of POS/SOP). One-pot synthesis of cocoa butter equivalents or other cocoa butter alternatives is possible using this aspect of the invention.

In one aspect, lipases that exhibit regioselectivity and/or chemoselectivity are used in the structure synthesis of lipids or in the processing of lipids. Thus, the methods of the invention use lipases with defined regio-specificity or defined chemoselectivity (e.g., a fatty acid specificity) in a biocatalytic synthetic reaction. For example, the methods of the invention can use lipases with SN1, SN2 and/or SN3 regiospecificity, or combinations thereof. In one aspect, the methods of the invention use lipases that exhibit regioselectivity for the 2-position of a triacylglyceride (TAG). This SN2 regioselectivity can be used in the synthesis of a variety of structured lipids, e.g., triacylglycerides (TAGs), including 1,3-DAGs and components of cocoa butter.

The methods and compositions (lipases) of the invention can be used in the biocatalytic synthesis of structured lipids, and the production of nutraceuticals (e.g., polyunsaturated fatty acids and oils), various foods and food additives (e.g., emulsifiers, fat replacers, margarines and spreads), cosmetics (e.g., emulsifiers, creams), pharmaceuticals and drug delivery agents (e.g., liposomes, tablets, formulations), and animal feed additives (e.g., polyunsaturated fatty acids, such as linoleic acids) comprising lipids made by the structured synthesis methods of the invention or processed by the methods of the invention In one aspect, lipases of the invention can act on fluorogenic fatty acid (FA) esters, e.g., umbelliferyl FA esters. In one aspect, profiles of FA specificities of lipases made or modified by the methods of the invention can be obtained by measuring their relative activities on a series of umbelliferyl FA esters, such as palmitate, stearate, oleate, laurate, PUFA, butyrate.

The methods and compositions (lipases) of the invention can be used to synthesize enantiomerically pure chiral products. In one aspect, the methods and compositions (lipases) of the invention can be used to prepare a D-amino acid and corresponding esters from a racemic mix. For example, D-aspartic acid can be prepared from racemic aspartic acid. In one aspect, optically active D-homophenylalanine and/or its esters are prepared. The enantioselectively synthesized D-homophenylalanine can be starting material for many drugs, such as Enalapril, Lisinopril, and Quinapril, used in the treatment of hypertension and congestive heart failure. The D-aspartic acid and its derivatives made by the methods and compositions of the invention can be used in pharmaceuticals, e.g., for the inhibition of arginiosuccinate synthetase to prevent or treat sepsis or cytokine-induced systemic hypotension or as immunosuppressive agents. The D-aspartic acid and its derivatives made by the methods and compositions of the invention can be used as taste modifying compositions for foods, e.g., as sweeteners (e.g., ALITAME™). For example, the methods and compositions (lipases) of the invention can be used to synthesize an optical isomer S(+) of 2-(6-methoxy-2-naphthyl) propionic acid from a racemic (R,S) ester of 2-(6-methoxy-2-naphthyl) propionic acid.

In one aspect, the methods and compositions (lipases) of the invention can be used to for stereoselectively hydrolyzing racemic mixtures of esters of 2-substituted acids, e.g., 2-aryloxy substituted acids, such as R-2-(4-hydroxyphenoxy)propionic acid, 2-arylpropionic acid, ketoprofen to synthesize enantiomerically pure chiral products.

The methods and compositions (lipases) of the invention can be used to hydrolyze oils, such as fish, animal and vegetable oils, and lipids, such as poly-unsaturated fatty acids. In one aspect, the polypeptides of the invention are used process fatty acids (such as poly-unsaturated fatty acids), e.g., fish oil fatty acids, for use in or as a feed additive. Addition of poly-unsaturated fatty acids PUFAs to feed for dairy cattle has been demonstrated to result in improved fertility and milk yields. Fish oil contains a high level of PUFAs and therefore is a potentially inexpensive source for PUFAs as a starting material for the methods of the invention. The biocatalytic methods of the invention can process fish oil under mild conditions, thus avoiding harsh conditions utilized in some processes. Harsh conditions may promote unwanted isomerization, polymerization and oxidation of the PUFAs. In one aspect, the methods of the invention comprise lipase-catalyzed total hydrolysis of fish-oil or selective hydrolysis of PUFAs from fish oil to provide a mild alternative that would leave the high-value PUFAs intact. In one aspect, the methods further comprise hydrolysis of lipids by chemical or physical splitting of the fat.

In one aspect, the lipases and methods of the invention are used for the total hydrolysis of fish oil. Lipases can be screened for their ability to catalyze the total hydrolysis of fish oil under different conditions using. In alternative aspects, a single or multiple lipases are used to catalyze the total splitting of the fish oil. Several lipases of the invention may need to be used, owing to the presence of the PUFAs. In one aspect, a PUFA-specific lipase of the invention is combined with a general lipase to achieve the desired effect.

The methods and compositions (lipases) of the invention can be used to catalyze the partial or total hydrolysis of other oils, e.g. olive oils, that do not contain PUFAs.

The methods and compositions (lipases) of the invention can be used to catalyze the hydrolysis of PUFA glycerol esters. These methods can be used to make feed additives. In one aspect, lipases of the invention catalyze the release of PUFAs from simple esters and fish oil. Standard assays and analytical methods can be utilized.

The methods and compositions (lipases) of the invention can be used to selectively hydrolyze saturated esters over unsaturated esters into acids or alcohols. The methods and compositions (lipases) of the invention can be used to treat latexes for a variety of purposes, e.g., to treat latexes used in hair fixative compositions to remove unpleasant odors. The methods and compositions (lipases) of the invention can be used in the treatment of a lipase deficiency in an animal, e.g., a mammal, such as a human. The methods and compositions (lipases) of the invention can be used to prepare lubricants, such as hydraulic oils. The methods and compositions (lipases) of the invention can be used in making and using detergents. The methods and compositions (lipases) of the invention can be used in processes for the chemical finishing of fabrics, fibers or yarns. In one aspect, the methods and compositions (lipases) of the invention can be used for obtaining flame retardancy in a fabric using, e.g., a halogen-substituted carboxylic acid or an ester thereof, i.e. a fluorinated, chlorinated or bromated carboxylic acid or an ester thereof.

Monooxygenases

In one aspect, the invention provides monooxygenases, polynucleotides encoding them, and methods of making and using these polynucleotides and polypeptides. In one aspect, the invention is directed to polypeptides, e.g., enzymes, having a monooxygenase activity, including thermostable and thermotolerant monooxygenase activity, and polynucleotides encoding these enzymes, and making and using these polynucleotides and polypeptides.

In one aspect, the monooxygenases of the invention have commercial utility as biocatalysts for use in the synthesis of aromatic and aliphatic esters and their derivatives, such as acids and alcohols. In one aspect, the monooxygenases of the invention are used in the catalysis of sulfoxidation reactions. In one aspect, the invention provides Baeyer-Villiger monooxygenases, polynucleotides encoding the Baeyer-Villiger monooxygenases, and methods of using these Baeyer-Villiger monooxygenases and polynucleotides. In one aspect, the invention provides methods of producing chiral synthetic intermediates using Baeyer-Villiger monooxygenases.

In one aspect, the monooxygenase activity comprises catalysis of sulfoxidation reactions. The monooxygenase activity can comprise an asymmetric sulfoxidation reaction. The monooxygenase activity can be enantiospecific. In one aspect, it can generate a substantially chiral product.

In one aspect, the monooxygenase activity comprises generation of an ester or a lactone having at least one of the following structures:

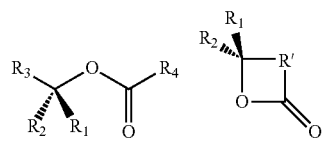

wherein: $R_1$, $R_2$, $R_3$ and $R_4$ are each independently selected from —H, substituted or unsubstituted alkyl, alkenyl, alkynyl, aryl, heteroaryl, cycloalkyl, and heterocyclic; wherein the substituted groups are substituted with one or more of lower alkyl, hydroxy, alkoxy, mercapto, cycloalkyl, heterocyclic, aryl, heteroaryl, aryloxy, and halogen, or two or more of $R_1$, $R_2$, $R_3$ and $R_4$ may together form cyclic moieties, and, R' is selected from substituted or unsubstituted alkylene, alkenylene, alkynylene, arylene, heteroarylene, cycloalkylene, and heterocyclic; wherein the substitutions are substituted with one or more of lower alkyl, hydroxy, alkoxy, mercapto, cycloalkyl, heterocyclic, aryl, heteroaryl, aryloxy, and halogen.

In one aspect, the monooxygenase activity comprises oxidation of a cycloalkanone to produce a chiral lactone. The cycloalkanone can comprise a cyclobutanone, a cyclopentanone, a cyclohexanone, a 2-methylcyclopentanone, a 2-methylcyclohexanone, a cyclohex-2-ene-1-one, a 2-(cyclohex-1-enyl)cyclohexanone, a 1,2-cyclohexanedione, a 1,3-cyclohexanedione or a 1,4-cyclohexanedione.

In one aspect, the monooxygenase activity comprises a chlorophenol 4-monooxygenase activity or a xylene monooxygenase activity.

The invention provides a pharmaceutical composition comprising a polypeptide of the invention.

The invention provides a method for converting a ketone to its corresponding ester comprising contacting the ketone with a polypeptide of the invention under conditions wherein the polypeptide catalyzes the conversion of the ketone to its corresponding ester. In one aspect, the polypeptide has an monooxygenase activity that is enantiospecific to generate a substantially chiral product. In one aspect, the ester is an aromatic or an aliphatic ester.

The invention provides a method for converting a cycloaliphatic ketone to its corresponding lactone comprising contacting the cycloaliphatic ketone with a polypeptide of the invention under conditions wherein the polypeptide catalyzes the conversion of the cycloaliphatic ketone to its corresponding lactone. In one aspect, the polypeptide has an monooxygenase activity that is enantiospecific to generate a substantially chiral product. In one aspect, the ester or lactone has at least one of the following structures:

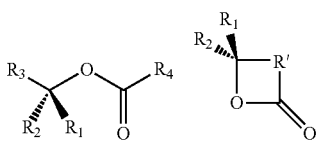

wherein: $R_1$, $R_2$, $R_3$ and $R_4$ are each independently selected from —H, substituted or unsubstituted alkyl, alkenyl, alkynyl, aryl, heteroaryl, cycloalkyl, and heterocyclic; wherein the substituted groups are substituted with one or more of lower alkyl, hydroxy, alkoxy, mercapto, cycloalkyl, heterocyclic, aryl, heteroaryl, aryloxy, and halogen, or two or more of $R_1$, $R_2$, $R_3$ and $R_4$ may together form cyclic moieties, and, R' is selected from substituted or unsubstituted alkylene, alkenylene, alkynylene, arylene, heteroarylene, cycloalkylene, and heterocyclic; wherein the substitutions are substituted with one or more of lower alkyl, hydroxy, alkoxy, mercapto, cycloalkyl, heterocyclic, aryl, heteroaryl, aryloxy, and halogen.

Nitroreductases

In one aspect, the invention provides nitroreductases, polynucleotides encoding them, and methods of making and using these polynucleotides and polypeptides. In one aspect, the invention is directed to polypeptides, e.g., enzymes, having a nitroreductase activity, including thermostable and thermotolerant nitroreductase activity, and polynucleotides encoding these enzymes, and making and using these polynucleotides and polypeptides.

Nitroreductases can catalyze the six-electron reduction of nitro compounds to the corresponding amines. Amines have a variety of applications as synthons and advanced pharmaceutical intermediates. There are markets for both aromatic amines and chiral aliphatic amines.

Nitroreductases of the invention fall in to two main classes. These are the oxygen-sensitive and oxygen-insensitive nitroreductases. The oxygen-sensitive enzyme can catalyze nitroreduction only under anaerobic conditions. A nitro anion radical is formed by a one-electron transfer and is immediately reoxidized in the presence of oxygen thus generating a futile cycle whereby reducing equivalents are consumed without nitroreduction. On the other hand the oxygen-insensitive nitroreductases catalyze nitroreduction in a series of two electron transfers, first via the nitroso and then the hydroxylamine intermediates before forming the amine.

Nitrilases

In one aspect, the invention provides nitrilases, polynucleotides encoding them, and methods of making and using these polynucleotides and polypeptides. In one aspect, the invention is directed to polypeptides, e.g., enzymes, having a nitrilase activity, including thermostable and thermotolerant nitrilase activity, and polynucleotides encoding these enzymes, and making and using these polynucleotides and polypeptides.

Nitrilases of the invention can be used for hydrolyzing a nitrile to a carboxylic acid. In one embodiment, the conditions of the reaction comprise aqueous conditions. In another embodiment, the conditions comprise a pH of about 8.0 and/or a temperature from about 37° C. to about 45° C. Nitrilases of the invention can also be used for hydrolyzing a cyanohydrin moiety or an aminonitrile moiety of a molecule. Alternatively, the nitrilases of the invention can be used for making a chiral α-hydroxy acid molecule, a chiral amino acid molecule, a chiral β-hydroxy acid molecule, or a chiral gamma-hydroxy acid molecule. In one embodiment, the chiral molecule is an (R)-enantiomer. In another embodiment, the chiral molecule is an (S)-enantiomer. In one embodiment of the invention, one particular enzyme can have R-specificity for one particular substrate and the same enzyme can have S-specificity for a different particular substrate.

In one aspect, nitrilases of the invention can be used for making a composition or an intermediate thereof, wherein the nitrilase of the invention hydrolyzes a cyanohydrin or a aminonitrile moiety. In one embodiment, the composition or intermediate thereof comprises (S)-2-amino-4-phenyl butanoic acid. In a further embodiment, the composition or intermediate thereof comprises an L-amino acid. In a further embodiment, the composition comprises a food additive or a pharmaceutical drug.

In another aspect, nitrilases of the invention can be used for making an (R)-ethyl 4-cyano-3-hydroxybutyric acid, wherein the nitrilase of the invention acts upon a hydroxyglutaryl nitrile and selectively produces an (R)-enantiomer, so as to make (R)-ethyl 4-cyano-3-hydroxybutyric acid. In one embodiment, the ee is at least 95% or at least 99%. In another embodiment, the hydroxyglutaryl nitrile comprises 1,3-dicyano-2-hydroxy-propane or 3-hydroxyglutaronitrile.

In another aspect, nitrilases of the invention can be used for making an (S)-ethyl 4-cyano-3-hydroxybutyric acid, wherein the nitrilase of the invention acts upon a hydroxyglutaryl nitrile and selectively produces an (S)-enantiomer, so as to make (S)-ethyl 4-cyano-3-hydroxybutyric acid.

In another aspect, the nitrilases of the invention can be used for making a (R)-mandelic acid, wherein the nitrilase of the invention acts upon a mandelonitrile to produce a (R)-mandelic acid. In one embodiment, the (R)-mandelic acid comprises (R)-2-chloromandelic acid. In another embodiment, the (R)-mandelic acid comprises an aromatic ring substitution in the ortho-, meta-, or para-positions; a 1-naphthyl derivative of (R)-mandelic acid, a pyridyl derivative of (R)-mandelic acid or a thienyl derivative of (R)-mandelic acid or a combination thereof.

In another aspect, the nitrilases of the invention can be used for making a (S)-mandelic acid, wherein the nitrilase of the invention acts upon a mandelonitrile to produce a (S)-mandelic acid. In one embodiment, the (S)-mandelic acid comprises (S)-methyl benzyl cyanide and the mandelonitrile comprises (S)-methoxy-benzyl cyanide. In one embodiment, the (S)-mandelic acid comprises an aromatic ring substitution in the ortho-, meta-, or para-positions; a 1-naphthyl derivative of (S)-mandelic acid, a pyridyl derivative of (S)-mandelic acid or a thienyl derivative of (S)-mandelic acid or a combination thereof.

In yet another aspect, the nitrilases of the invention can be used for making a (S)-phenyl lactic acid derivative or a (R)-phenyllacetic acid derivative, wherein the nitrilase of the invention acts upon a phenyllactonitrile and selectively produces an (S)-enantiomer or an (R)-enantiomer, thereby producing an (S)-phenyl lactic acid derivative or an (R)-phenyl lactic acid derivative.

P450 Enzymes

In one aspect, the invention provides P450 enzymes, polynucleotides encoding them, and methods of making and using these polynucleotides and polypeptides. In one aspect, the invention is directed to polypeptides, e.g., enzymes, having a P450 enzymatic activity, including thermostable and thermotolerant P450 enzymatic activity, and polynucleotides encoding these enzymes, and making and using these polynucleotides and polypeptides.

P450s are oxidative enzymes that are widespread in nature and polypeptides of the invention having P450 activity can be used in processes such as detoxifying xenobiotics, catabolism of unusual carbon sources and biosynthesis of secondary metabolites (e.g., detoxification of toxic composition, e.g., pesticides, poisons, chemical warfare agents and the like). These oxygenases activate molecular oxygen using an iron-heme center and utilize a redox electron shuttle to support the epoxidation reaction.

In one aspect, the P450 activity comprises a monooxygenation reaction. In one aspect, the P450 activity comprises catalysis of incorporation of oxygen into a substrate. In one aspect, the P450 activity can further comprise hydroxylation of aliphatic or aromatic carbons. In another aspect, the P450 activity can comprise epoxidation. Alternatively, the P450 activity can comprise N-, O-, or S-dealkylation. In one aspect, the P450 activity can comprise dehalogenation. In another aspect the P450 activity can comprise oxidative deamination. Alternatively, the P450 activity can comprise N-oxidation or N-hydroxylation. In one aspect, the P450 activity can comprise sulphoxide formation.

In one aspect, the epoxidase activity further comprises an alkene substrate. The epoxidase activity can further comprise production of a chiral product. In one aspect, the epoxidase activity can be enantioselective.

Pectate Lyases

In one aspect, the invention provides pectate lyases, e.g. pectinases, polynucleotides encoding them, and methods of making and using these polynucleotides and polypeptides. In one aspect, the invention is directed to polypeptides, e.g., enzymes, having a pectate lyase, e.g. a pectinase activity, including thermostable and thermotolerant pectate lyase, e.g. a pectinase activity, and polynucleotides encoding these enzymes, and making and using these polynucleotides and polypeptides.

The pectate lyases, e.g. pectinases, of the invention can be used to catalyze the beta-elimination or hydrolysis of pectin and/or polygalacturonic acid, such as 1,4-linked alpha-D-galacturonic acid. They can be used in variety of industrial applications, e.g., to treat plant cell walls, such as those in cotton or other natural fibers. In another exemplary industrial application, the polypeptides of the invention can be used in textile scouring.

In one aspect, pectate lyase activity comprises catalysis of beta-elimination (trans-elimination) or hydrolysis of pectin or polygalacturonic acid (pectate). The pectate lyase activity can comprise the breakup or dissolution of plant cell walls. The pectate lyase activity can comprise beta-elimination (trans-elimination) or hydrolysis of 1,4-linked alpha-D-galacturonic acid. The pectate lyase activity can comprise catalysis of beta-elimination (trans-elimination) or hydrolysis of methyl-esterified galacturonic acid. The pectate lyase activity can be exo-acting or endo-acting. In one aspect, the pectate lyase activity is endo-acting and acts at random sites within a polymer chain to give a mixture of oligomers. In one aspect, the pectate lyase activity is exo-acting and acts from one end of a polymer chain and produces monomers or dimers. The pectate lyase activity can catalyze the random cleavage of alpha-1,4-glycosidic linkages in pectic acid (polygalacturonic acid) by trans-elimination or hydrolysis. The pectate lyase activity can comprise activity the same or similar to pectate lyase (EC 4.2.2.2), poly(1,4-alpha-D-galacturonide) lyase, polygalacturonate lyase (EC 4.2.2.2), pectin lyase (EC 4.2.2.10), polygalacturonase (EC 3.2.1.15), exo-polygalacturonase (EC 3.2.1.67), exo-polygalacturonate lyase (EC 4.2.2.9) or exo-poly-alpha-galacturonosidase (EC 3.2.1.82). The pectate lyase activity can comprise beta-elimination (trans-elimination) or hydrolysis of galactan to galactose or galactooligomers. The pectate lyase activity can comprise beta-elimination (trans-elimination) or hydrolysis of a plant fiber. The plant fiber can comprise cotton fiber, hemp fiber or flax fiber.

The pectate lyases, e.g. pectinases, of the invention can be used for hydrolyzing, breaking up or disrupting a pectin- or pectate (polygalacturonic acid)-comprising composition, for liquefying or removing a pectin or pectate (polygalacturonic acid) from a composition. Alternatively, the pectate lyases, e.g. pectinases, of the invention can be used in detergent compositions. In one aspect, the pectate lyase is a nonsurface-active pectate lyase or a surface-active pectate lyase. The pectate lyase can be formulated in a non-aqueous liquid composition, a cast solid, a granular form, a particulate form, a compressed tablet, a gel form, a paste or a slurry form.

In one aspect, the pectate lyases, e.g. pectinases, of the invention can be used for washing an object. In another aspect, textiles or fabrics comprise a polypeptide of the invention, or a polypeptide encoded by a nucleic acid of the invention, wherein the polypeptide has pectate lyase, e.g. pectinase activity. Additionally, the pectate lyases, e.g. pectinases, of the invention can be used for fiber, thread, textile or fabric scouring. In one aspect, the pectate lyase is an alkaline active and thermostable pectate lyase. The desizing and scouring treatments can be combined in a single bath. The method can further comprise addition of an alkaline and thermostable amylase. The desizing or scouring treatments can comprise conditions of between about pH 8.5 to pH 10.0 and temperatures of at about 40° C. The method can further comprise addition of a bleaching step. The desizing, scouring and bleaching treatments can be done simultaneously or sequentially in a single-bath container. The bleaching treatment can comprise hydrogen peroxide or at least one peroxy compound that can generate hydrogen peroxide when dissolved in water, or combinations thereof, and at least one bleach activator. The fiber, thread, textile or fabric can comprise a cellulosic material. The cellulosic material can comprise a crude fiber, a yarn, a woven or knit textile, a cotton, a linen, a flax, a ramie, a rayon, a hemp, a jute or a blend of natural or synthetic fibers.

Alternatively, the pectate lyases, e.g. pectinases, of the invention can be used in feeds or foods. For example, the pectate lyases, e.g. pectinases, of the invention can be used to improve the extraction of oil from an oil-rich plant material. In one aspect, the oil-lich plant material comprises an oil-rich seed. The oil can be a soybean oil, an olive oil, a rapeseed (canola) oil or a sunflower oil.

In another aspect, the pectate lyases, e.g. pectinases, of the invention can be used for preparing a fruit or vegetable juice, syrup, puree or extract. In yet another aspect, the pectate lyases, e.g. pectinases, of the invention can used for treating a paper or a paper or wood pulp. Alternatively, the invention provides papers or paper products or paper pulps comprising a pectate lyase of the invention, or a polypeptide encoded by a nucleic acid of the invention.

In yet another aspect, the invention provides pharmaceutical compositions comprising a polypeptide of the invention, or a polypeptide encoded by a nucleic acid of the invention, wherein the polypeptide has pectate lyase, e.g. pectinase activity. The pharmaceutical composition can act as a digestive aid.

Alternatively, the invention provides oral care products comprising a polypeptide of the invention, or a polypeptide encoded by a nucleic acid of the invention, wherein the polypeptide has pectate lyase, e.g. pectinase activity. The oral care product can comprise a toothpaste, a dental cream, a gel or a tooth powder, an odontic, a mouth wash, a pre- or post brushing rinse formulation, a chewing gum, a lozenge or a candy.

Phosphatases

In one aspect, the invention provides phosphatases, polynucleotides encoding them, and methods of making and using these polynucleotides and polypeptides. In one aspect, the invention is directed to polypeptides, e.g., enzymes, having a phosphatase activity, including thermostable and thermotolerant phosphatase activity, and polynucleotides encoding these enzymes, and making and using these polynucleotides and polypeptides.

Phosphatases are a group of enzymes that remove phosphate groups from organophosphate ester compounds. There are numerous phosphatases, including alkaline phosphatases, phosphodiesterases and phytases.

Alkaline phosphatases are widely distributed enzymes and are composed of a group of enzymes which hydrolyze organic phosphate ester bonds at alkaline pH.

Phosphodiesterases are capable of hydrolyzing nucleic acids by hydrolyzing the phosphodiester bridges of DNA and RNA. The classification of phosphodiesterases depends upon which side of the phosphodiester bridge is attacked. The 3' enzymes specifically hydrolyze the ester linkage between the 3' carbon and the phosphoric group whereas the 5' enzymes hydrolyze the ester linkage between the phosphoric group and the 5' carbon of the phosphodiester bridge. The best known of the class 3' enzymes is a phosphodiesterase from the venom of the rattlesnake or from a rustle's viper, which hydrolyses all the 3' bonds in either RNA or DNA liberating nearly all the nucleotide units as nucleotide 5' phosphates. This enzyme requires a free 3' hydroxyl group on the terminal nucleotide residue and proceeds stepwise from that end of the polynucleotide chain. This enzyme and all other nucleases which attack only at the ends of the polynucleotide chains are called exonucleases. The 5' enzymes are represented by a phosphodiesterase from bovine spleen, also an exonuclease, which hydrolyses all the 5' linkages of both DNA and RNA and thus liberates only nucleoside 3' phosphates. It begins its attack at the end of the chain having a free 3' hydroxyl group.

Phytase enzymes remove phosphate from phytic acid (inositol hexaphosphoric acid), a compound found in plants such as corn, wheat and rice. The enzyme has commercial use for the treatment of animal feed, making the inositol of the phytic acid available for animal nutrition. Phytases are used to improve the utilization of natural phosphorus in animal feed. Use of phytase as a feed additive enables the animal to metabolize a larger degree of its cereal feed's natural mineral content thereby reducing or altogether eliminating the need for synthetic phosphorus additives. More important than the reduced need for phosphorus additives is the corresponding reduction of phosphorus in pig and chicken waste. Many European countries severely limit the amount of manure that can be spread per acre due to concerns regarding phosphorus contamination of ground water.

Alkaline phosphatases hydrolyze monophosphate esters, releasing an organic phosphate and the cognate alcohol compound. It is non-specific with respect to the alcohol moiety and it is this feature which accounts for the many uses of this enzyme.

Phospholipases

In one aspect, the invention provides phospholipases, polynucleotides encoding them, and methods of making and using these polynucleotides and polypeptides. In one aspect, the invention is directed to polypeptides, e.g., enzymes, having a phospholipase activity, including thermostable and thermotolerant phospholipase activity, and polynucleotides encoding these enzymes, and making and using these polynucleotides and polypeptides.

Phospholipases are enzymes that hydrolyze the ester bonds of phospholipids. Corresponding to their importance in the metabolism of phospholipids, these enzymes are widespread among prokaryotes and eukaryotes. The phospholipases affect the metabolism, construction and reorganization of biological membranes and are involved in signal cascades. Several types of phospholipases are known which differ in their specificity according to the position of the bond attacked in the phospholipid molecule. Phospholipase A1 (PLA1) removes the 1-position fatty acid to produce free fatty acid and 1-lyso-2-acylphospholipid. Phospholipase A2 (PLA2) removes the 2-position fatty acid to produce free fatty acid and 1-acyl-2-lysophospholipid. PLA1 and PLA2 enzymes can be intra- or extra-cellular, membrane-bound or soluble. Intracellular PLA2 is found in almost every mammalian cell. Phospholipase C (PLC) removes the phosphate moiety to produce 1,2 diacylglycerol and phospho base. Phospholipase D (PLD) produces 1,2-diacylglycerophosphate and base group. PLC and PLD are important in cell function and signaling. PLD had been the dominant phospholipase in biocatalysis. Patatins are another type of phospholipase, thought to work as a PLA.

The invention provides methods for cleaving a glycerolphosphate ester linkage comprising the following steps: (a) providing a polypeptide having a phospholipase activity, wherein the polypeptide comprises an amino acid sequence of the invention, or the polypeptide is encoded by a nucleic acid of the invention; (b) providing a composition comprising a glycerolphosphate ester linkage; and, (c) contacting the polypeptide of step (a) with the composition of step (b) under conditions wherein the polypeptide cleaves the glycerolphosphate ester linkage. In one aspect, the conditions comprise between about pH 5 to about 5.5, or, between about pH 4.5 to about 5.0. In one aspect, the conditions comprise a temperature of between about 40° C. and about 70° C. In one aspect, the composition comprises a vegetable oil. In one aspect, the composition comprises an oilseed phospholipid. In one aspect, the cleavage reaction can generate a water extractable phosphorylated base and a diglyceride.

Phospholipases of the invention can be used in oil degumming, wherein the phospholipase is used under conditions wherein the phospholipase can cleave ester linkages in an oil, thereby degumming the oil. In one aspect, the oil is a vegetable oil. In another aspect, the vegetable oil comprises oilseed. The vegetable oil can comprise palm oil, rapeseed oil, corn oil, soybean oil, canola oil, sesame oil, peanut oil or sunflower oil. In one aspect, the method further comprises addition of a phospholipase of the invention, another phospholipase, another enzyme, or a combination thereof.

In another aspect of the invention, phospholipases of the invention can be used for converting a non-hydratable phospholipid to a hydratable form or for caustic refining of a phospholipid-containing composition. In the latter use, the polypeptide of the invention can be added before caustic refining and the composition comprising the phospholipid can comprise a plant and the polypeptide can be expressed transgenically in the plant, the polypeptide having a phospholipase activity can be added during crushing of a seed or other plant part, or, the polypeptide having a phospholipase activity is added following crushing or prior to refining. The polypeptide can be added during caustic refining and varying levels of acid and caustic can be added depending on levels of phosphorous and levels of free fatty acids. The polypeptide can be added after caustic refining: in an intense mixer or retention mixer prior to separation; following a heating step; in a centrifuge; in a soapstock; in a washwater; or, during bleaching or deodorizing steps.

In yet another aspect, the phospholipases of the invention can be used for purification of a phytosterol or a triterpene. The phytosterol or a triterpene can comprise a plant sterol. The plant sterol can be derived from a vegetable oil. The vegetable oil can comprise a coconut oil, canola oil, cocoa butter oil, corn oil, cottonseed oil, linseed oil, olive oil, palm oil, peanut oil, oil derived from a rice bran, safflower oil, sesame oil, soybean oil or a sunflower oil. The method can comprise use of nonpolar solvents to quantitatively extract free phytosterols and phytosteryl fatty-acid esters. The phytosterol or a triterpene can comprise a β-sitosterol, a campesterol, a stigmasterol, a stigmastanol, a β-sitostanol, a sitostanol, a desmosterol, a chalinasterol, a poriferasterol, a clionasterol or a brassicasterol.

In one embodiment, the phospholipases of the invention can be used for refining a crude oil. The polypeptide can have a phospholipase activity is in a water solution that is added to the composition. The water level can be between about 0.5 to 5%. The process time can be less than about 2 hours, less than about 60 minutes, less than about 30 minutes, less than 15 minutes, or less than 5 minutes. The hydrolysis conditions can comprise a temperature of between about 25° C.-70° C. The hydrolysis conditions can comprise use of caustics. The hydrolysis conditions can comprise a pH of between about pH 3 and pH 10, between about pH 4 and pH 9, or between about pH 5 and pH 8. The hydrolysis conditions can comprise addition of emulsifiers and/or mixing after the contacting of step (c). The methods can comprise addition of an emulsion-breaker and/or heat to promote separation of an aqueous phase. The methods can comprise degumming before the contacting step to collect lecithin by centrifugation and then adding a PLC, a PLC and/or a PLA to remove non-hydratable phospholipids. The methods can comprise water degumming of crude oil to less than 10 ppm for edible oils and subsequent physical refining to less than about 50 ppm for biodiesel oils. The methods can comprise addition of acid to promote hydration of non-hydratable phospholipids.

Phytases

In one aspect, the invention provides phytases, polynucleotides encoding them, and methods of making and using these polynucleotides and polypeptides. In one aspect, the invention is directed to polypeptides, e.g., enzymes, having a phytase activity, including thermostable and thermotolerant phytase activity, and polynucleotides encoding these enzymes, and making and using these polynucleotides and polypeptides.

Conversion of phytate to inositol and inorganic phosphorous can be catalyzed by phytase enzymes. Phytases such as phytase #EC 3.1.3.8 are capable of catalyzing the hydrolysis of myo-inositol hexaphosphate to D-myo-inositol 1,2,4,5,6-pentaphosphate and orthophosphate. Other phytases hydrolyze inositol pentaphosphate to tetra-, tri-, and lower phosphates. Acid phosphatases are enzymes that catalytically hydrolyze a wide variety of phosphate esters. For example, #EC 3.1.3.2 enzymes catalyze the hydrolysis of orthophosphoric monoesters to orthophosphate products.

Phytases of the invention can be used in producing phytase as a feed additive, e.g. for monogastric animals, fish, poultry, ruminants and other non-ruminants. Phytases of the invention can also be used for producing animal feed from certain industrial processes, e.g., wheat and corn waste products. In one aspect, the wet milling process of corn produces glutens sold as animal feeds. The addition of phytase improves the nutritional value of the feed product.

Phytases of the invention may also be used in dietary aids or in pharmaceutical compositions, for reducing pollution and increasing nutrient availability in an environment or environmental sample by degrading environmental phytic acid, for liberating minerals from phytates in plant materials either in vitro, i.e., in feed treatment processes, or in vivo, i.e., by administering the enzymes to animals.

Polymerases

In one aspect, the invention provides polymerases, polynucleotides encoding them, and methods of making and using these polynucleotides and polypeptides. In one aspect, the invention is directed to polypeptides, e.g., enzymes, having a polymerase activity, including thermostable and thermotolerant polymerase activity, and polynucleotides encoding these enzymes, and making and using these polynucleotides and polypeptides.

The polymerase enzymes of the invention can have different polymerase activities at various high temperatures. In one aspect, the polymerase activity comprises addition of deoxynucleotides at the 3' hydroxyl end of a polynucleotide. The invention also provides kits, e.g., diagnostic kits, and methods for performing various amplification reactions, e.g., polymerase chain reactions, transcription amplifications, ligase chain reactions, self-sustained sequence replication or Q Beta replicase amplifications.

In one aspect, the polymerase activity comprises addition of nucleotides at the 3' hydroxyl end of a nucleic acid. The polymerase activity can comprise a 5'→3' polymerase activity, a 3'→5' exonuclease activity or a 5'→3' exonuclease activity or all or a combination thereof. In one aspect, the polymerase activity comprises only a 5'→3' polymerase activity, but not a 3'→5' exonuclease activity or a 5'→3' exonuclease activity. In another aspect, the polymerase activity can comprise a 5'→3' polymerase activity and a 3'→5' exonuclease activity, but not a 5'→3' exonuclease activity. Alternatively, the polymerase activity can comprise a 5'→3' polymerase activity and a 5'→3' exonuclease activity, but not a 3'→5' exonuclease activity. The polymerase activity can comprise addition of dUTP or dITP. The polymerase activity can comprise addition of a modified or a non-natural nucleotide to a polynucleotide, such as an analog of guanine, cytosine, thymine, adenine or uracil, e.g., a 2-aminopurine, an inosine or a 5-methylcytosine.

In one aspect, the polymerase activity can comprise strand displacement properties. In one aspect, the polymerase activity comprises reverse transcriptase activity.

Proteases

In one aspect, the invention provides proteases, polynucleotides encoding them, and methods of making and using these polynucleotides and polypeptides. In one aspect, the invention is directed to polypeptides, e.g., enzymes, having a protease activity, including thermostable and thermotolerant protease activity, and polynucleotides encoding these enzymes, and making and using these polynucleotides and polypeptides.

Proteases of the invention can be carbonyl hydrolases which act to cleave peptide bonds of proteins or peptides. Proteolytic enzymes are ubiquitous in occurrence, found in all living organisms, and are essential for cell growth and differentiation. The extracellular proteases are of commercial value and find multiple applications in various industrial sectors. Industrial applications of proteases include food processing, brewing, alcohol production, peptide synthesis, enantioselectivity, hide preparation in the leather industry, waste management and animal degradation, silver recovery in the photographic industry, medical treatment, silk degumming, biofilm degradation, biomass conversion to ethanol, biodefense, antimicrobial agents and disinfectants, personal care and cosmetics, biotech reagents and in increasing starch yield from corn wet milling. Additionally, proteases are important components of laundry detergents and other products. Within biological research, proteases are used in purification processes to degrade unwanted proteins. It is often desirable to employ proteases of low specificity or mixtures of more specific proteases to obtain the necessary degree of degradation.

Proteases are classified according to their catalytic mechanisms. The International Union of Biochemistry and Molecular Biology (IUBMB) recognizes four mechanistic classes: (1) the serine proteases; (2) the cysteine proteases; (3) the aspartic proteases; and (4) the metalloproteases. In addition, the IUBMB recognizes a class of endopeptidases (oligopeptidases) of unknown catalytic mechanism. The serine proteases have alkaline pH optima, the metalloproteases are optimally active around neutrality, and the cysteine and aspartic enzymes have acidic pH optima. Serine proteases class comprises two distinct families: the chymotrypsin family, which includes the mammalian enzymes such as chymotrypsin, trypsin, elastase, or kallikrein, and the subtilisin family, which include the bacterial enzymes such as subtilisin. Serine proteases are used for a variety of industrial purposes, such as laundry detergents to aid in the removal of proteinaceous stains. In the food processing industry, serine proteases are used to produce protein-rich concentrates from fish and livestock, and in the preparation of dairy products.

The proteases of the invention can be used in a variety of diagnostic, therapeutic, and industrial contexts. The proteases of the invention can be used as, e.g., an additive for a detergent, for processing foods and for chemical synthesis utilizing a reverse reaction. Additionally, the proteases of the invention can be used in food processing, brewing, bath additives, alcohol production, peptide synthesis, enantioselectivity, hide preparation in the leather industry, waste management and animal degradation, silver recovery in the photographic industry, medical treatment, silk degumming, biofilm degradation, biomass conversion to ethanol, biodefense, antimicrobial agents and disinfectants, personal care and cosmetics, biotech reagents, in increasing starch yield from corn wet milling and pharmaceuticals such as digestive aids and anti-inflammatory (anti-phlogistic) agents.

Xylanases

In one aspect, the invention provides xylanases, polynucleotides encoding them, and methods of making and using these polynucleotides and polypeptides. In one aspect, the invention is directed to polypeptides, e.g., enzymes, having a xylanase activity, including thermostable and thermotolerant xylanase activity, and polynucleotides encoding these enzymes, and making and using these polynucleotides and polypeptides.

Xylanases (e.g., endo-1,4-beta-xylanase, EC 3.2.1.8) of the invention can hydrolyze internal β-1,4-xylosidic linkages in xylan to produce smaller molecular weight xylose and xylo-oligomers. Xylans are polysaccharides formed from 1,4-β-glycoside-linked D-xylopyranoses. Xylanases of the invention are of considerable commercial value, being used in the food industry, for baking and fruit and vegetable processing, breakdown of agricultural waste, in the manufacture of animal feed and in pulp and paper production.

Arabinoxylanase are major non-starch polysaccharides of cereals representing 2.5-7.1% w/w depending on variety and growth conditions. The physicochemical properties of this polysaccharide are such that it gives rise to viscous solutions or even gels under oxidative conditions. In addition, arabinoxylans have high water-binding capacity and may have a role in protein foam stability. All of these characteristics present problems for several industries including brewing, baking, animal nutrition and paper manufacturing. In brewing applications, the presence of xylan results in wort filterability and haze formation issues. In baking applications (especially for cookies and crackers), these arabinoxylans create sticky doughs that are difficult to machine and reduce biscuit size. In addition, this carbohydrate is implicated in rapid rehydration of the baked product resulting in loss of crispiness and reduced shelf-life. For monogastric animal feed applications with cereal diets, arabinoxylan is a major contributing factor to viscosity of gut contents and thereby adversely affects the digestibility of the feed and animal growth rate. For ruminant animals, these polysaccharides represent substantial components of fiber intake and more complete digestion of arabinoxylans would facilitate higher feed conversion efficiencies.

Xylanases are currently used as additives (dough conditioners) in dough processing for the hydrolysis of water soluble arabinoxylan. In baking applications (especially for cookies and crackers), arabinoxylan creates sticky doughs that are difficult to machine and reduce biscuit size. In addition, this carbohydrate is implicated in rapid rehydration of the baked product resulting in loss of crispiness and reduced shelf-life.

The enhancement of xylan digestion in animal feed may improve the availability and digestibility of valuable carbohydrate and protein feed nutrients. For monogastric animal feed applications with cereal diets, arabinoxylan is a major contributing factor to viscosity of gut contents and thereby adversely affects the digestibility of the feed and animal growth rate. For ruminant animals, these polysaccharides represent substantial components of fiber intake and more complete digestion would facilitate higher feed conversion efficiencies. It is desirable for animal feed xylanases to be active in the animal stomach. This requires a feed enzyme to have high activity at 37° C. and at low pH for monogastrics (pH 2-4) and near neutral pH for ruminants (pH 6.5-7). The enzyme should also possess resistance to animal gut xylanases and stability at the higher temperatures involved in feed pelleting. As such, there is a need in the art for xylanase feed additives for monogastric feed with high specific activity, activity at 35-40° C. and pH 2-4, half life greater than 30 minutes in SGF and a half-life >5 minutes at 85° C. in formulated state. For ruminant feed, there is a need for xylanase feed additives that have a high specific activity, activity at 35-40° C. and pH 6.5-7.0, half life greater than 30 minutes in SRF and stability as a concentrated dry powder.

In one aspect, the xylanases of the invention are also used in improving the quality and quantity of milk protein production in lactating cows, increasing the amount of soluble saccharides in the stomach and small intestine of pigs, improving late egg production efficiency and egg yields in hens. Additionally, xylanases of the inventions can be used in biobleaching and treatment of chemical pulps, biobleaching and treatment of wood or paper pulps, in reducing lignin in wood and modifying wood, as feed additives and/or supplements or in manufacturing cellulose solutions. Detergent compositions comprising xylanases of the invention are used for fruit, vegetables and/or mud and clay compounds.

In another aspect, xylanases of the invention can be used in compositions for the treatments and/or prophylaxis of coccidiosis. In yet another aspect, xylanases of the invention can be used in the production of water soluble dietary fiber, in improving the filterability, separation and production of starch, the beverage industry in improving filterability of wort or beer, in reducing viscosity of plant material, or in increasing viscosity or gel strength of food products such as jam, marmalade, jelly, juice, paste, soup, salsa, etc. Xylanases of the invention may also be used in hydrolysis of hemicellulose for which it is selective, particularly in the presence of cellulose. In addition, xylanases of the invention can also be used in the production of ethanol, in transformation of a microbe that produces ethanol, in production of oenological tannins and enzymatic composition, in stimulating the natural defenses of plants, in production of sugars from hemicellulose substrates, in the cleaning of fruit, vegetables, mud or clay containing soils, in cleaning beer filtration membranes, and in killing or inhibiting microbial cells.

Table 1, below, lists the various EC (Enzyme Commission) Numbers along with the corresponding mode of action for each enzyme class, subclass and sub-subclass. Enzyme nomenclature is based upon the recommendations of the Nomenclature Committee of the International Union of Biochemistry and Molecular Biology (IUBMB). Table 2, below, lists the various EC Numbers along with the corresponding name given to each enzyme class, subclass and sub-subclass. Tables 1 and 2 list exemplary enzymatic activities of polypeptides of the invention, as can be determined by sequence identity (e.g., homology); and in one embodiment a sequence of the invention comprises an enzyme having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more sequence identity (homology) to an enzyme encoded by an exemplary sequence of the invention, including all odd numbered SEQ ID NO:1 to SEQ ID NO:26,897, or an exemplary polypeptide of the invention, including all even numbered SEQ ID NO:2 to SEQ ID NO:26,898, and with an exemplary function as listed in Table 1 or Table 2.

Table 3, below, contains the exemplary SEQ ID NOs: of the invention, and the closest hit (BLAST) information for the polynucleotides and polypeptides of the invention. This information includes the closest hit organism, accession number, definition of the closest hit, EC number, percentage amino acid identity and the percent nucleotide identity, along with the Evalue for the closest hits. The information contained in Table 3 identifies exemplary activities of polypeptides of the invention, based on sequence identity (homology). In one embodiment a sequence of the invention comprises an enzyme with at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more sequence identity (homology) to an enzyme as listed in Table 3.

TABLE 1

EC (Enzyme Commission) Numbers with the corresponding mode of action for each enzyme class, subclass and sub-subclass

| | |
|---|---|
| 1.—.—.— | Oxidoreductases. |
| 1.1.—.— | Acting on the CH—OH group of donors. |
| 1.1.1.— | With NAD(+) or NADP(+) as acceptor. |
| 1.1.2.— | With a cytochrome as acceptor. |
| 1.1.3.— | With oxygen as acceptor. |
| 1.1.4.— | With a disulfide as acceptor. |
| 1.1.5.— | With a quinone or similar compound as acceptor. |
| 1.1.99.— | With other acceptors. |
| 1.2.—.— | Acting on the aldehyde or oxo group of donors. |

TABLE 1-continued

EC (Enzyme Commission) Numbers with the corresponding mode of action for each enzyme class, subclass and sub-subclass

| | |
|---|---|
| 1.2.1.— | With NAD(+) or NADP(+) as acceptor. |
| 1.2.2.— | With a cytochrome as acceptor. |
| 1.2.3.— | With oxygen as acceptor. |
| 1.2.4.— | With a disulfide as acceptor. |
| 1.2.7.— | With an iron-sulfur protein as acceptor. |
| 1.2.99.— | With other acceptors. |
| 1.3.—.— | Acting on the CH—CH group of donors. |
| 1.3.1.— | With NAD(+) or NADP(+) as acceptor. |
| 1.3.2.— | With a cytochrome as acceptor. |
| 1.3.3.— | With oxygen as acceptor. |
| 1.3.5.— | With a quinone or related compound as acceptor. |
| 1.3.7.— | With an iron-sulfur protein as acceptor. |
| 1.3.99.— | With other acceptors. |
| 1.4.—.— | Acting on the CH—NH(2) group of donors. |
| 1.4.1.— | With NAD(+) or NADP(+) as acceptor. |
| 1.4.2.— | With a cytochrome as acceptor. |
| 1.4.3.— | With oxygen as acceptor. |
| 1.4.4.— | With a disulfide as acceptor. |
| 1.4.7.— | With an iron-sulfur protein as acceptor. |
| 1.4.99.— | With other acceptors. |
| 1.5.—.— | Acting on the CH—NH group of donors. |
| 1.5.1.— | With NAD(+) or NADP(+) as acceptor. |
| 1.5.3.— | With oxygen as acceptor. |
| 1.5.4.— | With a disulfide as acceptor. |
| 1.5.5.— | With a quinone or similar compound as acceptor. |
| 1.5.8.— | With a flavin as acceptor. |
| 1.5.99.— | With other acceptors. |
| 1.6.—.— | Acting on NADH or NADPH. |
| 1.6.1.— | With NAD(+) or NADP(+) as acceptor. |
| 1.6.2.— | With a heme protein as acceptor. |
| 1.6.3.— | With a oxygen as acceptor. |
| 1.6.4.— | With a disulfide as acceptor. |
| 1.6.5.— | With a quinone or similar compound as acceptor. |
| 1.6.6.— | With a nitrogenous group as acceptor. |
| 1.6.8.— | With a flavin as acceptor. |
| 1.6.99.— | With other acceptors. |
| 1.7.—.— | Acting on other nitrogenous compounds as donors. |
| 1.7.1.— | With NAD(+) or NADP(+) as acceptor. |
| 1.7.2.— | With a cytochrome as acceptor. |
| 1.7.3.— | With oxygen as acceptor. |
| 1.7.7.— | With an iron-sulfur protein as acceptor. |
| 1.7.99.— | With other acceptors. |
| 1.8.—.— | Acting on a sulfur group of donors. |
| 1.8.1.— | With NAD(+) or NADP(+) as acceptor. |
| 1.8.2.— | With a cytochrome as acceptor. |
| 1.8.3.— | With oxygen as acceptor. |
| 1.8.4.— | With a disulfide as acceptor. |
| 1.8.5.— | With a quinone or similar compound as acceptor. |
| 1.8.7.— | With an iron-sulfur protein as acceptor. |
| 1.8.98.— | With other, known, acceptors. |
| 1.8.99.— | With other acceptors. |
| 1.9.—.— | Acting on a heme group of donors. |
| 1.9.3.— | With oxygen as acceptor. |
| 1.9.6.— | With a nitrogenous group as acceptor. |
| 1.9.99.— | With other acceptors. |
| 1.10.—.— | Acting on diphenols and related substances as donors. |
| 1.10.1.— | With NAD(+) or NADP(+) as acceptor. |
| 1.10.2.— | With a cytochrome as acceptor. |
| 1.10.3.— | With oxygen as acceptor. |
| 1.10.99.— | With other acceptors. |
| 1.11.—.— | Acting on a peroxide as acceptor (peroxidases). |
| 1.12.—.— | Acting on hydrogen as donor. |
| 1.12.1.— | With NAD(+) or NADP(+) as acceptor. |
| 1.12.2.— | With a cytochrome as acceptor. |
| 1.12.5.— | With a quinone or similar compound as acceptor. |
| 1.12.7.— | With an iron-sulfur protein as acceptor. |
| 1.12.98.— | With other known acceptors. |
| 1.12.99.— | With other acceptors. |

TABLE 1-continued

EC (Enzyme Commission) Numbers with the corresponding mode of action for each enzyme class, subclass and sub-subclass

| | |
|---|---|
| 1.13.—.— | Acting on single donors with incorporation of molecular oxygen. |
| 1.13.11.— | With incorporation of two atoms of oxygen. |
| 1.13.12.— | With incorporation of one atom of oxygen. |
| 1.14.—.— | Acting on paired donors, with incorporation or reduction of molecular oxygen |
| 1.14.11.— | With 2-oxoglutarate as one donor, and incorporation of one atom each of oxygen into both donors |
| 1.14.12.— | With NADH or NADPH as one donor, and incorporation of two atoms of oxygen into one donor |
| 1.14.13.— | With NADH or NADPH as one donor, and incorporation of one atom of oxygen |
| 1.14.14.— | With reduced flavin or flavoprotein as one donor, and incorporation of one atom of oxygen |
| 1.14.15.— | With a reduced iron-sulfur protein as one donor, and incorporation of one atom of oxygen |
| 1.14.16.— | With reduced pteridine as one donor, and incorporation of one atom of oxygen |
| 1.14.17.— | With reduced ascorbate as one donor, and incorporation of one atom of oxygen |
| 1.14.18.— | With another compound as one donor, and incorporation of one incorporation of one atom of oxygen |
| 1.14.19.— | With oxidation of a pair of donors resulting in the reduction of molecular oxygen to two molecules of water |
| 1.14.20.— | With 2-oxoglutarate as one donor, and the other dehydrogenated. |
| 1.14.21.— | With NADH or NADPH as one donor, and the other dehydrogenated. |
| 1.15.—.— | Acting on superoxide as acceptor. |
| 1.16.—.— | Oxidizing metal ions. |
| 1.16.1.— | With NAD(+) or NADP(+) as acceptor. |
| 1.16.3.— | With oxygen as acceptor. |
| 1.16.8.— | With flavin as acceptor. |
| 1.17.—.— | Acting on CH or CH(2) groups. |
| 1.17.1.— | With NAD(+) or NADP(+) as acceptor. |
| 1.17.3.— | With oxygen as acceptor. |
| 1.17.4.— | With a disulfide as acceptor. |
| 1.17.5.— | With a quinone or similar compound as acceptor |
| 1.17.99.— | With other acceptors. |
| 1.18.—.— | Acting on iron-sulfur proteins as donors. |
| 1.18.1.— | With NAD(+) or NADP(+) as acceptor. |
| 1.18.6.— | With dinitrogen as acceptor. |
| 1.18.96.— | With other, known, acceptors. |
| 1.18.99.— | With H(+) as acceptor. |
| 1.19.—.— | Acting on reduced flavodoxin as donor. |
| 1.19.6.— | With dinitrogen as acceptor. |
| 1.20.—.— | Acting on phosphorus or arsenic in donors. |
| 1.20.1.— | Acting on phosphorus or arsenic in donors, with NAD(P)(+) as acceptor |
| 1.20.4.— | Acting on phosphorus or arsenic in donors, with disulfide as acceptor |
| 1.20.98.— | Acting on phosphorus or arsenic in donors, with other, known acceptors |
| 1.20.99.— | Acting on phosphorus or arsenic in donors, with other acceptors |
| 1.21.—.— | Acting on x-H and y-H to form an x-y bond. |
| 1.21.3.— | With oxygen as acceptor. |
| 1.21.4.— | With a disulfide as acceptor. |
| 1.21.99.— | With other acceptors. |
| 1.97.—.— | Other oxidoreductases. |
| 2.—.—.— | Transferases. |
| 2.1.—.— | Transferring one-carbon groups. |
| 2.1.1.— | Methyltransferases. |
| 2.1.2.— | Hydroxymethyl-, formyl- and related transferases. |
| 2.1.3.— | Carboxyl- and carbamoyltransferases. |
| 2.1.4.— | Amidinotransferases. |
| 2.2.—.— | Transferring aldehyde or ketone residues. |
| 2.2.1.— | Transketolases and transaldolases. |
| 2.3.—.— | Acyltransferases. |
| 2.3.1.— | Transferring groups other than amino-acyl groups. |
| 2.3.2.— | Aminoacyltransferases. |
| 2.3.3.— | Acyl groups converted into alkyl on transfer. |
| 2.4.—.— | Glycosyltransferases. |
| 2.4.1.— | Hexosyltransferases. |
| 2.4.2.— | Pentosyltransferases. |
| 2.4.99.— | Transferring other glycosyl groups. |
| 2.5.—.— | Transferring alkyl or aryl groups, other than methyl groups. |
| 2.6.—.— | Transferring nitrogenous groups. |
| 2.6.1.— | Transaminases (aminotransferases). |
| 2.6.3.— | Oximinotransferases. |
| 2.6.99.— | Transferring other nitrogenous groups. |
| 2.7.—.— | Transferring phosphorous-containing groups. |
| 2.7.1.— | Phosphotransferases with an alcohol group as acceptor. |
| 2.7.2.— | Phosphotransferases with a carboxyl group as acceptor. |
| 2.7.3.— | Phosphotransferases with a nitrogenous group as acceptor. |
| 2.7.4.— | Phosphotransferases with a phosphate group as acceptor. |
| 2.7.6.— | Diphosphotransferases. |
| 2.7.7.— | Nucleotidyltransferases. |
| 2.7.8.— | Transferases for other substituted phosphate groups. |
| 2.7.9.— | Phosphotransferases with paired acceptors. |
| 2.8.—.— | Transferring sulfur-containing groups. |
| 2.8.1.— | Sulfurtransferases. |
| 2.8.2.— | Sulfotransferases. |
| 2.8.3.— | CoA-transferases. |
| 2.8.4.— | Transferring alkylthio groups. |
| 2.9.—.— | Transferring selenium-containing groups. |
| 2.9.1.— | Selenotransferases. |
| 3.—.—.— | Hydrolases. |
| 3.1.—.— | Acting on ester bonds. |
| 3.1.1.— | Carboxylic ester hydrolases. |
| 3.1.2.— | Thiolester hydrolases. |
| 3.1.3.— | Phosphoric monoester hydrolases. |
| 3.1.4.— | Phosphoric diester hydrolases. |
| 3.1.5.— | Triphosphoric monoester hydrolases. |
| 3.1.6.— | Sulfuric ester hydrolases. |
| 3.1.7.— | Diphosphoric monoester hydrolases. |
| 3.1.8.— | Phosphoric triester hydrolases. |
| 3.1.11.— | Exodeoxyribonucleases producing 5'-phosphomonoesters. |
| 3.1.13.— | Exoribonucleases producing 5'-phosphomonoesters. |
| 3.1.14.— | Exoribonucleases producing 3'-phosphomonoesters. |
| 3.1.15.— | Exonucleases active with either ribo- or deoxyribonucleic acid and producing 5'-phosphomonoesters |
| 3.1.16.— | Exonucleases active with either ribo- or deoxyribonucleic acid producing 3'-phosphomonoesters |
| 3.1.21.— | Endodeoxyribonucleases producing 5'-phosphomonoesters. |
| 3.1.22.— | Endodeoxyribonucleases producing other than 5'-phosphomonoesters. |
| 3.1.25.— | Site-specific endodeoxyribonucleases specific for altered bases. |
| 3.1.26.— | Endoribonucleases producing 5'-phosphomonoesters. |
| 3.1.27.— | Endoribonucleases producing other than 5'-phosphomonoesters. |
| 3.1.30.— | Endoribonucleases active with either ribo- or deoxyribonucleic and producing 5'-phosphomonoesters |
| 3.1.31.— | Endoribonucleases active with either ribo- or deoxyribonucleic acid and producing 3'-phosphomonoesters |
| 3.2.—.— | Glycosylases. |
| 3.2.1.— | Glycosidases, i.e. enzymes hydrolyzing O- and S-glycosyl compounds |
| 3.2.2.— | Hydrolyzing N-glycosyl compounds. |

TABLE 1-continued

EC (Enzyme Commission) Numbers with the corresponding mode of action for each enzyme class, subclass and sub-subclass

| | |
|---|---|
| 3.3.—.— | Acting on ether bonds. |
| 3.3.1.— | Thioether and trialkylsulfonium hydrolases. |
| 3.3.2.— | Ether hydrolases. |
| 3.4.—.— | Acting on peptide bonds (peptide hydrolases). |
| 3.4.11.— | Aminopeptidases. |
| 3.4.13.— | Dipeptidases. |
| 3.4.14.— | Dipeptidyl-peptidases and tripeptidyl-peptidases. |
| 3.4.15.— | Peptidyl-dipeptidases. |
| 3.4.16.— | Serine-type carboxypeptidases. |
| 3.4.17.— | Metallocarboxypeptidases. |
| 3.4.18.— | Cysteine-type carboxypeptidases. |
| 3.4.19.— | Omega peptidases. |
| 3.4.21.— | Serine endopeptidases. |
| 3.4.22.— | Cysteine endopeptidases. |
| 3.4.23.— | Aspartic endopeptidases. |
| 3.4.24.— | Metalloendopeptidases. |
| 3.4.25.— | Threonine endopeptidases. |
| 3.4.99.— | Endopeptidases of unknown catalytic mechanism. |
| 3.5.—.— | Acting on carbon-nitrogen bonds, other than peptide bonds. |
| 3.5.1.— | In linear amides. |
| 3.5.2.— | In cyclic amides. |
| 3.5.3.— | In linear amides. |
| 3.5.4.— | In cyclic amidines. |
| 3.5.5.— | In nitriles. |
| 3.5.99.— | In other compounds. |
| 3.6.—.— | Acting on acid anhydrides. |
| 3.6.1.— | In phosphorous-containing anhydrides. |
| 3.6.2.— | In sulfonyl-containing anhydrides. |
| 3.6.3.— | Acting on acid anhydrides; catalyzing transmembrane movement of substances |
| 3.6.4.— | Acting on acid anhydrides; involved in cellular and subcellular movement |
| 3.6.5.— | Acting on GTP; involved in cellular and subcellular movement. |
| 3.7.—.— | Acting on carbon-carbon bonds. |
| 3.7.1.— | In ketonic substances. |
| 3.8.—.— | Acting on halide bonds. |
| 3.8.1.— | In C-halide compounds. |
| 3.9.—.— | Acting on phosphorus-nitrogen bonds. |
| 3.10.—.— | Acting on sulfur-nitrogen bonds. |
| 3.11.—.— | Acting on carbon-phosphorus bonds. |
| 3.12.—.— | Acting on sulfur-sulfur bonds. |
| 3.13.—.— | Acting on carbon-sulfur bonds. |
| 4.—.—.— | Lyases. |
| 4.1.—.— | Carbon-carbon lyases. |
| 4.1.1.— | Carboxy-lyases. |
| 4.1.2.— | Aldehyde-lyases. |
| 4.1.3.— | Oxo-acid-lyases. |
| 4.1.99.— | Other carbon-carbon lyases. |
| 4.2.—.— | Carbon-oxygen lyases. |
| 4.2.1.— | Hydro-lyases. |
| 4.2.2.— | Acting on polysaccharides. |
| 4.2.3.— | Acting on phosphates. |
| 4.2.99.— | Other carbon-oxygen lyases. |
| 4.3.—.— | Carbon-nitrogen lyases. |
| 4.3.1.— | Animonia-lyases. |
| 4.3.2.— | Lyases acting on amides, amidines, etc. |
| 4.3.3.— | Amine-lyases. |
| 4.3.99.— | Other carbon-nitrogen-lyases. |
| 4.4.—.— | Carbon-sulfur lyases. |
| 4.5.—.— | Carbon-halide lyases. |
| 4.6.—.— | Phosphorus-oxygen lyases. |
| 4.99.—.— | Other lyases. |
| 5.—.—.— | Isomerases. |
| 5.1.—.— | Racemases and epimerases. |
| 5.1.1.— | Acting on amino acids and derivatives. |
| 5.1.2.— | Acting on hydroxy acids and derivatives. |
| 5.1.3.— | Acting on carbohydrates and derivatives. |
| 5.1.99.— | Acting on other compounds. |
| 5.2.—.— | Cis-trans-isomerases. |
| 5.3.—.— | Intramolecular oxidoreductases. |
| 5.3.1.— | Interconverting aldoses and ketoses. |
| 5.3.2.— | Interconverting keto- and enol-groups. |
| 5.3.3.— | Transposing C═C bonds. |
| 5.3.4.— | Transposing S—S bonds. |
| 5.3.99.— | Other intramolecular oxidoreductases. |
| 5.4.—.— | Intramolecular transferases (mutases). |
| 5.4.1.— | Transferring acyl groups. |
| 5.4.2.— | Phosphotransferases (phosphomutases). |
| 5.4.3.— | Transferring amino groups. |
| 5.4.4.— | Transferring hydroxy groups. |
| 5.4.99.— | Transferring other groups. |
| 5.5.—.— | Intramolecular lyases. |
| 5.99.—.— | Other isomerases. |
| 6.—.—.— | Ligases. |
| 6.1.—.— | Forming carbon-oxygen bonds. |
| 6.1.1.— | Ligases forming aminoacyl-tRNA and related compounds. |
| 6.2.—.— | Forming carbon-sulfur bonds. |
| 6.2.1.— | Acid--thiol ligases. |
| 6.3.—.— | Forming carbon-nitrogen bonds. |
| 6.3.1.— | Acid--ammonia (or amide) ligases (amide synthases). |
| 6.3.2.— | Acid--D-amino-acid ligases (peptide synthases). |
| 6.3.3.— | Cyclo-ligases. |
| 6.3.4.— | Other carbon--nitrogen ligases. |
| 6.3.5.— | Carbon--nitrogen ligases with glutamine as amido-N-donor. |
| 6.4.—.— | Forming carbon-carbon bonds. |
| 6.5.—.— | Forming phosphoric ester bonds. |
| 6.6.—.— | Forming nitrogen-metal bonds. |
| 6.6.1.— | Forming nitrogen-metal bonds. |

TABLE 2

EC Numbers with the corresponding name given to each enzyme class, subclass and sub-subclass.

ENZYME: 1.—.—.—

| | |
|---|---|
| 1.1.1.1 | Alcohol dehydrogenase. |
| 1.1.1.2 | Alcohol dehydrogenase (NADP+). |
| 1.1.1.3 | Homoserine dehydrogenase. |
| 1.1.1.4 | (R,R)-butanediol dehydrogenase. |
| 1.1.1.5 | Acetoin dehydrogenase. |
| 1.1.1.6 | Glycerol dehydrogenase. |
| 1.1.1.7 | Propanediol-phosphate dehydrogenase. |
| 1.1.1.8 | Glycerol-3-phosphate dehydrogenase (NAD+). |
| 1.1.1.9 | D-xylulose reductase. |
| 1.1.1.10 | L-xylulose reductase. |
| 1.1.1.11 | D-arabinitol 4-dehydrogenase. |
| 1.1.1.12 | L-arabinitol 4-dehydrogenase. |
| 1.1.1.13 | L-arabinitol 2-dehydrogenase. |
| 1.1.1.14 | L-iditol 2-dehydrogenase. |
| 1.1.1.15 | D-iditol 2-dehydrogenase. |
| 1.1.1.16 | Galactitol 2-dehydrogenase. |
| 1.1.1.17 | Mannitol-1-phosphate 5-dehydrogenase. |
| 1.1.1.18 | Inositol 2-dehydrogenase. |
| 1.1.1.19 | L-glucuronate reductase. |
| 1.1.1.20 | Glucuronolactone reductase. |
| 1.1.1.21 | Aldehyde reductase. |
| 1.1.1.22 | UDP-glucose 6-dehydrogenase. |
| 1.1.1.23 | Histidinol dehydrogenase. |
| 1.1.1.24 | Quinate dehydrogenase. |
| 1.1.1.25 | Shikimate dehydrogenase. |
| 1.1.1.26 | Glyoxylate reductase. |
| 1.1.1.27 | L-lactate dehydrogenase. |
| 1.1.1.28 | D-lactate dehydrogenase. |
| 1.1.1.29 | Glycerate dehydrogenase. |
| 1.1.1.30 | 3-hydroxybutyrate dehydrogenase. |
| 1.1.1.31 | 3-hydroxyisobutyrate dehydrogenase. |
| 1.1.1.32 | Mevaldate reductase. |
| 1.1.1.33 | Mevaldate reductase (NADPH). |

TABLE 2-continued

EC Numbers with the corresponding name given to each enzyme class, subclass and sub-subclass.

| | |
|---|---|
| 1.1.1.34 | Hydroxymethylglutaryl-CoA reductase (NADPH). |
| 1.1.1.35 | 3-hydroxyacyl-CoA dehydrogenase. |
| 1.1.1.36 | Acetoacetyl-CoA reductase. |
| 1.1.1.37 | Malate dehydrogenase. |
| 1.1.1.38 | Malate dehydrogenase (oxaloacetate-decarboxylating). |
| 1.1.1.39 | Malate dehydrogenase (decarboxylating). |
| 1.1.1.40 | Malate dehydrogenase (oxaloacetate-decarboxylating) (NADP+). |
| 1.1.1.41 | Isocitrate dehydrogenase (NAD+). |
| 1.1.1.42 | Isocitrate dehydrogenase (NADP+). |
| 1.1.1.43 | Phosphogluconate 2-dehydrogenase. |
| 1.1.1.44 | Phosphogluconate dehydrogenase (decarboxylating). |
| 1.1.1.45 | L-gulonate 3-dehydrogenase. |
| 1.1.1.46 | L-arabinose 1-dehydrogenase. |
| 1.1.1.47 | Glucose 1-dehydrogenase. |
| 1.1.1.48 | Galactose 1-dehydrogenase. |
| 1.1.1.49 | Glucose-6-phosphate 1-dehydrogenase. |
| 1.1.1.50 | 3-alpha-hydroxysteroid dehydrogenase (B-specific). |
| 1.1.1.51 | 3(or 17)beta-hydroxysteroid dehydrogenase. |
| 1.1.1.52 | 3-alpha-hydroxycholanate dehydrogenase. |
| 1.1.1.53 | 3-alpha(or 20-beta)-hydroxysteroid dehydrogenase. |
| 1.1.1.54 | Allyl-alcohol dehydrogenase. |
| 1.1.1.55 | L-acetaldehyde reductase (NADPH). |
| 1.1.1.56 | Ribitol 2-dehydrogenase. |
| 1.1.1.57 | Fructuronate reductase. |
| 1.1.1.58 | Tagaturonate reductase. |
| 1.1.1.59 | 3-hydroxypropionate dehydrogenase. |
| 1.1.1.60 | 2-hydroxy-3-oxopropionate reductase. |
| 1.1.1.61 | 4-hydroxybutyrate dehydrogenase. |
| 1.1.1.62 | Estradiol 17-beta-dehydrogenase. |
| 1.1.1.63 | Testosterone 17-beta-dehydrogenase. |
| 1.1.1.64 | Testosterone 17-beta-dehydrogenase (NADP+). |
| 1.1.1.65 | Pyridoxine 4-dehydrogenase. |
| 1.1.1.66 | Omega-hydroxydecanoate dehydrogenase. |
| 1.1.1.67 | Mannitol 2-dehydrogenase. |
| 1.1.1.69 | Gluconate 5-dehydrogenase. |
| 1.1.1.71 | Alcohol dehydrogenase (NAD(P)+). |
| 1.1.1.72 | Glycerol dehydrogenase (NADP+). |
| 1.1.1.73 | Octanol dehydrogenase. |
| 1.1.1.75 | (R)-aminopropanol dehydrogenase. |
| 1.1.1.76 | (S,S)-butanediol dehydrogenase. |
| 1.1.1.77 | Lactaldehyde reductase. |
| 1.1.1.78 | D-lactaldehyde dehydrogenase. |
| 1.1.1.79 | Glyoxylate reductase (NADP+). |
| 1.1.1.80 | Isopropanol dehydrogenase (NADP+). |
| 1.1.1.81 | Hydroxypyruvate reductase. |
| 1.1.1.82 | Malate dehydrogenase (NADP+). |
| 1.1.1.83 | D-malate dehydrogenase (decarboxylating). |
| 1.1.1.84 | Dimethylmalate dehydrogenase. |
| 1.1.1.85 | 3-isopropylmalate dehydrogenase. |
| 1.1.1.86 | Ketol-acid reductoisomerase. |
| 1.1.1.87 | Homoisocitrate dehydrogenase. |
| 1.1.1.88 | Hydroxymethylglutaryl-CoA reductase. |
| 1.1.1.90 | Aryl-alcohol dehydrogenase. |
| 1.1.1.91 | Aryl-alcohol dehydrogenase (NADP+). |
| 1.1.1.92 | Oxaloglycolate reductase (decarboxylating). |
| 1.1.1.93 | Tartrate dehydrogenase. |
| 1.1.1.94 | Glycerol-3-phosphate dehydrogenase (NAD(P)+). |
| 1.1.1.95 | Phosphoglycerate dehydrogenase. |
| 1.1.1.96 | Diiodophenylpyruvate reductase. |
| 1.1.1.97 | 3-hydroxybenzyl-alcohol dehydrogenase. |
| 1.1.1.98 | (R)-2-hydroxy-fatty-acid dehydrogenase. |
| 1.1.1.99 | (S)-2-hydroxy-fatty-acid dehydrogenase. |
| 1.1.1.100 | 3-oxoacyl-[acyl-carrier-protein] reductase. |
| 1.1.1.101 | Acylglycerone-phosphate reductase. |
| 1.1.1.102 | 3-dehydrosphinganine reductase. |
| 1.1.1.103 | L-threonine 3-dehydrogenase. |
| 1.1.1.104 | 4-oxoproline reductase. |
| 1.1.1.105 | Retinol dehydrogenase. |
| 1.1.1.106 | Pantoate 4-dehydrogenase. |
| 1.1.1.107 | Pyridoxal 4-dehydrogenase. |
| 1.1.1.108 | Carnitine 3-dehydrogenase. |
| 1.1.1.110 | Indolelactate dehydrogenase. |
| 1.1.1.111 | 3-(imidazol-5-yl)lactate dehydrogenase. |
| 1.1.1.112 | Indanol dehydrogenase. |
| 1.1.1.113 | L-xylose 1-dehydrogenase. |
| 1.1.1.114 | Apiose 1-reductase. |
| 1.1.1.115 | Ribose 1-dehydrogenase (NADP+). |
| 1.1.1.116 | D-arabinose 1-dehydrogenase. |
| 1.1.1.117 | D-arabinose 1-dehydrogenase (NAD(P)+). |
| 1.1.1.118 | Glucose 1-dehydrogenase (NAD+). |
| 1.1.1.119 | Glucose 1-dehydrogenase (NADP+). |
| 1.1.1.120 | Galactose 1-dehydrogenase (NADP+). |
| 1.1.1.121 | Aldose 1-dehydrogenase. |
| 1.1.1.122 | D-threo-aldose 1-dehydrogenase. |
| 1.1.1.123 | Sorbose 5-dehydrogenase (NADP+). |
| 1.1.1.124 | Fructose 5-dehydrogenase (NADP+). |
| 1.1.1.125 | 2-deoxy-D-gluconate 3-dehydrogenase. |
| 1.1.1.126 | 2-dehydro-3-deoxy-D-gluconate 6-dehydrogenase. |
| 1.1.1.127 | 2-dehydro-3-deoxy-D-gluconate 5-dehydrogenase. |
| 1.1.1.128 | L-idonate 2-dehydrogenase. |
| 1.1.1.129 | L-threonate 3-dehydrogenase. |
| 1.1.1.130 | 3-dehydro-L-gulonate 2-dehydrogenase. |
| 1.1.1.131 | Mannuronate reductase. |
| 1.1.1.132 | GDP-mannose 6-dehydrogenase. |
| 1.1.1.133 | dTDP-4-dehydrorhamnose reductase. |
| 1.1.1.134 | dTDP-6-deoxy-L-talose 4-dehydrogenase. |
| 1.1.1.135 | GDP-6-deoxy-D-talose 4-dehydrogenase. |
| 1.1.1.136 | UDP-N-acetylglucosamine 6-dehydrogenase. |
| 1.1.1.137 | Ribitol-5-phosphate 2-dehydrogenase. |
| 1.1.1.138 | Mannitol 2-dehydrogenase (NADP+). |
| 1.1.1.140 | Sorbitol-6-phosphate 2-dehydrogenase. |
| 1.1.1.141 | 15-hydroxyprostaglandin dehydrogenase (NAD+). |
| 1.1.1.142 | D-pinitol dehydrogenase. |
| 1.1.1.143 | Sequoyitol dehydrogenase. |
| 1.1.1.144 | Perillyl-alcohol dehydrogenase. |
| 1.1.1.145 | 3-beta-hydroxy-delta(5)-steroid dehydrogenase. |
| 1.1.1.146 | 11-beta-hydroxysteroid dehydrogenase. |
| 1.1.1.147 | 16-alpha-hydroxysteroid dehydrogenase. |
| 1.1.1.148 | Estradiol 17-alpha-dehydrogenase. |
| 1.1.1.149 | 20-alpha-hydroxysteroid dehydrogenase. |
| 1.1.1.150 | 21-hydroxysteroid dehydrogenase (NAD+). |
| 1.1.1.152 | 3-alpha-hydroxy-5-beta-androstane-17-one 3-alpha-dehydrogenase. |
| 1.1.1.153 | Sepiapterin reductase. |
| 1.1.1.154 | Ureidoglycolate dehydrogenase. |
| 1.1.1.155 | Homoisocitrate dehydrogenase. |
| 1.1.1.156 | Glycerol 2-dehydrogenase (NADP+). |
| 1.1.1.157 | 3-hydroxybutyryl-CoA dehydrogenase. |
| 1.1.1.158 | UDP-N-acetylmuramate dehydrogenase. |
| 1.1.1.159 | 7-alpha-hydroxysteroid dehydrogenase. |
| 1.1.1.160 | Dihydrobunolol dehydrogenase. |
| 1.1.1.161 | Cholestanetetraol 26-dehydrogenase. |
| 1.1.1.162 | Erythrulose reductase. |
| 1.1.1.163 | Cyclopentanol dehydrogenase. |
| 1.1.1.164 | Hexadecanol dehydrogenase. |
| 1.1.1.165 | 2-alkyn-1-ol dehydrogenase. |
| 1.1.1.166 | Hydroxycyclohexanecarboxylate dehydrogenase. |
| 1.1.1.167 | Hydroxymalonate dehydrogenase. |
| 1.1.1.168 | 2-dehydropantolactone reductase (A-specific). |
| 1.1.1.169 | 2-dehydropantoate 2-reductase. |
| 1.1.1.170 | Sterol-4-alpha-carboxylate 3-dehydrogenase (decarboxylating). |
| 1.1.1.172 | 2-oxoadipate reductase. |

TABLE 2-continued

EC Numbers with the corresponding name given to each enzyme class, subclass and sub-subclass.

| | |
|---|---|
| 1.1.1.173 | L-rhamnose 1-dehydrogenase. |
| 1.1.1.174 | Cyclohexane-1,2-diol dehydrogenase. |
| 1.1.1.175 | D-xylose 1-dehydrogenase. |
| 1.1.1.176 | 12-alpha-hydroxysteroid dehydrogenase. |
| 1.1.1.177 | Glycerol-3-phosphate 1-dehydrogenase (NADP+). |
| 1.1.1.178 | 3-hydroxy-2-methylbutyryl-CoA dehydrogenase. |
| 1.1.1.179 | D-xylose 1-dehydrogenase (NADP+). |
| 1.1.1.181 | Cholest-5-ene-3-beta,7-alpha-diol 3-beta-dehydrogenase. |
| 1.1.1.183 | Geraniol dehydrogenase. |
| 1.1.1.184 | Carbonyl reductase (NADPH). |
| 1.1.1.185 | L-glycol dehydrogenase. |
| 1.1.1.186 | dTDP-galactose 6-dehydrogenase. |
| 1.1.1.187 | GDP-4-dehydro-D-rhamnose reductase. |
| 1.1.1.188 | Prostaglandin-F synthase. |
| 1.1.1.189 | Prostaglandin-E(2) 9-reductase. |
| 1.1.1.190 | Indole-3-acetaldehyde reductase (NADH). |
| 1.1.1.191 | Indole-3-acetaldehyde reductase (NADPH). |
| 1.1.1.192 | Long-chain-alcohol dehydrogenase. |
| 1.1.1.193 | 5-amino-6-(5-phosphoribosylamino)uracil reductase. |
| 1.1.1.194 | Coniferyl-alcohol dehydrogenase. |
| 1.1.1.195 | Cinnamyl-alcohol dehydrogenase. |
| 1.1.1.196 | 15-hydroxyprostaglandin-D dehydrogenase (NADP+). |
| 1.1.1.197 | 15-hydroxyprostaglandin dehydrogenase (NADP+). |
| 1.1.1.198 | (+)-borneol dehydrogenase. |
| 1.1.1.199 | (S)-usnate reductase. |
| 1.1.1.200 | Aldose-6-phosphate reductase (NADPH). |
| 1.1.1.201 | 7-beta-hydroxysteroid dehydrogenase (NADP+). |
| 1.1.1.202 | 1,3-propanediol dehydrogenase. |
| 1.1.1.203 | Uronate dehydrogenase. |
| 1.1.1.205 | IMP dehydrogenase. |
| 1.1.1.206 | Tropine dehydrogenase. |
| 1.1.1.207 | (−)-menthol dehydrogenase. |
| 1.1.1.208 | (+)-neomenthol dehydrogenase. |
| 1.1.1.209 | 3(or 17)-alpha-hydroxysteroid dehydrogenase. |
| 1.1.1.210 | 3-beta(or 20-alpha)-hydroxysteroid dehydrogenase. |
| 1.1.1.211 | Long-chain-3-hydroxyacyl-CoA dehydrogenase. |
| 1.1.1.212 | 3-oxoacyl-[acyl-carrier-protein] reductase (NADH). |
| 1.1.1.213 | 3-alpha-hydroxysteroid dehydrogenase (A-specific). |
| 1.1.1.214 | 2-dehydropantolactone reductase (B-specific). |
| 1.1.1.215 | Gluconate 2-dehydrogenase. |
| 1.1.1.216 | Farnesol dehydrogenase. |
| 1.1.1.217 | Benzyl-2-methyl-hydroxybutyrate dehydrogenase. |
| 1.1.1.218 | Morphine 6-dehydrogenase. |
| 1.1.1.219 | Dihydrokaempferol 4-reductase. |
| 1.1.1.220 | 6-pyruvoyltetrahydropterin 2′-reductase. |
| 1.1.1.221 | Vomifoliol 4′-dehydrogenase. |
| 1.1.1.222 | (R)-4-hydroxyphenyllactate dehydrogenase. |
| 1.1.1.223 | Isopiperitenol dehydrogenase. |
| 1.1.1.224 | Mannose-6-phosphate 6-reductase. |
| 1.1.1.225 | Chlordecone reductase. |
| 1.1.1.226 | 4-hydroxycyclohexanecarboxylate dehydrogenase. |
| 1.1.1.227 | (−)-borneol dehydrogenase. |
| 1.1.1.228 | (+)-sabinol dehydrogenase. |
| 1.1.1.229 | Diethyl 2-methyl-3-oxosuccinate reductase. |
| 1.1.1.230 | 3-alpha-hydroxyglycyrrhetinate dehydrogenase. |
| 1.1.1.231 | 15-hydroxyprostaglandin-I dehydrogenase (NADP+). |
| 1.1.1.232 | 15-hydroxyicosatetraenoate dehydrogenase. |
| 1.1.1.233 | N-acylmannosamine 1-dehydrogenase. |
| 1.1.1.234 | Flavanone 4-reductase. |
| 1.1.1.235 | 8-oxocoformycin reductase. |
| 1.1.1.236 | Tropinone reductase. |
| 1.1.1.237 | Hydroxyphenylpyruvate reductase. |
| 1.1.1.238 | 12-beta-hydroxysteroid dehydrogenase. |
| 1.1.1.239 | 3-alpha-(17-beta)-hydroxysteroid dehydrogenase (NAD+). |
| 1.1.1.240 | N-acetylhexosamine 1-dehydrogenase. |
| 1.1.1.241 | 6-endo-hydroxycineole dehydrogenase. |
| 1.1.1.243 | Carveol dehydrogenase. |
| 1.1.1.244 | Methanol dehydrogenase. |
| 1.1.1.245 | Cyclohexanol dehydrogenase. |
| 1.1.1.246 | Pterocarpin synthase. |
| 1.1.1.247 | Codeinone reductase (NADPH). |
| 1.1.1.248 | Salutaridine reductase (NADPH). |
| 1.1.1.250 | D-arabinitol 2-dehydrogenase. |
| 1.1.1.251 | Galactitol-1-phosphate 5-dehydrogenase. |
| 1.1.1.252 | Tetrahydroxynaphthalene reductase. |
| 1.1.1.254 | (S)-carnitine 3-dehydrogenase. |
| 1.1.1.255 | Mannitol dehydrogenase. |
| 1.1.1.256 | Fluoren-9-ol dehydrogenase. |
| 1.1.1.257 | 4-(hydroxymethyl)benzenesulfonate dehydrogenase. |
| 1.1.1.258 | 6-hydroxyhexanoate dehydrogenase. |
| 1.1.1.259 | 3-hydroxypimeloyl-CoA dehydrogenase. |
| 1.1.1.260 | Sulcatone reductase. |
| 1.1.1.261 | Glycerol-1-phosphate dehydrogenase (NAD(P)+). |
| 1.1.1.262 | 4-hydroxythreonine-4-phosphate dehydrogenase. |
| 1.1.1.263 | 1,5-anhydro-D-fructose reductase. |
| 1.1.1.264 | L-idonate 5-dehydrogenase. |
| 1.1.1.265 | 3-methylbutanal reductase. |
| 1.1.1.266 | dTDP-4-dehydro-6-deoxyglucose reductase. |
| 1.1.1.267 | 1-deoxy-D-xylulose-5-phosphate reductoisomerase. |
| 1.1.1.268 | 2-(R)-hydroxypropyl-CoM dehydrogenase. |
| 1.1.1.269 | 2-(S)-hydroxypropyl-CoM dehydrogenase. |
| 1.1.1.270 | 3-keto-steroid reductase. |
| 1.1.1.271 | GDP-L-fucose synthase. |
| 1.1.1.272 | (R)-2-hydroxyacid dehydrogenase. |
| 1.1.1.273 | Vellosimine dehydrogenase. |
| 1.1.1.274 | 2,5-didehydrogluconate reductase. |
| 1.1.1.275 | (+)-trans-carveol dehydrogenase. |
| 1.1.1.276 | Serine 3-dehydrogenase. |
| 1.1.1.277 | 3-beta-hydroxy-5-beta-steroid dehydrogenase. |
| 1.1.1.278 | 3-beta-hydroxy-5-alpha-steroid dehydrogenase. |
| 1.1.1.279 | (R)-3-hydroxyacid-ester dehydrogenase. |
| 1.1.1.280 | (S)-3-hydroxyacid-ester dehydrogenase. |
| 1.1.1.281 | GDP-4-dehydro-6-deoxy-D-mannose reductase. |
| 1.1.1.282 | Quinate/shikimate dehydrogenase. |
| 1.1.2.2 | Mannitol dehydrogenase (cytochrome). |
| 1.1.2.3 | L-lactate dehydrogenase (cytochrome). |
| 1.1.2.4 | D-lactate dehydrogenase (cytochrome). |
| 1.1.2.5 | D-lactate dehydrogenase (cytochrome c-553). |
| 1.1.3.3 | Malate oxidase. |
| 1.1.3.4 | Glucose oxidase. |
| 1.1.3.5 | Hexose oxidase. |
| 1.1.3.6 | Cholesterol oxidase. |
| 1.1.3.7 | Aryl-alcohol oxidase. |
| 1.1.3.8 | L-gulonolactone oxidase. |
| 1.1.3.9 | Galactose oxidase. |
| 1.1.3.10 | Pyranose oxidase. |

TABLE 2-continued

EC Numbers with the corresponding name given to each enzyme class, subclass and sub-subclass.

| EC Number | Name |
|---|---|
| 1.1.3.11 | L-sorbose oxidase. |
| 1.1.3.12 | Pyridoxine 4-oxidase. |
| 1.1.3.13 | Alcohol oxidase. |
| 1.1.3.14 | Catechol oxidase (dimerizing). |
| 1.1.3.15 | (S)-2-hydroxy-acid oxidase. |
| 1.1.3.16 | Ecdysone oxidase. |
| 1.1.3.17 | Choline oxidase. |
| 1.1.3.18 | Secondary-alcohol oxidase. |
| 1.1.3.19 | 4-hydroxymandelate oxidase. |
| 1.1.3.20 | Long-chain-alcohol oxidase. |
| 1.1.3.21 | Glycerol-3-phosphate oxidase. |
| 1.1.3.23 | Thiamine oxidase. |
| 1.1.3.24 | L-galactonolactone oxidase. |
| 1.1.3.25 | Cellobiose oxidase. |
| 1.1.3.27 | Hydroxyphytanate oxidase. |
| 1.1.3.28 | Nucleoside oxidase. |
| 1.1.3.29 | N-acylhexosamine oxidase. |
| 1.1.3.30 | Polyvinyl-alcohol oxidase. |
| 1.1.3.37 | D-arabinono-1,4-lactone oxidase. |
| 1.1.3.38 | Vanillyl-alcohol oxidase. |
| 1.1.3.39 | Nucleoside oxidase (H(2)O(2)-forming). |
| 1.1.3.40 | D-mannitol oxidase. |
| 1.1.3.41 | Xylitol oxidase. |
| 1.1.4.1 | Vitamin-K-epoxide reductase (warfarin-sensitive). |
| 1.1.4.2 | Vitamin-K-epoxide reductase (warfarin-insensitive). |
| 1.1.5.2 | Quinoprotein glucose dehydrogenase. |
| 1.1.99.1 | Choline dehydrogenase. |
| 1.1.99.2 | 2-hydroxyglutarate dehydrogenase. |
| 1.1.99.3 | Gluconate 2-dehydrogenase (acceptor). |
| 1.1.99.4 | Dehydrogluconate dehydrogenase. |
| 1.1.99.5 | Glycerol-3-phosphate dehydrogenase. |
| 1.1.99.6 | D-2-hydroxy-acid dehydrogenase. |
| 1.1.99.7 | Lactate--malate transhydrogenase. |
| 1.1.99.8 | Alcohol dehydrogenase (acceptor). |
| 1.1.99.9 | Pyridoxine 5-dehydrogenase. |
| 1.1.99.10 | Glucose dehydrogenase (acceptor). |
| 1.1.99.11 | Fructose 5-dehydrogenase. |
| 1.1.99.12 | Sorbose dehydrogenase. |
| 1.1.99.13 | Glucoside 3-dehydrogenase. |
| 1.1.99.14 | Glycolate dehydrogenase. |
| 1.1.99.16 | Malate dehydrogenase (acceptor). |
| 1.1.99.18 | Cellobiose dehydrogenase (acceptor). |
| 1.1.99.19 | Uracil dehydrogenase. |
| 1.1.99.20 | Alkan-1-ol dehydrogenase (acceptor). |
| 1.1.99.21 | D-sorbitol dehydrogenase (acceptor). |
| 1.1.99.22 | Glycerol dehydrogenase (acceptor). |
| 1.1.99.23 | Polyvinyl-alcohol dehydrogenase (acceptor). |
| 1.1.99.24 | Hydroxyacid--oxoacid transhydrogenase. |
| 1.1.99.25 | Quinate dehydrogenase (pyrroloquinoline-quinone). |
| 1.1.99.26 | 3-hydroxycyclohexanone dehydrogenase. |
| 1.1.99.27 | (R)-pantolactone dehydrogenase (flavin). |
| 1.1.99.28 | Glucose--fructose oxidoreductase. |
| 1.1.99.29 | Pyranose dehydrogenase (acceptor). |
| 1.1.99.30 | 2-oxo-acid reductase. |
| 1.2.1.1 | Formaldehyde dehydrogenase (glutathione). |
| 1.2.1.2 | Formate dehydrogenase. |
| 1.2.1.3 | Aldehyde dehydrogenase (NAD+). |
| 1.2.1.4 | Aldehyde dehydrogenase (NADP+). |
| 1.2.1.5 | Aldehyde dehydrogenase (NAD(P)+). |
| 1.2.1.7 | Benzaldehyde dehydrogenase (NADP+). |
| 1.2.1.8 | Betaine-aldehyde dehydrogenase. |
| 1.2.1.9 | Glyceraldehyde-3-phosphate dehydrogenase (NADP+). |
| 1.2.1.10 | Acetaldehyde dehydrogenase (acetylating). |
| 1.2.1.11 | Aspartate-semialdehyde dehydrogenase. |
| 1.2.1.12 | Glyceraldehyde-3-phosphate dehydrogenase (phosphorylating). |
| 1.2.1.13 | Glyceraldehyde-3-phosphate dehydrogenase (NADP(+)) (phosphorylating). |
| 1.2.1.15 | Malonate-semialdehyde dehydrogenase. |
| 1.2.1.16 | Succinate-semialdehyde dehydrogenase (NAD(P)+). |
| 1.2.1.17 | Glyoxylate dehydrogenase (acylating). |
| 1.2.1.18 | Malonate-semialdehyde dehydrogenase (acetylating). |
| 1.2.1.19 | Aminobutyraldehyde dehydrogenase. |
| 1.2.1.20 | Glutarate-semialdehyde dehydrogenase. |
| 1.2.1.21 | Glycolaldehyde dehydrogenase. |
| 1.2.1.22 | Lactaldehyde dehydrogenase. |
| 1.2.1.23 | 2-oxoaldehyde dehydrogenase (NAD+). |
| 1.2.1.24 | Succinate-semialdehyde dehydrogenase. |
| 1.2.1.25 | 2-oxoisovalerate dehydrogenase (acylating). |
| 1.2.1.26 | 2,5-dioxovalerate dehydrogenase. |
| 1.2.1.27 | Methylmalonate-semialdehyde dehydrogenase (acylating). |
| 1.2.1.28 | Benzaldehyde dehydrogenase (NAD+). |
| 1.2.1.29 | Aryl-aldehyde dehydrogenase. |
| 1.2.1.30 | Aryl-aldehyde dehydrogenase (NADP+). |
| 1.2.1.31 | L-aminoadipate-semialdehyde dehydrogenase. |
| 1.2.1.32 | Aminomuconate-semialdehyde dehydrogenase. |
| 1.2.1.33 | (R)-dehydropantoate dehydrogenase. |
| 1.2.1.36 | Retinal dehydrogenase. |
| 1.2.1.38 | N-acetyl-gamma-glutamyl-phosphate reductase. |
| 1.2.1.39 | Phenylacetaldehyde dehydrogenase. |
| 1.2.1.40 | 3-alpha,7-alpha,12-alpha-trihydroxycholestan-26-al 26-oxidoreductase. |
| 1.2.1.41 | Glutamate-5-semialdehyde dehydrogenase. |
| 1.2.1.42 | Hexadecanal dehydrogenase (acylating). |
| 1.2.1.43 | Formate dehydrogenase (NADP+). |
| 1.2.1.44 | Cinnamoyl-CoA reductase. |
| 1.2.1.45 | 4-carboxy-2-hydroxymuconate-6-semialdehyde dehydrogenase. |
| 1.2.1.46 | Formaldehyde dehydrogenase. |
| 1.2.1.47 | 4-trimethylammoniobutyraldehyde dehydrogenase. |
| 1.2.1.48 | Long-chain-aldehyde dehydrogenase. |
| 1.2.1.49 | 2-oxoaldehyde dehydrogenase (NADP+). |
| 1.2.1.50 | Long-chain-fatty-acyl-CoA reductase. |
| 1.2.1.51 | Pyruvate dehydrogenase (NADP+). |
| 1.2.1.52 | Oxoglutarate dehydrogenase (NADP+). |
| 1.2.1.53 | 4-hydroxyphenylacetaldehyde dehydrogenase. |
| 1.2.1.54 | Gamma-guanidinobutyraldehyde dehydrogenase. |
| 1.2.1.57 | Butanal dehydrogenase. |
| 1.2.1.58 | Phenylglyoxylate dehydrogenase (acylating). |
| 1.2.1.59 | Glyceraldehyde-3-phosphate dehydrogenase (NAD(P)(+)) (phosphorylating). |
| 1.2.1.60 | 5-carboxymethyl-2-hydroxymuconic-semialdehyde dehydrogenase. |
| 1.2.1.61 | 4-hydroxymuconic-semialdehyde dehydrogenase. |
| 1.2.1.62 | 4-formylbenzenesulfonate dehydrogenase. |
| 1.2.1.63 | 6-oxohexanoate dehydrogenase. |
| 1.2.1.64 | 4-hydroxybenzaldehyde dehydrogenase. |
| 1.2.1.65 | Salicylaldehyde dehydrogenase. |
| 1.2.1.66 | Mycothiol-dependent formaldehyde dehydrogenase. |
| 1.2.1.67 | Vanillin dehydrogenase. |
| 1.2.1.68 | Coniferyl-aldehyde dehydrogenase. |
| 1.2.1.69 | Fluoroacetaldehyde dehydrogenase. |
| 1.2.2.1 | Formate dehydrogenase (cytochrome). |
| 1.2.2.2 | Pyruvate dehydrogenase (cytochrome). |
| 1.2.2.3 | Formate dehydrogenase (cytochrome c-553). |

TABLE 2-continued

EC Numbers with the corresponding name given to each enzyme class, subclass and sub-subclass.

| | |
|---|---|
| 1.2.2.4 | Carbon-monoxide dehydrogenase (cytochrome b-561). |
| 1.2.3.1 | Aldehyde oxidase. |
| 1.2.3.3 | Pyruvate oxidase. |
| 1.2.3.4 | Oxalate oxidase. |
| 1.2.3.5 | Glyoxylate oxidase. |
| 1.2.3.6 | Pyruvate oxidase (CoA-acetylating). |
| 1.2.3.7 | Indole-3-acetaldehyde oxidase. |
| 1.2.3.8 | Pyridoxal oxidase. |
| 1.2.3.9 | Aryl-aldehyde oxidase. |
| 1.2.3.11 | Retinal oxidase. |
| 1.2.3.13 | 4-hydroxyphenylpyruvate oxidase. |
| 1.2.4.1 | Pyruvate dehydrogenase (acetyl-transferring). |
| 1.2.4.2 | Oxoglutarate dehydrogenase (succinyl-transferring). |
| 1.2.4.4 | 3-methyl-2-oxobutanoate dehydrogenase (2-methylpropanoyl-transferring). |
| 1.2.7.1 | Pyruvate synthase. |
| 1.2.7.2 | 2-oxobutyrate synthase. |
| 1.2.7.3 | 2-oxoglutarate synthase. |
| 1.2.7.4 | Carbon-monoxide dehydrogenase (ferredoxin). |
| 1.2.7.5 | Aldehyde ferredoxin oxidoreductase. |
| 1.2.7.6 | Glyceraldehyde-3-phosphate dehydrogenase (ferredoxin). |
| 1.2.7.7 | 3-methyl-2-oxobutanoate dehydrogenase (ferredoxin). |
| 1.2.7.8 | Indolepyruvate ferredoxin oxidoreductase. |
| 1.2.7.9 | 2-oxoglutarate ferredoxin oxidoreductase. |
| 1.2.99.2 | Carbon-monoxide dehydrogenase (acceptor). |
| 1.2.99.3 | Aldehyde dehydrogenase (pyrroloquinoline-quinone). |
| 1.2.99.4 | Formaldehyde dismutase. |
| 1.2.99.5 | Formylmethanofuran dehydrogenase. |
| 1.2.99.6 | Carboxylate reductase. |
| 1.2.99.7 | Aldehyde dehydrogenase (FAD-independent). |
| 1.3.1.1 | Dihydrouracil dehydrogenase (NAD+). |
| 1.3.1.2 | Dihydropyrimidine dehydrogenase (NADP+). |
| 1.3.1.3 | Cortisone beta-reductase. |
| 1.3.1.4 | Cortisone alpha-reductase. |
| 1.3.1.5 | Cucurbitacin delta(23)-reductase. |
| 1.3.1.6 | Fumarate reductase (NADH). |
| 1.3.1.7 | Meso-tartrate dehydrogenase. |
| 1.3.1.8 | Acyl-CoA dehydrogenase (NADP+). |
| 1.3.1.9 | Enoyl-[acyl-carrier-protein] reductase (NADH). |
| 1.3.1.10 | Enoyl-[acyl-carrier-protein] reductase (NADPH, B-specific). |
| 1.3.1.11 | 2-coumarate reductase. |
| 1.3.1.12 | Prephenate dehydrogenase. |
| 1.3.1.13 | Prephenate dehydrogenase (NADP+). |
| 1.3.1.14 | Orotate reductase (NADH). |
| 1.3.1.15 | Orotate reductase (NADPH). |
| 1.3.1.16 | Beta-nitroacrylate reductase. |
| 1.3.1.17 | 3-methyleneoxindole reductase. |
| 1.3.1.18 | Kynurenate-7,8-dihydrodiol dehydrogenase. |
| 1.3.1.19 | Cis-1,2-dihydrobenzene-1,2-diol dehydrogenase. |
| 1.3.1.20 | Trans-1,2-dihydrobenzene-1,2-diol dehydrogenase. |
| 1.3.1.21 | 7-dehydrocholesterol reductase. |
| 1.3.1.22 | Cholestenone 5-alpha-reductase. |
| 1.3.1.23 | Cholestenone 5-beta-reductase. |
| 1.3.1.24 | Biliverdin reductase. |
| 1.3.1.25 | 1,6-dihydroxycyclohexa-2,4-diene-1-carboxylate dehydrogenase. |
| 1.3.1.26 | Dihydrodipicolinate reductase. |
| 1.3.1.27 | 2-hexadecenal reductase. |
| 1.3.1.28 | 2,3-dihydro-2,3-dihydroxybenzoate dehydrogenase. |
| 1.3.1.29 | Cis-1,2-dihydro-1,2-dihydroxynaphthalene dehydrogenase. |
| 1.3.1.30 | Progesterone 5-alpha-reductase. |
| 1.3.1.31 | 2-enoate reductase. |
| 1.3.1.32 | Maleylacetate reductase. |
| 1.3.1.33 | Protochlorophyllide reductase. |
| 1.3.1.34 | 2,4-dienoyl-CoA reductase (NADPH). |
| 1.3.1.35 | Phosphatidylcholine desaturase. |
| 1.3.1.36 | Geissoschizine dehydrogenase. |
| 1.3.1.37 | Cis-2-enoyl-CoA reductase (NADPH). |
| 1.3.1.38 | Trans-2-enoyl-CoA reductase (NADPH). |
| 1.3.1.39 | Enoyl-[acyl-carrier-protein] reductase (NADPH, A-specific). |
| 1.3.1.40 | 2-hydroxy-6-oxo-6-phenylhexa-2,4-dienoate reductase. |
| 1.3.1.41 | Xanthommatin reductase. |
| 1.3.1.42 | 12-oxophytodienoate reductase. |
| 1.3.1.43 | Cyclohexadienyl dehydrogenase. |
| 1.3.1.44 | Trans-2-enoyl-CoA reductase (NAD+). |
| 1.3.1.45 | 2'-hydroxyisoflavone reductase. |
| 1.3.1.46 | Biochanin-A reductase. |
| 1.3.1.47 | Alpha-santonin 1,2-reductase. |
| 1.3.1.48 | 15-oxoprostaglandin 13-oxidase. |
| 1.3.1.49 | Cis-3,4-dihydrophenanthrene-3,4-diol dehydrogenase. |
| 1.3.1.51 | 2'-hydroxydaidzein reductase. |
| 1.3.1.52 | 2-methyl-branched-chain-enoyl-CoA reductase. |
| 1.3.1.53 | (3S,4R)-3,4-dihydroxycyclohexa-1,5-diene-1,4-dicarboxylate dehydrogenase. |
| 1.3.1.54 | Precorrin-6A reductase. |
| 1.3.1.56 | Cis-2,3-dihydrobiphenyl-2,3-diol dehydrogenase. |
| 1.3.1.57 | Phloroglucinol reductase. |
| 1.3.1.58 | 2,3-dihydroxy-2,3-dihydro-p-cumate dehydrogenase. |
| 1.3.1.59 | 1,6-dihydroxy-5-methylcyclohexa-2,4-dienecarboxylate dehydrogenase. |
| 1.3.1.60 | Dibenzothiophene dihydrodiol dehydrogenase. |
| 1.3.1.61 | Terephthalate 1,2-cis-dihydrodiol dehydrogenase. |
| 1.3.1.62 | Pimeloyl-CoA dehydrogenase. |
| 1.3.1.63 | 2,4-dichlorobenzoyl-CoA reductase. |
| 1.3.1.64 | Phthalate 4,5-cis-dihydrodiol dehydrogenase. |
| 1.3.1.65 | 5,6-dihydroxy-3-methyl-2-oxo-1,2,5,6-tetrahydroquinoline dehydrogenase. |
| 1.3.1.66 | Cis-dihydroethylcatechol dehydrogenase. |
| 1.3.1.67 | Cis-1,2-dihydroxy-4-methylcyclohexa-3,5-diene-1-carboxylate dehydrogenase. |
| 1.3.1.68 | 1,2-dihydroxy-6-methylcyclohexa-3,5-dienecarboxylate dehydrogenase. |
| 1.3.1.69 | Zeatin reductase. |
| 1.3.1.70 | Delta(14)-sterol reductase. |
| 1.3.1.71 | Delta(24(24(1)))-sterol reductase. |
| 1.3.1.72 | Delta(24)-sterol reductase. |
| 1.3.1.73 | 1,2-dihydrovomilenine reductase. |
| 1.3.1.74 | 2-alkenal reductase. |
| 1.3.1.75 | Divinyl chlorophyllide a 8-vinyl-reductase. |
| 1.3.1.76 | Precorrin-2 dehydrogenase. |
| 1.3.2.3 | Galactonolactone dehydrogenase. |
| 1.3.3.1 | Dihydroorotate oxidase. |
| 1.3.3.2 | Lathosterol oxidase. |
| 1.3.3.3 | Coproporphyrinogen oxidase. |
| 1.3.3.4 | Protoporphyrinogen oxidase. |
| 1.3.3.5 | Bilirubin oxidase. |
| 1.3.3.6 | Acyl-CoA oxidase. |
| 1.3.3.7 | Dihydrouracil oxidase. |
| 1.3.3.8 | Tetrahydroberberine oxidase. |
| 1.3.3.9 | Secologanin synthase. |
| 1.3.3.10 | Tryptophan alpha,beta-oxidase. |
| 1.3.5.1 | Succinate dehydrogenase (ubiquinone). |
| 1.3.7.1 | 6-hydroxynicotinate reductase. |
| 1.3.7.2 | 15,16-dihydrobiliverdin:ferredoxin oxidoreductase. |
| 1.3.7.3 | Phycoerythrobilin:ferredoxin oxidoreductase. |

TABLE 2-continued

EC Numbers with the corresponding name given to each enzyme class, subclass and sub-subclass.

| | |
|---|---|
| 1.3.7.4 | Phytochromobilin:ferredoxin oxidoreductase. |
| 1.3.7.5 | Phycocyanobilin:ferredoxin oxidoreductase. |
| 1.3.99.1 | Succinate dehydrogenase. |
| 1.3.99.2 | Butyryl-CoA dehydrogenase. |
| 1.3.99.3 | Acyl-CoA dehydrogenase. |
| 1.3.99.4 | 3-oxosteroid 1-dehydrogenase. |
| 1.3.99.5 | 3-oxo-5-alpha-steroid 4-dehydrogenase. |
| 1.3.99.6 | 3-oxo-5-beta-steroid 4-dehydrogenase. |
| 1.3.99.7 | Glutaryl-CoA dehydrogenase. |
| 1.3.99.8 | 2-furoyl-CoA dehydrogenase. |
| 1.3.99.10 | Isovaleryl-CoA dehydrogenase. |
| 1.3.99.11 | Dihydroorotate dehydrogenase. |
| 1.3.99.12 | 2-methylacyl-CoA dehydrogenase. |
| 1.3.99.13 | Long-chain-acyl-CoA dehydrogenase. |
| 1.3.99.14 | Cyclohexanone dehydrogenase. |
| 1.3.99.15 | Benzoyl-CoA reductase. |
| 1.3.99.16 | Isoquinoline 1-oxidoreductase. |
| 1.3.99.17 | Quinoline 2-oxidoreductase. |
| 1.3.99.18 | Quinaldate 4-oxidoreductase. |
| 1.3.99.19 | Quinoline-4-carboxylate 2-oxidoreductase. |
| 1.3.99.20 | 4-hydroxybenzoyl-CoA reductase. |
| 1.3.99.21 | (R)-benzylsuccinyl-CoA dehydrogenase. |
| 1.4.1.1 | Alanine dehydrogenase. |
| 1.4.1.2 | Glutamate dehydrogenase. |
| 1.4.1.3 | Glutamate dehydrogenase (NAD(P)+). |
| 1.4.1.4 | Glutamate dehydrogenase (NADP+). |
| 1.4.1.5 | L-amino-acid dehydrogenase. |
| 1.4.1.7 | Serine 2-dehydrogenase. |
| 1.4.1.8 | Valine dehydrogenase (NADP+). |
| 1.4.1.9 | Leucine dehydrogenase. |
| 1.4.1.10 | Glycine dehydrogenase. |
| 1.4.1.11 | L-erythro-3,5-diaminohexanoate dehydrogenase. |
| 1.4.1.12 | 2,4-diaminopentanoate dehydrogenase. |
| 1.4.1.13 | Glutamate synthase (NADPH). |
| 1.4.1.14 | Glutamate synthase (NADH). |
| 1.4.1.15 | Lysine dehydrogenase. |
| 1.4.1.16 | Diaminopimelate dehydrogenase. |
| 1.4.1.17 | N-methylalanine dehydrogenase. |
| 1.4.1.18 | Lysine 6-dehydrogenase. |
| 1.4.1.19 | Tryptophan dehydrogenase. |
| 1.4.1.20 | Phenylalanine dehydrogenase. |
| 1.4.2.1 | Glycine dehydrogenase (cytochrome). |
| 1.4.3.1 | D-aspartate oxidase. |
| 1.4.3.2 | L-amino-acid oxidase. |
| 1.4.3.3 | D-amino-acid oxidase. |
| 1.4.3.4 | Amine oxidase (flavin-containing). |
| 1.4.3.5 | Pyridoxamine-phosphate oxidase. |
| 1.4.3.6 | Amine oxidase (copper-containing). |
| 1.4.3.7 | D-glutamate oxidase. |
| 1.4.3.8 | Ethanolamine oxidase. |
| 1.4.3.10 | Putrescine oxidase. |
| 1.4.3.11 | L-glutamate oxidase. |
| 1.4.3.12 | Cyclohexylamine oxidase. |
| 1.4.3.13 | Protein-lysine 6-oxidase. |
| 1.4.3.14 | L-lysine oxidase. |
| 1.4.3.15 | D-glutamate(D-aspartate) oxidase. |
| 1.4.3.16 | L-aspartate oxidase. |
| 1.4.3.19 | Glycine oxidase. |
| 1.4.4.2 | Glycine dehydrogenase (decarboxylating). |
| 1.4.7.1 | Glutamate synthase (ferredoxin). |
| 1.4.99.1 | D-amino-acid dehydrogenase. |
| 1.4.99.2 | Taurine dehydrogenase. |
| 1.4.99.3 | Amine dehydrogenase. |
| 1.4.99.4 | Aralkylamine dehydrogenase. |
| 1.4.99.5 | Glycine dehydrogenase (cyanide-forming). |
| 1.5.1.1 | Pyrroline-2-carboxylate reductase. |
| 1.5.1.2 | Pyrroline-5-carboxylate reductase. |
| 1.5.1.3 | Dihydrofolate reductase. |
| 1.5.1.5 | Methylenetetrahydrofolate dehydrogenase (NADP+). |
| 1.5.1.6 | Formyltetrahydrofolate dehydrogenase. |
| 1.5.1.7 | Saccharopine dehydrogenase (NAD+, L-lysine-forming). |
| 1.5.1.8 | Saccharopine dehydrogenase (NADP+, L-lysine-forming). |
| 1.5.1.9 | Saccharopine dehydrogenase (NAD+, L-glutamate-forming). |
| 1.5.1.10 | Saccharopine dehydrogenase (NADP+, L-glutamate-forming). |
| 1.5.1.11 | D-octopine dehydrogenase. |
| 1.5.1.12 | 1-pyrroline-5-carboxylate dehydrogenase. |
| 1.5.1.15 | Methylenetetrahydrofolate dehydrogenase (NAD+). |
| 1.5.1.16 | D-lysopine dehydrogenase. |
| 1.5.1.17 | Alanopine dehydrogenase. |
| 1.5.1.18 | Ephedrine dehydrogenase. |
| 1.5.1.19 | D-nopaline dehydrogenase. |
| 1.5.1.20 | Methylenetetrahydrofolate reductase (NADPH). |
| 1.5.1.21 | Delta(1)-piperideine-2-carboxylate reductase. |
| 1.5.1.22 | Strombine dehydrogenase. |
| 1.5.1.23 | Tauropine dehydrogenase. |
| 1.5.1.24 | N(5)-(carboxyethyl)ornithine synthase. |
| 1.5.1.25 | Thiomorpholine-carboxylate dehydrogenase. |
| 1.5.1.26 | Beta-alanopine dehydrogenase. |
| 1.5.1.27 | 1,2-dehydroreticulinium reductase (NADPH). |
| 1.5.1.28 | Opine dehydrogenase. |
| 1.5.1.29 | FMN reductase. |
| 1.5.1.30 | Flavin reductase. |
| 1.5.1.31 | Berberine reductase. |
| 1.5.1.32 | Vomilenine reductase. |
| 1.5.1.33 | Pteridine reductase. |
| 1.5.1.34 | 6,7-dihydropteridine reductase. |
| 1.5.3.1 | Sarcosine oxidase. |
| 1.5.3.2 | N-methyl-L-amino-acid oxidase. |
| 1.5.3.4 | N(6)-methyl-lysine oxidase. |
| 1.5.3.5 | (S)-6-hydroxynicotine oxidase. |
| 1.5.3.6 | (R)-6-hydroxynicotine oxidase. |
| 1.5.3.7 | L-pipecolate oxidase. |
| 1.5.3.10 | Dimethylglycine oxidase. |
| 1.5.3.11 | Polyamine oxidase. |
| 1.5.3.12 | Dihydrobenzophenanthridine oxidase. |
| 1.5.4.1 | Pyrimidodiazepine synthase. |
| 1.5.5.1 | Electron-transferring-flavoprotein dehydrogenase. |
| 1.5.8.1 | Dimethylamine dehydrogenase. |
| 1.5.8.2 | Trimethylamine dehydrogenase. |
| 1.5.99.1 | Sarcosine dehydrogenase. |
| 1.5.99.2 | Dimethylglycine dehydrogenase. |
| 1.5.99.3 | L-pipecolate dehydrogenase. |
| 1.5.99.4 | Nicotine dehydrogenase. |
| 1.5.99.5 | Methylglutamate dehydrogenase. |
| 1.5.99.6 | Spermidine dehydrogenase. |
| 1.5.99.8 | Proline dehydrogenase. |
| 1.5.99.9 | Methylenetetrahydromethanopterin dehydrogenase. |
| 1.5.99.11 | 5,10-methylenetetrahydromethanopterin reductase. |
| 1.5.99.12 | Cytokinin dehydrogenase. |
| 1.6.1.1 | NAD(P)(+) transhydrogenase (B-specific). |
| 1.6.1.2 | NAD(P)(+) transhydrogenase (AB-specific). |
| 1.6.2.2 | Cytochrome-b5 reductase. |
| 1.6.2.4 | NADPH--hemoprotein reductase. |
| 1.6.2.5 | NADPH--cytochrome-c2 reductase. |
| 1.6.2.6 | Leghemoglobin reductase. |
| 1.6.3.1 | NAD(P)H oxidase. |
| 1.6.5.3 | NADH dehydrogenase (ubiquinone). |
| 1.6.5.4 | Monodehydroascorbate reductase (NADH). |
| 1.6.5.5 | NADPH:quinone reductase. |
| 1.6.5.6 | p-benzoquinone reductase (NADPH). |
| 1.6.5.7 | 2-hydroxy-1,4-benzoquinone reductase. |
| 1.6.6.9 | Trimethylamine-N-oxide reductase. |
| 1.6.99.1 | NADPH dehydrogenase. |
| 1.6.99.2 | NAD(P)H dehydrogenase (quinone). |

TABLE 2-continued

EC Numbers with the corresponding name given to each enzyme class, subclass and sub-subclass.

| | |
|---|---|
| 1.6.99.3 | NADH dehydrogenase. |
| 1.6.99.5 | NADH dehydrogenase (quinone). |
| 1.6.99.6 | NADPH dehydrogenase (quinone). |
| 1.7.1.1 | Nitrate reductase (NADH). |
| 1.7.1.2 | Nitrate reductase (NAD(P)H). |
| 1.7.1.3 | Nitrate reductase (NADPH). |
| 1.7.1.4 | Nitrite reductase (NAD(P)H). |
| 1.7.1.5 | Hyponitrite reductase. |
| 1.7.1.6 | Azobenzene reductase. |
| 1.7.1.7 | GMP reductase. |
| 1.7.1.9 | Nitroquinoline-N-oxide reductase. |
| 1.7.1.10 | Hydroxylamine reductase (NADH). |
| 1.7.1.11 | 4-(dimethylamino)phenylazoxybenzene reductase. |
| 1.7.1.12 | N-hydroxy-2-acetamidofluorene reductase. |
| 1.7.2.1 | Nitrite reductase (NO-forming). |
| 1.7.2.2 | Nitrite reductase (cytochrome; ammonia-forming). |
| 1.7.2.3 | Trimethylamine-N-oxide reductase (cytochrome c). |
| 1.7.3.1 | Nitroethane oxidase. |
| 1.7.3.2 | Acetylindoxyl oxidase. |
| 1.7.3.3 | Urate oxidase. |
| 1.7.3.4 | Hydroxylamine oxidase. |
| 1.7.3.5 | 3-aci-nitropropanoate oxidase. |
| 1.7.7.1 | Ferredoxin--nitrite reductase. |
| 1.7.7.2 | Ferredoxin--nitrate reductase. |
| 1.7.99.1 | Hydroxylamine reductase. |
| 1.7.99.4 | Nitrate reductase. |
| 1.7.99.5 | 5,10-methylenetetrahydrofolate reductase (FADH(2)). |
| 1.7.99.6 | Nitrous-oxide reductase. |
| 1.7.99.7 | Nitric-oxide reductase. |
| 1.7.99.8 | Hydroxylamine oxidoreductase. |
| 1.8.1.2 | Sulfite reductase (NADPH). |
| 1.8.1.3 | Hypotaurine dehydrogenase. |
| 1.8.1.4 | Dihydrolipoyl dehydrogenase. |
| 1.8.1.5 | 2-oxopropyl-CoM reductase (carboxylating). |
| 1.8.1.6 | Cystine reductase. |
| 1.8.1.7 | Glutathione-disulfide reductase. |
| 1.8.1.8 | Protein-disulfide reductase. |
| 1.8.1.9 | Thioredoxin-disulfide reductase. |
| 1.8.1.10 | CoA-glutathione reductase. |
| 1.8.1.11 | Asparagusate reductase. |
| 1.8.1.12 | Trypanothione-disulfide reductase. |
| 1.8.1.13 | Bis-gamma-glutamylcystine reductase. |
| 1.8.1.14 | CoA-disulfide reductase. |
| 1.8.1.15 | Mycothione reductase. |
| 1.8.2.1 | Sulfite dehydrogenase. |
| 1.8.2.2 | Thiosulfate dehydrogenase. |
| 1.8.3.1 | Sulfite oxidase. |
| 1.8.3.2 | Thiol oxidase. |
| 1.8.3.3 | Glutathione oxidase. |
| 1.8.3.4 | Methanethiol oxidase. |
| 1.8.3.5 | Prenylcysteine oxidase. |
| 1.8.4.1 | Glutathione--homocystine transhydrogenase. |
| 1.8.4.2 | Protein-disulfide reductase (glutathione). |
| 1.8.4.3 | Glutathione--CoA-glutathione transhydrogenase. |
| 1.8.4.4 | Glutathione--cystine transhydrogenase. |
| 1.8.4.5 | Methionine-S-oxide reductase. |
| 1.8.4.6 | Protein-methionine-S-oxide reductase. |
| 1.8.4.7 | Enzyme-thiol transhydrogenase (glutathione-disulfide). |
| 1.8.4.8 | Phosphoadenylyl-sulfate reductase (thioredoxin). |
| 1.8.4.9 | Adenylyl-sulfate reductase (glutathione). |
| 1.8.4.10 | Adenylyl-sulfate reductase (thioredoxin). |
| 1.8.5.1 | Glutathione dehydrogenase (ascorbate). |
| 1.8.7.1 | Sulfite reductase (ferredoxin). |
| 1.8.98.1 | CoB--CoM heterodisulfide reductase. |
| 1.8.99.1 | Sulfite reductase. |
| 1.8.99.2 | Adenylyl-sulfate reductase. |
| 1.8.99.3 | Hydrogensulfite reductase. |
| 1.9.3.1 | Cytochrome-c oxidase. |
| 1.9.6.1 | Nitrate reductase (cytochrome). |
| 1.9.99.1 | Iron--cytochrome-c reductase. |
| 1.10.1.1 | Trans-acenaphthene-1,2-diol dehydrogenase. |
| 1.10.2.1 | L-ascorbate--cytochrome-b5 reductase. |
| 1.10.2.2 | Ubiquinol--cytochrome-c reductase. |
| 1.10.3.1 | Catechol oxidase. |
| 1.10.3.2 | Laccase. |
| 1.10.3.3 | L-ascorbate oxidase. |
| 1.10.3.4 | O-aminophenol oxidase. |
| 1.10.3.5 | 3-hydroxyanthranilate oxidase. |
| 1.10.3.6 | Rifamycin-B oxidase. |
| 1.10.99.1 | Plastoquinol--plastocyanin reductase. |
| 1.11.1.1 | NADH peroxidase. |
| 1.11.1.2 | NADPH peroxidase. |
| 1.11.1.3 | Fatty-acid peroxidase. |
| 1.11.1.5 | Cytochrome-c peroxidase. |
| 1.11.1.6 | Catalase. |
| 1.11.1.7 | Peroxidase. |
| 1.11.1.8 | Iodide peroxidase. |
| 1.11.1.9 | Glutathione peroxidase. |
| 1.11.1.10 | Chloride peroxidase. |
| 1.11.1.11 | L-ascorbate peroxidase. |
| 1.11.1.12 | Phospholipid-hydroperoxide glutathione peroxidase. |
| 1.11.1.13 | Manganese peroxidase. |
| 1.11.1.14 | Diarylpropane peroxidase. |
| 1.12.1.2 | Hydrogen dehydrogenase. |
| 1.12.1.3 | Hydrogen dehydrogenase (NADP+). |
| 1.12.2.1 | Cytochrome-c3 hydrogenase. |
| 1.12.5.1 | Hydrogen:quinone oxidoreductase. |
| 1.12.7.2 | Ferredoxin hydrogenase. |
| 1.12.98.1 | Coenzyme F420 hydrogenase. |
| 1.12.98.2 | 5,10-methenyltetrahydromethanopterin hydrogenase. |
| 1.12.98.3 | Methanosarcina-phenazine hydrogenase. |
| 1.12.99.6 | Hydrogenase (acceptor). |
| 1.13.11.1 | Catechol 1,2-dioxygenase. |
| 1.13.11.2 | Catechol 2,3-dioxygenase. |
| 1.13.11.3 | Protocatechuate 3,4-dioxygenase. |
| 1.13.11.4 | Gentisate 1,2-dioxygenase. |
| 1.13.11.5 | Homogentisate 1,2-dioxygenase. |
| 1.13.11.6 | 3-hydroxyanthranilate 3,4-dioxygenase. |
| 1.13.11.8 | Protocatechuate 4,5-dioxygenase. |
| 1.13.11.9 | 2,5-dihydroxypyridine 5,6-dioxygenase. |
| 1.13.11.10 | 7,8-dihydroxykynurenate 8,8a-dioxygenase. |
| 1.13.11.11 | Tryptophan 2,3-dioxygenase. |
| 1.13.11.12 | Lipoxygenase. |
| 1.13.11.13 | Ascorbate 2,3-dioxygenase. |
| 1.13.11.14 | 2,3-dihydroxybenzoate 3,4-dioxygenase. |
| 1.13.11.15 | 3,4-dihydroxyphenylacetate 2,3-dioxygenase. |
| 1.13.11.16 | 3-carboxyethylcatechol 2,3-dioxygenase. |
| 1.13.11.17 | Indole 2,3-dioxygenase. |
| 1.13.11.18 | Sulfur dioxygenase. |
| 1.13.11.19 | Cysteamine dioxygenase. |
| 1.13.11.20 | Cysteine dioxygenase. |
| 1.13.11.22 | Caffeate 3,4-dioxygenase. |
| 1.13.11.23 | 2,3-dihydroxyindole 2,3-dioxygenase. |
| 1.13.11.24 | Quercetin 2,3-dioxygenase. |
| 1.13.11.25 | 3,4-dihydroxy-9,10-secoandrosta-1,3,5(10)-triene-9,17-dione 4,5-dioxygenase. |
| 1.13.11.26 | Peptide-tryptophan 2,3-dioxygenase. |
| 1.13.11.27 | 4-hydroxyphenylpyruvate dioxygenase. |
| 1.13.11.28 | 2,3-dihydroxybenzoate 2,3-dioxygenase. |
| 1.13.11.29 | Stizolobate synthase. |
| 1.13.11.30 | Stizolobinate synthase. |
| 1.13.11.31 | Arachidonate 12-lipoxygenase. |
| 1.13.11.32 | 2-nitropropane dioxygenase. |
| 1.13.11.33. | Arachidonate 15-lipoxygenase. |
| 1.13.11.34 | Arachidonate 5-lipoxygenase. |
| 1.13.11.35 | Pyrogallol 1,2-oxygenase. |

TABLE 2-continued

EC Numbers with the corresponding name given to each enzyme class, subclass and sub-subclass.

| | |
|---|---|
| 1.13.11.36 | Chloridazon-catechol dioxygenase. |
| 1.13.11.37 | Hydroxyquinol 1,2-dioxygenase. |
| 1.13.11.38 | 1-hydroxy-2-naphthoate 1,2-dioxygenase. |
| 1.13.11.39 | Biphenyl-2,3-diol 1,2-dioxygenase. |
| 1.13.11.40 | Arachidonate 8-lipoxygenase. |
| 1.13.11.41 | 2,4'-dihydroxyacetophenone dioxygenase. |
| 1.13.11.42 | Indoleamine-pyrrole 2,3-dioxygenase. |
| 1.13.11.43 | Lignostilbene alpha-beta-dioxygenase. |
| 1.13.11.44 | Linoleate diol synthase. |
| 1.13.11.45 | Linoleate 11-lipoxygenase. |
| 1.13.11.46 | 4-hydroxymandelate synthase. |
| 1.13.11.47 | 3-hydroxy-4-oxoquinoline 2,4-dioxygenase. |
| 1.13.11.48 | 3-hydroxy-2-methylquinolin-4-one 2,4-dioxygenase. |
| 1.13.11.49 | Chlorite O(2)-lyase. |
| 1.13.11.50 | Acetylacetone-cleaving enzyme. |
| 1.13.12.1 | Arginine 2-monooxygenase. |
| 1.13.12.2 | Lysine 2-monooxygenase. |
| 1.13.12.3 | Tryptophan 2-monooxygenase. |
| 1.13.12.4 | Lactate 2-monooxygenase. |
| 1.13.12.5 | Renilla-luciferin 2-monooxygenase. |
| 1.13.12.6 | Cypridina-luciferin 2-monooxygenase. |
| 1.13.12.7 | Photinus-luciferin 4-monooxygenase (ATP-hydrolyzing). |
| 1.13.12.8 | Watasenia-luciferin 2-monooxygenase. |
| 1.13.12.9 | Phenylalanine 2-monooxygenase. |
| 1.13.12.11 | Methylphenyltetrahydropyridine N-monooxygenase. |
| 1.13.12.12 | Apo-beta-carotenoid-14',13'-dioxygenase. |
| 1.13.12.13 | Oplophorus-luciferin 2-monooxygenase. |
| 1.13.99.1 | Inositol oxygenase. |
| 1.13.99.3 | Tryptophan 2'-dioxygenase. |
| 1.14.11.1 | Gamma-butyrobetaine dioxygenase. |
| 1.14.11.2 | Procollagen-proline dioxygenase. |
| 1.14.11.3 | Pyrimidine-deoxynucleoside 2'-dioxygenase. |
| 1.14.11.4 | Procollagen-lysine 5-dioxygenase. |
| 1.14.11.6 | Thymine dioxygenase. |
| 1.14.11.7 | Procollagen-proline 3-dioxygenase. |
| 1.14.11.8 | Trimethyllysine dioxygenase, |
| 1.14.11.9 | Naringenin 3-dioxygenase. |
| 1.14.11.10 | Pyrimidine-deoxynucleoside 1'-dioxygenase. |
| 1.14.11.11 | Hyoscyamine (6S)-dioxygenase. |
| 1.14.11.12 | Gibberellin-44 dioxygenase. |
| 1.14.11.13 | Gibberellin 2-beta-dioxygenase. |
| 1.14.11.14 | 6-beta-hydroxyhyoscyamine epoxidase. |
| 1.14.11.15 | Gibberellin 3-beta-dioxygenase. |
| 1.14.11.16 | Peptide-aspartate beta-dioxygenase. |
| 1.14.11.17 | Taurine dioxygenase. |
| 1.14.11.18 | Phytanoyl-CoA dioxygenase. |
| 1.14.11.19 | Leucocyanidin oxygenase. |
| 1.14.11.20 | Desacetoxyvindoline 4-hydroxylase. |
| 1.14.11.21 | Clavaminate synthase. |
| 1.14.12.1 | Anthranilate 1,2-dioxygenase (deaminating, decarboxylating). |
| 1.14.12.3 | Benzene 1,2-dioxygenase. |
| 1.14.12.4 | 3-hydroxy-2-methylpyridinecarboxylate dioxygenase. |
| 1.14.12.5 | 5-pyridoxate dioxygenase. |
| 1.14.12.7 | Phthalate 4,5-dioxygenase. |
| 1.14.12.8 | 4-sulfobenzoate 3,4-dioxygenase. |
| 1.14.12.9 | 4-chlorophenylacetate 3,4-dioxygenase. |
| 1.14.12.10 | Benzoate 1,2-dioxygenase. |
| 1.14.12.11 | Toluene dioxygenase. |
| 1.14.12.12 | Naphthalene 1,2-dioxygenase. |
| 1.14.12.13 | 2-chlorobenzoate 1,2-dioxygenase. |
| 1.14.12.14 | 2-aminobenzenesulfonate 2,3-dioxygenase. |
| 1.14.12.15 | Terephthalate 1,2-dioxygenase. |
| 1.14.12.16 | 2-hydroxyquinoline 5,6-dioxygenase. |
| 1.14.12.17 | Nitric oxide dioxygenase. |
| 1.14.12.18 | Biphenyl 2,3-dioxygenase. |
| 1.14.13.1 | Salicylate 1-monooxygenase. |
| 1.14.13.2 | 4-hydroxybenzoate 3-monooxygenase. |
| 1.14.13.3 | 4-hydroxyphenylacetate 3-monooxygenase. |
| 1.14.13.4 | Melilotate 3-monooxygenase. |
| 1.14.13.5 | Imidazoleacetate 4-monooxygenase. |
| 1.14.13.6 | Orcinol 2-monooxygenase. |
| 1.14.13.7 | Phenol 2-monooxygenase. |
| 1.14.13.8 | Dimethylaniline monooxygenase (N-oxide-forming). |
| 1.14.16.4 | Tryptophan 5-monooxygenase. |
| 1.14.16.5 | Glyceryl-ether monooxygenase. |
| 1.14.16.6 | Mandelate 4-monooxygenase. |
| 1.14.17.1 | Dopamine beta-monooxygenase. |
| 1.14.17.3 | Peptidylglycine monooxygenase. |
| 1.14.17.4 | Aminocyclopropanecarboxylate oxidase. |
| 1.14.18.1 | Monophenol monooxygenase. |
| 1.14.18.2 | CMP-N-acetylneuraminate monooxygenase. |
| 1.14.19.1 | Stearoyl-CoA 9-desaturase. |
| 1.14.19.2 | Acyl-[acyl-carrier-protein] desaturase. |
| 1.14.19.3 | Linoleoyl-CoA desaturase. |
| 1.14.20.1 | Deacetoxycephalosporin-C synthase. |
| 1.14.21.1 | (S)-stylopine synthase. |
| 1.14.21.2 | (S)-cheilanthifoline synthase. |
| 1.14.21.3 | Berbamunine synthase. |
| 1.14.21.4 | Salutaridine synthase. |
| 1.14.21.5 | (S)-canadine synthase. |
| 1.14.99.1 | Prostaglandin-endoperoxide synthase. |
| 1.14.99.2 | Kynurenine 7,8-hydroxylase. |
| 1.14.99.3 | Heme oxygenase (decyclizing). |
| 1.14.99.4 | Progesterone monooxygenase. |
| 1.14.99.7 | Squalene monooxygenase. |
| 1.14.99.9 | Steroid 17-alpha-monooxygenase. |
| 1.14.99.10 | Steroid 21-monooxygenase. |
| 1.14.99.11 | Estradiol 6-beta-monooxygenase. |
| 1.14.99.12 | Androst-4-ene-3,17-dione monooxygenase. |
| 1.14.99.14 | Progesterone 11-alpha-monooxygenase. |
| 1.14.99.15 | 4-methoxybenzoate monooxygenase (O-demethylating). |
| 1.14.99.19 | Plasmanylethanolamine desaturase. |
| 1.14.99.20 | Phylloquinone monooxygenase (2,3-epoxidizing). |
| 1.14.99.21 | Latia-luciferin monooxygenase (demethylating). |
| 1.14.99.22 | Ecdysone 20-monooxygenase. |
| 1.14.99.23 | 3-hydroxybenzoate 2-monooxygenase. |
| 1.14.99.24 | Steroid 9-alpha-monooxygenase. |
| 1.14.99.26 | 2-hydroxypyridine 5-monooxygenase. |
| 1.14.99.27 | Juglone 3-monooxygenase. |
| 1.14.99.28 | Linalool 8-monooxygenase. |
| 1.14.99.29 | Deoxyhypusine monooxygenase. |
| 1.14.99.30 | Carotene 7,8-desaturase. |
| 1.14.99.31 | Myristoyl-CoA 11-(E) desaturase. |
| 1.14.99.32 | Myristoyl-CoA 11-(Z) desaturase. |
| 1.14.99.33 | Delta(12)-fatty acid dehydrogenase. |
| 1.14.99.34 | Monoprenyl isoflavone epoxidase. |
| 1.14.99.35 | Thiophene-2-carbonyl-CoA monooxygenase. |
| 1.14.99.36 | Beta-carotene 15,15'-monooxygenase. |
| 1.14.99.37 | Taxadiene 5-alpha-hydroxylase. |
| 1.15.1.1 | Superoxide dismutase. |
| 1.15.1.2 | Superoxide reductase. |
| 1.16.1.1 | Mercury(II) reductase. |
| 1.16.1.2 | Diferric-transferrin reductase. |
| 1.16.1.3 | Aquacobalamin reductase. |
| 1.16.1.4 | Cob(II)alamin reductase. |
| 1.16.1.5 | Aquacobalamin reductase (NADPH). |

TABLE 2-continued

EC Numbers with the corresponding name given to each enzyme class, subclass and sub-subclass.

| | |
|---|---|
| 1.16.1.6 | Cyanocobalamin reductase (cyanide-eliminating). |
| 1.16.1.7 | Ferric-chelate reductase. |
| 1.16.1.8 | [Methionine synthase] reductase. |
| 1.16.3.1 | Ferroxidase. |
| 1.16.8.1 | Cob(II)yrinic acid a,c-diamide reductase. |
| 1.17.1.1 | CDP-4-dehydro-6-deoxyglucose reductase. |
| 1.17.1.2 | 4-hydroxy-3-methylbut-2-enyl diphosphate reductase. |
| 1.17.1.3 | Leucoanthocyanidin reductase. |
| 1.17.1.4 | Xanthine dehydrogenase. |
| 1.17.1.5 | Nicotinate dehydrogenase. |
| 1.17.3.1 | Pteridine oxidase. |
| 1.17.3.2 | Xanthine oxidase. |
| 1.17.3.3 | 6-hydroxynicotinate dehydrogenase. |
| 1.17.4.1 | Ribonucleoside-diphosphate reductase. |
| 1.17.4.2 | Ribonucleoside-triphosphate reductase. |
| 1.17.4.3 | 4-hydroxy-3-methylbut-2-en-1-yl diphosphate synthase. |
| 1.17.5.1 | Phenylacetyl-CoA dehydrogenase. |
| 1.17.99.1 | 4-cresol dehydrogenase (hydroxylating). |
| 1.17.99.2 | Ethylbenzene hydroxylase. |
| 1.18.1.1 | Rubredoxin--NAD(+) reductase. |
| 1.18.1.2 | Ferredoxin--NADP(+) reductase. |
| 1.18.1.3 | Ferredoxin--NAD(+) reductase. |
| 1.18.1.4 | Rubredoxin--NAD(P)(+) reductase. |
| 1.18.6.1 | Nitrogenase. |
| 1.19.6.1 | Nitrogenase (flavodoxin). |
| 1.20.1.1 | Phosphonate dehydrogenase. |
| 1.20.4.1 | Arsenate reductase (glutaredoxin). |
| 1.20.4.2 | Methylarsonate reductase. |
| 1.20.98.1 | Arsenate reductase (azurin). |
| 1.20.99.1 | Arsenate reductase (donor). |
| 1.21.3.1 | Isopenicillin-N synthase. |
| 1.21.3.2 | Columbamine oxidase. |
| 1.21.3.3 | Reticuline oxidase. |
| 1.21.3.4 | Sulochrin oxidase ((+)-bisdechlorogeodin-forming). |
| 1.21.3.5 | Sulochrin oxidase ((−)-bisdechlorogeodin-forming). |
| 1.21.3.6 | Aureusidin synthase. |
| 1.21.4.1 | D-proline reductase (dithiol). |
| 1.21.4.2 | Glycine reductase. |
| 1.21.4.3 | Sarcosine reductase. |
| 1.21.4.4 | Betaine reductase. |
| 1.21.99.1 | Beta-cyclopiazonate dehydrogenase. |
| 1.97.1.1 | Chlorate reductase. |
| 1.97.1.2 | Pyrogallol hydroxytransferase. |
| 1.97.1.3 | Sulfur reductase. |
| 1.97.1.4 | [Formate acetyltransferase] activating enzyme. |
| 1.97.1.8 | Tetrachloroethene reductive dehalogenase. |
| 1.97.1.9 | Selenate reductase. |
| 1.97.1.10 | Thyroxine 5'-deiodinase. |
| 1.97.1.11 | Thyroxine 5-deiodinase. |
| ENZYME: 2.—.—.— | |
| 2.1.1.1 | Nicotinamide N-methyltransferase. |
| 2.1.1.2 | Guanidinoacetate N-methyltransferase. |
| 2.1.1.3 | Thetin--homocysteine S-methyltransferase. |
| 2.1.1.4 | Acetylserotonin O-methyltransferase. |
| 2.1.1.5 | Betaine--homocysteine S-methyltransferase. |
| 2.1.1.6 | Catechol O-methyltransferase. |
| 2.1.1.7 | Nicotinate N-methyltransferase. |
| 2.1.1.8 | Histamine N-methyltransferase. |
| 2.1.1.9 | Thiol S-methyltransferase. |
| 2.1.1.10 | Homocysteine S-methyltransferase. |
| 2.1.1.11 | Magnesium protoporphyrin IX methyltransferase. |
| 2.1.1.12 | Methionine S-methyltransferase. |
| 2.1.1.13 | Methionine synthase. |
| 2.1.1.14 | 5-methyltetrahydropteroyltriglutamate--homocysteine S-methyltransferase. |
| 2.1.1.15 | Fatty-acid O-methyltransferase. |
| 2.1.1.16 | Methylene-fatty-acyl-phospholipid synthase. |
| 2.1.1.17 | Phosphatidylethanolamine N-methyltransferase. |
| 2.1.1.18 | Polysaccharide O-methyltransferase. |
| 2.1.1.19 | Trimethylsulfonium--tetrahydrofolate N-methyltransferase. |
| 2.1.1.20 | Glycine N-methyltransferase. |
| 2.1.1.21 | Methylamine--glutamate N-methyltransferase. |
| 2.1.1.22 | Carnosine N-methyltransferase. |
| 2.1.1.25 | Phenol O-methyltransferase. |
| 2.1.1.26 | Iodophenol O-methyltransferase. |
| 2.1.1.27 | Tyramine N-methyltransferase. |
| 2.1.1.28 | Phenylethanolamine N-methyltransferase. |
| 2.1.1.29 | tRNA (cytosine-5-)-methyltransferase. |
| 2.1.1.31 | tRNA (guanine-N(1)-)-methyltransferase. |
| 2.1.1.32 | tRNA (guanine-N(2)-)-methyltransferase. |
| 2.1.1.33 | tRNA (guanine-N(7)-)-methyltransferase. |
| 2.1.1.34 | tRNA (guanosine-2'-O-)-methyltransferase. |
| 2.1.1.35 | tRNA (uracil-5-)-methyltransferase. |
| 2.1.1.36 | tRNA (adenine-N(1)-)-methyltransferase. |
| 2.1.1.37 | DNA (cytosine-5-)-methyltransferase. |
| 2.1.1.38 | O-demethylpuromycin O-methyltransferase. |
| 2.1.1.39 | Inositol 3-methyltransferase. |
| 2.1.1.40 | Inositol 1-methyltransferase. |
| 2.1.1.41 | Sterol 24-C-methyltransferase. |
| 2.1.1.42 | Luteolin O-methyltransferase. |
| 2.1.1.43 | Histone-lysine N-methyltransferase. |
| 2.1.1.44 | Dimethylhistidine N-methyltransferase. |
| 2.1.1.45 | Thymidylate synthase. |
| 2.1.1.46 | Isoflavone 4'-O-methyltransferase. |
| 2.1.1.47 | Indolepyruvate C-methyltransferase. |
| 2.1.1.48 | rRNA (adenine-N(6)-)-methyltransferase. |
| 2.1.1.49 | Amine N-methyltransferase. |
| 2.1.1.50 | Loganate O-methyltransferase. |
| 2.1.1.51 | rRNA (guanine-N(1)-)-methyltransferase. |
| 2.1.1.52 | rRNA (guanine-N(2)-)-methyltransferase. |
| 2.1.1.53 | Putrescine N-methyltransferase. |
| 2.1.1.54 | Deoxycytidylate C-methyltransferase. |
| 2.1.1.55 | tRNA (adenine-N(6)-)-methyltransferase. |
| 2.1.1.56 | mRNA (guanine-N(7)-)-methyltransferase. |
| 2.1.1.57 | mRNA (nucleoside-2'-O-)-methyltransferase. |
| 2.1.1.59 | [Cytochrome c]-lysine N-methyltransferase. |
| 2.1.1.60 | Calmodulin-lysine N-methyltransferase. |
| 2.1.1.61 | tRNA (5-methylaminomethyl-2-thiouridylate)-methyltransferase. |
| 2.1.1.62 | mRNA (2'-O-methyladenosine-N(6)-)-methyltransferase. |
| 2.1.1.63 | Methylated-DNA--[protein]-cysteine S-methyltransferase. |
| 2.1.1.64 | 3-demethylubiquinone-9 3-O-methyltransferase. |
| 2.1.1.65 | Licodione 2'-O-methyltransferase. |
| 2.1.1.66 | rRNA (adenosine-2'-O-)-methyltransferase. |
| 2.1.1.67 | Thiopurine S-methyltransferase. |
| 2.1.1.68 | Caffeate O-methyltransferase. |

TABLE 2-continued

EC Numbers with the corresponding name given to each enzyme class, subclass and sub-subclass.

| EC Number | Name |
|---|---|
| 2.1.1.69 | 5-hydroxyfuranocoumarin 5-O-methyltransferase. |
| 2.1.1.70 | 8-hydroxyfuranocoumarin 8-O-methyltransferase. |
| 2.1.1.71 | Phosphatidyl-N-methylethanolamine N-methyltransferase. |
| 2.1.1.72 | Site-specific DNA-methyltransferase (adenine-specific). |
| 2.1.1.74 | Methylenetetrahydrofolate--tRNA-(uracil-5-)-methyltransferase (FADH(2)-oxidizing). |
| 2.1.1.75 | Apigenin 4'-O-methyltransferase. |
| 2.1.1.76 | Quercetin 3-O-methyltransferase. |
| 2.1.1.77 | Protein-L-isoaspartate(D-aspartate) O-methyltransferase. |
| 2.1.1.78 | Isoorientin 3'-O-methyltransferase. |
| 2.1.1.79 | Cyclopropane-fatty-acyl-phospholipid synthase. |
| 2.1.1.80 | Protein-glutamate O-methyltransferase. |
| 2.1.1.82 | 3-methylquercitin 7-O-methyltransferase. |
| 2.1.1.83 | 3,7-dimethylquercitin 4'-O-methyltransferase. |
| 2.1.1.84 | Methylquercetagetin 6-O-methyltransferase. |
| 2.1.1.85 | Protein-histidine N-methyltransferase. |
| 2.1.1.86 | Tetrahydromethanopterin S-methyltransferase. |
| 2.1.1.87 | Pyridine N-methyltransferase. |
| 2.1.1.88 | 8-hydroxyquercitin 8-O-methyltransferase. |
| 2.1.1.89 | Tetrahydrocolumbamine 2-O-methyltransferase. |
| 2.1.1.90 | Methanol--5-hydroxybenzimidazolylcobamide Co-methyltransferase. |
| 2.1.1.91 | Isobutyraldoxime O-methyltransferase. |
| 2.1.1.92 | Bergaptol O-methyltransferase. |
| 2.1.1.93 | Xanthotoxol O-methyltransferase. |
| 2.1.1.94 | 11-O-demethyl-17-O-deacetylvindoline O-methyltransferase. |
| 2.1.1.95 | Tocopherol O-methyltransferase. |
| 2.1.1.96 | Thioether S-methyltransferase. |
| 2.1.1.97 | 3-hydroxyanthranilate 4-C-methyltransferase. |
| 2.1.1.98 | Diphthine synthase. |
| 2.1.1.99 | 16-methoxy-2,3-dihydro-3-hydroxytabersonine N-methyltransferase. |
| 2.1.1.100 | Protein-S-isoprenylcysteine O-methyltransferase. |
| 2.1.1.101 | Macrocin O-methyltransferase. |
| 2.1.1.102 | Demethylmacrocin O-methyltransferase. |
| 2.1.1.103 | Phosphoethanolamine N-methyltransferase. |
| 2.1.1.104 | Caffeoyl-CoA O-methyltransferase. |
| 2.1.1.105 | N-benzoyl-4-hydroxyanthranilate 4-O-methyltransferase. |
| 2.1.1.106 | Tryptophan 2-C-methyltransferase. |
| 2.1.1.107 | Uroporphyrin-III C-methyltransferase. |
| 2.1.1.108 | 6-hydroxymellein O-methyltransferase. |
| 2.1.1.109 | Demethylsterigmatocystin 6-O-methyltransferase. |
| 2.1.1.110 | Sterigmatocystin 7-O-methyltransferase. |
| 2.1.1.111 | Anthranilate N-methyltransferase. |
| 2.1.1.112 | Glucuronoxylan 4-O-methyltransferase. |
| 2.1.1.113 | Site-specific DNA-methyltransferase (cytosine-N(4)-specific). |
| 2.1.1.114 | Hexaprenyldihydroxybenzoate methyltransferase. |
| 2.1.1.115 | (RS)-1-benzyl-1,2,3,4-tetrahydroisoquinoline N-methyltransferase. |
| 2.1.1.116 | 3'-hydroxy-N-methyl-(S)-coclaurine 4'-O-methyltransferase. |
| 2.1.1.117 | (S)-scoulerine 9-O-methyltransferase. |
| 2.1.1.118 | Columbamine O-methyltransferase. |
| 2.1.1.119 | 10-hydroxydihydrosanguinarine 10-O-methyltransferase. |
| 2.1.1.120 | 12-hydroxydihydrochelirubine 12-O-methyltransferase. |
| 2.1.1.121 | 6-O-methylnorlaudanosoline 5'-O-methyltransferase. |
| 2.1.1.122 | (S)-tetrahydroprotoberberine N-methyltransferase. |
| 2.1.1.123 | [Cytochrome-c]-methionine S-methyltransferase. |
| 2.1.1.124 | [Cytochrome-c]-arginine N-methyltransferase. |
| 2.1.1.125 | Histone-arginine N-methyltransferase. |
| 2.1.1.126 | [Myelin basic protein]-arginine N-methyltransferase. |
| 2.1.1.127 | [Ribulose-bisphosphate carboxylase]-lysine N-methyltransferase. |
| 2.1.1.128 | (RS)-norcoclaurine 6-O-methyltransferase. |
| 2.1.1.129 | Inositol 4-methyltransferase. |
| 2.1.1.130 | Precorrin-2 C(20)-methyltransferase. |
| 2.1.1.131 | Precorrin-3B C(17)-methyltransferase. |
| 2.1.1.132 | Precorrin-6Y C(5,15)-methyltransferase (decarboxylating). |
| 2.1.1.133 | Precorrin-4 C(11)-methyltransferase. |
| 2.1.1.136 | Chlorophenol O-methyltransferase. |
| 2.1.1.137 | Arsenite methyltransferase. |
| 2.1.1.139 | 3'-demethylstaurosporine O-methyltransferase. |
| 2.1.1.140 | (S)-coclaurine-N-methyltransferase. |
| 2.1.1.141 | Jasmonate O-methyltransferase. |
| 2.1.1.142 | Cycloartenol 24-C-methyltransferase. |
| 2.1.1.143 | 24-methylenesterol C-methyltransferase. |
| 2.1.1.144 | Trans-aconitate 2-methyltransferase. |
| 2.1.1.145 | Trans-aconitate 3-methyltransferase. |
| 2.1.1.146 | (Iso)eugenol O-methyltransferase. |
| 2.1.1.147 | Corydaline synthase. |
| 2.1.1.148 | Thymidylate synthase (FAD). |
| 2.1.1.149 | Myricetin O-methyltransferase. |
| 2.1.1.150 | Isoflavone 7-O-methyltransferase. |
| 2.1.1.151 | Cobalt-factor II C(20)-methyltransferase. |
| 2.1.1.152 | Precorrin-6A synthase (deacetylating). |
| 2.1.2.1 | Glycine hydroxymethyltransferase. |
| 2.1.2.2 | Phosphoribosylglycinamide formyltransferase. |
| 2.1.2.3 | Phosphoribosylaminoimidazolecarboxamide formyltransferase. |
| 2.1.2.4 | Glycine formimidoyltransferase. |
| 2.1.2.5 | Glutamate formimidoyltransferase. |
| 2.1.2.7 | D-alanine 2-hydroxymethyltransferase. |
| 2.1.2.8 | Deoxycytidylate 5-hydroxymethyltransferase. |
| 2.1.2.9 | Methionyl-tRNA formyltransferase. |
| 2.1.2.10 | Aminomethyltransferase. |
| 2.1.2.11 | 3-methyl-2-oxobutanoate hydroxymethyltransferase. |
| 2.1.3.1 | Methylmalonyl-CoA carboxytransferase. |
| 2.1.3.2 | Aspartate carbamoyltransferase. |
| 2.1.3.3 | Ornithine carbamoyltransferase. |
| 2.1.3.5 | Oxamate carbamoyltransferase. |
| 2.1.3.6 | Putrescine carbamoyltransferase. |
| 2.1.3.7 | 3-hydroxymethylcephem carbamoyltransferase. |
| 2.1.3.8 | Lysine carbamoyltransferase. |
| 2.1.4.1 | Glycine amidinotransferase. |
| 2.1.4.2 | Scyllo-inosamine-4-phosphate amidinotransferase. |
| 2.2.1.1 | Transketolase. |
| 2.2.1.2 | Transaldolase. |
| 2.2.1.3 | Formaldehyde transketolase. |

TABLE 2-continued

EC Numbers with the corresponding name given to each enzyme class, subclass and sub-subclass.

| | |
|---|---|
| 2.2.1.4 | Acetoin--ribose-5-phosphate transaldolase. |
| 2.2.1.5 | 2-hydroxy-3-oxoadipate synthase. |
| 2.2.1.6 | Acetolactate synthase. |
| 2.2.1.7 | 1-deoxy-D-xylulose-5-phosphate synthase. |
| 2.2.1.8 | Fluorothreonine transaldolase. |
| 2.3.1.1 | Amino-acid N-acetyltransferase. |
| 2.3.1.2 | Imidazole N-acetyltransferase. |
| 2.3.1.3 | Glucosamine N-acetyltransferase. |
| 2.3.1.4 | Glucosamine 6-phosphate N-acetyltransferase. |
| 2.3.1.5 | Arylamine N-acetyltransferase. |
| 2.3.1.6 | Choline O-acetyltransferase. |
| 2.3.1.7 | Carnitine O-acetyltransferase. |
| 2.3.1.8 | Phosphate acetyltransferase. |
| 2.3.1.9 | Acetyl-CoA C-acetyltransferase. |
| 2.3.1.10 | Hydrogen-sulfide S-acetyltransferase. |
| 2.3.1.11 | Thioethanolamine S-acetyltransferase. |
| 2.3.1.12 | Dihydrolipoyllysine-residue acetyltransferase. |
| 2.3.1.13 | Glycine N-acyltransferase. |
| 2.3.1.14 | Glutamine N-phenylacetyltransferase. |
| 2.3.1.15 | Glycerol-3-phosphate O-acyltransferase. |
| 2.3.1.16 | Acetyl-CoA C-acyltransferase. |
| 2.3.1.17 | Aspartate N-acetyltransferase. |
| 2.3.1.18 | Galactoside O-acetyltransferase. |
| 2.3.1.19 | Phosphate butyryltransferase. |
| 2.3.1.20 | Diacylglycerol O-acyltransferase. |
| 2.3.1.21 | Carnitine O-palmitoyltransferase. |
| 2.3.1.22 | 2-acylglycerol O-acyltransferase. |
| 2.3.1.23 | 1-acylglycerophosphocholine O-acyltransferase. |
| 2.3.1.24 | Sphingosine N-acyltransferase. |
| 2.3.1.25 | Plasmalogen synthase. |
| 2.3.1.26 | Sterol O-acyltransferase. |
| 2.3.1.27 | Cortisol O-acetyltransferase. |
| 2.3.1.28 | Chloramphenicol O-acetyltransferase. |
| 2.3.1.29 | Glycine C-acetyltransferase. |
| 2.3.1.30 | Serine O-acetyltransferase. |
| 2.3.1.31 | Homoserine O-acetyltransferase. |
| 2.3.1.32 | Lysine N-acetyltransferase. |
| 2.3.1.33 | Histidine N-acetyltransferase. |
| 2.3.1.34 | D-tryptophan N-acetyltransferase. |
| 2.3.1.35 | Glutamate N-acetyltransferase. |
| 2.3.1.36 | D-amino-acid N-acetyltransferase. |
| 2.3.1.37 | 5-aminolevulinate synthase. |
| 2.3.1.38 | [Acyl-carrier-protein] S-acetyltransferase. |
| 2.3.1.39 | [Acyl-carrier-protein] S-malonyltransferase. |
| 2.3.1.40 | Acyl-[acyl-carrier-protein]--phospholipid O-acyltransferase. |
| 2.3.1.41 | 3-oxoacyl-[acyl-carrier-protein] synthase. |
| 2.3.1.42 | Glycerone-phosphate O-acyltransferase. |
| 2.3.1.43 | Phosphatidylcholine--sterol O-acyltransferase. |
| 2.3.1.44 | N-acetylneuraminate 4-O-acetyltransferase. |
| 2.3.1.45 | N-acetylneuraminate 7-O(or 9-O)-acetyltransferase. |
| 2.3.1.46 | Homoserine O-succinyltransferase. |
| 2.3.1.47 | 8-amino-7-oxononanoate synthase. |
| 2.3.1.48 | Histone acetyltransferase. |
| 2.3.1.49 | Deacetyl-[citrate-(pro-3S)-lyase] S-acetyltransferase. |
| 2.3.1.50 | Serine C-palmitoyltransferase. |
| 2.3.1.51 | 1-acylglycerol-3-phosphate O-acyltransferase. |
| 2.3.1.52 | 2-acylglycerol-3-phosphate O-acyltransferase. |
| 2.3.1.53 | Phenylalanine N-acetyltransferase. |
| 2.3.1.54 | Formate C-acetyltransferase. |
| 2.3.1.56 | Aromatic-hydroxylamine O-acetyltransferase. |
| 2.3.1.57 | Diamine N-acetyltransferase. |
| 2.3.1.58 | 2,3-diaminopropionate N-oxalyltransferase. |
| 2.3.1.59 | Gentamicin 2'-N-acetyltransferase. |
| 2.3.1.60 | Gentamicin 3'-N-acetyltransferase. |
| 2.3.1.61 | Dihydrolipoyllysine-residue succinyltransferase. |
| 2.3.1.62 | 2-acylglycerophosphocholine O-acyltransferase. |
| 2.3.1.63 | 1-alkylglycerophosphocholine O-acyltransferase. |
| 2.3.1.64 | Agmatine N(4)-coumaroyltransferase. |
| 2.3.1.65 | Glycine N-choloyltransferase. |
| 2.3.1.66 | Leucine N-acetyltransferase. |
| 2.3.1.67 | 1-alkylglycerophosphocholine O-acetyltransferase. |
| 2.3.1.68 | Glutamine N-acyltransferase. |
| 2.3.1.69 | Monoterpenol O-acetyltransferase. |
| 2.3.1.70 | CDP-acylglycerol O-arachidonoyltransferase. |
| 2.3.1.71 | Glycine N-benzoyltransferase. |
| 2.3.1.72 | Indoleacetylglucose--inositol O-acyltransferase. |
| 2.3.1.73 | Diacylglycerol--sterol O-acyltransferase. |
| 2.3.1.74 | Naringenin-chalcone synthase. |
| 2.3.1.75 | Long-chain-alcohol O-fatty-acyltransferase. |
| 2.3.1.76 | Retinol O-fatty-acyltransferase. |
| 2.3.1.77 | Triacylglycerol--sterol O-acyltransferase. |
| 2.3.1.78 | Heparan-alpha-glucosaminide N-acetyltransferase. |
| 2.3.1.79 | Maltose O-acetyltransferase. |
| 2.3.1.80 | Cysteine-S-conjugate N-acetyltransferase. |
| 2.3.1.81 | Aminoglycoside N(3')-acetyltransferase. |
| 2.3.1.82 | Aminoglycoside N(6')-acetyltransferase. |
| 2.3.1.83 | Phosphatidylcholine--dolichol O-acyltransferase. |
| 2.3.1.84 | Alcohol O-acetyltransferase. |
| 2.3.1.85 | Fatty-acid synthase. |
| 2.3.1.86 | Fatty-acyl-CoA synthase. |
| 2.3.1.87 | Aralkylamine N-acetyltransferase. |
| 2.3.1.88 | Peptide alpha-N-acetyltransferase. |
| 2.3.1.89 | Tetrahydrodipicolinate N-acetyltransferase. |
| 2.3.1.90 | Beta-glucogallin O-galloyltransferase. |
| 2.3.1.91 | Sinapoylglucose--choline O-sinapoyltransferase. |
| 2.3.1.92 | Sinapoylglucose--malate O-sinapoyltransferase. |
| 2.3.1.93 | 13-hydroxylupinine O-tigloyltransferase. |
| 2.3.1.94 | Erythronolide synthase. |
| 2.3.1.95 | Trihydroxystilbene synthase. |
| 2.3.1.96 | Glycoprotein N-palmitoyltransferase. |
| 2.3.1.97 | Glycylpeptide N-tetradecanoyltransferase. |
| 2.3.1.98 | Chlorogenate--glucarate O-hydroxycinnamoyltransferase. |
| 2.3.1.99 | Quinate O-hydroxycinnamoyltransferase. |
| 2.3.1.100 | Myelin-proteolipid O-palmitoyltransferase. |
| 2.3.1.101 | Formylmethanofuran--tetrahydromethanopterin N-formyltransferase. |
| 2.3.1.102 | N(6)-hydroxylysine O-acetyltransferase. |
| 2.3.1.103 | Sinapoylglucose--sinapoylglucose O-sinapoyltransferase. |
| 2.3.1.104 | 1-alkenylglycerophosphocholine O-acyltransferase. |
| 2.3.1.105 | Alkylglycerophosphate 2-O-acetyltransferase. |
| 2.3.1.106 | Tartronate O-hydroxycinnamoyltransferase. |
| 2.3.1.107 | 17-O-deacetylvindoline O-acetyltransferase. |
| 2.3.1.108 | Tubulin N-acetyltransferase. |
| 2.3.1.109 | Arginine N-succinyltransferase. |
| 2.3.1.110 | Tyramine N-feruloyltransferase. |

TABLE 2-continued

EC Numbers with the corresponding name given to each enzyme class, subclass and sub-subclass.

| | |
|---|---|
| 2.3.1.111 | Mycocerosate synthase. |
| 2.3.1.112 | D-tryptophan N-malonyltransferase. |
| 2.3.1.113 | Anthranilate N-malonyltransferase. |
| 2.3.1.114 | 3,4-dichloroaniline N-malonyltransferase. |
| 2.3.1.115 | Isoflavone-7-O-beta-glucoside 6"-O-malonyltransferase. |
| 2.3.1.116 | Flavonol-3-O-beta-glucoside O-malonyltransferase. |
| 2.3.1.117 | 2,3,4,5-tetrahydropyridine-2,6-dicarboxylate N-succinyltransferase. |
| 2.3.1.118 | N-hydroxyarylamine O-acetyltransferase. |
| 2.3.1.119 | Icosanoyl-CoA synthase. |
| 2.3.1.121 | 1-alkenylglycerophosphoethanolamine O-acyltransferase. |
| 2.3.1.122 | Trehalose O-mycolyltransferase. |
| 2.3.1.123 | Dolichol O-acyltransferase. |
| 2.3.1.125 | 1-alkyl-2-acetylglycerol O-acyltransferase. |
| 2.3.1.126 | Isocitrate O-dihydroxycinnamoyltransferase. |
| 2.3.1.127 | Ornithine N-benzoyltransferase. |
| 2.3.1.128 | Ribosomal-protein-alanine N-acetyltransferase. |
| 2.3.1.129 | Acyl-[acyl-carrier-protein]--UDP-N-acetylglucosamine O-acyltransferase. |
| 2.3.1.130 | Galactarate O-hydroxycinnamoyltransferase. |
| 2.3.1.131 | Glucarate O-hydroxycinnamoyltransferase. |
| 2.3.1.132 | Glucarolactone O-hydroxycinnamoyltransferase. |
| 2.3.1.133 | Shikimate O-hydroxycinnamoyltransferase. |
| 2.3.1.134 | Galactolipid O-acyltransferase. |
| 2.3.1.135 | Phosphatidylcholine--retinol O-acyltransferase. |
| 2.3.1.136 | Polysialic-acid O-acetyltransferase. |
| 2.3.1.137 | Carnitine O-octanoyltransferase. |
| 2.3.1.138 | Putrescine N-hydroxycinnamoyltransferase. |
| 2.3.1.139 | Ecdysone O-acyltransferase. |
| 2.3.1.140 | Rosmarinate synthase. |
| 2.3.1.141 | Galactosylacylglycerol O-acyltransferase. |
| 2.3.1.142 | Glycoprotein O-fatty-acyltransferase. |
| 2.3.1.143 | Beta-glucogallin--tetrakisgalloylglucose O-galloyltransferase. |
| 2.3.1.144 | Anthranilate N-benzoyltransferase. |
| 2.3.1.145 | Piperidine N-piperoyltransferase. |
| 2.3.1.146 | Pinosylvin synthase. |
| 2.3.1.147 | Glycerophospholipid arachidonoyl-transferase (CoA-independent). |
| 2.3.1.148 | Glycerophospholipid acyltransferase (CoA-dependent). |
| 2.3.1.149 | Platelet-activating factor acetyltransferase. |
| 2.3.1.150 | Salutaridinol 7-O-acetyltransferase. |
| 2.3.1.151 | Benzophenone synthase. |
| 2.3.1.152 | Alcohol O-cinnamoyltransferase. |
| 2.3.1.153 | Anthocyanin 5-aromatic acyltransferase. |
| 2.3.1.154 | Propionyl-CoA C(2)-trimethyltridecanoyltransferase. |
| 2.3.1.155 | Acetyl-CoA C-myristoyltransferase. |
| 2.3.1.156 | Phloroisovalerophenone synthase. |
| 2.3.1.157 | Glucosamine-1-phosphate N-acetyltransferase. |
| 2.3.1.158 | Phospholipid:diacylglycerol acyltransferase. |
| 2.3.1.159 | Acridone synthase. |
| 2.3.1.160 | Vinorine synthase. |
| 2.3.1.161 | Lovastatin nonaketide synthase. |
| 2.3.1.162 | Taxadien-5-alpha-ol O-acetyltransferase. |
| 2.3.1.163 | 10-hydroxytaxane O-acetyltransferase. |
| 2.3.1.164 | Isopenicillin-N N-acyltransferase. |
| 2.3.1.165 | 6-methylsalicylic acid synthase. |
| 2.3.1.166 | 2-alpha-hydroxytaxane 2-O-benzoyltransferase. |
| 2.3.1.167 | 10-deacetylbaccatin III 10-O-acetyltransferase. |
| 2.3.1.168 | Dihydrolipoyllysine-residue (2-methylpropanoyl)transferase. |
| 2.3.1.169 | CO-methylating acetyl-CoA synthase. |
| 2.3.2.1 | D-glutamyltransferase. |
| 2.3.2.2 | Gamma-glutamyltransferase. |
| 2.3.2.3 | Lysyltransferase. |
| 2.3.2.4 | Gamma-glutamylcyclotransferase. |
| 2.3.2.5 | Glutaminyl-peptide cyclotransferase. |
| 2.3.2.6 | Leucyltransferase. |
| 2.3.2.7 | Aspartyltransferase. |
| 2.3.2.8 | Arginyltransferase. |
| 2.3.2.9 | Agaritine gamma-glutamyltransferase. |
| 2.3.2.10 | UDP-N-acetylmuramoylpentapeptide-lysine N(6)-alanyltransferase. |
| 2.3.2.11 | Alanylphosphatidylglycerol synthase. |
| 2.3.2.12 | Peptidyltransferase. |
| 2.3.2.13 | Protein-glutamine gamma-glutamyltransferase. |
| 2.3.2.14 | D-alanine gamma-glutamyltransferase. |
| 2.3.2.15 | Glutathione gamma-glutamylcysteinyltransferase. |
| 2.3.3.1 | Citrate (Si)-synthase. |
| 2.3.3.2 | Decylcitrate synthase. |
| 2.3.3.3 | Citrate (Re)-synthase. |
| 2.3.3.4 | Decylhomocitrate synthase. |
| 2.3.3.5 | 2-methylcitrate synthase. |
| 2.3.3.6 | 2-ethylmalate synthase. |
| 2.3.3.7 | 3-ethylmalate synthase. |
| 2.3.3.8 | ATP citrate synthase. |
| 2.3.3.9 | Malate synthase. |
| 2.3.3.10 | Hydroxymethylglutaryl-CoA synthase. |
| 2.3.3.11 | 2-hydroxyglutarate synthase. |
| 2.3.3.12 | 3-propylmalate synthase. |
| 2.3.3.13 | 2-isopropylmalate synthase. |
| 2.3.3.14 | Homocitrate synthase. |
| 2.3.3.15 | Sulfoacetaldehyde acetyltransferase. |
| 2.4.1.1 | Phosphorylase. |
| 2.4.1.2 | Dextrin dextranase. |
| 2.4.1.4 | Amylosucrase. |
| 2.4.1.5 | Dextransucrase. |
| 2.4.1.7 | Sucrose phosphorylase. |
| 2.4.1.8 | Maltose phosphorylase. |
| 2.4.1.9 | Inulosucrase. |
| 2.4.1.10 | Levansucrase. |
| 2.4.1.11 | Glycogen (starch) synthase. |
| 2.4.1.12 | Cellulose synthase (UDP-forming). |
| 2.4.1.13 | Sucrose synthase. |
| 2.4.1.14 | Sucrose-phosphate synthase. |
| 2.4.1.15 | Alpha,alpha-trehalose-phosphate synthase (UDP-forming). |
| 2.4.1.16 | Chitin synthase. |
| 2.4.1.17 | Glucuronosyltransferase. |
| 2.4.1.18 | 1,4-alpha-glucan branching enzyme. |
| 2.4.1.19 | Cyclomaltodextrin glucanotransferase. |
| 2.4.1.20 | Cellobiose phosphorylase. |
| 2.4.1.21 | Starch synthase. |
| 2.4.1.22 | Lactose synthase. |
| 2.4.1.23 | Sphingosine beta-galactosyltransferase. |
| 2.4.1.24 | 1,4-alpha-glucan 6-alpha-glucosyltransferase. |
| 2.4.1.25 | 4-alpha-glucanotransferase. |
| 2.4.1.26 | DNA alpha-glucosyltransferase. |
| 2.4.1.27 | DNA beta-glucosyltransferase. |
| 2.4.1.28 | Glucosyl-DNA beta-glucosyltransferase. |
| 2.4.1.29 | Cellulose synthase (GDP-forming). |
| 2.4.1.30 | 1,3-beta-oligoglucan phosphorylase. |
| 2.4.1.31 | Laminaribiose phosphorylase. |

TABLE 2-continued

EC Numbers with the corresponding name given to each enzyme class, subclass and sub-subclass.

| | |
|---|---|
| 2.4.1.32 | Glucomannan 4-beta-mannosyltransferase. |
| 2.4.1.33 | Alginate synthase. |
| 2.4.1.34 | 1,3-beta-glucan synthase. |
| 2.4.1.35 | Phenol beta-glucosyltransferase. |
| 2.4.1.36 | Alpha,alpha-trehalose-phosphate synthase (GDP-forming). |
| 2.4.1.37 | Fucosylgalactoside 3-alpha-galactosyltransferase. |
| 2.4.1.38 | Beta-N-acetylglucosaminylglycopeptide beta-1,4-galactosyltransferase. |
| 2.4.1.39 | Steroid N-acetylglucosaminyltransferase. |
| 2.4.1.40 | Glycoprotein-fucosylgalactoside alpha-N-acetylgalactosaminyltransferase. |
| 2.4.1.41 | Polypeptide N-acetylgalactosaminyltransferase. |
| 2.4.1.43 | Polygalacturonate 4-alpha-galacturonosyltransferase. |
| 2.4.1.44 | Lipopolysaccharide 3-alpha-galactosyltransferase. |
| 2.4.1.45 | 2-hydroxyacylsphingosine 1-beta-galactosyltransferase. |
| 2.4.1.46 | 1,2-diacylglycerol 3-beta-galactosyltransferase. |
| 2.4.1.47 | N-acylsphingosine galactosyltransferase. |
| 2.4.1.48 | Heteroglycan alpha-mannosyltransferase. |
| 2.4.1.49 | Cellodextrin phosphorylase. |
| 2.4.1.50 | Procollagen galactosyltransferase. |
| 2.4.1.52 | Poly(glycerol-phosphate) alpha-glucosyltransferase. |
| 2.4.1.53 | Poly(ribitol-phosphate) beta-glucosyltransferase. |
| 2.4.1.54 | Undecaprenyl-phosphate mannosyltransferase. |
| 2.4.1.56 | Lipopolysaccharide N-acetylglucosaminyltransferase. |
| 2.4.1.57 | Phosphatidylinositol alpha-mannosyltransferase. |
| 2.4.1.58 | Lipopolysaccharide glucosyltransferase I. |
| 2.4.1.60 | Abequosyltransferase. |
| 2.4.1.62 | Ganglioside galactosyltransferase. |
| 2.4.1.63 | Linamarin synthase. |
| 2.4.1.64 | Alpha,alpha-trehalose phosphorylase. |
| 2.4.1.65 | 3-galactosyl-N-acetylglucosaminide 4-alpha-L-fucosyltransferase. |
| 2.4.1.66 | Procollagen glucosyltransferase. |
| 2.4.1.67 | Galactinol--raffinose galactosyltransferase. |
| 2.4.1.68 | Glycoprotein 6-alpha-L-fucosyltransferase. |
| 2.4.1.69 | Galactoside 2-alpha-L-fucosyltransferase. |
| 2.4.1.70 | Poly(ribitol-phosphate) N-acetylglucosaminyltransferase. |
| 2.4.1.71 | Arylamine glucosyltransferase. |
| 2.4.1.73 | Lipopolysaccharide glucosyltransferase II. |
| 2.4.1.74 | Glycosaminoglycan galactosyltransferase. |
| 2.4.1.75 | UDP-galacturonosyltransferase. |
| 2.4.1.78 | Phosphopolyprenol glucosyltransferase. |
| 2.4.1.79 | Galactosylgalactosylglucosylceramide beta-D-acetylgalactosaminyltransferase. |
| 2.4.1.80 | Ceramide glucosyltransferase. |
| 2.4.1.81 | Flavone 7-O-beta-glucosyltransferase. |
| 2.4.1.82 | Galactinol--sucrose galactosyltransferase. |
| 2.4.1.83 | Dolichyl-phosphate beta-D-mannosyltransferase. |
| 2.4.1.85 | Cyanohydrin beta-glucosyltransferase. |
| 2.4.1.86 | Glucosaminylgalactosylglucosylceramide beta-galactosyltransferase. |
| 2.4.1.87 | N-acetyllactosaminide 3-alpha-galactosyltransferase. |
| 2.4.1.88 | Globoside alpha-N-acetylgalactosaminyltransferase. |
| 2.4.1.90 | N-acetyllactosamine synthase. |
| 2.4.1.91 | Flavonol 3-O-glucosyltransferase. |
| 2.4.1.92 | (N-acetylneuraminyl)-galactosylglucosylceramide N-acetylgalactosaminyltransferase. |
| 2.4.1.94 | Protein N-acetylglucosaminyltransferase. |
| 2.4.1.95 | Bilirubin-glucuronoside glucuronosyltransferase. |
| 2.4.1.96 | Sn-glycerol-3-phosphate 1-galactosyltransferase. |
| 2.4.1.97 | 1,3-beta-D-glucan phosphorylase. |
| 2.4.1.99 | Sucrose:sucrose fructosyltransferase. |
| 2.4.1.100 | 2,1-fructan:2,1-fructan 1-fructosyltransferase. |
| 2.4.1.101 | Alpha-1,3-mannosyl-glycoprotein 2-beta-N-acetylglucosaminyltransferase. |
| 2.4.1.102 | Beta-1,3-galactosyl-O-glycosyl-glycoprotein beta-1,6-N-acetylglucosaminyltransferase. |
| 2.4.1.103 | Alizarin 2-beta-glucosyltransferase. |
| 2.4.1.104 | O-dihydroxycoumarin 7-O-glucosyltransferase. |
| 2.4.1.105 | Vitexin beta-glucosyltransferase. |
| 2.4.1.106 | Isovitexin beta-glucosyltransferase. |
| 2.4.1.109 | Dolichyl-phosphate-mannose--protein mannosyltransferase. |
| 2.4.1.110 | tRNA-queuosine beta-mannosyltransferase. |
| 2.4.1.111 | Coniferyl-alcohol glucosyltransferase. |
| 2.4.1.112 | Alpha-1,4-glucan-protein synthase (UDP-forming). |
| 2.4.1.113 | Alpha-1,4-glucan-protein synthase (ADP-forming). |
| 2.4.1.114 | 2-coumarate O-beta-glucosyltransferase. |
| 2.4.1.115 | Anthocyanidin 3-O-glucosyltransferase. |
| 2.4.1.116 | Cyanidin-3-rhamnosylglucoside 5-O-glucosyltransferase. |
| 2.4.1.117 | Dolichyl-phosphate beta-glucosyltransferase. |
| 2.4.1.118 | Cytokinin 7-beta-glucosyltransferase. |
| 2.4.1.119 | Dolichyl-diphosphooligosaccharide--protein glycotransferase. |
| 2.4.1.120 | Sinapate 1-glucosyltransferase. |
| 2.4.1.121 | Indole-3-acetate beta-glucosyltransferase. |
| 2.4.1.122 | Glycoprotein-N-acetylgalactosamine 3-beta-galactosyltransferase. |
| 2.4.1.123 | Inositol 3-alpha-galactosyltransferase. |
| 2.4.1.125 | Sucrose--1,6-alpha-glucan 3(6)-alpha-glucosyltransferase. |
| 2.4.1.126 | Hydroxycinnamate 4-beta-glucosyltransferase. |
| 2.4.1.127 | Monoterpenol beta-glucosyltransferase. |
| 2.4.1.128 | Scopoletin glucosyltransferase. |
| 2.4.1.129 | Peptidoglycan glycosyltransferase. |
| 2.4.1.130 | Dolichyl-phosphate-mannose--glycolipid alpha-mannosyltransferase. |
| 2.4.1.131 | Glycolipid 2-alpha-mannosyltransferase. |
| 2.4.1.132 | Glycolipid 3-alpha-mannosyltransferase. |
| 2.4.1.133 | Xylosylprotein 4-beta-galactosyltransferase. |
| 2.4.1.134 | Galactosylxylosylprotein 3-beta-galactosyltransferase. |
| 2.4.1.135 | Galactosylgalactosylxylosylprotein 3-beta-glucuronosyltransferase. |
| 2.4.1.136 | Gallate 1-beta-glucosyltransferase. |
| 2.4.1.137 | Sn-glycerol-3-phosphate 2-alpha-galactosyltransferase. |
| 2.4.1.138 | Mannotetraose 2-alpha-N-acetylglucosaminyltransferase. |

TABLE 2-continued

EC Numbers with the corresponding name given to each enzyme class, subclass and sub-subclass.

| | |
|---|---|
| 2.4.1.139 | Maltose synthase. |
| 2.4.1.140 | Alternansucrase. |
| 2.4.1.141 | N-acetylglucosaminyldiphosphodolichol N-acetylglucosaminyltransferase. |
| 2.4.1.142 | Chitobiosyldiphosphodolichol beta-mannosyltransferase. |
| 2.4.1.143 | Alpha-1,6-mannosyl-glycoprotein 2-beta-N-acetylglucosaminyltransferase. |
| 2.4.1.144 | Beta-1,4-mannosyl-glycoprotein 4-beta-N-acetylglucosaminyltransferase. |
| 2.4.1.145 | Alpha-1,3-mannosyl-glycoprotein 4-beta-N-acetylglucosaminyltransferase. |
| 2.4.1.146 | Beta-1,3-galactosyl-O-glycosyl-glycoprotein beta-1,3-N-acetylglucosaminyltransferase. |
| 2.4.1.147 | Acetylgalactosaminyl-O-glycosyl-glycoprotein beta-1,3-N-acetylglucosaminyltransferase. |
| 2.4.1.148 | Acetylgalactosaminyl-O-glycosyl-glycoprotein beta-1,6-N-acetylglucosaminyltransferase. |
| 2.4.1.149 | N-acetyllactosaminide beta-1,3-N-acetylglucosaminyltransferase. |
| 2.4.1.150 | N-acetyllactosaminide beta-1,6-N-acetylglucosaminyl-transferase. |
| 2.4.1.152 | 4-galactosyl-N-acetylglucosaminide 3-alpha-L-fucosyltransferase. |
| 2.4.1.153 | Dolichyl-phosphate alpha-N-acetylglucosaminyltransferase. |
| 2.4.1.154 | Globotriosylceramide beta-1,6-N-acetylgalactosaminyl-transferase. |
| 2.4.1.155 | Alpha-1,6-mannosyl-glycoprotein 6-beta-N-acetylglucosaminyltransferase. |
| 2.4.1.156 | Indolylacetyl-myo-inositol galactosyltransferase. |
| 2.4.1.157 | 1,2-diacylglycerol 3-glucosyltransferase. |
| 2.4.1.158 | 13-hydroxydocosanoate 13-beta-glucosyltransferase. |
| 2.4.1.159 | Flavonol-3-O-glucoside L-rhamnosyltransferase. |
| 2.4.1.160 | Pyridoxine 5'-O-beta-D-glucosyltransferase. |
| 2.4.1.161 | Oligosaccharide 4-alpha-D-glucosyltransferase. |
| 2.4.1.162 | Aldose beta-D-fructosyltransferase. |
| 2.4.1.163 | Beta-galactosyl-N-acetylglucosaminylgalactosylglucosyl-ceramide beta-1,3-acetylglucosaminyltransferase. |
| 2.4.1.164 | Galactosyl-N-acetylglucosaminylgalactosylglucosyl-ceramide beta-1,6-N-acetylglucosaminyltransferase. |
| 2.4.1.165 | N-acetylneuraminylgalactosylglucosylceramide beta-1,4-N-acetylgalactosaminyltransferase. |
| 2.4.1.166 | Raffinose--raffinose alpha-galactosyltransferase. |
| 2.4.1.167 | Sucrose 6(F)-alpha-galactosyltransferase. |
| 2.4.1.168 | Xyloglucan 4-glucosyltransferase. |
| 2.4.1.170 | Isoflavone 7-O-glucosyltransferase. |
| 2.4.1.171 | Methyl-ONN-azoxymethanol beta-D-glucosyltransferase. |
| 2.4.1.172 | Salicyl-alcohol beta-D-glucosyltransferase. |
| 2.4.1.173 | Sterol 3-beta-glucosyltransferase. |
| 2.4.1.174 | Glucuronylgalactosylproteoglycan 4-beta-N-acetylgalactosaminyltransferase. |
| 2.4.1.175 | Glucuronosyl-N-acetylgalactosaminyl-proteoglycan 4-beta-N-acetylgalactosaminyltransferase. |
| 2.4.1.176 | Gibberellin beta-D-glucosyltransferase. |
| 2.4.1.177 | Cinnamate beta-D-glucosyltransferase. |
| 2.4.1.178 | Hydroxymandelonitrile glucosyltransferase. |
| 2.4.1.179 | Lactosylceramide beta-1,3-galactosyltransferase. |
| 2.4.1.180 | Lipopolysaccharide N-acetylmannosaminouronosyltransferase. |
| 2.4.1.181 | Hydroxyanthraquinone glucosyltransferase. |
| 2.4.1.182 | Lipid-A-disaccharide synthase. |
| 2.4.1.183 | Alpha-1,3-glucan synthase. |
| 2.4.1.184 | Galactolipid galactosyltransferase. |
| 2.4.1.185 | Flavanone 7-O-beta-glucosyltransferase. |
| 2.4.1.186 | Glycogenin glucosyltransferase. |
| 2.4.1.187 | N-acetylglucosaminyldiphosphoundecaprenol N-acetyl-beta-D-mannosaminyltransferase. |
| 2.4.1.188 | N-acetylglucosaminyldiphosphoundecaprenol glucosyltransferase. |
| 2.4.1.189 | Luteolin 7-O-glucuronosyltransferase. |
| 2.4.1.190 | Luteolin-7-O-glucuronide 7-O-glucuronosyltransferase. |
| 2.4.1.191 | Luteolin-7-O-diglucuronide 4'-O-glucuronosyltransferase. |
| 2.4.1.192 | Nuatigenin 3-beta-glucosyltransferase. |
| 2.4.1.193 | Sarsapogenin 3-beta-glucosyltransferase. |
| 2.4.1.194 | 4-hydroxybenzoate 4-O-beta-D-glucosyltransferase. |
| 2.4.1.195 | Thiohydroximate beta-D-glucosyltransferase. |
| 2.4.1.196 | Nicotinate glucosyltransferase. |
| 2.4.1.197 | High-mannose-oligosaccharide beta-1,4-N-acetylglucosaminyltransferase. |
| 2.4.1.198 | Phosphatidylinositol N-acetylglucosaminyltransferase. |
| 2.4.1.199 | Beta-mannosylphosphodecaprenol-mannooligosaccharide 6-mannosyltransferase. |
| 2.4.1.201 | Alpha-1,6-mannosyl-glycoprotein 4-beta-N-acetylglucosaminyltransferase. |
| 2.4.1.202 | 2,4-dihydroxy-7-methoxy-2H-1,4-benzoxazin-3(4H)-one 2-D-glucosyltransferase. |
| 2.4.1.203 | Trans-zeatin O-beta-D-glucosyltransferase. |
| 2.4.1.205 | Galactogen 6-beta-galactosyltransferase. |
| 2.4.1.206 | Lactosylceramide 1,3-N-acetyl-beta-D-glucosaminyltransferase. |
| 2.4.1.207 | Xyloglucan:xyloglucosyl transferase. |
| 2.4.1.208 | Diglucosyl diacylglycerol synthase. |
| 2.4.1.209 | Cis-p-coumarate glucosyltransferase. |
| 2.4.1.210 | Limonoid glucosyltransferase. |
| 2.4.1.211 | 1,3-beta-galactosyl-N-acetylhexosamine phosphorylase. |
| 2.4.1.212 | Hyaluronan synthase. |
| 2.4.1.213 | Glucosylglycerol-phosphate synthase. |
| 2.4.1.214 | Glycoprotein 3-alpha-L-fucosyltransferase. |
| 2.4.1.215 | Cis-zeatin O-beta-D-glucosyltransferase. |
| 2.4.1.216 | Trehalose 6-phosphate phosphorylase. |
| 2.4.1.217 | Mannosyl-3-phosphoglycerate synthase. |
| 2.4.1.218 | Hydroquinone glucosyltransferase. |
| 2.4.1.219 | Vomilenine glucosyltransferase. |
| 2.4.1.220 | Indoxyl-UDPG glucosyltransferase. |
| 2.4.1.221 | Peptide-O-fucosyltransferase. |
| 2.4.1.222 | O-fucosylpeptide 3-beta-N-acetylglucosaminyltransferase. |
| 2.4.1.223 | Glucuronyl-galactosyl-proteoglycan 4-alpha-N-acetylglucosaminyltransferase. |
| 2.4.1.224 | Glucuronosyl-N-acetylglucosaminyl-proteoglycan 4-alpha-N-acetylglucosaminyltransferase. |
| 2.4.1.225 | N-acetylglucosaminyl-proteoglycan 4-beta-glucuronosyltransferase. |
| 2.4.1.226 | N-acetylgalactosaminyl-proteoglycan 3-beta-glucuronosyltransferase. |
| 2.4.1.227 | Undecaprenyldiphospho-muramoylpentapeptide beta-N-acetylglucosaminyltransferase. |

TABLE 2-continued

EC Numbers with the corresponding name given to each enzyme class, subclass and sub-subclass.

| | |
|---|---|
| 2.4.1.228 | Lactosylceramide4-alpha-galactosyltransferase. |
| 2.4.1.229 | [Skp1-protein]-hydroxyproline N-acetylglucosaminyltransferase. |
| 2.4.1.230 | Kojibiose phosphorylase. |
| 2.4.1.231 | Alpha,alpha-trehalose phosphorylase (configuration-retaining). |
| 2.4.1.232 | Initiation-specific alpha-1,6-mannosyltransferase. |
| 2.4.2.1 | Purine-nucleoside phosphorylase. |
| 2.4.2.2 | Pyrimidine-nucleoside phosphorylase. |
| 2.4.2.3 | Uridine phosphorylase. |
| 2.4.2.4 | Thymidine phosphorylase. |
| 2.4.2.5 | Nucleoside ribosyltransferase. |
| 2.4.2.6 | Nucleoside deoxyribosyltransferase. |
| 2.4.2.7 | Adenine phosphoribosyltransferase. |
| 2.4.2.8 | Hypoxanthine phosphoribosyltransferase. |
| 2.4.2.9 | Uracil phosphoribosyltransferase. |
| 2.4.2.10 | Orotate phosphoribosyltransferase. |
| 2.4.2.11 | Nicotinate phosphoribosyltransferase. |
| 2.4.2.12 | Nicotinamide phosphoribosyltransferase. |
| 2.4.2.14 | Amidophosphoribosyltransferase. |
| 2.4.2.15 | Guanosine phosphorylase. |
| 2.4.2.16 | Urate-ribonucleotide phosphorylase. |
| 2.4.2.17 | ATP phosphoribosyltransferase. |
| 2.4.2.18 | Anthranilate phosphoribosyltransferase. |
| 2.4.2.19 | Nicotinate-nucleotide diphosphorylase (carboxylating). |
| 2.4.2.20 | Dioxotetrahydropyrimidine phosphoribosyltransferase. |
| 2.4.2.21 | Nicotinate-nucleotide--dimethylbenzimidazole phosphoribosyltransferase. |
| 2.4.2.22 | Xanthine phosphoribosyltransferase. |
| 2.4.2.23 | Deoxyuridine phosphorylase. |
| 2.4.2.24 | 1,4-beta-D-xylan synthase. |
| 2.4.2.25 | Flavone apiosyltransferase. |
| 2.4.2.26 | Protein xylosyltransferase. |
| 2.4.2.27 | dTDP-dihydrostreptose--streptidine-6-phosphate dihydrostreptosyltransferase. |
| 2.4.2.28 | S-methyl-5-thioadenosine phosphorylase. |
| 2.4.2.29 | Queuine tRNA-ribosyltransferase. |
| 2.4.2.30 | NAD(+) ADP-ribosyltransferase. |
| 2.4.2.31 | NAD(P)(+)--arginine ADP-ribosyltransferase. |
| 2.4.2.32 | Dolichyl-phosphate D-xylosyltransferase. |
| 2.4.2.33 | Dolichyl-xylosyl-phosphate--protein xylosyltransferase. |
| 2.4.2.34 | Indolylacetylinositol arabinosyltransferase. |
| 2.4.2.35 | Flavonol-3-O-glycoside xylosyltransferase. |
| 2.4.2.36 | NAD(+)--diphthamide ADP-ribosyltransferase. |
| 2.4.2.37 | NAD(+)--dinitrogen-reductase ADP-D-ribosyltransferase. |
| 2.4.2.38 | Glycoprotein 2-beta-D-xylosyltransferase. |
| 2.4.2.39 | Xyloglucan 6-xylosyltransferase. |
| 2.4.2.40 | Zeatin O-beta-D-xylosyltransferase. |
| 2.4.99.1 | Beta-galactoside alpha-2,6-sialyltransferase. |
| 2.4.99.2 | Monosialoganglioside sialyltransferase. |
| 2.4.99.3 | Alpha-N-acetylgalactosaminide alpha-2,6-sialyltransferase. |
| 2.4.99.4 | Beta-galactoside alpha-2,3-sialyltransferase. |
| 2.4.99.5 | Galactosyldiacylglycerol alpha-2,3-sialyltransferase. |
| 2.4.99.6 | N-acetyllactosaminide alpha-2,3-sialyltransferase. |
| 2.4.99.7 | (Alpha-N-acetylneuraminyl-2,3-beta-galactosyl-1,3)-N-acetyl-galactosaminide 6-alpha-sialyltransferase. |
| 2.4.99.8 | Alpha-N-acetylneuraminate alpha-2,8-sialyltransferase. |
| 2.4.99.9 | Lactosylceramide alpha-2,3-sialyltransferase. |
| 2.4.99.10 | Neolactotetraosylceramide alpha-2,3-sialyltransferase. |
| 2.4.99.11 | Lactosylceramide alpha-2,6-N-sialyltransferase. |
| 2.5.1.1 | Dimethylallyltranstransferase. |
| 2.5.1.2 | Thiamine pyridinylase. |
| 2.5.1.3 | Thiamine-phosphate diphosphorylase. |
| 2.5.1.4 | Adenosylmethionine cyclotransferase. |
| 2.5.1.5 | Galactose-6-sulfurylase. |
| 2.5.1.6 | Methionine adenosyltransferase. |
| 2.5.1.7 | UDP-N-acetylglucosamine 1-carboxyvinyltransferase. |
| 2.5.1.8 | tRNA isopentenyltransferase. |
| 2.5.1.9 | Riboflavin synthase. |
| 2.5.1.10 | Geranyltranstransferase. |
| 2.5.1.11 | Trans-octaprenyltranstransferase. |
| 2.5.1.15 | Dihydropteroate synthase. |
| 2.5.1.16 | Spermidine synthase. |
| 2.5.1.17 | Cob(I)yrinic acid a,c-diamide adenosyltransferase. |
| 2.5.1.18 | Glutathione transferase. |
| 2.5.1.19 | 3-phosphoshikimate 1-carboxyvinyltransferase. |
| 2.5.1.20 | Rubber cis-polyprenylcistransferase. |
| 2.5.1.21 | Farnesyl-diphosphate farnesyltransferase. |
| 2.5.1.22 | Spermine synthase. |
| 2.5.1.23 | Sym-norspermidine synthase. |
| 2.5.1.24 | Discadenine synthase. |
| 2.5.1.25 | tRNA-uridine aminocarboxypropyltransferase. |
| 2.5.1.26 | Alkylglycerone-phosphate synthase. |
| 2.5.1.27 | Adenylate dimethylallyltransferase. |
| 2.5.1.28 | Dimethylallylcistransferase. |
| 2.5.1.29 | Farnesyltranstransferase. |
| 2.5.1.30 | Trans-hexaprenyltranstransferase. |
| 2.5.1.31 | Di-trans,poly-cis-decaprenylcistransferase. |
| 2.5.1.32 | Geranylgeranyl-diphosphate geranylgeranyltransferase. |
| 2.5.1.33 | Trans-pentaprenyltranstransferase. |
| 2.5.1.34 | Tryptophan dimethylallyltransferase. |
| 2.5.1.35 | Aspulvinone dimethylallyltransferase. |
| 2.5.1.36 | Trihydroxypterocarpan dimethylallyltransferase. |
| 2.5.1.38 | Isonocardicin synthase. |
| 2.5.1.39 | 4-hydroxybenzoate nonaprenyltransferase. |
| 2.5.1.41 | Phosphoglycerol geranylgeranyltransferase. |
| 2.5.1.42 | Geranylgeranylglycerol-phosphate geranylgeranyltransferase. |
| 2.5.1.43 | Nicotianamine synthase. |
| 2.5.1.44 | Homospermidine synthase. |
| 2.5.1.45 | Homospermidine synthase (spermidine-specific). |
| 2.5.1.46 | Deoxyhypusine synthase. |
| 2.5.1.47 | Cysteine synthase. |
| 2.5.1.48 | Cystathionine gamma-synthase. |
| 2.5.1.49 | O-acetylhomoserine aminocarboxypropyltransferase. |
| 2.5.1.50 | Zeatin 9-aminocarboxyethyltransferase. |
| 2.5.1.51 | Beta-pyrazolylalanine synthase. |
| 2.5.1.52 | L-mimosine synthase. |
| 2.5.1.53 | Uracilylalanine synthase. |
| 2.5.1.54 | 3-deoxy-7-phosphoheptulonate synthase. |
| 2.5.1.55 | 3-deoxy-8-phosphooctulonate synthase. |
| 2.5.1.56 | N-acetylneuraminate synthase. |
| 2.5.1.57 | N-acylneuraminate-9-phosphate synthase. |
| 2.5.1.58 | Protein farnesyltransferase. |
| 2.5.1.59 | Protein geranylgeranyltransferase type I. |
| 2.5.1.60 | Protein geranylgeranyltransferase type II. |
| 2.5.1.61 | Hydroxymethylbilane synthase. |
| 2.5.1.62 | Chlorophyll synthase. |
| 2.5.1.63 | Adenosyl-fluoride synthase. |
| 2.5.1.64 | 2-succinyl-6-hydroxy-2,4-cyclohexadiene-1-carboxylate synthase. |

TABLE 2-continued

EC Numbers with the corresponding name given to each enzyme class, subclass and sub-subclass.

| | |
|---|---|
| 2.6.1.1 | Aspartate transaminase. |
| 2.6.1.2 | Alanine transaminase. |
| 2.6.1.3 | Cysteine transaminase. |
| 2.6.1.4 | Glycine transaminase. |
| 2.6.1.5 | Tyrosine transaminase. |
| 2.6.1.6 | Leucine transaminase. |
| 2.6.1.7 | Kynurenine--oxoglutarate transaminase. |
| 2.6.1.8 | 2,5-diaminovalerate transaminase. |
| 2.6.1.9 | Histidinol-phosphate transaminase. |
| 2.6.1.11 | Acetylornithine transaminase. |
| 2.6.1.12 | Alanine--oxo-acid transaminase. |
| 2.6.1.13 | Ornithine--oxo-acid transaminase. |
| 2.6.1.14 | Asparagine--oxo-acid transaminase. |
| 2.6.1.15 | Glutamine--pyruvate transaminase. |
| 2.6.1.16 | Glutamine--fructose-6-phosphate transaminase (isomerizing). |
| 2.6.1.17 | Succinyldiaminopimelate transaminase. |
| 2.6.1.18 | Beta-alanine--pyruvate transaminase. |
| 2.6.1.19 | 4-aminobutyrate transaminase. |
| 2.6.1.21 | D-alanine transaminase. |
| 2.6.1.22 | (S)-3-amino-2-methylpropionate transaminase. |
| 2.6.1.23 | 4-hydroxyglutamate transaminase. |
| 2.6.1.24 | Diiodotyrosine transaminase. |
| 2.6.1.26 | Thyroid-hormone transaminase. |
| 2.6.1.27 | Tryptophan transaminase. |
| 2.6.1.28 | Tryptophan--phenylpyruvate transaminase. |
| 2.6.1.29 | Diamine transaminase. |
| 2.6.1.30 | Pyridoxamine--pyruvate transaminase. |
| 2.6.1.31 | Pyridoxamine--oxaloacetate transaminase. |
| 2.6.1.32 | Valine--3-methyl-2-oxovalerate transaminase. |
| 2.6.1.33 | dTDP-4-amino-4,6-dideoxy-D-glucose transaminase. |
| 2.6.1.34 | UDP-2-acetamido-4-amino-2,4,6-trideoxyglucose transaminase. |
| 2.6.1.35 | Glycine--oxaloacetate transaminase. |
| 2.6.1.36 | L-lysine 6-transaminase. |
| 2.6.1.37 | 2-aminoethylphosphonate--pyruvate transaminase. |
| 2.6.1.38 | Histidine transaminase. |
| 2.6.1.39 | 2-aminoadipate transaminase. |
| 2.6.1.40 | (R)-3-amino-2-methylpropionate--pyruvate transaminase. |
| 2.6.1.41 | D-methionine--pyruvate transaminase. |
| 2.6.1.42 | Branched-chain-amino-acid transaminase. |
| 2.6.1.43 | Aminolevulinate transaminase. |
| 2.6.1.44 | Alanine--glyoxylate transaminase. |
| 2.6.1.45 | Serine--glyoxylate transaminase. |
| 2.6.1.46 | Diaminobutyrate--pyruvate transaminase. |
| 2.6.1.47 | Alanine--oxomalonate transaminase. |
| 2.6.1.48 | 5-aminovalerate transaminase. |
| 2.6.1.49 | Dihydroxyphenylalanine transaminase. |
| 2.6.1.50 | Glutamine--scyllo-inositol transaminase. |
| 2.6.1.51 | Serine--pyruvate transaminase. |
| 2.6.1.52 | Phosphoserine transaminase. |
| 2.6.1.54 | Pyridoxamine-phosphate transaminase. |
| 2.6.1.55 | Taurine-2-oxoglutarate transaminase. |
| 2.6.1.56 | 1D-1-guanidino-3-amino-1,3-dideoxy-scyllo-inositol transaminase. |
| 2.6.1.57 | Aromatic-amino-acid transaminase. |
| 2.6.1.58 | Phenylalanine(histidine) transaminase. |
| 2.6.1.59 | dTDP-4-amino-4,6-dideoxygalactose transaminase. |
| 2.6.1.60 | Aromatic-amino-acid--glyoxylate transaminase. |
| 2.6.1.62 | Adenosylmethionine--8-amino-7-oxononanoate transaminase. |
| 2.6.1.63 | Kynurenine--glyoxylate transaminase. |
| 2.6.1.64 | Glutamine--phenylpyruvate transaminase. |
| 2.6.1.65 | N(6)-acetyl-beta-lysine transaminase. |
| 2.6.1.66 | Valine--pyruvate transaminase. |
| 2.6.1.67 | 2-aminohexanoate transaminase. |
| 2.6.1.68 | Ornithine(lysine) transaminase. |
| 2.6.1.70 | Aspartate--phenylpyruvate transaminase. |
| 2.6.1.71 | Lysine--pyruvate 6-transaminase. |
| 2.6.1.72 | D-4-hydroxyphenylglycine transaminase. |
| 2.6.1.73 | Methionine--glyoxylate transaminase. |
| 2.6.1.74 | Cephalosporin-C transaminase. |
| 2.6.1.75 | Cysteine-conjugate transaminase. |
| 2.6.1.76 | Diaminobutyrate--2-oxoglutarate transaminase. |
| 2.6.1.77 | Taurine--pyruvate aminotransferase. |
| 2.6.3.1 | Oximinotransferase. |
| 2.6.99.1 | dATP(dGTP)--DNA purinetransferase. |
| 2.7.1.1 | Hexokinase. |
| 2.7.1.2 | Glucokinase. |
| 2.7.1.3 | Ketohexokinase. |
| 2.7.1.4 | Fructokinase. |
| 2.7.1.5 | Rhamnulokinase. |
| 2.7.1.6 | Galactokinase. |
| 2.7.1.7 | Mannokinase. |
| 2.7.1.8 | Glucosamine kinase. |
| 2.7.1.10 | Phosphoglucokinase. |
| 2.7.1.11 | 6-phosphofructokinase. |
| 2.7.1.12 | Gluconokinase. |
| 2.7.1.13 | Dehydrogluconokinase. |
| 2.7.1.14 | Sedoheptulokinase. |
| 2.7.1.15 | Ribokinase. |
| 2.7.1.16 | Ribulokinase. |
| 2.7.1.17 | Xylulokinase. |
| 2.7.1.18 | Phosphoribokinase. |
| 2.7.1.19 | Phosphoribulokinase. |
| 2.7.1.20 | Adenosine kinase. |
| 2.7.1.21 | Thymidine kinase. |
| 2.7.1.22 | Ribosylnicotinamide kinase. |
| 2.7.1.23 | NAD(+) kinase. |
| 2.7.1.24 | Dephospho-CoA kinase. |
| 2.7.1.25 | Adenylyl-sulfate kinase. |
| 2.7.1.26 | Riboflavin kinase. |
| 2.7.1.27 | Erythritol kinase. |
| 2.7.1.28 | Triokinase. |
| 2.7.1.29 | Glycerone kinase. |
| 2.7.1.30 | Glycerol kinase. |
| 2.7.1.31 | Glycerate kinase. |
| 2.7.1.32 | Choline kinase. |
| 2.7.1.33 | Pantothenate kinase. |
| 2.7.1.34 | Pantetheine kinase. |
| 2.7.1.35 | Pyridoxal kinase. |
| 2.7.1.36 | Mevalonate kinase. |
| 2.7.1.37 | Protein kinase. |
| 2.7.1.38 | Phosphorylase kinase. |
| 2.7.1.39 | Homoserine kinase. |
| 2.7.1.40 | Pyruvate kinase. |
| 2.7.1.41 | Glucose-1-phosphate phosphodismutase. |
| 2.7.1.42 | Riboflavin phosphotransferase. |
| 2.7.1.43 | Glucuronokinase. |
| 2.7.1.44 | Galacturonokinase. |
| 2.7.1.45 | 2-dehydro-3-deoxygluconokinase. |
| 2.7.1.46 | L-arabinokinase. |
| 2.7.1.47 | D-ribulokinase. |
| 2.7.1.48 | Uridine kinase. |
| 2.7.1.49 | Hydroxymethylpyrimidine kinase. |
| 2.7.1.50 | Hydroxyethylthiazole kinase. |
| 2.7.1.51 | L-fuculokinase. |
| 2.7.1.52 | Fucokinase. |
| 2.7.1.53 | L-xylulokinase. |
| 2.7.1.54 | D-arabinokinase. |
| 2.7.1.55 | Allose kinase. |
| 2.7.1.56 | 1-phosphofructokinase. |
| 2.7.1.58 | 2-dehydro-3-deoxygalactonokinase. |
| 2.7.1.59 | N-acetylglucosamine kinase. |
| 2.7.1.60 | N-acylmannosamine kinase. |
| 2.7.1.61 | Acyl-phosphate--hexose phosphotransferase. |
| 2.7.1.62 | Phosphoramidate--hexose phosphotransferase. |

TABLE 2-continued

EC Numbers with the corresponding name given to each enzyme class, subclass and sub-subclass.

| | |
|---|---|
| 2.7.1.63 | Polyphosphate--glucose phosphotransferase. |
| 2.7.1.64 | Inositol 3-kinase. |
| 2.7.1.65 | Scyllo-inosamine 4-kinase. |
| 2.7.1.66 | Undecaprenol kinase. |
| 2.7.1.67 | 1-phosphatidylinositol 4-kinase. |
| 2.7.1.68 | 1-phosphatidylinositol-4-phosphate 5-kinase. |
| 2.7.1.69 | Protein-N(pi)-phosphohistidine--sugar phosphotransferase. |
| 2.7.1.71 | Shikimate kinase. |
| 2.7.1.72 | Streptomycin 6-kinase. |
| 2.7.1.73 | Inosine kinase. |
| 2.7.1.74 | Deoxycytidine kinase. |
| 2.7.1.76 | Deoxyadenosine kinase. |
| 2.7.1.77 | Nucleoside phosphotransferase. |
| 2.7.1.78 | Polynucleotide 5'-hydroxy-kinase. |
| 2.7.1.79 | Diphosphate--glycerol phosphotransferase. |
| 2.7.1.80 | Diphosphate--serine phosphotransferase. |
| 2.7.1.81 | Hydroxylysine kinase. |
| 2.7.1.82 | Ethanolamine kinase. |
| 2.7.1.83 | Pseudouridine kinase. |
| 2.7.1.84 | Alkylglycerone kinase. |
| 2.7.1.85 | Beta-glucoside kinase. |
| 2.7.1.86 | NADH kinase. |
| 2.7.1.87 | Streptomycin 3''-kinase. |
| 2.7.1.88 | Dihydrostreptomycin-6-phosphate 3'-alpha-kinase. |
| 2.7.1.89 | Thiamine kinase. |
| 2.7.1.90 | Diphosphate--fructose-6-phosphate 1-phosphotransferase. |
| 2.7.1.91 | Sphinganine kinase. |
| 2.7.1.92 | 5-dehydro-2-deoxygluconokinase. |
| 2.7.1.93 | Alkylglycerol kinase. |
| 2.7.1.94 | Acylglycerol kinase. |
| 2.7.1.95 | Kanamycin kinase. |
| 2.7.1.99 | [Pyruvate dehydrogenase (lipoamide)]kinase. |
| 2.7.1.100 | S-methyl-5-thioribose kinase. |
| 2.7.1.101 | Tagatose kinase. |
| 2.7.1.102 | Hamamelose kinase. |
| 2.7.1.103 | Viomycin kinase. |
| 2.7.1.104 | Diphosphate--protein phosphotransferase. |
| 2.7.1.105 | 6-phosphofructo-2-kinase. |
| 2.7.1.106 | Glucose-1,6-bisphosphate synthase. |
| 2.7.1.107 | Diacylglycerol kinase. |
| 2.7.1.108 | Dolichol kinase. |
| 2.7.1.109 | [Hydroxymethylglutaryl-CoA reductase (NADPH)] kinase. |
| 2.7.1.110 | Dephospho-[reductase kinase] kinase. |
| 2.7.1.112 | Protein-tyrosine kinase. |
| 2.7.1.113 | Deoxyguanosine kinase. |
| 2.7.1.114 | AMP--thymidine kinase. |
| 2.7.1.115 | [3-methyl-2-oxobutanoate dehydrogenase (lipoamide)] kinase. |
| 2.7.1.116 | [Isocitrate dehydrogenase (NADP+)] kinase. |
| 2.7.1.117 | [Myosin light-chain] kinase. |
| 2.7.1.118 | ADP--thymidine kinase. |
| 2.7.1.119 | Hygromycin-B kinase. |
| 2.7.1.120 | Caldesmon kinase. |
| 2.7.1.121 | Phosphoenolpyruvate--glycerone phosphotransferase. |
| 2.7.1.122 | Xylitol kinase. |
| 2.7.1.123 | Calcium/calmodulin-dependent protein kinase. |
| 2.7.1.124 | [Tyrosine 3-monooxygenase] kinase. |
| 2.7.1.125 | Rhodopsin kinase. |
| 2.7.1.126 | [Beta-adrenergic-receptor] kinase. |
| 2.7.1.127 | Inositol-trisphosphate 3-kinase. |
| 2.7.1.128 | [Acetyl-CoA carboxylase] kinase. |
| 2.7.1.129 | [Myosin heavy-chain] kinase. |
| 2.7.1.130 | Tetraacyldisaccharide 4'-kinase. |
| 2.7.1.131 | [Low-density lipoprotein receptor] kinase. |
| 2.7.1.132 | Tropomyosin kinase. |
| 2.7.1.134 | Inositol-tetrakisphosphate 1-kinase. |
| 2.7.1.135 | [Tau protein] kinase. |
| 2.7.1.136 | Macrolide 2'-kinase. |
| 2.7.1.137 | Phosphatidylinositol 3-kinase. |
| 2.7.1.138 | Ceramide kinase. |
| 2.7.1.140 | Inositol-tetrakisphosphate 5-kinase. |
| 2.7.1.141 | [RNA-polymerase]-subunit kinase. |
| 2.7.1.142 | Glycerol-3-phosphate--glucose phosphotransferase. |
| 2.7.1.143 | Diphosphate-purine nucleoside kinase. |
| 2.7.1.144 | Tagatose-6-phosphate kinase. |
| 2.7.1.145 | Deoxynucleoside kinase. |
| 2.7.1.146 | ADP-specific phosphofructokinase. |
| 2.7.1.147 | ADP-specific glucokinase. |
| 2.7.1.148 | 4-(cytidine 5'-diphospho)-2-C-methyl-D-erythritol kinase. |
| 2.7.1.149 | 1-phosphatidylinositol-5-phosphate 4-kinase. |
| 2.7.1.150 | 1-phosphatidylinositol-3-phosphate 5-kinase. |
| 2.7.1.151 | Inositol-polyphosphate multikinase. |
| 2.7.1.153 | Phosphatidylinositol-4,5-bisphosphate 3-kinase. |
| 2.7.1.154 | Phosphatidylinositol-4-phosphate 3-kinase. |
| 2.7.1.155 | Diphosphoinositol-pentakisphosphate kinase. |
| 2.7.1.156 | Adenosylcobinamide kinase. |
| 2.7.2.1 | Acetate kinase. |
| 2.7.2.2 | Carbamate kinase. |
| 2.7.2.3 | Phosphoglycerate kinase. |
| 2.7.2.4 | Aspartate kinase. |
| 2.7.2.6 | Formate kinase. |
| 2.7.2.7 | Butyrate kinase. |
| 2.7.2.8 | Acetylglutamate kinase. |
| 2.7.2.10 | Phosphoglycerate kinase (GTP). |
| 2.7.2.11 | Glutamate 5-kinase. |
| 2.7.2.12 | Acetate kinase (diphosphate). |
| 2.7.2.13 | Glutamate 1-kinase. |
| 2.7.2.14 | Branched-chain-fatty-acid kinase. |
| 2.7.3.1 | Guanidinoacetate kinase. |
| 2.7.3.2 | Creatine kinase. |
| 2.7.3.3 | Arginine kinase. |
| 2.7.3.4 | Taurocyamine kinase. |
| 2.7.3.5 | Lombricine kinase. |
| 2.7.3.6 | Hypotaurocyamine kinase. |
| 2.7.3.7 | Opheline kinase. |
| 2.7.3.8 | Ammonia kinase. |
| 2.7.3.9 | Phosphoenolpyruvate--protein phosphotransferase. |
| 2.7.3.10 | Agmatine kinase. |
| 2.7.3.11 | Protein-histidine pros-kinase. |
| 2.7.3.12 | Protein-histidine tele-kinase. |
| 2.7.4.1 | Polyphosphate kinase. |
| 2.7.4.2 | Phosphomevalonate kinase. |
| 2.7.4.3 | Adenylate kinase. |
| 2.7.4.4 | Nucleoside-phosphate kinase. |
| 2.7.4.6 | Nucleoside-diphosphate kinase. |
| 2.7.4.7 | Phosphomethylpyrimidine kinase. |
| 2.7.4.8 | Guanylate kinase. |
| 2.7.4.9 | dTMP kinase. |
| 2.7.4.10 | Nucleoside-triphosphate--adenylate kinase. |
| 2.7.4.11 | (Deoxy)adenylate kinase. |
| 2.7.4.12 | T(2)-induced deoxynucleotide kinase. |
| 2.7.4.13 | (Deoxy)nucleoside-phosphate kinase. |
| 2.7.4.14 | Cytidylate kinase. |
| 2.7.4.15 | Thiamine-diphosphate kinase. |
| 2.7.4.16 | Thiamine-phosphate kinase. |
| 2.7.4.17 | 3-phosphoglyceroyl-phosphate--polyphosphate phosphotransferase. |
| 2.7.4.18 | Farnesyl-diphosphate kinase. |
| 2.7.4.19 | 5-methyldeoxycytidine-5'-phosphate kinase. |
| 2.7.4.20 | Dolichyl-diphosphate--polyphosphate phosphotransferase. |
| 2.7.4.21 | Inositol-hexakisphosphate kinase. |
| 2.7.6.1 | Ribose-phosphate diphosphokinase. |
| 2.7.6.2 | Thiamine diphosphokinase. |

TABLE 2-continued

EC Numbers with the corresponding name given to each enzyme class, subclass and sub-subclass.

| | |
|---|---|
| 2.7.6.3 | 2-amino-4-hydroxy-6-hydroxymethyldihydropteridine diphosphokinase. |
| 2.7.6.4 | Nucleotide diphosphokinase. |
| 2.7.6.5 | GTP diphosphokinase. |
| 2.7.7.1 | Nicotinamide-nucleotide adenylyltransferase. |
| 2.7.7.2 | FMN adenylyltransferase. |
| 2.7.7.3 | Pantetheine-phosphate adenylyltransferase. |
| 2.7.7.4 | Sulfate adenylyltransferase. |
| 2.7.7.5 | Sulfate adenylyltransferase (ADP). |
| 2.7.7.6 | DNA-directed RNA polymerase. |
| 2.7.7.7 | DNA-directed DNA polymerase. |
| 2.7.7.8 | Polyribonucleotide nucleotidyltransferase. |
| 2.7.7.9 | UTP--glucose-1-phosphate uridylyltransferase. |
| 2.7.7.10 | UTP--hexose-1-phosphate uridylyltransferase. |
| 2.7.7.11 | UTP--xylose-1-phosphate uridylyltransferase. |
| 2.7.7.12 | UDP-glucose--hexose-1-phosphate uridylyltransferase. |
| 2.7.7.13 | Mannose-1-phosphate guanylyltransferase. |
| 2.7.7.14 | Ethanolamine-phosphate cytidylyltransferase. |
| 2.7.7.15 | Choline-phosphate cytidylyltransferase. |
| 2.7.7.18 | Nicotinate-nucleotide adenylyltransferase. |
| 2.7.7.19 | Polynucleotide adenylyltransferase. |
| 2.7.7.21 | tRNA cytidylyltransferase. |
| 2.7.7.22 | Mannose-1-phosphate guanylyltransferase (GDP). |
| 2.7.7.23 | UDP-N-acetylglucosamine diphosphorylase. |
| 2.7.7.24 | Glucose-1-phosphate thymidylyltransferase. |
| 2.7.7.25 | tRNA adenylyltransferase. |
| 2.7.7.27 | Glucose-1-phosphate adenylyltransferase. |
| 2.7.7.28 | Nucleoside-triphosphate-aldose 1-phosphate nucleotidyltransferase. |
| 2.7.7.30 | Fucose-1-phosphate guanylyltransferase. |
| 2.7.7.31 | DNA nucleotidylexotransferase. |
| 2.7.7.32 | Galactose-1-phosphate thymidylyltransferase. |
| 2.7.7.33 | Glucose-1-phosphate cytidylyltransferase. |
| 2.7.7.34 | Glucose-1-phosphate guanylyltransferase. |
| 2.7.7.35 | Ribose-5-phosphate adenylyltransferase. |
| 2.7.7.36 | Aldose-1-phosphate adenylyltransferase. |
| 2.7.7.37 | Aldose-1-phosphate nucleotidyltransferase. |
| 2.7.7.38 | 3-deoxy-manno-octulosonate cytidylyltransferase. |
| 2.7.7.39 | Glycerol-3-phosphate cytidylyltransferase. |
| 2.7.7.40 | D-ribitol-5-phosphate cytidylyltransferase. |
| 2.7.7.41 | Phosphatidate cytidylyltransferase. |
| 2.7.7.42 | [Glutamate--ammonia-ligase] adenylyltransferase. |
| 2.7.7.43 | N-acylneuraminate cytidylyltransferase. |
| 2.7.7.44 | Glucuronate-1-phosphate uridylyltransferase. |
| 2.7.7.45 | Guanosine-triphosphate guanylyltransferase. |
| 2.7.7.46 | Gentamicin 2''-nucleotidyltransferase. |
| 2.7.7.47 | Streptomycin 3''-adenylyltransferase. |
| 2.7.7.48 | RNA-directed RNA polymerase. |
| 2.7.7.49 | RNA-directed DNA polymerase. |
| 2.7.7.50 | mRNA guanylyltransferase. |
| 2.7.7.51 | Adenylylsulfate--ammonia adenylyltransferase. |
| 2.7.7.52 | RNA uridylyltransferase. |
| 2.7.7.53 | ATP adenylyltransferase. |
| 2.7.7.54 | Phenylalanine adenylyltransferase. |
| 2.7.7.55 | Anthranilate adenylyltransferase. |
| 2.7.7.56 | tRNA nucleotidyltransferase. |
| 2.7.7.57 | N-methylphosphoethanolamine cytidylyltransferase. |
| 2.7.7.58 | (2,3-dihydroxybenzoyl)adenylate synthase. |
| 2.7.7.59 | [Protein-PII] uridylyltransferase. |
| 2.7.7.60 | 2-C-methyl-D-erythritol 4-phosphate cytidylyltransferase. |
| 2.7.7.61 | Holo-ACP synthase. |
| 2.7.7.62 | Adenosylcobinamide-phosphate guanylyltransferase. |
| 2.7.8.1 | Ethanolaminephosphotransferase. |
| 2.7.8.2 | Diacylglycerol cholinephosphotransferase. |
| 2.7.8.3 | Ceramide cholinephosphotransferase. |
| 2.7.8.4 | Serine-phosphoethanolamine synthase. |
| 2.7.8.5 | CDP-diacylglycerol--glycerol-3-phosphate 3-phosphatidyltransferase. |
| 2.7.8.6 | Undecaprenyl-phosphate galactose phosphotransferase. |
| 2.7.8.7 | Holo-[acyl-carrier-protein] synthase. |
| 2.7.8.8 | CDP-diacylglycerol--serine O-phosphatidyltransferase. |
| 2.7.8.9 | Phosphomannan mannosephosphotransferase. |
| 2.7.8.10 | Sphingosine cholinephosphotransferase. |
| 2.7.8.11 | CDP-diacylglycerol--inositol 3-phosphatidyltransferase. |
| 2.7.8.12 | CDP-glycerol glycerophosphotransferase. |
| 2.7.8.13 | Phospho-N-acetylmuramoyl-pentapeptide-transferase. |
| 2.7.8.14 | CDP-ribitol ribitolphosphotransferase. |
| 2.7.8.15 | UDP-N-acetylglucosamine--dolichyl-phosphate N-acetylglucosaminephosphotransferase. |
| 2.7.8.17 | UDP-N-acetylglucosamine--lysosomal-enzyme N-acetylglucosaminephosphotransferase. |
| 2.7.8.18 | UDP-galactose--UDP-N-acetylglucosamine galactose phosphotransferase. |
| 2.7.8.19 | UDP-glucose--glycoprotein glucose phosphotransferase. |
| 2.7.8.20 | Phosphatidylglycerol--membrane-oligosaccharide glycerophosphotransferase. |
| 2.7.8.21 | Membrane-oligosaccharide glycerophosphotransferase. |
| 2.7.8.22 | 1-alkenyl-2-acylglycerol choline phosphotransferase. |
| 2.7.8.23 | Carboxyvinyl-carboxyphosphonate phosphorylmutase. |
| 2.7.8.24 | Phosphatidylcholine synthase. |
| 2.7.8.25 | Triphosphoribosyl-dephospho-CoA synthase. |
| 2.7.8.26 | Adenosylcobinamide-GDP ribazoletransferase. |
| 2.7.9.1 | Pyruvate, phosphate dikinase. |
| 2.7.9.2 | Pyruvate, water dikinase. |
| 2.7.9.3 | Selenide, water dikinase. |
| 2.7.9.4 | Alpha-glucan, water dikinase. |
| 2.8.1.1 | Thiosulfate sulfur-transferase. |
| 2.8.1.2 | 3-mercaptopyruvate sulfur-transferase. |
| 2.8.1.3 | Thiosulfate--thiol sulfur-transferase. |
| 2.8.1.4 | tRNA sulfur-transferase. |
| 2.8.1.5 | Thiosulfate--dithiol sulfur-transferase. |
| 2.8.1.6 | Biotin synthase. |
| 2.8.1.7 | Cysteine desulfurase. |
| 2.8.2.1 | Aryl sulfotransferase. |
| 2.8.2.2 | Alcohol sulfotransferase. |
| 2.8.2.3 | Amine sulfotransferase. |
| 2.8.2.4 | Estrone sulfotransferase. |
| 2.8.2.5 | Chondroitin 4-sulfotransferase. |
| 2.8.2.6 | Choline sulfotransferase. |
| 2.8.2.7 | UDP-N-acetylgalactosamine-4-sulfate sulfotransferase. |
| 2.8.2.8 | [Heparan sulfate]-glucosamine N-sulfotransferase. |
| 2.8.2.9 | Tyrosine-ester sulfotransferase. |
| 2.8.2.10 | Renilla-luciferin sulfotransferase. |
| 2.8.2.11 | Galactosylceramide sulfotransferase. |
| 2.8.2.13 | Psychosine sulfotransferase. |
| 2.8.2.14 | Bile-salt sulfotransferase. |
| 2.8.2.15 | Steroid sulfotransferase. |

TABLE 2-continued

EC Numbers with the corresponding name given to each enzyme class, subclass and sub-subclass.

| | |
|---|---|
| 2.8.2.16 | Thiol sulfotransferase. |
| 2.8.2.17 | Chondroitin 6-sulfotransferase. |
| 2.8.2.18 | Cortisol sulfotransferase. |
| 2.8.2.19 | Triglucosylalkylacylglycerol sulfotransferase. |
| 2.8.2.20 | Protein-tyrosine sulfotransferase. |
| 2.8.2.21 | Keratan sulfotransferase. |
| 2.8.2.22 | Arylsulfate sulfotransferase. |
| 2.8.2.23 | [Heparan sulfate]-glucosamine 3-sulfotransferase 1. |
| 2.8.2.24 | Desulfoglucosinolate sulfotransferase. |
| 2.8.2.25 | Flavonol 3-sulfotransferase. |
| 2.8.2.26 | Quercetin-3-sulfate 3'-sulfotransferase. |
| 2.8.2.27 | Quercetin-3-sulfate 4'-sulfotransferase. |
| 2.8.2.28 | Quercetin-3,3'-bissulfate 7-sulfotransferase. |
| 2.8.2.29 | [Heparan sulfate]-glucosamine 3-sulfotransferase 2. |
| 2.8.2.30 | [Heparan sulfate]-glucosamine 3-sulfotransferase 3. |
| 2.8.3.1 | Propionate CoA-transferase. |
| 2.8.3.2 | Oxalate CoA-transferase. |
| 2.8.3.3 | Malonate CoA-transferase. |
| 2.8.3.5 | 3-oxoacid CoA-transferase. |
| 2.8.3.6 | 3-oxoadipate CoA-transferase. |
| 2.8.3.7 | Succinate--citramalate CoA-transferase. |
| 2.8.3.8 | Acetate CoA-transferase. |
| 2.8.3.9 | Butyrate--acetoacetate CoA-transferase. |
| 2.8.3.10 | Citrate CoA-transferase. |
| 2.8.3.11 | Citramalate CoA-transferase. |
| 2.8.3.12 | Glutaconate CoA-transferase. |
| 2.8.3.13 | Succinate--hydroxymethylglutarate CoA-transferase. |
| 2.8.3.14 | 5-hydroxypentanoate CoA-transferase. |
| 2.8.3.15 | Succinyl-CoA:(R)-benzylsuccinate CoA-transferase. |
| 2.8.3.16 | Formyl-CoA transferase. |
| 2.8.3.17 | Cinnamoyl-CoA:phenyllactate CoA-transferase. |
| 2.8.4.1 | Coenzyme-B sulfoethylthiotransferase. |
| 2.9.1.1 | L-seryl-tRNA(Sec) selenium transferase. |
| ENZYME: 3.—.—.— | |
| 3.1.1.1 | Carboxylesterase. |
| 3.1.1.2 | Arylesterase. |
| 3.1.1.3 | Triacylglycerol lipase. |
| 3.1.1.4 | Phospholipase A(2). |
| 3.1.1.5 | Lysophospholipase. |
| 3.1.1.6 | Acetylesterase. |
| 3.1.1.7 | Acetylcholinesterase. |
| 3.1.1.8 | Cholinesterase. |
| 3.1.1.10 | Tropinesterase. |
| 3.1.1.11 | Pectinesterase. |
| 3.1.1.13 | Sterol esterase. |
| 3.1.1.14 | Chlorophyllase. |
| 3.1.1.15 | L-arabinonolactonase. |
| 3.1.1.17 | Gluconolactonase. |
| 3.1.1.19 | Uronolactonase. |
| 3.1.1.20 | Tannase. |
| 3.1.1.21 | Retinyl-palmitate esterase. |
| 3.1.1.22 | Hydroxybutyrate-dimer hydrolase. |
| 3.1.1.23 | Acylglycerol lipase. |
| 3.1.1.24 | 3-oxoadipate enol-lactonase. |
| 3.1.1.25 | 1,4-lactonase. |
| 3.1.1.26 | Galactolipase. |
| 3.1.1.27 | 4-pyridoxolactonase. |
| 3.1.1.28 | Acylcarnitine hydrolase. |
| 3.1.1.29 | Aminoacyl-tRNA hydrolase. |
| 3.1.1.30 | D-arabinonolactonase. |
| 3.1.1.31 | 6-phosphogluconolactonase. |
| 3.1.1.32 | Phospholipase A(1). |
| 3.1.1.33 | 6-acetylglucose deacetylase. |
| 3.1.1.34 | Lipoprotein lipase. |
| 3.1.1.35 | Dihydrocoumarin hydrolase. |
| 3.1.1.36 | Limonin-D-ring-lactonase. |
| 3.1.1.37 | Steroid-lactonase. |
| 3.1.1.38 | Triacetate-lactonase. |
| 3.1.1.39 | Actinomycin lactonase. |
| 3.1.1.40 | Orsellinate-depside hydrolase. |
| 3.1.1.41 | Cephalosporin-C deacetylase. |
| 3.1.1.42 | Chlorogenate hydrolase. |
| 3.1.1.43 | Alpha-amino-acid esterase. |
| 3.1.1.44 | 4-methyloxaloacetate esterase. |
| 3.1.1.45 | Carboxymethylenebutenolidase. |
| 3.1.1.46 | Deoxylimonate A-ring-lactonase. |
| 3.1.1.47 | 1-alkyl-2-acetylglycerophosphocholine esterase. |
| 3.1.1.48 | Fusarinine-C ornithinesterase. |
| 3.1.1.49 | Sinapine esterase. |
| 3.1.1.50 | Wax-ester hydrolase. |
| 3.1.1.51 | Phorbol-diester hydrolase. |
| 3.1.1.52 | Phosphatidylinositol deacylase. |
| 3.1.1.53 | Sialate O-acetylesterase. |
| 3.1.1.54 | Acetoxybutynylbithiophene deacetylase. |
| 3.1.1.55 | Acetylsalicylate deacetylase. |
| 3.1.1.56 | Methylumbelliferyl-acetate deacetylase. |
| 3.1.1.57 | 2-pyrone-4,6-dicarboxylate lactonase. |
| 3.1.1.58 | N-acetylgalactosaminoglycan deacetylase. |
| 3.1.1.59 | Juvenile-hormone esterase. |
| 3.1.1.60 | Bis(2-ethylhexyl)phthalate esterase. |
| 3.1.1.61 | Protein-glutamate methylesterase. |
| 3.1.1.63 | 11-cis-retinyl-palmitate hydrolase. |
| 3.1.1.64 | All-trans-retinyl-palmitate hydrolase. |
| 3.1.1.65 | L-rhamnono-1,4-lactonase. |
| 3.1.1.66 | 5-(3,4-diacetoxybut-1-ynyl)-2,2'-bithiophene deacetylase. |
| 3.1.1.67 | Fatty-acyl-ethyl-ester synthase. |
| 3.1.1.68 | Xylono-1,4-lactonase. |
| 3.1.1.70 | Cetraxate benzylesterase. |
| 3.1.1.71 | Acetylalkylglycerol acetylhydrolase. |
| 3.1.1.72 | Acetylxylan esterase. |
| 3.1.1.73 | Feruloyl esterase. |
| 3.1.1.74 | Cutinase. |
| 3.1.1.75 | Poly(3-hydroxybutyrate) depolymerase. |
| 3.1.1.76 | Poly(3-hydroxyoctanoate) depolymerase. |
| 3.1.1.77 | Acyloxyacyl hydrolase. |
| 3.1.1.78 | Polyneuridine-aldehyde esterase. |
| 3.1.1.79 | Hormone-sensitive lipase. |
| 3.1.2.1 | Acetyl-CoA hydrolase. |
| 3.1.2.2 | Palmitoyl-CoA hydrolase. |
| 3.1.2.3 | Succinyl-CoA hydrolase. |
| 3.1.2.4 | 3-hydroxyisobutyryl-CoA hydrolase. |
| 3.1.2.5 | Hydroxymethylglutaryl-CoA hydrolase. |
| 3.1.2.6 | Hydroxyacylglutathione hydrolase. |
| 3.1.2.7 | Glutathione thiolesterase. |
| 3.1.2.10 | Formyl-CoA hydrolase. |
| 3.1.2.11 | Acetoacetyl-CoA hydrolase. |
| 3.1.2.12 | S-formylglutathione hydrolase. |
| 3.1.2.13 | S-succinylglutathione hydrolase. |
| 3.1.2.14 | Oleoyl-[acyl-carrier-protein] hydrolase. |
| 3.1.2.15 | Ubiquitin thiolesterase. |
| 3.1.2.16 | [Citrate-(pro-3S)-lyase] thioesterase. |
| 3.1.2.17 | (S)-methylmalonyl-CoA hydrolase. |
| 3.1.2.18 | ADP-dependent short-chain-acyl-CoA hydrolase. |
| 3.1.2.19 | ADP-dependent medium-chain-acyl-CoA hydrolase. |
| 3.1.2.20 | Acyl-CoA hydrolase. |
| 3.1.2.21 | Dodecanoyl-[acyl-carrier protein] hydrolase. |
| 3.1.2.22 | Palmitoyl-protein hydrolase. |
| 3.1.2.23 | 4-hydroxybenzoyl-CoA thioesterase. |
| 3.1.2.24 | 2-(2-hydroxyphenyl)benzenesulfinate hydrolase. |
| 3.1.2.25 | Phenylacetyl-CoA hydrolase. |
| 3.1.3.1 | Alkaline phosphatase. |
| 3.1.3.2 | Acid phosphatase. |
| 3.1.3.3 | Phosphoserine phosphatase. |
| 3.1.3.4 | Phosphatidate phosphatase. |
| 3.1.3.5 | 5'-nucleotidase. |
| 3.1.3.6 | 3'-nucleotidase. |
| 3.1.3.7 | 3'(2'),5'-bisphosphate nucleotidase. |

TABLE 2-continued

EC Numbers with the corresponding name given to each enzyme class, subclass and sub-subclass.

| | |
|---|---|
| 3.1.3.8 | 3-phytase. |
| 3.1.3.9 | Glucose-6-phosphatase. |
| 3.1.3.10 | Glucose-1-phosphatase. |
| 3.1.3.11 | Fructose-bisphosphatase. |
| 3.1.3.12 | Trehalose-phosphatase. |
| 3.1.3.13 | Bisphosphoglycerate phosphatase. |
| 3.1.3.14 | Methylphosphothioglycerate phosphatase. |
| 3.1.3.15 | Histidinol-phosphatase. |
| 3.1.3.16 | Phosphoprotein phosphatase. |
| 3.1.3.17 | [Phosphorylase] phosphatase. |
| 3.1.3.18 | Phosphoglycolate phosphatase. |
| 3.1.3.19 | Glycerol-2-phosphatase. |
| 3.1.3.20 | Phosphoglycerate phosphatase. |
| 3.1.3.21 | Glycerol-1-phosphatase. |
| 3.1.3.22 | Mannitol-1-phosphatase. |
| 3.1.3.23 | Sugar-phosphatase. |
| 3.1.3.24 | Sucrose-phosphatase. |
| 3.1.3.25 | Inositol-1(or 4)-monophosphatase. |
| 3.1.3.26 | 4-phytase. |
| 3.1.3.27 | Phosphatidylglycerophosphatase. |
| 3.1.3.28 | ADP-phosphoglycerate phosphatase. |
| 3.1.3.29 | N-acylneuraminate-9-phosphatase. |
| 3.1.3.31 | Nucleotidase. |
| 3.1.3.32 | Polynucleotide 3'-phosphatase. |
| 3.1.3.33 | Polynucleotide 5'-phosphatase. |
| 3.1.3.34 | Deoxynucleotide 3'-phosphatase. |
| 3.1.3.35 | Thymidylate 5'-phosphatase. |
| 3.1.3.36 | Phosphoinositide 5-phosphatase. |
| 3.1.3.37 | Sedoheptulose-bisphosphatase. |
| 3.1.3.38 | 3-phosphoglycerate phosphatase. |
| 3.1.3.39 | Streptomycin-6-phosphatase. |
| 3.1.3.40 | Guanidinodeoxy-scyllo-inositol-4-phosphatase. |
| 3.1.3.41 | 4-nitrophenylphosphatase. |
| 3.1.3.42 | [Glycogen-synthase-D] phosphatase. |
| 3.1.3.43 | [Pyruvate dehydrogenase (lipoamide)]-phosphatase. |
| 3.1.3.44 | [Acetyl-CoA carboxylase]-phosphatase. |
| 3.1.3.45 | 3-deoxy-manno-octulosonate-8-phosphatase. |
| 3.1.3.46 | Fructose-2,6-bisphosphate 2-phosphatase. |
| 3.1.3.47 | [Hydroxymethylglutaryl-CoA reductase (NADPH)]-phosphatase. |
| 3.1.3.48 | Protein-tyrosine-phosphatase. |
| 3.1.3.49 | [Pyruvate kinase]-phosphatase. |
| 3.1.3.50 | Sorbitol-6-phosphatase. |
| 3.1.3.51 | Dolichyl-phosphatase. |
| 3.1.3.52 | [3-methyl-2-oxobutanoate dehydrogenase (lipoamide)]-phosphatase. |
| 3.1.3.53 | [Myosin light-chain]-phosphatase. |
| 3.1.3.54 | Fructose-2,6-bisphosphate 6-phosphatase. |
| 3.1.3.55 | Caldesmon-phosphatase. |
| 3.1.3.56 | Inositol-polyphosphate 5-phosphatase. |
| 3.1.3.57 | Inositol-1,4-bisphosphate 1-phosphatase. |
| 3.1.3.58 | Sugar-terminal-phosphatase. |
| 3.1.3.59 | Alkylacetylglycerophosphatase. |
| 3.1.3.60 | Phosphoenolpyruvate phosphatase. |
| 3.1.3.62 | Multiple inositol-polyphosphate phosphatase. |
| 3.1.3.63 | 2-carboxy-D-arabinitol-1-phosphatase. |
| 3.1.3.64 | Phosphatidylinositol-3-phosphatase. |
| 3.1.3.66 | Phosphatidylinositol-3,4-bisphosphate 4-phosphatase. |
| 3.1.3.67 | Phosphatidylinositol-3,4,5-trisphosphate 3-phosphatase. |
| 3.1.3.68 | 2-deoxyglucose-6-phosphatase. |
| 3.1.3.69 | Glucosylglycerol 3-phosphatase. |
| 3.1.3.70 | Mannosyl-3-phosphoglycerate phosphatase. |
| 3.1.3.71 | 2-phosphosulfolactate phosphatase. |
| 3.1.3.72 | 5-phytase. |
| 3.1.3.73 | Alpha-ribazole phosphatase. |
| 3.1.4.1 | Phosphodiesterase I. |
| 3.1.4.2 | Glycerophosphocholine phosphodiesterase. |
| 3.1.4.3 | Phospholipase C. |
| 3.1.4.4 | Phospholipase D. |
| 3.1.4.11 | Phosphoinositide phospholipase C. |
| 3.1.4.12 | Sphingomyelin phosphodiesterase. |
| 3.1.4.13 | Serine-ethanolaminephosphate phosphodiesterase. |
| 3.1.4.14 | [Acyl-carrier-protein] phosphodiesterase. |
| 3.1.4.15 | Adenylyl-[glutamate--ammonia ligase] hydrolase. |
| 3.1.4.16 | 2',3'-cyclic-nucleotide 2'-phosphodiesterase. |
| 3.1.4.17 | 3',5'-cyclic-nucleotide phosphodiesterase. |
| 3.1.4.35 | 3',5'-cyclic-GMP phosphodiesterase. |
| 3.1.4.37 | 2',3'-cyclic-nucleotide 3'-phosphodiesterase. |
| 3.1.4.38 | Glycerophosphocholine cholinephosphodiesterase. |
| 3.1.4.39 | Alkylglycerophosphoethanolamine phosphodiesterase. |
| 3.1.4.40 | CMP-N-acylneuraminate phosphodiesterase. |
| 3.1.4.41 | Sphingomyelin phosphodiesterase D. |
| 3.1.4.42 | Glycerol-1,2-cyclic-phosphate 2-phosphodiesterase. |
| 3.1.4.43 | Glycerophosphoinositol inositolphosphodiesterase. |
| 3.1.4.44 | Glycerophosphoinositol glycerophosphodiesterase. |
| 3.1.4.45 | N-acetylglucosamine-1-phosphodiester alpha-N-acetylglucosaminidase. |
| 3.1.4.46 | Glycerophosphodiester phosphodiesterase. |
| 3.1.4.48 | Dolichylphosphate-glucose phosphodiesterase. |
| 3.1.4.49 | Dolichylphosphate-mannose phosphodiesterase. |
| 3.1.4.50 | Glycosylphosphatidylinositol phospholipase D. |
| 3.1.4.51 | Glucose-1-phospho-D-mannosylglycoprotein phosphodiesterase. |
| 3.1.5.1 | dGTPase. |
| 3.1.6.1 | Arylsulfatase. |
| 3.1.6.2 | Steryl-sulfatase. |
| 3.1.6.3 | Glycosulfatase. |
| 3.1.6.4 | N-acetylgalactosamine-6-sulfatase. |
| 3.1.6.6 | Choline-sulfatase. |
| 3.1.6.7 | Cellulose-polysulfatase. |
| 3.1.6.8 | Cerebroside-sulfatase. |
| 3.1.6.9 | Chondro-4-sulfatase. |
| 3.1.6.10 | Chondro-6-sulfatase. |
| 3.1.6.11 | Disulfoglucosamine-6-sulfatase. |
| 3.1.6.12 | N-acetylgalactosamine-4-sulfatase. |
| 3.1.6.13 | Iduronate-2-sulfatase. |
| 3.1.6.14 | N-acetylglucosamine-6-sulfatase. |
| 3.1.6.15 | N-sulfoglucosamine-3-sulfatase. |
| 3.1.6.16 | Monomethyl-sulfatase. |
| 3.1.6.17 | D-lactate-2-sulfatase. |
| 3.1.6.18 | Glucuronate-2-sulfatase. |
| 3.1.7.1 | Prenyl-diphosphatase. |
| 3.1.7.2 | Guanosine-3',5'-bis(diphosphate) 3'-diphosphatase. |
| 3.1.7.3 | Monoterpenyl-diphosphatase. |
| 3.1.8.1 | Aryldialkylphosphatase. |
| 3.1.8.2 | Diisopropyl-fluorophosphatase. |
| 3.1.11.1 | Exodeoxyribonuclease I. |
| 3.1.11.2 | Exodeoxyribonuclease III. |
| 3.1.11.3 | Exodeoxyribonuclease (lambda-induced). |
| 3.1.11.4 | Exodeoxyribonuclease (phage Sp3-induced). |
| 3.1.11.5 | Exodeoxyribonuclease V. |
| 3.1.11.6 | Exodeoxyribonuclease VII. |
| 3.1.13.1 | Exoribonuclease II. |
| 3.1.13.2 | Exoribonuclease H. |
| 3.1.13.3 | Oligonucleotidase. |
| 3.1.13.4 | Poly(A)-specific ribonuclease. |
| 3.1.14.1 | Yeast ribonuclease. |

TABLE 2-continued

EC Numbers with the corresponding name given to each enzyme class, subclass and sub-subclass.

| | |
|---|---|
| 3.1.15.1 | Venom exonuclease. |
| 3.1.16.1 | Spleen exonuclease. |
| 3.1.21.1 | Deoxyribonuclease I. |
| 3.1.21.2 | Deoxyribonuclease IV (phage-T(4)-induced). |
| 3.1.21.3 | Type I site-specific deoxyribonuclease. |
| 3.1.21.4 | Type II site-specific deoxyribonuclease. |
| 3.1.21.5 | Type III site-specific deoxyribonuclease. |
| 3.1.21.6 | CC-preferring endodeoxyribonuclease. |
| 3.1.21.7 | Deoxyribonuclease V. |
| 3.1.22.1 | Deoxyribonuclease II. |
| 3.1.22.2 | Aspergillus deoxyribonuclease K(1). |
| 3.1.22.4 | Crossover junction endoribonuclease. |
| 3.1.22.5 | Deoxyribonuclease X. |
| 3.1.25.1 | Deoxyribonuclease (pyrimidine dimer). |
| 3.1.26.1 | Physarum polycephalum ribonuclease. |
| 3.1.26.2 | Ribonuclease alpha. |
| 3.1.26.3 | Ribonuclease III. |
| 3.1.26.4 | Ribonuclease H. |
| 3.1.26.5 | Ribonuclease P. |
| 3.1.26.6 | Ribonuclease IV. |
| 3.1.26.7 | Ribonuclease P4. |
| 3.1.26.8 | Ribonuclease M5. |
| 3.1.26.9 | Ribonuclease (poly-(U)-specific). |
| 3.1.26.10 | Ribonuclease IX. |
| 3.1.26.11 | Ribonuclease Z. |
| 3.1.27.1 | Ribonuclease T(2). |
| 3.1.27.2 | Bacillus subtilis ribonuclease. |
| 3.1.27.3 | Ribonuclease T(1). |
| 3.1.27.4 | Ribonuclease U(2). |
| 3.1.27.5 | Pancreatic ribonuclease. |
| 3.1.27.6 | Enterobacter ribonuclease. |
| 3.1.27.7 | Ribonuclease F. |
| 3.1.27.8 | Ribonuclease V. |
| 3.1.27.9 | tRNA-intron endonuclease. |
| 3.1.27.10 | rRNA endonuclease. |
| 3.1.30.1 | Aspergillus nuclease S(1). |
| 3.1.30.2 | Serratia marcescens nuclease. |
| 3.1.31.1 | Micrococcal nuclease. |
| 3.2.1.1 | Alpha-amylase. |
| 3.2.1.2 | Beta-amylase. |
| 3.2.1.3 | Glucan 1,4-alpha-glucosidase. |
| 3.2.1.4 | Cellulase. |
| 3.2.1.6 | Endo-1,3(4)-beta-glucanase. |
| 3.2.1.7 | Inulinase. |
| 3.2.1.8 | Endo-1,4-beta-xylanase. |
| 3.2.1.10 | Oligo-1,6-glucosidase. |
| 3.2.1.11 | Dextranase. |
| 3.2.1.14 | Chitinase. |
| 3.2.1.15 | Polygalacturonase. |
| 3.2.1.17 | Lysozyme. |
| 3.2.1.18 | Exo-alpha-sialidase. |
| 3.2.1.20 | Alpha-glucosidase. |
| 3.2.1.21 | Beta-glucosidase. |
| 3.2.1.22 | Alpha-galactosidase. |
| 3.2.1.23 | Beta-galactosidase. |
| 3.2.1.24 | Alpha-mannosidase. |
| 3.2.1.25 | Beta-mannosidase. |
| 3.2.1.26 | Beta-fructofuranosidase. |
| 3.2.1.28 | Alpha,alpha-trehalase. |
| 3.2.1.31 | Beta-glucuronidase. |
| 3.2.1.32 | Xylan endo-1,3-beta-xylosidase. |
| 3.2.1.33 | Amylo-alpha-1,6-glucosidase. |
| 3.2.1.35 | Hyaluronoglucosaminidase. |
| 3.2.1.36 | Hyaluronoglucuronidase. |
| 3.2.1.37 | Xylan 1,4-beta-xylosidase. |
| 3.2.1.38 | Beta-D-fucosidase. |
| 3.2.1.39 | Glucan endo-1,3-beta-D-glucosidase. |
| 3.2.1.40 | Alpha-L-rhamnosidase. |
| 3.2.1.41 | Pullulanase. |
| 3.2.1.42 | GDP-glucosidase. |
| 3.2.1.43 | Beta-L-rhamnosidase. |
| 3.2.1.44 | Fucoidanase. |
| 3.2.1.45 | Glucosylceramidase. |
| 3.2.1.46 | Galactosylceramidase. |
| 3.2.1.47 | Galactosylgalactosylglucosylceramidase. |
| 3.2.1.48 | Sucrose alpha-glucosidase. |
| 3.2.1.49 | Alpha-N-acetylgalactosaminidase. |
| 3.2.1.50 | Alpha-N-acetylglucosaminidase. |
| 3.2.1.51 | Alpha-L-fucosidase. |
| 3.2.1.52 | Beta-N-acetylhexosaminidase. |
| 3.2.1.53 | Beta-N-acetylgalactosaminidase. |
| 3.2.1.54 | Cyclomaltodextrinase. |
| 3.2.1.55 | Alpha-N-arabinofuranosidase. |
| 3.2.1.56 | Glucuronosyl-disulfoglucosamine glucuronidase. |
| 3.2.1.57 | Isopullulanase. |
| 3.2.1.58 | Glucan 1,3-beta-glucosidase. |
| 3.2.1.59 | Glucan endo-1,3-alpha-glucosidase. |
| 3.2.1.60 | Glucan 1,4-alpha-maltotetraohydrolase. |
| 3.2.1.61 | Mycodextranase. |
| 3.2.1.62 | Glycosylceramidase. |
| 3.2.1.63 | 1,2-alpha-L-fucosidase. |
| 3.2.1.64 | 2,6-beta-fructan 6-levanbiohydrolase. |
| 3.2.1.65 | Levanase. |
| 3.2.1.66 | Quercitrinase. |
| 3.2.1.67 | Galacturan 1,4-alpha-galacturonidase. |
| 3.2.1.68 | Isoamylase. |
| 3.2.1.70 | Glucan 1,6-alpha-glucosidase. |
| 3.2.1.71 | Glucan endo-1,2-beta-glucosidase. |
| 3.2.1.72 | Xylan 1,3-beta-xylosidase. |
| 3.2.1.73 | Licheninase. |
| 3.2.1.74 | Glucan 1,4-beta-glucosidase. |
| 3.2.1.75 | Glucan endo-1,6-beta-glucosidase. |
| 3.2.1.76 | L-iduronidase. |
| 3.2.1.77 | Mannan 1,2-(1,3)-alpha-mannosidase. |
| 3.2.1.78 | Mannan endo-1,4-beta-mannosidase. |
| 3.2.1.80 | Fructan beta-fructosidase. |
| 3.2.1.81 | Agarase. |
| 3.2.1.82 | Exo-poly-alpha-galacturonosidase. |
| 3.2.1.83 | Kappa-carrageenase. |
| 3.2.1.84 | Glucan 1,3-alpha-glucosidase. |
| 3.2.1.85 | 6-phospho-beta-galactosidase. |
| 3.2.1.86 | 6-phospho-beta-glucosidase. |
| 3.2.1.87 | Capsular-polysaccharide endo-1,3-alpha-galactosidase. |
| 3.2.1.88 | Beta-L-arabinosidase. |
| 3.2.1.89 | Arabinogalactan endo-1,4-beta-galactosidase. |
| 3.2.1.91 | Cellulose 1,4-beta-cellobiosidase. |
| 3.2.1.92 | Peptidoglycan beta-N-acetylmuramidase. |
| 3.2.1.93 | Alpha,alpha-phosphotrehalase. |
| 3.2.1.94 | Glucan 1,6-alpha-isomaltosidase. |
| 3.2.1.95 | Dextran 1,6-alpha-isomaltotriosidase. |
| 3.2.1.96 | Mannosyl-glycoprotein endo-beta-N-acetylglucosaminidase. |
| 3.2.1.97 | Glycopeptide alpha-N-acetylgalactosaminidase. |
| 3.2.1.98 | Glucan 1,4-alpha-maltohexaosidase. |
| 3.2.1.99 | Arabinan endo-1,5-alpha-L-arabinosidase. |
| 3.2.1.100 | Mannan 1,4-mannobiosidase. |
| 3.2.1.101 | Mannan endo-1,6-alpha-mannosidase. |
| 3.2.1.102 | Blood-group-substance endo-1,4-beta-galactosidase. |
| 3.2.1.103 | Keratan-sulfate endo-1,4-beta-galactosidase. |
| 3.2.1.104 | Steryl-beta-glucosidase. |
| 3.2.1.105 | Strictosidine beta-glucosidase. |
| 3.2.1.106 | Mannosyl-oligosaccharide glucosidase. |
| 3.2.1.107 | Protein-glucosylgalactosylhydroxylysine glucosidase. |
| 3.2.1.108 | Lactase. |
| 3.2.1.109 | Endogalactosaminidase. |
| 3.2.1.110 | Mucinaminylserine mucinaminidase. |
| 3.2.1.111 | 1,3-alpha-L-fucosidase. |
| 3.2.1.112 | 2-deoxyglucosidase. |
| 3.2.1.113 | Mannosyl-oligosaccharide 1,2-alpha-mannosidase. |
| 3.2.1.114 | Mannosyl-oligosaccharide 1,3-1,6-alpha-mannosidase. |
| 3.2.1.115 | Branched-dextran exo-1,2-alpha-glucosidase. |
| 3.2.1.116 | Glucan 1,4-alpha-maltotriohydrolase. |

TABLE 2-continued

EC Numbers with the corresponding name given to each enzyme class, subclass and sub-subclass.

| | |
|---|---|
| 3.2.1.117 | Amygdalin beta-glucosidase. |
| 3.2.1.118 | Prunasin beta-glucosidase. |
| 3.2.1.119 | Vicianin beta-glucosidase. |
| 3.2.1.120 | Oligoxyloglucan beta-glycosidase. |
| 3.2.1.121 | Polymannuronate hydrolase. |
| 3.2.1.122 | Maltose-6'-phosphate glucosidase. |
| 3.2.1.123 | Endoglycosylceramidase. |
| 3.2.1.124 | 3-deoxy-2-octulosonidase. |
| 3.2.1.125 | Raucaffricine beta-glucosidase. |
| 3.2.1.126 | Coniferin beta-glucosidase. |
| 3.2.1.127 | 1,6-alpha-L-fucosidase. |
| 3.2.1.128 | Glycyrrhizinate beta-glucuronidase. |
| 3.2.1.129 | Endo-alpha-sialidase. |
| 3.2.1.130 | Glycoprotein endo-alpha-1,2-mannosidase. |
| 3.2.1.131 | Xylan alpha-1,2-glucuronosidase. |
| 3.2.1.132 | Chitosanase. |
| 3.2.1.133 | Glucan 1,4-alpha-maltohydrolase. |
| 3.2.1.134 | Difructose-anhydride synthase. |
| 3.2.1.135 | Neopullulanase. |
| 3.2.1.136 | Glucuronoarabinoxylan endo-1,4-beta-xylanase. |
| 3.2.1.137 | Mannan exo-1,2-1,6-alpha-mannosidase. |
| 3.2.1.139 | Alpha-glucuronidase. |
| 3.2.1.140 | Lacto-N-biosidase. |
| 3.2.1.141 | 4-alpha-D-{(1->4)-alpha-D-glucano}trehalose trehalohydrolase. |
| 3.2.1.142 | Limit dextrinase. |
| 3.2.1.143 | Poly(ADP-ribose) glycohydrolase. |
| 3.2.1.144 | 3-deoxyoctulosonase. |
| 3.2.1.145 | Galactan 1,3-beta-galactosidase. |
| 3.2.1.146 | Beta-galactofuranosidase. |
| 3.2.1.147 | Thioglucosidase. |
| 3.2.1.148 | Ribosylhomocysteinase. |
| 3.2.1.149 | Beta-primeverosidase. |
| 3.2.1.150 | Oligoxyloglucan reducing-end-specific cellobiohydrolase. |
| 3.2.1.151 | Xyloglucan-specific endo-beta-1,4-glucanase. |
| 3.2.2.1 | Purine nucleosidase. |
| 3.2.2.2 | Inosine nucleosidase. |
| 3.2.2.3 | Uridine nucleosidase. |
| 3.2.2.4 | AMP nucleosidase. |
| 3.2.2.5 | NAD(+) nucleosidase. |
| 3.2.2.6 | NAD(P)(+) nucleosidase. |
| 3.2.2.7 | Adenosine nucleosidase. |
| 3.2.2.8 | Ribosylpyrimidine nucleosidase. |
| 3.2.2.9 | Adenosylhomocysteine nucleosidase. |
| 3.2.2.10 | Pyrimidine-5'-nucleotide nucleosidase. |
| 3.2.2.11 | Beta-aspartyl-N-acetylglucosaminidase. |
| 3.2.2.12 | Inosinate nucleosidase. |
| 3.2.2.13 | 1-methyladenosine nucleosidase. |
| 3.2.2.14 | NMN nucleosidase. |
| 3.2.2.15 | DNA-deoxyinosine glycosylase. |
| 3.2.2.16 | Methylthioadenosine nucleosidase. |
| 3.2.2.17 | Deoxyribodipyrimidine endonucleosidase. |
| 3.2.2.19 | [Protein ADP-ribosylarginine] hydrolase. |
| 3.2.2.20 | DNA-3-methyladenine glycosylase I. |
| 3.2.2.21 | DNA-3-methyladenine glycosylase II. |
| 3.2.2.22 | rRNA N-glycosylase. |
| 3.2.2.23 | DNA-formamidopyrimidine glycosylase. |
| 3.2.2.24 | ADP-ribosyl-[dinitrogen reductase] hydrolase. |
| 3.3.1.1 | Adenosylhomocysteinase. |
| 3.3.1.2 | Adenosylmethionine hydrolase. |
| 3.3.2.1 | Isochorismatase. |
| 3.3.2.2 | Alkenylglycerophosphocholine hydrolase. |
| 3.3.2.3 | Epoxide hydrolase. |
| 3.3.2.4 | Trans-epoxysuccinate hydrolase. |
| 3.3.2.5 | Alkenylglycerophosphoethanolamine hydrolase. |
| 3.3.2.6 | Leukotriene-A(4) hydrolase. |
| 3.3.2.7 | Hepoxilin-epoxide hydrolase. |
| 3.3.2.8 | Limonene-1,2-epoxide hydrolase. |
| 3.4.11.1 | Leucyl aminopeptidase. |
| 3.4.11.2 | Membrane alanyl aminopeptidase. |
| 3.4.11.3 | Cystinyl aminopeptidase. |
| 3.4.11.4 | Tripeptide aminopeptidase. |
| 3.4.11.5 | Prolyl aminopeptidase. |
| 3.4.11.6 | Aminopeptidase B. |
| 3.4.11.7 | Glutamyl aminopeptidase. |
| 3.4.11.9 | Xaa-Pro aminopeptidase. |
| 3.4.11.10 | Bacterial leucyl aminopeptidase. |
| 3.4.11.13 | Clostridial aminopeptidase. |
| 3.4.11.14 | Cytosol alanyl aminopeptidase. |
| 3.4.11.15 | Aminopeptidase Y. |
| 3.4.11.16 | Xaa-Trp aminopeptidase. |
| 3.4.11.17 | Tryptophanyl aminopeptidase. |
| 3.4.11.18 | Methionyl aminopeptidase. |
| 3.4.11.19 | D-stereospecific aminopeptidase. |
| 3.4.11.20 | Aminopeptidase Ey. |
| 3.4.11.21 | Aspartyl aminopeptidase. |
| 3.4.11.22 | Aminopeptidase I. |
| 3.4.11.23 | PepB aminopeptidase. |
| 3.4.13.3 | Xaa-His dipeptidase. |
| 3.4.13.4 | Xaa-Arg dipeptidase. |
| 3.4.13.5 | Xaa-methyl-His dipeptidase. |
| 3.4.13.7 | Glu-Glu dipeptidase. |
| 3.4.13.9 | Xaa-Pro dipeptidase. |
| 3.4.13.12 | Met-Xaa dipeptidase. |
| 3.4.13.17 | Non-stereospecific dipeptidase. |
| 3.4.13.18 | Cytosol nonspecific dipeptidase. |
| 3.4.13.19 | Membrane dipeptidase. |
| 3.4.13.20 | Beta-Ala-His dipeptidase. |
| 3.4.13.21 | Dipeptidase E. |
| 3.4.14.1 | Dipeptidyl-peptidase I. |
| 3.4.14.2 | Dipeptidyl-peptidase II. |
| 3.4.14.4 | Dipeptidyl-peptidase III. |
| 3.4.14.5 | Dipeptidyl-peptidase IV. |
| 3.4.14.6 | Dipeptidyl-dipeptidase. |
| 3.4.14.9 | Tripeptidyl-peptidase I. |
| 3.4.14.10 | Tripeptidyl-peptidase II. |
| 3.4.14.11 | Xaa-Pro dipeptidyl-peptidase. |
| 3.4.15.1 | Peptidyl-dipeptidase A. |
| 3.4.15.4 | Peptidyl-dipeptidase B. |
| 3.4.15.5 | Peptidyl-dipeptidase Dcp. |
| 3.4.16.2 | Lysosomal Pro-X carboxypeptidase. |
| 3.4.16.4 | Serine-type D-Ala-D-Ala carboxypeptidase. |
| 3.4.16.5 | Carboxypeptidase C. |
| 3.4.16.6 | Carboxypeptidase D. |
| 3.4.17.1 | Carboxypeptidase A. |
| 3.4.17.2 | Carboxypeptidase B. |
| 3.4.17.3 | Lysine carboxypeptidase. |
| 3.4.17.4 | Gly-X carboxypeptidase. |
| 3.4.17.6 | Alanine carboxypeptidase. |
| 3.4.17.8 | Muramoylpentapeptide carboxypeptidase. |
| 3.4.17.10 | Carboxypeptidase E. |
| 3.4.17.11 | Glutamate carboxypeptidase. |
| 3.4.17.12 | Carboxypeptidase M. |
| 3.4.17.13 | Muramoyltetrapeptide carboxypeptidase. |
| 3.4.17.14 | Zinc D-Ala-D-Ala carboxypeptidase. |
| 3.4.17.15 | Carboxypeptidase A2. |
| 3.4.17.16 | Membrane Pro-X carboxypeptidase. |
| 3.4.17.17 | Tubulinyl-Tyr carboxypeptidase. |
| 3.4.17.18 | Carboxypeptidase T. |
| 3.4.17.19 | Carboxypeptidase Taq. |
| 3.4.17.20 | Carboxypeptidase U. |
| 3.4.17.21 | Glutamate carboxypeptidase II. |
| 3.4.17.22 | Metallocarboxypeptidase D. |
| 3.4.18.1 | Cathepsin X. |
| 3.4.19.1 | Acylaminoacyl-peptidase. |
| 3.4.19.2 | Peptidyl-glycinamidase. |
| 3.4.19.3 | Pyroglutamyl-peptidase I. |
| 3.4.19.5 | Beta-aspartyl-peptidase. |
| 3.4.19.6 | Pyroglutamyl-peptidase II. |
| 3.4.19.7 | N-formylmethionyl-peptidase. |
| 3.4.19.9 | Gamma-glutamyl hydrolase. |
| 3.4.19.11 | Gamma-D-glutamyl-meso-diaminopimelate peptidase. |

TABLE 2-continued

EC Numbers with the corresponding name given to each enzyme class, subclass and sub-subclass.

| | |
|---|---|
| 3.4.19.12 | Ubiquitinyl hydrolase 1. |
| 3.4.21.1 | Chymotrypsin. |
| 3.4.21.2 | Chymotrypsin C. |
| 3.4.21.3 | Metridin. |
| 3.4.21.4 | Trypsin. |
| 3.4.21.5 | Thrombin. |
| 3.4.21.6 | Coagulation factor Xa. |
| 3.4.21.7 | Plasmin. |
| 3.4.21.9 | Enteropeptidase. |
| 3.4.21.10 | Acrosin. |
| 3.4.21.12 | Alpha-lytic endopeptidase. |
| 3.4.21.19 | Glutamyl endopeptidase. |
| 3.4.21.20 | Cathepsin G. |
| 3.4.21.21 | Coagulation factor VIIa. |
| 3.4.21.22 | Coagulation factor IXa. |
| 3.4.21.25 | Cucumisin. |
| 3.4.21.26 | Prolyl oligopeptidase. |
| 3.4.21.27 | Coagulation factor XIa. |
| 3.4.21.32 | Brachyurin. |
| 3.4.21.34 | Plasma kallikrein. |
| 3.4.21.35 | Tissue kallikrein. |
| 3.4.21.36 | Pancreatic elastase. |
| 3.4.21.37 | Leukocyte elastase. |
| 3.4.21.38 | Coagulation factor XIIa. |
| 3.4.21.39 | Chymase. |
| 3.4.21.41 | Complement subcomponent C1r. |
| 3.4.21.42 | Complement subcomponent C1s. |
| 3.4.21.43 | Classical-complement-pathway C3/C5 convertase. |
| 3.4.21.45 | Complement factor I. |
| 3.4.21.46 | Complement factor D. |
| 3.4.21.47 | Alternative-complement-pathway C3/C5 convertase. |
| 3.4.21.48 | Cerevisin. |
| 3.4.21.49 | Hypodermin C. |
| 3.4.21.50 | Lysyl endopeptidase. |
| 3.4.21.53 | Endopeptidase La. |
| 3.4.21.54 | Gamma-renin. |
| 3.4.21.55 | Venombin AB. |
| 3.4.21.57 | Leucyl endopeptidase. |
| 3.4.21.59 | Tryptase. |
| 3.4.21.60 | Scutelarin. |
| 3.4.21.61 | Kexin. |
| 3.4.21.62 | Subtilisin. |
| 3.4.21.63 | Oryzin. |
| 3.4.21.64 | Endopeptidase K. |
| 3.4.21.65 | Thermomycolin. |
| 3.4.21.66 | Thermitase. |
| 3.4.21.67 | Endopeptidase So. |
| 3.4.21.68 | T-plasminogen activator. |
| 3.4.21.69 | Protein C (activated). |
| 3.4.21.70 | Pancreatic endopeptidase E. |
| 3.4.21.71 | Pancreatic elastase II. |
| 3.4.21.72 | IgA-specific serine endopeptidase. |
| 3.4.21.73 | U-plasminogen activator. |
| 3.4.21.74 | Venombin A. |
| 3.4.21.75 | Furin. |
| 3.4.21.76 | Myeloblastin. |
| 3.4.21.77 | Semenogelase. |
| 3.4.21.78 | Granzyme A. |
| 3.4.21.79 | Granzyme B. |
| 3.4.21.80 | Streptogrisin A. |
| 3.4.21.81 | Streptogrisin B. |
| 3.4.21.82 | Glutamyl endopeptidase II. |
| 3.4.21.83 | Oligopeptidase B. |
| 3.4.21.84 | Limulus clotting factor C. |
| 3.4.21.85 | Limulus clotting factor B. |
| 3.4.21.86 | Limulus clotting enzyme. |
| 3.4.21.87 | Omptin. |
| 3.4.21.88 | Repressor lexA. |
| 3.4.21.89 | Signal peptidase I. |
| 3.4.21.90 | Togavirin. |
| 3.4.21.91 | Flavivirin. |
| 3.4.21.92 | Endopeptidase Clp. |
| 3.4.21.93 | Proprotein convertase 1. |
| 3.4.21.94 | Proprotein convertase 2. |
| 3.4.21.95 | Snake venom factor V activator. |
| 3.4.21.96 | Lactocepin. |
| 3.4.21.97 | Assemblin. |
| 3.4.21.98 | Hepacivirin. |
| 3.4.21.99 | Spermosin. |
| 3.4.21.100 | Pseudomonalisin. |
| 3.4.21.101 | Xanthomonalisin. |
| 3.4.21.102 | C-terminal processing peptidase. |
| 3.4.21.103 | Physarolisin. |
| 3.4.22.1 | Cathepsin B. |
| 3.4.22.2 | Papain. |
| 3.4.22.3 | Ficain. |
| 3.4.22.6 | Chymopapain. |
| 3.4.22.7 | Asclepain. |
| 3.4.22.8 | Clostripain. |
| 3.4.22.10 | Streptopain. |
| 3.4.22.14 | Actinidain. |
| 3.4.22.15 | Cathepsin L. |
| 3.4.22.16 | Cathepsin H. |
| 3.4.22.24 | Cathepsin T. |
| 3.4.22.25 | Glycyl endopeptidase. |
| 3.4.22.26 | Cancer procoagulant. |
| 3.4.22.27 | Cathepsin S. |
| 3.4.22.28 | Picornain 3C. |
| 3.4.22.29 | Picornain 2A. |
| 3.4.22.30 | Caricain. |
| 3.4.22.31 | Ananain. |
| 3.4.22.32 | Stem bromelain. |
| 3.4.22.33 | Fruit bromelain. |
| 3.4.22.34 | Legumain. |
| 3.4.22.35 | Histolysain. |
| 3.4.22.36 | Caspase-1. |
| 3.4.22.37 | Gingipain R. |
| 3.4.22.38 | Cathepsin K. |
| 3.4.22.39 | Adenain. |
| 3.4.22.40 | Bleomycin hydrolase. |
| 3.4.22.41 | Cathepsin F. |
| 3.4.22.42 | Cathepsin O. |
| 3.4.22.43 | Cathepsin V. |
| 3.4.22.44 | Nuclear-inclusion-a endopeptidase. |
| 3.4.22.45 | Helper-component proteinase. |
| 3.4.22.46 | L-peptidase. |
| 3.4.22.47 | Gingipain K. |
| 3.4.22.48 | Staphopain. |
| 3.4.22.49 | Separase. |
| 3.4.22.50 | V-cath endopeptidase. |
| 3.4.22.51 | Cruzipain. |
| 3.4.22.52 | Calpain-1. |
| 3.4.22.53 | Calpain-2. |
| 3.4.23.1 | Pepsin A. |
| 3.4.23.2 | Pepsin B. |
| 3.4.23.3 | Gastricsin. |
| 3.4.23.4 | Chymosin. |
| 3.4.23.5 | Cathepsin D. |
| 3.4.23.12 | Nepenthesin. |
| 3.4.23.15 | Renin. |
| 3.4.23.16 | HIV-1 retropepsin. |
| 3.4.23.17 | Pro-opiomelanocortin converting enzyme. |
| 3.4.23.18 | Aspergillopepsin I. |
| 3.4.23.19 | Aspergillopepsin II. |
| 3.4.23.20 | Penicillopepsin. |
| 3.4.23.21 | Rhizopuspepsin. |
| 3.4.23.22 | Endothiapepsin. |
| 3.4.23.23 | Mucorpepsin. |
| 3.4.23.24 | Candidapepsin. |
| 3.4.23.25 | Saccharopepsin. |
| 3.4.23.26 | Rhodotorulapepsin. |
| 3.4.23.28 | Acrocylindropepsin. |
| 3.4.23.29 | Polyporopepsin. |
| 3.4.23.30 | Pycnoporopepsin. |
| 3.4.23.31 | Scytalidopepsin A. |
| 3.4.23.32 | Scytalidopepsin B. |
| 3.4.23.34 | Cathepsin E. |
| 3.4.23.35 | Barrierpepsin. |
| 3.4.23.36 | Signal peptidase II. |
| 3.4.23.38 | Plasmepsin I. |
| 3.4.23.39 | Plasmepsin II. |
| 3.4.23.40 | Phytepsin. |

TABLE 2-continued

EC Numbers with the corresponding name given to each enzyme class, subclass and sub-subclass.

| EC Number | Name |
|---|---|
| 3.4.23.41 | Yapsin 1. |
| 3.4.23.42 | Thermopsin. |
| 3.4.23.43 | Prepilin peptidase. |
| 3.4.23.44 | Nodavirus endopeptidase. |
| 3.4.23.45 | Memapsin 1. |
| 3.4.23.46 | Memapsin 2. |
| 3.4.23.47 | HIV-2 retropepsin. |
| 3.4.23.48 | Plasminogen activator Pla. |
| 3.4.24.1 | Atrolysin A. |
| 3.4.24.3 | Microbial collagenase. |
| 3.4.24.6 | Leucolysin. |
| 3.4.24.7 | Interstitial collagenase. |
| 3.4.24.11 | Neprilysin. |
| 3.4.24.12 | Envelysin. |
| 3.4.24.13 | IgA-specific metalloendopeptidase. |
| 3.4.24.14 | Procollagen N-endopeptidase. |
| 3.4.24.15 | Thimet oligopeptidase. |
| 3.4.24.16 | Neurolysin. |
| 3.4.24.17 | Stromelysin 1. |
| 3.4.24.18 | Meprin A. |
| 3.4.24.19 | Procollagen C-endopeptidase. |
| 3.4.24.20 | Peptidyl-Lys metalloendopeptidase. |
| 3.4.24.21 | Astacin. |
| 3.4.24.22 | Stromelysin 2. |
| 3.4.24.23 | Matrilysin. |
| 3.4.24.24 | Gelatinase A. |
| 3.4.24.25 | Vibriolysin. |
| 3.4.24.26 | Pseudolysin. |
| 3.4.24.27 | Thermolysin. |
| 3.4.24.28 | Bacillolysin. |
| 3.4.24.29 | Aureolysin. |
| 3.4.24.30 | Coccolysin. |
| 3.4.24.31 | Mycolysin. |
| 3.4.24.32 | Beta-lytic metalloendopeptidase. |
| 3.4.24.33 | Peptidyl-Asp metalloendopeptidase. |
| 3.4.24.34 | Neutrophil collagenase. |
| 3.4.24.35 | Gelatinase B. |
| 3.4.24.36 | Leishmanolysin. |
| 3.4.24.37 | Saccharolysin. |
| 3.4.24.38 | Gametolysin. |
| 3.4.24.39 | Deuterolysin. |
| 3.4.24.40 | Serralysin. |
| 3.4.24.41 | Atrolysin B. |
| 3.4.24.42 | Atrolysin C. |
| 3.4.24.43 | Atroxase. |
| 3.4.24.44 | Atrolysin E. |
| 3.4.24.45 | Atrolysin F. |
| 3.4.24.46 | Adamalysin. |
| 3.4.24.47 | Horrilysin. |
| 3.4.24.48 | Ruberlysin. |
| 3.4.24.49 | Bothropasin. |
| 3.4.24.50 | Bothrolysin. |
| 3.4.24.51 | Ophiolysin. |
| 3.4.24.52 | Trimerelysin I. |
| 3.4.24.53 | Trimerelysin II. |
| 3.4.24.54 | Mucrolysin. |
| 3.4.24.55 | Pitrilysin. |
| 3.4.24.56 | Insulysin. |
| 3.4.24.57 | O-sialoglycoprotein endopeptidase. |
| 3.4.24.58 | Russellysin. |
| 3.4.24.59 | Mitochondrial intermediate peptidase. |
| 3.4.24.60 | Dactylysin. |
| 3.4.24.61 | Nardilysin. |
| 3.4.24.62 | Magnolysin. |
| 3.4.24.63 | Meprin B. |
| 3.4.24.64 | Mitochondrial processing peptidase. |
| 3.4.24.65 | Macrophage elastase. |
| 3.4.24.66 | Choriolysin L. |
| 3.4.24.67 | Choriolysin H. |
| 3.4.24.68 | Tentoxilysin. |
| 3.4.24.69 | Bontoxilysin. |
| 3.4.24.70 | Oligopeptidase A. |
| 3.4.24.71 | Endothelin-converting enzyme 1. |
| 3.4.24.72 | Fibrolase. |
| 3.4.24.73 | Jararhagin. |
| 3.4.24.74 | Fragilysin. |
| 3.4.24.75 | Lysostaphin. |
| 3.4.24.76 | Flavastacin. |
| 3.4.24.77 | Snapalysin. |
| 3.4.24.78 | GPR endopeptidase. |
| 3.4.24.79 | Pappalysin-1. |
| 3.4.24.80 | Membrane-type matrix metalloproteinase-1. |
| 3.4.24.81 | ADAM10 endopeptidase. |
| 3.4.24.82 | ADAMTS-4 endopeptidase. |
| 3.4.24.83 | Anthrax lethal factor endopeptidase. |
| 3.4.24.84 | Ste24 endopeptidase. |
| 3.4.24.85 | S2P endopeptidase. |
| 3.4.24.86 | ADAM 17 endopeptidase. |
| 3.4.25.1 | Proteasome endopeptidase complex. |
| 3.5.1.1 | Asparaginase. |
| 3.5.1.2 | Glutaminase. |
| 3.5.1.3 | Omega-amidase. |
| 3.5.1.4 | Amidase. |
| 3.5.1.5 | Urease. |
| 3.5.1.6 | Beta-ureidopropionase. |
| 3.5.1.7 | Ureidosuccinase. |
| 3.5.1.8 | Formylaspartate deformylase. |
| 3.5.1.9 | Arylformamidase. |
| 3.5.1.10 | Formyltetrahydrofolate deformylase. |
| 3.5.1.11 | Penicillin amidase. |
| 3.5.1.12 | Biotinidase. |
| 3.5.1.13 | Aryl-acylamidase. |
| 3.5.1.14 | Aminoacylase. |
| 3.5.1.15 | Aspartoacylase. |
| 3.5.1.16 | Acetylornithine deacetylase. |
| 3.5.1.17 | Acyl-lysine deacylase. |
| 3.5.1.18 | Succinyl-diaminopimelate desuccinylase. |
| 3.5.1.19 | Nicotinamidase. |
| 3.5.1.20 | Citrullinase. |
| 3.5.1.21 | N-acetyl-beta-alanine deacetylase. |
| 3.5.1.22 | Pantothenase. |
| 3.5.1.23 | Ceramidase. |
| 3.5.1.24 | Choloylglycine hydrolase. |
| 3.5.1.25 | N-acetylglucosamine-6-phosphate deacetylase. |
| 3.5.1.26 | N(4)-(beta-N-acetylglucosaminyl)-L-asparaginase. |
| 3.5.1.27 | N-formylmethionylaminoacyl-tRNA deformylase. |
| 3.5.1.28 | N-acetylmuramoyl-L-alanine amidase. |
| 3.5.1.29 | 2-(acetamidomethylene)succinate hydrolase. |
| 3.5.1.30 | 5-aminopentanamidase. |
| 3.5.1.31 | Formylmethionine deformylase. |
| 3.5.1.32 | Hippurate hydrolase. |
| 3.5.1.33 | N-acetylglucosamine deacetylase. |
| 3.5.1.35 | D-glutaminase. |
| 3.5.1.36 | N-methyl-2-oxoglutaramate hydrolase. |
| 3.5.1.38 | Glutamin-(asparagin-)ase. |
| 3.5.1.39 | Alkylamidase. |
| 3.5.1.40 | Acylagmatine amidase. |
| 3.5.1.41 | Chitin deacetylase. |
| 3.5.1.42 | Nicotinamide-nucleotide amidase. |
| 3.5.1.43 | Peptidyl-glutaminase. |
| 3.5.1.44 | Protein-glutamine glutaminase. |
| 3.5.1.46 | 6-aminohexanoate-dimer hydrolase. |
| 3.5.1.47 | N-acetyldiaminopimelate deacetylase. |
| 3.5.1.48 | Acetylspermidine deacetylase. |
| 3.5.1.49 | Formamidase. |
| 3.5.1.50 | Pentanamidase. |
| 3.5.1.51 | 4-acetamidobutyryl-CoA deacetylase. |
| 3.5.1.52 | Peptide-N(4)-(N-acetyl-beta-glucosaminyl)asparagine amidase. |
| 3.5.1.53 | N-carbamoylputrescine amidase. |
| 3.5.1.54 | Allophanate hydrolase. |
| 3.5.1.55 | Long-chain-fatty-acyl-glutamate deacylase. |
| 3.5.1.56 | N,N-dimethylformamidase. |
| 3.5.1.57 | Tryptophanamidase. |
| 3.5.1.58 | N-benzyloxycarbonylglycine hydrolase. |
| 3.5.1.59 | N-carbamoylsarcosine amidase. |
| 3.5.1.60 | N-(long-chain-acyl)ethanolamine deacylase. |
| 3.5.1.61 | Mimosinase. |

TABLE 2-continued

EC Numbers with the corresponding name given to each enzyme class, subclass and sub-subclass.

| | |
|---|---|
| 3.5.1.62 | Acetylputrescine deacetylase. |
| 3.5.1.63 | 4-acetamidobutyrate deacetylase. |
| 3.5.1.64 | N(alpha)-benzyloxycarbonylleucine hydrolase. |
| 3.5.1.65 | Theanine hydrolase. |
| 3.5.1.66 | 2-(hydroxymethyl)-3-(acetamidomethylene)succinate hydrolase. |
| 3.5.1.67 | 4-methyleneglutaminase. |
| 3.5.1.68 | N-formylglutamate deformylase. |
| 3.5.1.69 | Glycosphingolipid deacylase. |
| 3.5.1.70 | Aculeacin-A deacylase. |
| 3.5.1.71 | N-feruloylglycine deacylase. |
| 3.5.1.72 | D-benzoylarginine-4-nitroanilide amidase. |
| 3.5.1.73 | Carnitinamidase. |
| 3.5.1.74 | Chenodeoxycholoyltaurine hydrolase. |
| 3.5.1.75 | Urethanase. |
| 3.5.1.76 | Arylalkyl acylamidase. |
| 3.5.1.77 | N-carbamoyl-D-amino acid hydrolase. |
| 3.5.1.78 | Glutathionylspermidine amidase. |
| 3.5.1.79 | Phthalyl amidase. |
| 3.5.1.81 | N-acyl-D-amino-acid deacylase. |
| 3.5.1.82 | N-acyl-D-glutamate deacylase. |
| 3.5.1.83 | N-acyl-D-aspartate deacylase. |
| 3.5.1.84 | Biuret amidohydrolase. |
| 3.5.1.85 | (S)—N-acetyl-1-phenylethylamine hydrolase. |
| 3.5.1.86 | Mandelamide amidase. |
| 3.5.1.87 | N-carbamoyl-L-amino-acid hydrolase. |
| 3.5.1.88 | Peptide deformylase. |
| 3.5.1.89 | N-acetylglucosaminylphosphatidylinositol deacylase. |
| 3.5.1.90 | Adenosylcobinamide hydrolase. |
| 3.5.2.1 | Barbiturase. |
| 3.5.2.2 | Dihydropyrimidinase. |
| 3.5.2.3 | Dihydroorotase. |
| 3.5.2.4 | Carboxymethylhydantoinase. |
| 3.5.2.5 | Allantoinase. |
| 3.5.2.6 | Beta-lactamase. |
| 3.5.2.7 | Imidazolonepropionase. |
| 3.5.2.9 | 5-oxoprolinase (ATP-hydrolyzing). |
| 3.5.2.10 | Creatininase. |
| 3.5.2.11 | L-lysine-lactamase. |
| 3.5.2.12 | 6-aminohexanoate-cyclic-dimer hydrolase. |
| 3.5.2.13 | 2,5-dioxopiperazine hydrolase. |
| 3.5.2.14 | N-methylhydantoinase (ATP-hydrolyzing). |
| 3.5.2.15 | Cyanuric acid amidohydrolase. |
| 3.5.2.16 | Maleimide hydrolase. |
| 3.5.2.17 | Hydroxyisourate hydrolase. |
| 3.5.3.1 | Arginase. |
| 3.5.3.2 | Guanidinoacetase. |
| 3.5.3.3 | Creatinase. |
| 3.5.3.4 | Allantoicase. |
| 3.5.3.5 | Formimidoylaspartate deiminase. |
| 3.5.3.6 | Arginine deiminase. |
| 3.5.3.7 | Guanidinobutyrase. |
| 3.5.3.8 | Formimidoylglutamase. |
| 3.5.3.9 | Allantoate deiminase. |
| 3.5.3.10 | D-arginase. |
| 3.5.3.11 | Agmatinase. |
| 3.5.3.12 | Agmatine deiminase. |
| 3.5.3.13 | Formimidoylglutamate deiminase. |
| 3.5.3.14 | Amidinoaspartase. |
| 3.5.3.15 | Protein-arginine deiminase. |
| 3.5.3.16 | Methylguanidinase. |
| 3.5.3.17 | Guanidinopropionase. |
| 3.5.3.18 | Dimethylargininase. |
| 3.5.3.19 | Ureidoglycolate hydrolase. |
| 3.5.3.20 | Diguanidinobutanase. |
| 3.5.3.21 | Methylenediurea deaminase. |
| 3.5.3.22 | Proclavaminate amidinohydrolase. |
| 3.5.4.1 | Cytosine deaminase. |
| 3.5.4.2 | Adenine deaminase. |
| 3.5.4.3 | Guanine deaminase. |
| 3.5.4.4 | Adenosine deaminase. |
| 3.5.4.5 | Cytidine deaminase. |
| 3.5.4.6 | AMP deaminase. |
| 3.5.4.7 | ADP deaminase. |
| 3.5.4.8 | Aminoimidazolase. |
| 3.5.4.9 | Methenyltetrahydrofolate cyclohydrolase. |
| 3.5.4.10 | IMP cyclohydrolase. |
| 3.5.4.11 | Pterin deaminase. |
| 3.5.4.12 | dCMP deaminase. |
| 3.5.4.13 | dCTP deaminase. |
| 3.5.4.14 | Deoxycytidine deaminase. |
| 3.5.4.15 | Guanosine deaminase. |
| 3.5.4.16 | GTP cyclohydrolase I. |
| 3.5.4.17 | Adenosine-phosphate deaminase. |
| 3.5.4.18 | ATP deaminase. |
| 3.5.4.19 | Phosphoribosyl-AMP cyclohydrolase. |
| 3.5.4.20 | Pyrithiamine deaminase. |
| 3.5.4.21 | Creatinine deaminase. |
| 3.5.4.22 | 1-pyrroline-4-hydroxy-2-carboxylate deaminase. |
| 3.5.4.23 | Blasticidin-S deaminase. |
| 3.5.4.24 | Sepiapterin deaminase. |
| 3.5.4.25 | GTP cyclohydrolase II. |
| 3.5.4.26 | Diaminohydroxyphosphoribosylaminopyrimidine deaminase. |
| 3.5.4.27 | Methenyltetrahydromethanopterin cyclohydrolase. |
| 3.5.4.28 | S-adenosylhomocysteine deaminase. |
| 3.5.4.29 | GTP cyclohydrolase IIa. |
| 3.5.4.30 | dCTP deaminase (dUMP-forming). |
| 3.5.5.1 | Nitrilase. |
| 3.5.5.2 | Ricinine nitrilase. |
| 3.5.5.4 | Cyanoalanine nitrilase. |
| 3.5.5.5 | Arylacetonitrilase. |
| 3.5.5.6 | Bromoxynil nitrilase. |
| 3.5.5.7 | Aliphatic nitrilase. |
| 3.5.5.8 | Thiocyanate hydrolase. |
| 3.5.99.1 | Riboflavinase. |
| 3.5.99.2 | Thiaminase. |
| 3.5.99.3 | Hydroxydechloroatrazine ethylaminohydrolase. |
| 3.5.99.4 | N-isopropylammelide isopropylaminohydrolase. |
| 3.5.99.5 | 2-aminomuconate deaminase. |
| 3.5.99.6 | Glucosamine-6-phosphate deaminase. |
| 3.5.99.7 | 1-aminocyclopropane-1-carboxylate deaminase. |
| 3.6.1.1 | Inorganic diphosphatase. |
| 3.6.1.2 | Trimetaphosphatase. |
| 3.6.1.3 | Adenosinetriphosphatase. |
| 3.6.1.5 | Apyrase. |
| 3.6.1.6 | Nucleoside-diphosphatase. |
| 3.6.1.7 | Acylphosphatase. |
| 3.6.1.8 | ATP diphosphatase. |
| 3.6.1.9 | Nucleotide diphosphatase. |
| 3.6.1.10 | Endopolyphosphatase. |
| 3.6.1.11 | Exopolyphosphatase. |
| 3.6.1.12 | dCTP diphosphatase. |
| 3.6.1.13 | ADP-ribose diphosphatase. |
| 3.6.1.14 | Adenosine-tetraphosphatase. |
| 3.6.1.15 | Nucleoside-triphosphatase. |
| 3.6.1.16 | CDP-glycerol diphosphatase. |
| 3.6.1.17 | Bis(5'-nucleosyl)-tetraphosphatase (asymmetrical). |
| 3.6.1.18 | FAD diphosphatase. |
| 3.6.1.19 | Nucleoside-triphosphate diphosphatase. |
| 3.6.1.20 | 5'-acylphosphoadenosine hydrolase. |
| 3.6.1.21 | ADP-sugar diphosphatase. |
| 3.6.1.22 | NAD+ diphosphatase. |
| 3.6.1.23 | dUTP diphosphatase. |
| 3.6.1.24 | Nucleoside phosphoacylhydrolase. |
| 3.6.1.25 | Triphosphatase. |
| 3.6.1.26 | CDP-diacylglycerol diphosphatase. |
| 3.6.1.27 | Undecaprenyl-diphosphatase. |
| 3.6.1.28 | Thiamine-triphosphatase. |
| 3.6.1.29 | Bis(5'-adenosyl)-triphosphatase. |
| 3.6.1.30 | M(7)G(5')pppN diphosphatase. |

TABLE 2-continued

EC Numbers with the corresponding name given to each enzyme class, subclass and sub-subclass.

| | |
|---|---|
| 3.6.1.31 | Phosphoribosyl-ATP diphosphatase. |
| 3.6.1.39 | Thymidine-triphosphatase. |
| 3.6.1.40 | Guanosine-5'-triphosphate,3'-diphosphate diphosphatase. |
| 3.6.1.41 | Bis(5'-nucleosyl)-tetraphosphatase (symmetrical). |
| 3.6.1.42 | Guanosine-diphosphatase. |
| 3.6.1.43 | Dolichyldiphosphatase. |
| 3.6.1.44 | Oligosaccharide-diphosphodolichol diphosphatase. |
| 3.6.1.45 | UDP-sugar diphosphatase. |
| 3.6.1.52 | Diphosphoinositol-polyphosphate diphosphatase. |
| 3.6.2.1 | Adenylylsulfatase. |
| 3.6.2.2 | Phosphoadenylylsulfatase. |
| 3.6.3.1 | Phospholipid-translocating ATPase. |
| 3.6.3.2 | Magnesium-importing ATPase. |
| 3.6.3.3 | Cadmium-exporting ATPase. |
| 3.6.3.4 | Copper-exporting ATPase. |
| 3.6.3.5 | Zinc-exporting ATPase. |
| 3.6.3.6 | Proton-exporting ATPase. |
| 3.6.3.7 | Sodium-exporting ATPase. |
| 3.6.3.8 | Calcium-transporting ATPase. |
| 3.6.3.9 | Sodium/potassium-exchanging ATPase. |
| 3.6.3.10 | Hydrogen/potassium-exchanging ATPase. |
| 3.6.3.11 | Chloride-transporting ATPase. |
| 3.6.3.12 | Potassium-transporting ATPase. |
| 3.6.3.14 | H(+)-transporting two-sector ATPase. |
| 3.6.3.15 | Sodium-transporting two-sector ATPase. |
| 3.6.3.16 | Arsenite-transporting ATPase. |
| 3.6.3.17 | Monosaccharide-transporting ATPase. |
| 3.6.3.18 | Oligosaccharide-transporting ATPase. |
| 3.6.3.19 | Maltose-transporting ATPase. |
| 3.6.3.20 | Glycerol-3-phosphate-transporting ATPase. |
| 3.6.3.21 | Polar-amino-acid-transporting ATPase. |
| 3.6.3.22 | Nonpolar-amino-acid-transporting ATPase. |
| 3.6.3.23 | Oligopeptide-transporting ATPase. |
| 3.6.3.24 | Nickel-transporting ATPase. |
| 3.6.3.25 | Sulfate-transporting ATPase. |
| 3.6.3.26 | Nitrate-transporting ATPase. |
| 3.6.3.27 | Phosphate-transporting ATPase. |
| 3.6.3.28 | Phosphonate-transporting ATPase. |
| 3.6.3.29 | Molybdate-transporting ATPase. |
| 3.6.3.30 | Fe(3+)-transporting ATPase. |
| 3.6.3.31 | Polyamine-transporting ATPase. |
| 3.6.3.32 | Quaternary-amine-transporting ATPase. |
| 3.6.3.33 | Vitamin B12-transporting ATPase. |
| 3.6.3.34 | Iron-chelate-transporting ATPase. |
| 3.6.3.35 | Manganese-transporting ATPase. |
| 3.6.3.36 | Taurine-transporting ATPase. |
| 3.6.3.37 | Guanine-transporting ATPase. |
| 3.6.3.38 | Capsular-polysaccharide-transporting ATPase. |
| 3.6.3.39 | Lipopolysaccharide-transporting ATPase. |
| 3.6.3.40 | Teichoic-acid-transporting ATPase. |
| 3.6.3.41 | Heme-transporting ATPase. |
| 3.6.3.42 | Beta-glucan-transporting ATPase. |
| 3.6.3.43 | Peptide-transporting ATPase. |
| 3.6.3.44 | Xenobiotic-transporting ATPase. |
| 3.6.3.45 | Steroid-transporting ATPase. |
| 3.6.3.46 | Cadmium-transporting ATPase. |
| 3.6.3.47 | Fatty-acyl-CoA-transporting ATPase. |
| 3.6.3.48 | Alpha-factor-transporting ATPase. |
| 3.6.3.49 | Channel-conductance-controlling ATPase. |
| 3.6.3.50 | Protein-secreting ATPase. |
| 3.6.3.51 | Mitochondrial protein-transporting ATPase. |
| 3.6.3.52 | Chloroplast protein-transporting ATPase. |
| 3.6.3.53 | Ag(+)-exporting ATPase. |
| 3.6.4.1 | Myosin ATPase. |
| 3.6.4.2 | Dynein ATPase. |
| 3.6.4.3 | Microtubule-severing ATPase. |
| 3.6.4.4 | Plus-end-directed kinesin ATPase. |
| 3.6.4.5 | Minus-end-directed kinesin ATPase. |
| 3.6.4.6 | Vesicle-fusing ATPase. |
| 3.6.4.7 | Peroxisome-assembly ATPase. |
| 3.6.4.8 | Proteasome ATPase. |
| 3.6.4.9 | Chaperonin ATPase. |
| 3.6.4.10 | Non-chaperonin molecular chaperone ATPase. |
| 3.6.4.11 | Nucleoplasmin ATPase. |
| 3.6.5.1 | Heterotrimeric G-protein GTPase. |
| 3.6.5.2 | Small monomeric GTPase. |
| 3.6.5.3 | Protein-synthesizing GTPase. |
| 3.6.5.4 | Signal-recognition-particle GTPase. |
| 3.6.5.5 | Dynamin GTPase. |
| 3.6.5.6 | Tubulin GTPase. |
| 3.7.1.1 | Oxaloacetase. |
| 3.7.1.2 | Fumarylacetoacetase. |
| 3.7.1.3 | Kynureninase. |
| 3.7.1.4 | Phloretin hydrolase. |
| 3.7.1.5 | Acylpyruvate hydrolase. |
| 3.7.1.6 | Acetylpyruvate hydrolase. |
| 3.7.1.7 | Beta-diketone hydrolase. |
| 3.7.1.8 | 2,6-dioxo-6-phenylhexa-3-enoate hydrolase. |
| 3.7.1.9 | 2-hydroxymuconate-semialdehyde hydrolase. |
| 3.7.1.10 | Cyclohexane-1,3-dione hydrolase. |
| 3.8.1.1 | Alkylhalidase. |
| 3.8.1.2 | (S)-2-haloacid dehalogenase. |
| 3.8.1.3 | Haloacetate dehalogenase. |
| 3.8.1.5 | Haloalkane dehalogenase. |
| 3.8.1.6 | 4-chlorobenzoate dehalogenase. |
| 3.8.1.7 | 4-chlorobenzoyl-CoA dehalogenase. |
| 3.8.1.8 | Atrazine chlorohydrolase. |
| 3.8.1.9 | (R)-2-haloacid dehalogenase. |
| 3.8.1.10 | 2-haloacid dehalogenase (configuration-inverting). |
| 3.8.1.11 | 2-haloacid dehalogenase (configuration-retaining). |
| 3.9.1.1 | Phosphoamidase. |
| 3.10.1.1 | N-sulfoglucosamine sulfohydrolase. |
| 3.10.1.2 | Cyclamate sulfohydrolase. |
| 3.11.1.1 | Phosphonoacetaldehyde hydrolase. |
| 3.11.1.2 | Phosphonoacetate hydrolase. |
| 3.12.1.1 | Trithionate hydrolase. |
| 3.13.1.1 | UDP-sulfoquinovose synthase. |

ENZYME: 4.—.—.—

| | |
|---|---|
| 4.1.1.1 | Pyruvate decarboxylase. |
| 4.1.1.2 | Oxalate decarboxylase. |
| 4.1.1.3 | Oxaloacetate decarboxylase. |
| 4.1.1.4 | Acetoacetate decarboxylase. |
| 4.1.1.5 | Acetolactate decarboxylase. |
| 4.1.1.6 | Aconitate decarboxylase. |
| 4.1.1.7 | Benzoylformate decarboxylase. |
| 4.1.1.8 | Oxalyl-CoA decarboxylase. |
| 4.1.1.9 | Malonyl-CoA decarboxylase. |
| 4.1.1.11 | Aspartate 1-decarboxylase. |
| 4.1.1.12 | Aspartate 4-decarboxylase. |
| 4.1.1.14 | Valine decarboxylase. |
| 4.1.1.15 | Glutamate decarboxylase. |
| 4.1.1.16 | Hydroxyglutamate decarboxylase. |
| 4.1.1.17 | Ornithine decarboxylase. |
| 4.1.1.18 | Lysine decarboxylase. |
| 4.1.1.19 | Arginine decarboxylase. |
| 4.1.1.20 | Diaminopimelate decarboxylase. |
| 4.1.1.21 | Phosphoribosylaminoimidazole carboxylase. |
| 4.1.1.22 | Histidine decarboxylase. |
| 4.1.1.23 | Orotidine-5'-phosphate decarboxylase. |
| 4.1.1.24 | Aminobenzoate decarboxylase. |

TABLE 2-continued

EC Numbers with the corresponding name given to each enzyme class, subclass and sub-subclass.

| | |
|---|---|
| 4.1.1.25 | Tyrosine decarboxylase. |
| 4.1.1.28 | Aromatic-L-amino-acid decarboxylase. |
| 4.1.1.29 | Sulfinoalanine decarboxylase. |
| 4.1.1.30 | Pantothenoylcysteine decarboxylase. |
| 4.1.1.31 | Phosphoenolpyruvate carboxylase. |
| 4.1.1.32 | Phosphoenolpyruvate carboxykinase (GTP). |
| 4.1.1.33 | Diphosphomevalonate decarboxylase. |
| 4.1.1.34 | Dehydro-L-gulonate decarboxylase. |
| 4.1.1.35 | UDP-glucuronate decarboxylase. |
| 4.1.1.36 | Phosphopantothenoylcysteine decarboxylase. |
| 4.1.1.37 | Uroporphyrinogen decarboxylase. |
| 4.1.1.38 | Phosphoenolpyruvate carboxykinase (diphosphate). |
| 4.1.1.39 | Ribulose-bisphosphate carboxylase. |
| 4.1.1.40 | Hydroxypyruvate decarboxylase. |
| 4.1.1.41 | Methylmalonyl-CoA decarboxylase. |
| 4.1.1.42 | Carnitine decarboxylase. |
| 4.1.1.43 | Phenylpyruvate decarboxylase. |
| 4.1.1.44 | 4-carboxymuconolactone decarboxylase. |
| 4.1.1.45 | Aminocarboxymuconate-semialdehyde decarboxylase. |
| 4.1.1.46 | O-pyrocatechuate decarboxylase. |
| 4.1.1.47 | Tartronate-semialdehyde synthase. |
| 4.1.1.48 | Indole-3-glycerol-phosphate synthase. |
| 4.1.1.49 | Phosphoenolpyruvate carboxykinase (ATP). |
| 4.1.1.50 | Adenosylmethionine decarboxylase. |
| 4.1.1.51 | 3-hydroxy-2-methylpyridine-4,5-dicarboxylate 4-decarboxylase. |
| 4.1.1.52 | 6-methylsalicylate decarboxylase. |
| 4.1.1.53 | Phenylalanine decarboxylase. |
| 4.1.1.54 | Dihydroxyfumarate decarboxylase. |
| 4.1.1.55 | 4,5-dihydroxyphthalate decarboxylase. |
| 4.1.1.56 | 3-oxolaurate decarboxylase. |
| 4.1.1.57 | Methionine decarboxylase. |
| 4.1.1.58 | Orsellinate decarboxylase. |
| 4.1.1.59 | Gallate decarboxylase. |
| 4.1.1.60 | Stipitatonate decarboxylase. |
| 4.1.1.61 | 4-hydroxybenzoate decarboxylase. |
| 4.1.1.62 | Gentisate decarboxylase. |
| 4.1.1.63 | Protocatechuate decarboxylase. |
| 4.1.1.64 | 2,2-dialkylglycine decarboxylase (pyruvate). |
| 4.1.1.65 | Phosphatidylserine decarboxylase. |
| 4.1.1.66 | Uracil-5-carboxylate decarboxylase. |
| 4.1.1.67 | UDP-galacturonate decarboxylase. |
| 4.1.1.68 | 5-oxopent-3-ene-1,2,5-tricarboxylate decarboxylase. |
| 4.1.1.69 | 3,4-dihydroxyphthalate decarboxylase. |
| 4.1.1.70 | Glutaconyl-CoA decarboxylase. |
| 4.1.1.71 | 2-oxoglutarate decarboxylase. |
| 4.1.1.72 | Branched-chain-2-oxoacid decarboxylase. |
| 4.1.1.73 | Tartrate decarboxylase. |
| 4.1.1.74 | Indolepyruvate decarboxylase. |
| 4.1.1.75 | 5-guanidino-2-oxopentanoate decarboxylase. |
| 4.1.1.76 | Arylmalonate decarboxylase. |
| 4.1.1.77 | 4-oxalocrotonate decarboxylase. |
| 4.1.1.78 | Acetylenedicarboxylate decarboxylase. |
| 4.1.1.79 | Sulfopyruvate decarboxylase. |
| 4.1.1.80 | 4-hydroxyphenylpyruvate decarboxylase. |
| 4.1.1.81 | Threonine-phosphate decarboxylase. |
| 4.1.2.2 | Ketotetrose-phosphate aldolase. |
| 4.1.2.4 | Deoxyribose-phosphate aldolase. |
| 4.1.2.5 | Threonine aldolase. |
| 4.1.2.9 | Phosphoketolase. |
| 4.1.2.10 | Mandelonitrile lyase. |
| 4.1.2.11 | Hydroxymandelonitrile lyase. |
| 4.1.2.12 | 2-dehydropantoate aldolase. |
| 4.1.2.13 | Fructose-bisphosphate aldolase. |
| 4.1.2.14 | 2-dehydro-3-deoxy-phosphogluconate aldolase. |
| 4.1.2.17 | L-fuculose-phosphate aldolase. |
| 4.1.2.18 | 2-dehydro-3-deoxy-L-pentonate aldolase. |
| 4.1.2.19 | Rhamnulose-1-phosphate aldolase. |
| 4.1.2.20 | 2-dehydro-3-deoxyglucarate aldolase. |
| 4.1.2.21 | 2-dehydro-3-deoxy-6-phosphogalactonate aldolase. |
| 4.1.2.22 | Fructose-6-phosphate phosphoketolase. |
| 4.1.2.23 | 3-deoxy-D-manno-octulosonate aldolase. |
| 4.1.2.24 | Dimethylaniline-N-oxide aldolase. |
| 4.1.2.25 | Dihydroneopterin aldolase. |
| 4.1.2.26 | Phenylserine aldolase. |
| 4.1.2.27 | Sphinganine-1-phosphate aldolase. |
| 4.1.2.28 | 2-dehydro-3-deoxy-D-pentonate aldolase. |
| 4.1.2.29 | 5-dehydro-2-deoxyphosphogluconate aldolase. |
| 4.1.2.30 | 17-alpha-hydroxyprogesterone aldolase. |
| 4.1.2.32 | Trimethylamine-oxide aldolase. |
| 4.1.2.33 | Fucosterol-epoxide lyase. |
| 4.1.2.34 | 4-(2-carboxyphenyl)-2-oxobut-3-enoate aldolase. |
| 4.1.2.35 | Propioin synthase. |
| 4.1.2.36 | Lactate aldolase. |
| 4.1.2.37 | Acetone-cyanohydrin lyase. |
| 4.1.2.38 | Benzoin aldolase. |
| 4.1.2.39 | Hydroxynitrilase. |
| 4.1.2.40 | Tagatose-bisphosphate aldolase. |
| 4.1.2.41 | Vanillin synthase. |
| 4.1.3.1 | Isocitrate lyase. |
| 4.1.3.3 | N-acetylneuraminate lyase. |
| 4.1.3.4 | Hydroxymethylglutaryl-CoA lyase. |
| 4.1.3.6 | Citrate (pro-3S)-lyase. |
| 4.1.3.13 | Oxalomalate lyase. |
| 4.1.3.14 | 3-hydroxyaspartate aldolase. |
| 4.1.3.16 | 4-hydroxy-2-oxoglutarate aldolase. |
| 4.1.3.17 | 4-hydroxy-4-methyl-2-oxoglutarate aldolase. |
| 4.1.3.22 | Citramalate lyase. |
| 4.1.3.24 | Malyl-CoA lyase. |
| 4.1.3.25 | Citramalyl-CoA lyase. |
| 4.1.3.26 | 3-hydroxy-3-isohexenylglutaryl-CoA lyase. |
| 4.1.3.27 | Anthranilate synthase. |
| 4.1.3.30 | Methylisocitrate lyase. |
| 4.1.3.32 | 2,3-dimethylmalate lyase. |
| 4.1.3.34 | Citryl-CoA lyase. |
| 4.1.3.35 | (1-hydroxycyclohexan-1-yl)acetyl-CoA lyase. |
| 4.1.3.36 | Naphthoate synthase. |
| 4.1.3.38 | Aminodeoxychorismate lyase. |
| 4.1.99.1 | Tryptophanase. |
| 4.1.99.2 | Tyrosine phenol-lyase. |
| 4.1.99.3 | Deoxyribodipyrimidine photo-lyase. |
| 4.1.99.5 | Octadecanal decarbonylase. |
| 4.1.99.11 | Benzylsuccinate synthase. |
| 4.2.1.1 | Carbonate dehydratase. |
| 4.2.1.2 | Fumarate hydratase. |
| 4.2.1.3 | Aconitate hydratase. |
| 4.2.1.4 | Citrate dehydratase. |
| 4.2.1.5 | Arabinonate dehydratase. |
| 4.2.1.6 | Galactonate dehydratase. |
| 4.2.1.7 | Altronate dehydratase. |
| 4.2.1.8 | Mannonate dehydratase. |
| 4.2.1.9 | Dihydroxy-acid dehydratase. |
| 4.2.1.10 | 3-dehydroquinate dehydratase. |
| 4.2.1.11 | Phosphopyruvate hydratase. |
| 4.2.1.12 | Phosphogluconate dehydratase. |
| 4.2.1.17 | Enoyl-CoA hydratase. |
| 4.2.1.18 | Methylglutaconyl-CoA hydratase. |
| 4.2.1.19 | Imidazoleglycerol-phosphate dehydratase. |
| 4.2.1.20 | Tryptophan synthase. |
| 4.2.1.22 | Cystathionine beta-synthase. |
| 4.2.1.24 | Porphobilinogen synthase. |
| 4.2.1.25 | L-arabinonate dehydratase. |
| 4.2.1.27 | Acetylenecarboxylate hydratase. |
| 4.2.1.28 | Propanediol dehydratase. |
| 4.2.1.30 | Glycerol dehydratase. |
| 4.2.1.31 | Maleate hydratase. |

TABLE 2-continued

EC Numbers with the corresponding name given to each enzyme class, subclass and sub-subclass.

| | |
|---|---|
| 4.2.1.32 | L(+)-tartrate dehydratase. |
| 4.2.1.33 | 3-isopropylmalate dehydratase. |
| 4.2.1.34 | (S)-2-methylmalate dehydratase. |
| 4.2.1.35 | (R)-2-methylmalate dehydratase. |
| 4.2.1.36 | Homoaconitate hydratase. |
| 4.2.1.39 | Gluconate dehydratase. |
| 4.2.1.40 | Glucarate dehydratase. |
| 4.2.1.41 | 5-dehydro-4-deoxyglucarate dehydratase. |
| 4.2.1.42 | Galactarate dehydratase. |
| 4.2.1.43 | 2-dehydro-3-deoxy-L-arabinonate dehydratase. |
| 4.2.1.44 | Myo-inosose-2 dehydratase. |
| 4.2.1.45 | CDP-glucose 4,6-dehydratase. |
| 4.2.1.46 | dTDP-glucose 4,6-dehydratase. |
| 4.2.1.47 | GDP-mannose 4,6-dehydratase. |
| 4.2.1.48 | D-glutamate cyclase. |
| 4.2.1.49 | Urocanate hydratase. |
| 4.2.1.50 | Pyrazolylalanine synthase. |
| 4.2.1.51 | Prephenate dehydratase. |
| 4.2.1.52 | Dihydrodipicolinate synthase. |
| 4.2.1.53 | Oleate hydratase. |
| 4.2.1.54 | Lactoyl-CoA dehydratase. |
| 4.2.1.55 | 3-hydroxybutyryl-CoA dehydratase. |
| 4.2.1.56 | Itaconyl-CoA hydratase. |
| 4.2.1.57 | Isohexenylglutaconyl-CoA hydratase. |
| 4.2.1.58 | Crotonoyl-[acyl-carrier-protein] hydratase. |
| 4.2.1.59 | 3-hydroxyoctanoyl-[acyl-carrier-protein] dehydratase. |
| 4.2.1.60 | 3-hydroxydecanoyl-[acyl-carrier-protein] dehydratase. |
| 4.2.1.61 | 3-hydroxypalmitoyl-[acyl-carrier-protein] dehydratase. |
| 4.2.1.62 | 5-alpha-hydroxysteroid dehydratase. |
| 4.2.1.65 | 3-cyanoalanine hydratase. |
| 4.2.1.66 | Cyanide hydratase. |
| 4.2.1.67 | D-fuconate dehydratase. |
| 4.2.1.68 | L-fuconate dehydratase. |
| 4.2.1.69 | Cyanamide hydratase. |
| 4.2.1.70 | Pseudouridylate synthase. |
| 4.2.1.73 | Protoaphin-aglucone dehydratase (cyclizing). |
| 4.2.1.74 | Long-chain-enoyl-CoA hydratase. |
| 4.2.1.75 | Uroporphyrinogen-III synthase. |
| 4.2.1.76 | UDP-glucose 4,6-dehydratase. |
| 4.2.1.77 | Trans-L-3-hydroxyproline dehydratase. |
| 4.2.1.78 | (S)-norcoclaurine synthase. |
| 4.2.1.79 | 2-methylcitrate dehydratase. |
| 4.2.1.80 | 2-oxopent-4-enoate hydratase. |
| 4.2.1.81 | D(−)-tartrate dehydratase. |
| 4.2.1.82 | Xylonate dehydratase. |
| 4.2.1.83 | 4-oxalmesaconate hydratase. |
| 4.2.1.84 | Nitrile hydratase. |
| 4.2.1.85 | Dimethylmaleate hydratase. |
| 4.2.1.86 | 16-dehydroprogesterone hydratase. |
| 4.2.1.87 | Octopamine dehydratase. |
| 4.2.1.88 | Synephrine dehydratase. |
| 4.2.1.89 | Carnitine dehydratase. |
| 4.2.1.90 | L-rhamnonate dehydratase. |
| 4.2.1.91 | Carboxycyclohexadienyl dehydratase. |
| 4.2.1.92 | Hydroperoxide dehydratase. |
| 4.2.1.93 | ATP-dependent NAD(P)H-hydrate dehydratase. |
| 4.2.1.94 | Scytalone dehydratase. |
| 4.2.1.95 | Kievitone hydratase. |
| 4.2.1.96 | 4a-hydroxytetrahydrobiopterin dehydratase. |
| 4.2.1.97 | Phaseollidin hydratase. |
| 4.2.1.98 | 16-alpha-hydroxyprogesterone dehydratase. |
| 4.2.1.99 | 2-methylisocitrate dehydratase. |
| 4.2.1.100 | Cyclohexa-1,5-dienecarbonyl-CoA hydratase. |
| 4.2.1.101 | Trans-feruloyl-CoA hydratase. |
| 4.2.1.103 | Cyclohexyl-isocyanide hydratase. |
| 4.2.1.104 | Cyanate hydratase. |
| 4.2.2.1 | Hyaluronate lyase. |
| 4.2.2.2 | Pectate lyase. |
| 4.2.2.3 | Poly(beta-D-mannuronate) lyase. |
| 4.2.2.4 | Chondroitin ABC lyase. |
| 4.2.2.5 | Chondroitin AC lyase. |
| 4.2.2.6 | Oligogalacturonide lyase. |
| 4.2.2.7 | Heparin lyase. |
| 4.2.2.8 | Heparin-sulfate lyase. |
| 4.2.2.9 | Pectate disaccharide-lyase. |
| 4.2.2.10 | Pectin lyase. |
| 4.2.2.11 | Poly(alpha-L-guluronate) lyase. |
| 4.2.2.12 | Xanthan lyase. |
| 4.2.2.13 | Exo-(1->4)-alpha-D-glucan lyase. |
| 4.2.2.14 | Glucuronan lyase. |
| 4.2.2.15 | Anhydrosialidase. |
| 4.2.2.16 | Levan fructotransferase (DFA-IV-forming). |
| 4.2.2.17 | Inulin fructotransferase (DFA-I-forming). |
| 4.2.2.18 | Inulin fructotransferase (DFA-III-forming). |
| 4.2.3.1 | Threonine synthase. |
| 4.2.3.2 | Ethanolamine-phosphate phospho-lyase. |
| 4.2.3.3 | Methylglyoxal synthase. |
| 4.2.3.4 | 3-dehydroquinate synthase. |
| 4.2.3.5 | Chorismate synthase. |
| 4.2.3.6 | Trichodiene synthase. |
| 4.2.3.7 | Pentalenene synthase. |
| 4.2.3.8 | Casbene synthase. |
| 4.2.3.9 | Aristolochene synthase. |
| 4.2.3.10 | (−)-endo-fenchol synthase. |
| 4.2.3.11 | Sabinene-hydrate synthase. |
| 4.2.3.12 | 6-pyruvoyltetrahydropterin synthase. |
| 4.2.3.13 | (+)-delta-cadinene synthase. |
| 4.2.3.14 | Pinene synthase. |
| 4.2.3.15 | Myrcene synthase. |
| 4.2.3.16 | (4S)-limonene synthase. |
| 4.2.3.17 | Taxadiene synthase. |
| 4.2.3.18 | Abietadiene synthase. |
| 4.2.3.19 | Ent-kaurene synthase. |
| 4.2.3.20 | (+)-limonene synthase. |
| 4.2.3.21 | Vetispiradiene synthase. |
| 4.2.99.12 | Carboxymethyloxysuccinate lyase. |
| 4.2.99.18 | DNA-(apurinic or apyrimidinicsite) lyase. |
| 4.2.99.19 | 2-hydroxypropyl-CoM lyase. |
| 4.3.1.1 | Aspartate ammonia-lyase. |
| 4.3.1.2 | Methylaspartate ammonia-lyase. |
| 4.3.1.3 | Histidine ammonia-lyase. |
| 4.3.1.4 | Formimidoyltetrahydrofolate cyclodeaminase. |
| 4.3.1.5 | Phenylalanine ammonia-lyase. |
| 4.3.1.6 | Beta-alanyl-CoA ammonia-lyase. |
| 4.3.1.7 | Ethanolamine ammonia-lyase. |
| 4.3.1.9 | Glucosaminate ammonia-lyase. |
| 4.3.1.10 | Serine-sulfate ammonia-lyase. |
| 4.3.1.11 | Dihydroxyphenylalanine ammonia-lyase. |
| 4.3.1.12 | Ornithine cyclodeaminase. |
| 4.3.1.13 | Carbamoyl-serine ammonia-lyase. |
| 4.3.1.14 | 3-aminobutyryl-CoA ammonia-lyase. |
| 4.3.1.15 | Diaminopropionate ammonia-lyase. |
| 4.3.1.16 | Threo-3-hydroxyaspartate ammonia-lyase. |
| 4.3.1.17 | L-serine ammonia-lyase. |
| 4.3.1.18 | D-serine ammonia-lyase. |
| 4.3.1.19 | Threonine ammonia-lyase. |
| 4.3.1.20 | Erythro-3-hydroxyaspartate ammonia-lyase. |
| 4.3.2.1 | Argininosuccinate lyase. |
| 4.3.2.2 | Adenylosuccinate lyase. |
| 4.3.2.3 | Ureidoglycolate lyase. |
| 4.3.2.4 | Purine imidazole-ring cyclase. |
| 4.3.2.5 | Peptidylamidoglycolate lyase. |
| 4.3.3.1 | 3-ketovalidoxylamine C-N-lyase. |

TABLE 2-continued

EC Numbers with the corresponding name given to each enzyme class, subclass and sub-subclass.

| | |
|---|---|
| 4.3.3.2 | Strictosidine synthase. |
| 4.3.3.3 | Deacetylisoipecoside synthase. |
| 4.3.3.4 | Deacetylipecoside synthase. |
| 4.4.1.1 | Cystathionine gamma-lyase. |
| 4.4.1.2 | Homocysteine desulfhydrase. |
| 4.4.1.3 | Dimethylpropiothetin dethiomethylase. |
| 4.4.1.4 | Alliin lyase. |
| 4.4.1.5 | Lactoylglutathione lyase. |
| 4.4.1.6 | S-alkylcysteine lyase. |
| 4.4.1.8 | Cystathionine beta-lyase. |
| 4.4.1.9 | L-3-cyanoalanine synthase. |
| 4.4.1.10 | Cysteine lyase. |
| 4.4.1.11 | Methionine gamma-lyase. |
| 4.4.1.13 | Cysteine-S-conjugate beta-lyase. |
| 4.4.1.14 | 1-aminocyclopropane-1-carboxylate synthase. |
| 4.4.1.15 | D-cysteine desulfhydrase. |
| 4.4.1.16 | Selenocysteine lyase. |
| 4.4.1.17 | Holocytochrome-c synthase. |
| 4.4.1.19 | Phosphosulfolactate synthase. |
| 4.4.1.20 | Leukotriene-C(4) synthase. |
| 4.5.1.1 | DDT-dehydrochlorinase. |
| 4.5.1.2 | 3-chloro-D-alanine dehydrochlorinase. |
| 4.5.1.3 | Dichloromethane dehalogenase. |
| 4.5.1.4 | L-2-amino-4-chloropent-4-enoate dehydrochlorinase. |
| 4.5.1.5 | S-carboxymethylcysteine synthase. |
| 4.6.1.1 | Adenylate cyclase. |
| 4.6.1.2 | Guanylate cyclase. |
| 4.6.1.6 | Cytidylate cyclase. |
| 4.6.1.12 | 2-C-methyl-D-erythritol 2,4-cyclodiphosphate synthase. |
| 4.6.1.13 | Phosphatidylinositol diacylglycerol-lyase. |
| 4.6.1.14 | Glycosylphosphatidylinositol diacylglycerol-lyase. |
| 4.6.1.15 | FAD-AMP lyase (cyclizing). |
| 4.99.1.1 | Ferrochelatase. |
| 4.99.1.2 | Alkylmercury lyase. |
| 4.99.1.3 | Sirohydrochlorin cobaltochelatase. |
| 4.99.1.4 | Sirohydrochlorin ferrochelatase. |
| 4.99.1.5 | Aliphatic aldoxime dehydratase. |
| 4.99.1.6 | Indoleacetaldoxime dehydratase. |
| ENZYME: 5.—.—.— | |
| 5.1.1.1 | Alanine racemase. |
| 5.1.1.2 | Methionine racemase. |
| 5.1.1.3 | Glutamate racemase. |
| 5.1.1.4 | Proline racemase |
| 5.1.1.5 | Lysine racemase. |
| 5.1.1.6 | Threonine racemase. |
| 5.1.1.7 | Diaminopimelate epimerase. |
| 5.1.1.8 | 4-hydroxyproline epimerase. |
| 5.1.1.9 | Arginine racemase. |
| 5.1.1.10 | Amino-acid racemase. |
| 5.1.1.11 | Phenylalanine racemase (ATP-hydrolyzing). |
| 5.1.1.12 | Ornithine racemase. |
| 5.1.1.13 | Aspartate racemase. |
| 5.1.1.14 | Nocardicin-A epimerase. |
| 5.1.1.15 | 2-aminohexano-6-lactam racemase. |
| 5.1.1.16 | Protein-serine epimerase. |
| 5.1.1.17 | Isopenicillin-N epimerase. |
| 5.1.2.1 | Lactate racemase. |
| 5.1.2.2 | Mandelate racemase. |
| 5.1.2.3 | 3-hydroxybutyryl-CoA epimerase. |
| 5.1.2.4 | Acetoin racemase. |
| 5.1.2.5 | Tartrate epimerase. |
| 5.1.2.6 | Isocitrate epimerase. |
| 5.1.3.1 | Ribulose-phosphate 3-epimerase. |
| 5.1.3.2 | UDP-glucose 4-epimerase. |
| 5.1.3.3 | Aldose 1-epimerase. |
| 5.1.3.4 | L-ribulose-phosphate 4-epimerase. |
| 5.1.3.5 | UDP-arabinose 4-epimerase. |
| 5.1.3.6 | UDP-glucuronate 4-epimerase. |
| 5.1.3.7 | UDP-N-acetylglucosamine 4-epimerase. |
| 5.1.3.8 | N-acylglucosamine 2-epimerase. |
| 5.1.3.9 | N-acylglucosamine-6-phosphate 2-epimerase. |
| 5.1.3.10 | CDP-abequose epimerase. |
| 5.1.3.11 | Cellobiose epimerase. |
| 5.1.3.12 | UDP-glucuronate 5'-epimerase. |
| 5.1.3.13 | dTDP-4-dehydrorhamnose 3,5-epimerase. |
| 5.1.3.14 | UDP-N-acetylglucosamine 2-epimerase. |
| 5.1.3.15 | Glucose-6-phosphate 1-epimerase. |
| 5.1.3.16 | UDP-glucosamine 4-epimerase. |
| 5.1.3.17 | Heparosan-N-sulfate-glucuronate 5-epimerase. |
| 5.1.3.18 | GDP-mannose 3,5-epimerase. |
| 5.1.3.19 | Chondroitin-glucuronate 5-epimerase. |
| 5.1.3.20 | ADP-glyceromanno-heptose 6-epimerase. |
| 5.1.3.21 | Maltose epimerase. |
| 5.1.99.1 | Methylmalonyl-CoA epimerase. |
| 5.1.99.2 | 16-hydroxysteroid epimerase. |
| 5.1.99.3 | Allantoin racemase. |
| 5.1.99.4 | Alpha-methylacyl-CoA racemase. |
| 5.2.1.1 | Maleate isomerase. |
| 5.2.1.2 | Maleylacetoacetate isomerase. |
| 5.2.1.3 | Retinal isomerase. |
| 5.2.1.4 | Maleylpyruvate isomerase. |
| 5.2.1.5 | Linoleate isomerase. |
| 5.2.1.6 | Furylfuramide isomerase. |
| 5.2.1.7 | Retinol isomerase. |
| 5.2.1.8 | Peptidylprolyl isomerase. |
| 5.2.1.9 | Farnesol 2-isomerase. |
| 5.2.1.10 | 2-chloro-4-carboxymethylenebut-2-en-1,4-olide isomerase. |
| 5.2.1.11 | 4-hydroxyphenylacetaldehyde-oxime isomerase. |
| 5.3.1.1 | Triose-phosphate isomerase. |
| 5.3.1.3 | Arabinose isomerase. |
| 5.3.1.4 | L-arabinose isomerase. |
| 5.3.1.5 | Xylose isomerase. |
| 5.3.1.6 | Ribose-5-phosphate isomerase. |
| 5.3.1.7 | Mannose isomerase. |
| 5.3.1.8 | Mannose-6-phosphate isomerase. |
| 5.3.1.9 | Glucose-6-phosphate isomerase. |
| 5.3.1.12 | Glucuronate isomerase. |
| 5.3.1.13 | Arabinose-5-phosphate isomerase. |
| 5.3.1.14 | L-rhamnose isomerase. |
| 5.3.1.15 | D-lyxose ketol-isomerase. |
| 5.3.1.16 | 1-(5-phosphoribosyl)-5-((5-phosphoribosylamino)methylideneamino)imidazole-4-carboxamide isomerase. |
| 5.3.1.17 | 4-deoxy-L-threo-5-hexosulose-uronate ketol-isomerase. |
| 5.3.1.20 | Ribose isomerase. |
| 5.3.1.21 | Corticosteroid side-chain-isomerase. |
| 5.3.1.22 | Hydroxypyruvate isomerase. |
| 5.3.1.23 | S-methyl-5-thioribose-1-phosphate isomerase. |
| 5.3.1.24 | Phosphoribosylanthranilate isomerase. |
| 5.3.1.25 | L-fucose isomerase. |
| 5.3.1.26 | Galactose-6-phosphate isomerase. |
| 5.3.2.1 | Phenylpyruvate tautomerase. |
| 5.3.2.2 | Oxaloacetate tautomerase. |
| 5.3.3.1 | Steroid delta-isomerase. |
| 5.3.3.2 | Isopentenyl-diphosphate delta-isomerase. |
| 5.3.3.3 | Vinylacetyl-CoA delta-isomerase. |
| 5.3.3.4 | Muconolactone delta-isomerase |
| 5.3.3.5 | Cholestenol delta-isomerase. |
| 5.3.3.6 | Methylitaconate delta-isomerase. |
| 5.3.3.7 | Aconitate delta-isomerase. |
| 5.3.3.8 | Dodecenoyl-CoA delta-isomerase. |
| 5.3.3.9 | Prostaglandin-A(1) delta-isomerase. |
| 5.3.3.10 | 5-carboxymethyl-2-hydroxymuconate delta-isomerase. |
| 5.3.3.11 | Isopiperitenone delta-isomerase. |
| 5.3.3.12 | Dopachrome isomerase. |
| 5.3.3.13 | Polyenoic fatty acid isomerase. |

TABLE 2-continued

EC Numbers with the corresponding name given to each enzyme class, subclass and sub-subclass.

| | |
|---|---|
| 5.3.4.1 | Protein disulfide-isomerase. |
| 5.3.99.2 | Prostaglandin-D synthase. |
| 5.3.99.3 | Prostaglandin-E synthase. |
| 5.3.99.4 | Prostaglandin-I synthase. |
| 5.3.99.5 | Thromboxane-A synthase. |
| 5.3.99.6 | Allene-oxide cyclase. |
| 5.3.99.7 | Styrene-oxide isomerase. |
| 5.4.1.1 | Lysolecithin acylmutase. |
| 5.4.1.2 | Precorrin-8X methylmutase. |
| 5.4.2.1 | Phosphoglycerate mutase. |
| 5.4.2.2 | Phosphoglucomutase. |
| 5.4.2.3 | Phosphoacetylglucosamine mutase. |
| 5.4.2.4 | Bisphosphoglycerate mutase. |
| 5.4.2.5 | Phosphoglucomutase (glucose-cofactor). |
| 5.4.2.6 | Beta-phosphoglucomutase. |
| 5.4.2.7 | Phosphopentomutase. |
| 5.4.2.8 | Phosphomannomutase. |
| 5.4.2.9 | Phosphoenolpyruvate mutase. |
| 5.4.2.10 | Phosphoglucosamine mutase. |
| 5.4.3.2 | Lysine 2,3-aminomutase. |
| 5.4.3.3 | Beta-lysine 5,6-aminomutase. |
| 5.4.3.4 | D-lysine S,6-aminomutase. |
| 5.4.3.5 | D-ornithine 4,5-aminomutase. |
| 5.4.3.6 | Tyrosine 2,3-aminomutase. |
| 5.4.3.7 | Leucine 2,3-aminomutase. |
| 5.4.3.8 | Glutamate-1-semialdehyde 2,1-aminomutase. |
| 5.4.4.1 | (Hydroxyamino)benzene mutase. |
| 5.4.4.2 | Isochorismate synthase. |
| 5.4.4.3 | 3-(hydroxyamino)phenol mutase. |
| 5.4.99.1 | Methylaspartate mutase. |
| 5.4.99.2 | Methylmalonyl-CoA mutase. |
| 5.4.99.3 | 2-acetolactate mutase. |
| 5.4.99.4 | 2-methyleneglutarate mutase. |
| 5.4.99.5 | Chorismate mutase. |
| 5.4.99.7 | Lanosterol synthase. |
| 5.4.99.8 | Cycloartenol synthase. |
| 5.4.99.9 | UDP-galactopyranose mutase. |
| 5.4.99.11 | Isomaltulose synthase. |
| 5.4.99.12 | tRNA-pseudouridine synthase I. |
| 5.4.99.13 | Isobutyryl-CoA mutase. |
| 5.4.99.14 | 4-carboxymethyl-4-methylbutenolide mutase. |
| 5.4.99.15 | (1->4)-alpha-D-glucan 1-alpha-D-glucosylmutase. |
| 5.4.99.16 | Maltose alpha-D-glucosyltransferase. |
| 5.4.99.17 | Squalene--hopene cyclase. |
| 5.5.1.1 | Muconate cycloisomerase. |
| 5.5.1.2 | 3-carboxy-cis,cis-muconate cycloisomerase. |
| 5.5.1.3 | Tetrahydroxypteridine cycloisomerase. |
| 5.5.1.4 | Inositol-3-phosphate synthase. |
| 5.5.1.5 | Carboxy-cis,cis-muconate cyclase. |
| 5.5.1.6 | Chalcone isomerase. |
| 5.5.1.7 | Chloromuconate cycloisomerase. |
| 5.5.1.8 | Geranyl-diphosphate cyclase. |
| 5.5.1.9 | Cycloeucalenol cycloisomerase. |
| 5.5.1.10 | Alpha-pinene-oxide decyclase. |
| 5.5.1.11 | Dichloromuconate cycloisomerase. |
| 5.5.1.12 | Copalyl diphosphate synthase. |
| 5.5.1.13 | Ent-copalyl diphosphate synthase. |
| 5.99.1.1 | Thiocyanate isomerase. |
| 5.99.1.2 | DNA topoisomerase. |
| 5.99.1.3 | DNA topoisomerase (ATP-hydrolyzing). |

ENZYME: 6.—.—

| | |
|---|---|
| 6.1.1.1 | Tyrosine--tRNA ligase. |
| 6.1.1.2 | Tryptophan--tRNA ligase. |
| 6.1.1.3 | Threonine--tRNA ligase. |
| 6.1.1.4 | Leucine--tRNA ligase. |
| 6.1.1.5 | Isoleucine--tRNA ligase. |
| 6.1.1.6 | Lysine--tRNA ligase. |
| 6.1.1.7 | Alanine--tRNA ligase. |
| 6.1.1.9 | Valine--tRNA ligase. |
| 6.1.1.10 | Methionine--tRNA ligase. |
| 6.1.1.11 | Serine--tRNA ligase. |
| 6.1.1.12 | Aspartate--tRNA ligase. |
| 6.1.1.13 | D-alanine--poly(phosphoribitol) ligase. |
| 6.1.1.14 | Glycine--tRNA ligase. |
| 6.1.1.15 | Proline--tRNA ligase. |
| 6.1.1.16 | Cysteine--tRNA ligase. |
| 6.1.1.17 | Glutamate--tRNA ligase. |
| 6.1.1.18 | Glutamine--tRNA ligase. |
| 6.1.1.19 | Arginine--tRNA ligase. |
| 6.1.1.20 | Phenylalanine--tRNA ligase. |
| 6.1.1.21 | Histidine--tRNA ligase. |
| 6.1.1.22 | Asparagine--tRNA ligase. |
| 6.1.1.23 | Aspartate--tRNA(Asn) ligase. |
| 6.1.1.24 | Glutamate--tRNA(Gln) ligase. |
| 6.1.1.25 | Lysine--tRNA(Pyl) ligase. |
| 6.2.1.1 | Acetate--CoA ligase. |
| 6.2.1.2 | Butyrate--CoA ligase. |
| 6.2.1.3 | Long-chain-fatty-acid--CoA ligase. |
| 6.2.1.4 | Succinate--CoA ligase (GDP-forming). |
| 6.2.1.5 | Succinate--CoA ligase (ADP-forming). |
| 6.2.1.6 | Glutarate--CoA ligase. |
| 6.2.1.7 | Cholate--CoA ligase. |
| 6.2.1.8 | Oxalate--CoA ligase. |
| 6.2.1.9 | Malate--CoA ligase. |
| 6.2.1.10 | Acid--CoA ligase (GDP-forming). |
| 6.2.1.11 | Biotin--CoA ligase. |
| 6.2.1.12 | 4-coumarate--CoA ligase. |
| 6.2.1.13 | Acetate--CoA ligase (ADP-forming). |
| 6.2.1.14 | 6-carboxyhexanoate--CoA ligase. |
| 6.2.1.15 | Arachidonate--CoA ligase. |
| 6.2.1.16 | Acetoacetate--CoA ligase. |
| 6.2.1.17 | Propionate--CoA ligase. |
| 6.2.1.18 | Citrate--CoA ligase. |
| 6.2.1.19 | Long-chain-fatty-acid--luciferin component ligase. |
| 6.2.1.20 | Long-chain-fatty-acid--[acyl-carrier protein] ligase. |
| 6.2.1.22 | [Citrate (pro-3S)-lyase] ligase. |
| 6.2.1.23 | Dicarboxylate--CoA ligase. |
| 6.2.1.24 | Phytanate--CoA ligase. |
| 6.2.1.25 | Benzoate--CoA ligase. |
| 6.2.1.26 | O-succinylbenzoate--CoA ligase. |
| 6.2.1.27 | 4-hydroxybenzoate--CoA ligase. |
| 6.2.1.28 | 3-alpha,7-alpha-dihydroxy-5-beta-cholestanate--CoA ligase. |
| 6.2.1.29 | 3-alpha,7-alpha,12-alpha-trihydroxy-5-beta-cholestanate--CoA ligase. |
| 6.2.1.30 | Phenylacetate--CoA ligase. |
| 6.2.1.31 | 2-furoate--CoA ligase. |
| 6.2.1.32 | Anthranilate--CoA ligase. |
| 6.2.1.33 | 4-chlorobenzoate--CoA ligase. |
| 6.2.1.34 | Trans-feruloyl--CoA synthase. |
| 6.3.1.1 | Aspartate--ammonia ligase. |
| 6.3.1.2 | Glutamate--ammonia ligase. |
| 6.3.1.4 | Aspartate--ammonia ligase (ADP-forming). |
| 6.3.1.5 | NAD(+) synthase. |
| 6.3.1.6 | Glutamate--ethylamine ligase. |
| 6.3.1.7 | 4-methyleneglutamate--ammonia ligase. |
| 6.3.1.8 | Glutathionylspermidine synthase. |
| 6.3.1.9 | Trypanothione synthase. |
| 6.3.1.10 | Adenosylcobinamide-phosphate synthase. |
| 6.3.2.1 | Pantoate--beta-alanine ligase. |
| 6.3.2.2 | Glutamate--cysteine ligase. |
| 6.3.2.3 | Glutathione synthase. |
| 6.3.2.4 | D-alanine--D-alanine ligase. |
| 6.3.2.5 | Phosphopantothenate--cysteine ligase. |
| 6.3.2.6 | Phosphoribosylaminoimidazolesuccinocarboxamide synthase. |
| 6.3.2.7 | UDP-N-acetylmuramoyl-L-alanyl-D-glutamate--L-lysine ligase. |
| 6.3.2.8 | UDP-N-acetylmuramate--L-alanine ligase. |

TABLE 2-continued

EC Numbers with the corresponding name given to each enzyme class, subclass and sub-subclass.

| | |
|---|---|
| 6.3.2.9 | UDP-N-acetylmuramoylalanine--D-glutamate ligase. |
| 6.3.2.10 | UDP-N-acetylmuramoyl-tripeptide--D-alanyl-D-alanine ligase. |
| 6.3.2.11 | Carnosine synthase. |
| 6.3.2.12 | Dihydrofolate synthase. |
| 6.3.2.13 | UDP-N-acetylmuramoylalanyl-D-glutamate--2,6-diaminopimelate ligase. |
| 6.3.2.14 | 2,3-dihydroxybenzoate--serine ligase. |
| 6.3.2.16 | D-alanine--alanyl-poly(glycerolphosphate) ligase. |
| 6.3.2.17 | Tetrahydrofolylpolyglutamate synthase. |
| 6.3.2.18 | Gamma-glutamylhistamine synthase. |
| 6.3.2.19 | Ubiquitin--protein ligase. |
| 6.3.2.20 | Indoleacetate-lysine synthetase. |
| 6.3.2.21 | Ubiquitin--calmodulin ligase. |
| 6.3.2.22 | Diphthine--ammonia ligase. |
| 6.3.2.23 | Homoglutathione synthase. |
| 6.3.2.24 | Tyrosine--arginine ligase. |
| 6.3.2.25 | Tubulin--tyrosine ligase. |
| 6.3.2.26 | N-(5-amino-5-carboxypentanoyl)-L-cysteinyl-D-valine synthase. |
| 6.3.2.27 | Aerobactin synthase. |
| 6.3.3.1 | Phosphoribosylformylglycinamidine cyclo-ligase. |
| 6.3.3.2 | 5-formyltetrahydrofolate cyclo-ligase. |
| 6.3.3.3 | Dethiobiotin synthase. |
| 6.3.3.4 | (Carboxyethyl)arginine beta-lactam-synthase. |
| 6.3.4.1 | GMP synthase. |
| 6.3.4.2 | CTP synthase. |
| 6.3.4.3 | Formate--tetrahydrofolate ligase. |
| 6.3.4.4 | Adenylosuccinate synthase. |
| 6.3.4.5 | Argininosuccinate synthase. |
| 6.3.4.6 | Urea carboxylase. |
| 6.3.4.7 | Ribose-5-phosphate--ammonia ligase. |
| 6.3.4.8 | Imidazoleacetate--phosphoribosyldipliosphate ligase. |
| 6.3.4.9 | Biotin--[methylmalonyl-CoA-carboxytransferase] ligase. |
| 6.3.4.10 | Biotin-[propionyl-CoA-carboxylase (ATP-hydrolyzing)] ligase. |
| 6.3.4.11 | Biotin--[methylcrotonoyl-CoA-carboxylase] ligase. |
| 6.3.4.12 | Glutamate--methylamine ligase. |
| 6.3.4.13 | Phosphoribosylamine-glycine ligase. |
| 6.3.4.14 | Biotin carboxylase. |
| 6.3.4.15 | Biotin--[acetyl-CoA-carboxylase] ligase. |
| 6.3.4.16 | Carbamoyl-phosphate synthase (ammonia). |
| 6.3.4.17 | Formate--dihydrofolate ligase. |
| 6.3.5.1 | NAD(+) synthase (glutamine-hydrolyzing). |
| 6.3.5.2 | GMP synthase (glutamine-hydrolyzing). |
| 6.3.5.3 | Phosphoribosylformylglycinamidine synthase. |
| 6.3.5.4 | Asparagine synthase (glutamine-hydrolyzing). |
| 6.3.5.5 | Carbamoyl-phosphate synthase (glutamine-hydrolyzing). |
| 6.3.5.6 | Asparaginyl-tRNA synthase (glutamine-hydrolyzing). |
| 6.3.5.7 | Glutaminyl-tRNA synthase (glutamine-hydrolyzing). |
| 6.3.5.8 | Aminodeoxychorismate synthase. |
| 6.3.5.9 | Hydrogenobyrinic acid a,c-diamide synthase (glutamine-hydrolyzing). |
| 6.3.5.10 | Adenosylcobyric acid synthase (glutamine-hydrolyzing). |
| 6.4.1.1 | Pyruvate carboxylase. |
| 6.4.1.2 | Acetyl-CoA carboxylase. |
| 6.4.1.3 | Propionyl-CoA carboxylase. |
| 6.4.1.4 | Methylcrotonoyl-CoA carboxylase. |
| 6.4.1.5 | Geranoyl-CoA carboxylase. |
| 6.4.1.6 | Acetone carboxylase. |
| 6.5.1.1 | DNA ligase (ATP). |
| 6.5.1.2 | DNA ligase (NAD+). |
| 6.5.1.3 | RNA ligase (ATP). |
| 6.5.1.4 | RNA-3'-phosphate cyclase. |
| 6.6.1.1 | Magnesium chelatase. |
| 6.6.1.2 | Cobaltochelatase. |
| 6.3.4.17 | Formate--dihydrofolate ligase. |
| 6.3.5.1 | NAD(+) synthase (glutamine-hydrolyzing). |
| 6.3.5.2 | GMP synthase (glutamine-hydrolyzing). |
| 6.3.5.3 | Phosphoribosylformylglycinamidine synthase. |
| 6.3.5.4 | Asparagine synthase (glutamine-hydrolyzing). |
| 6.3.5.5 | Carbamoyl-phosphate synthase (glutamine-hydrolyzing). |
| 6.3.5.6 | Asparaginyl-tRNA synthase (glutamine-hydrolyzing). |
| 6.3.5.7 | Glutaminyl-tRNA synthase (glutamine-hydrolyzing). |
| 6.3.5.8 | Aminodeoxychorismate synthase. |
| 6.3.5.9 | Hydrogenobyrinic acid a,c-diamide synthase (glutamine-hydrolyzing). |
| 6.3.5.10 | Adenosylcobyric acid synthase (glutamine-hydrolyzing). |
| 6.4.1.1 | Pyruvate carboxylase. |
| 6.4.1.2 | Acetyl-CoA carboxylase. |
| 6.4.1.3 | Propionyl-CoA carboxylase. |
| 6.4.1.4 | Methylcrotonoyl-CoA carboxylase. |
| 6.4.1.5 | Geranoyl-CoA carboxylase. |
| 6.4.1.6 | Acetone carboxylase. |
| 6.5.1.1 | DNA ligase (ATP). |
| 6.5.1.2 | DNA ligase (NAD+). |
| 6.5.1.3 | RNA ligase (ATP). |
| 6.5.1.4 | RNA-3'-phosphate cyclase. |
| 6.6.1.1 | Magnesium chelatase. |
| 6.6.1.2 | Cobaltochelatase. |

Table 3 summarizes exemplary functions of exemplary enzymes of the invention; these enzyme functions were determined using sequence identity comparison analysis using closest BLAST hits to the exemplary polypeptides and polynucleotides of the invention.

The invention also provides isolated and recombinant nucleic acids encoding polypeptides, e.g., SEQ ID NO:1, SEQ ID NO:3, SEQ ID NO:5, SEQ ID NO:7, SEQ ID NO:9, etc., and all additional nucleic acids disclosed in the SEQ ID listing, which include all odd numbered SEQ ID NOs: from SEQ ID NO:1 through SEQ ID NO:26,897 (the exemplary polynucleotides of the invention). The invention also provides isolated and recombinant polypeptides, SEQ ID NO:2, SEQ ID NO:4, SEQ ID NO:6, SEQ ID NO:8, SEQ ID NO:10, etc., and all polypeptides disclosed in the SEQ ID listing, which include all even numbered SEQ ID NOs: from SEQ ID NO:2 through SEQ ID NO:26,898 (the exemplary polypeptides of the invention).

In another embodiment, the polypeptides of the invention can be expressed in any expression system, in vitro or in vivo, e.g., any microorganism or other cell system (e.g., eukaryotic, such as yeast or mammalian cells) using procedures known in the art. In other aspects, the polypeptides of the invention can be immobilized on a solid support prior to use in the methods of the invention. Methods for immobilizing enzymes on solid supports are commonly known in the art, for example J. Mol. Cat. B: Enzymatic 6 (1999) 29-39; Chivata et al. Biocatalysis: Immobilized cells and enzymes, J. Mol. Cat. 37 (1986) 1-24:

Sharma et al., Immobilized Biomaterials Techniques and Applications, Angew. Chem. Int. Ed. Engl. 21 (1982) 837-54: Laskin (Ed.), Enzymes and mobilized Cells in Biotechnology.

DEFINITIONS

A "coding sequence of" or a "sequence encodes" a particular polypeptide or protein, is a nucleic acid sequence which is transcribed and translated into a polypeptide or protein when placed under the control of appropriate regulatory sequences.

A promoter sequence is "operably linked to" a coding sequence when RNA polymerase which initiates transcription at the promoter will transcribe the coding sequence into mRNA.

The phrase "substantially identical" in the context of two nucleic acids or polypeptides, refers to two or more sequences that have, e.g., at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more nucleotide or amino acid residue (sequence) identity, when compared and aligned for maximum correspondence, as measured using one of the known sequence comparison algorithms or by visual inspection. In alternative aspects, the substantial identity exists over a region of at least about 100 or more residues and most commonly the sequences are substantially identical over at least about 150 to 200 or more residues. In some aspects, the sequences are substantially identical over the entire length of the coding regions.

Additionally a "substantially identical" amino acid sequence is a sequence that differs from a reference sequence by one or more conservative or non-conservative amino acid substitutions, deletions, or insertions. In one aspect, the substitution occurs at a site that is not the active site of the molecule, or, alternatively the substitution occurs at a site that is the active site of the molecule, provided that the polypeptide essentially retains its functional (enzymatic) properties. A conservative amino acid substitution, for example, substitutes one amino acid for another of the same class (e.g., substitution of one hydrophobic amino acid, such as isoleucine, valine, leucine, or methionine, for another, or substitution of one polar amino acid for another, such as substitution of arginine for lysine, glutamic acid for aspartic acid or glutamine for asparagine). One or more amino acids can be deleted, for example, from a polypeptide, resulting in modification of the structure of the polypeptide, without significantly altering its biological activity. For example, amino- or carboxyl-terminal amino acids that are not required for a polypeptide, enzyme, protein, e.g. structural or binding protein, biological activity can be removed. Modified polypeptide sequences of the invention can be assayed for enzyme, structural or binding activity by any number of methods, including contacting the modified polypeptide sequence with a substrate and determining whether the modified polypeptide decreases the amount of specific substrate in the assay or increases the bioproducts of the reaction of a functional polypeptide, enzyme, protein, e.g. structural or binding protein, with the substrate. Assays for enzyme activity are well known in the art.

"Fragments" as used herein are a portion of a naturally occurring protein which can exist in at least two different conformations. Fragments can have the same or substantially the same amino acid sequence as the naturally occurring protein. Fragments which have different three dimensional structures as the naturally occurring protein are also included. An example of this, is a "pro-form" molecule, such as a low activity proprotein that can be modified by cleavage to produce a mature enzyme with significantly higher activity.

The term "variant" refers to polynucleotides or polypeptides of the invention modified at one or more base pairs, codons, introns, exons, or amino acid residues (respectively) yet still retain the biological activity of a polypeptide, enzyme, protein, e.g. structural or binding protein, of the invention. Variants can be produced by any number of means included methods such as, for example, error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, GSSM and any combination thereof.

The term "saturation mutagenesis", Gene Site Saturation Mutagenesis, or "GSSM" includes a method that uses degenerate oligonucleotide primers to introduce point mutations into a polynucleotide, as described in detail, below.

The term "optimized directed evolution system" or "optimized directed evolution" includes a method for reassembling fragments of related nucleic acid sequences, e.g., related genes, and explained in detail, below.

The term "synthetic ligation reassembly" or "SLR" includes a method of ligating oligonucleotide fragments in a non-stochastic fashion, and explained in detail, below.

Nucleic Acids

The invention provides nucleic acids (e.g., the exemplary SEQ ID NO:1, SEQ ID NO:3, SEQ ID NO:5, SEQ ID NO:7, SEQ ID NO:9, SEQ ID NO:11, etc., including all nucleic acids disclosed in the SEQ ID listing, which include all odd numbered SEQ ID NOs: from SEQ ID NO:1 through SEQ ID NO:26,897), including expression cassettes such as expression vectors, encoding polypeptides (e.g., enzymes) of the invention. The invention also includes methods for discovering new polypeptide (e.g., enzyme) sequences using the nucleic acids of the invention. The invention also includes methods for inhibiting the expression of enzymes, genes, transcripts and polypeptides using the nucleic acids of the invention. Also provided are methods for modifying the nucleic acids of the invention by, e.g., synthetic ligation reassembly, optimized directed evolution system and/or saturation mutagenesis.

The nucleic acids of the invention can be made, isolated and/or manipulated by, e.g., cloning and expression of cDNA libraries, amplification of message or genomic DNA by PCR, and the like. For example, exemplary sequences of the invention were initially derived from environmental sources.

In one aspect, the invention provides nucleic acids, and the polypeptides encoded by them, with a common novelty in that they are derived from a common source, e.g., an environmental or a bacterial source.

In practicing the methods of the invention, homologous genes can be modified by manipulating a template nucleic acid, as described herein. The invention can be practiced in conjunction with any method or protocol or device known in the art, which are well described in the scientific and patent literature.

The phrases "nucleic acid" or "nucleic acid sequence" as used herein refer to an oligonucleotide, nucleotide, polynucleotide, or to a fragment of any of these, to DNA or RNA of genomic or synthetic origin which may be single-stranded or double-stranded and may represent a sense or antisense (complementary) strand, to peptide nucleic acid (PNA), or to any DNA-like or RNA-like material, natural or synthetic in origin. The phrases "nucleic acid" or "nucleic acid sequence"

includes oligonucleotide, nucleotide, polynucleotide, or to a fragment of any of these, to DNA or RNA (e.g., mRNA, rRNA, tRNA, iRNA) of genomic or synthetic origin which may be single-stranded or double-stranded and may represent a sense or antisense strand, to peptide nucleic acid (PNA), or to any DNA-like or RNA-like material, natural or synthetic in origin, including, e.g., iRNA, ribonucleoproteins (e.g., e.g., double stranded iRNAs, e.g., iRNPs). The term encompasses nucleic acids, i.e., oligonucleotides, containing known analogues of natural nucleotides. The term also encompasses nucleic-acid-like structures with synthetic backbones, see e.g., Mata (1997) Toxicol. Appl. Pharmacol. 144:189-197; Strauss-Soukup (1997) Biochemistry 36:8692-8698; Samstag (1996) Antisense Nucleic Acid Drug Dev 6:153-156. "Oligonucleotide" includes either a single stranded polydeoxynucleotide or two complementary polydeoxynucleotide strands which may be chemically synthesized. Such synthetic oligonucleotides have no 5' phosphate and thus will not ligate to another oligonucleotide without adding a phosphate with an ATP in the presence of a kinase. A synthetic oligonucleotide can ligate to a fragment that has not been dephosphorylated.

A "coding sequence of" or a "nucleotide sequence encoding" a particular polypeptide or protein, is a nucleic acid sequence which is transcribed and translated into a polypeptide or protein when placed under the control of appropriate regulatory sequences. The term "gene" means the segment of DNA involved in producing a polypeptide chain; it includes regions preceding and following the coding region (leader and trailer) as well as, where applicable, intervening sequences (introns) between individual coding segments (exons). "Operably linked" as used herein refers to a functional relationship between two or more nucleic acid (e.g., DNA) segments. Typically, it refers to the functional relationship of transcriptional regulatory sequence to a transcribed sequence. For example, a promoter is operably linked to a coding sequence, such as a nucleic acid of the invention, if it stimulates or modulates the transcription of the coding sequence in an appropriate host cell or other expression system. Generally, promoter transcriptional regulatory sequences that are operably linked to a transcribed sequence are physically contiguous to the transcribed sequence, i.e., they are cis-acting. However, some transcriptional regulatory sequences, such as enhancers, need not be physically contiguous or located in close proximity to the coding sequences whose transcription they enhance.

As used herein, the term "promoter" includes all sequences capable of driving transcription of a coding sequence in a cell, e.g., a plant cell. Thus, promoters used in the constructs of the invention include cis-acting transcriptional control elements and regulatory sequences that are involved in regulating or modulating the timing and/or rate of transcription of a gene. For example, a promoter can be a cis-acting transcriptional control element, including an enhancer, a promoter, a transcription terminator, an origin of replication, a chromosomal integration sequence, 5' and 3' untranslated regions, or an intronic sequence, which are involved in transcriptional regulation. These cis-acting sequences typically interact with proteins or other biomolecules to carry out (turn on/off, regulate, modulate, etc.) transcription. "Constitutive" promoters are those that drive expression continuously under most environmental conditions and states of development or cell differentiation. "Inducible" or "regulatable" promoters direct expression of the nucleic acid of the invention under the influence of environmental conditions or developmental conditions. Examples of environmental conditions that may affect transcription by inducible promoters include anaerobic conditions, elevated temperature, drought, or the presence of light.

"Plasmids" can be commercially available, publicly available on an unrestricted basis, or can be constructed from available plasmids in accord with published procedures. Equivalent plasmids to those described herein are known in the art and will be apparent to the ordinarily skilled artisan.

In one aspect, the term "recombinant" means that the nucleic acid is adjacent to a "backbone" nucleic acid to which it is not adjacent in its natural environment. Additionally, to be "enriched" the nucleic acids will represent 5% or more of the number of nucleic acid inserts in a population of nucleic acid backbone molecules. Backbone molecules according to the invention include nucleic acids such as expression vectors, self-replicating nucleic acids, viruses, integrating nucleic acids and other vectors or nucleic acids used to maintain or manipulate a nucleic acid insert of interest. Typically, the enriched nucleic acids represent 15% or more of the number of nucleic acid inserts in the population of recombinant backbone molecules. More typically, the enriched nucleic acids represent 50% or more of the number of nucleic acid inserts in the population of recombinant backbone molecules. In a one aspect, the enriched nucleic acids represent 90% or more of the number of nucleic acid inserts in the population of recombinant backbone molecules.

One aspect of the invention is an isolated nucleic acid comprising one of the sequences of the invention, or a fragment comprising at least 10, 15, 20, 25, 30, 35, 40, 50, 75, 100, 150, 200, 300, 400, or 500 or more consecutive bases of a nucleic acid of the invention. The isolated, nucleic acids may comprise DNA, including cDNA, genomic DNA and synthetic DNA. The DNA may be double-stranded or single-stranded and if single stranded may be the coding strand or non-coding (anti-sense) strand. Alternatively, the isolated nucleic acids may comprise RNA.

The isolated nucleic acids of the invention may be used to prepare one of the polypeptides of the invention, or fragments comprising at least 5, 10, 15, 20, 25, 30, 35, 40, 50, 75, 100, or 150 or more consecutive amino acids of one of the polypeptides of the invention. Accordingly, another aspect of the invention is an isolated nucleic acid which encodes one of the polypeptides of the invention, or fragments comprising at least 5, 10, 15, 20, 25, 30, 35, 40, 50, 75, 100, or 150 or more consecutive amino acids of one of the polypeptides of the invention. The coding sequences of these nucleic acids may be identical to one of the coding sequences of one of the nucleic acids of the invention or may be different coding sequences which encode one of the of the invention having at least 5, 10, 15, 20, 25, 30, 35, 40, 50, 75, 100, or 150 or more consecutive amino acids of one of the polypeptides of the invention, as a result of the redundancy or degeneracy of the genetic code. The genetic code is well known to those of skill in the art and can be obtained, e.g., on page 214 of B. Lewin, Genes VI, Oxford University Press, 1997.

The isolated nucleic acid which encodes one of the polypeptides of the invention, but is not limited to: only the coding sequence of a nucleic acid of the invention and additional coding sequences, such as leader sequences or proprotein sequences and non-coding sequences, such as introns or non-coding sequences 5' and/or 3' of the coding sequence. Thus, as used herein, the term "polynucleotide encoding a polypeptide" encompasses a polynucleotide which includes only the coding sequence for the polypeptide as well as a polynucleotide which includes additional coding and/or non-coding sequence.

Alternatively, the nucleic acid sequences of the invention, may be mutagenized using conventional techniques, such as site directed mutagenesis, or other techniques familiar to those skilled in the art, to introduce silent changes into the polynucleotides of the invention. As used herein, "silent changes" include, for example, changes which do not alter the amino acid sequence encoded by the polynucleotide. Such changes may be desirable in order to increase the level of the polypeptide produced by host cells containing a vector encoding the polypeptide by introducing codons or codon pairs which occur frequently in the host organism.

The invention also relates to polynucleotides which have nucleotide changes which result in amino acid substitutions, additions, deletions, fusions and truncations in the polypeptides of the invention. Such nucleotide changes may be introduced using techniques such as site directed mutagenesis, random chemical mutagenesis, exonuclease III deletion and other recombinant DNA techniques. Alternatively, such nucleotide changes may be naturally occurring allelic variants which are isolated by identifying nucleic acids which specifically hybridize to probes comprising at least 10, 15, 20, 25, 30, 35, 40, 50, 75, 100, 150, 200, 300, 400, or 500 consecutive bases of one of the sequences of the invention (or the sequences complementary thereto) under conditions of high, moderate, or low stringency as provided herein.

General Techniques

The nucleic acids used to practice this invention, whether RNA, iRNA, antisense nucleic acid, cDNA, genomic DNA, vectors, viruses or hybrids thereof, may be isolated from a variety of sources, genetically engineered, amplified, and/or expressed/generated recombinantly. Recombinant polypeptides generated from these nucleic acids can be individually isolated or cloned and tested for a desired activity. Any recombinant expression system can be used, including bacterial, mammalian, yeast, insect or plant cell expression systems.

Alternatively, these nucleic acids can be synthesized in vitro by well-known chemical synthesis techniques, as described in, e.g., Adams (1983) J. Am. Chem. Soc. 105:661; Belousov (1997) Nucleic Acids Res. 25:3440-3444; Frenkel (1995) Free Radic. Biol. Med. 19:373-380; Blommers (1994) Biochemistry 33:7886-7896; Narang (1979) Meth. Enzymol. 68:90; Brown (1979) Meth. Enzymol. 68:109; Beaucage (1981) Tetra. Lett. 22:1859; U.S. Pat. No. 4,458,066.

Techniques for the manipulation of nucleic acids, such as, e.g., subcloning, labeling probes (e.g., random-primer labeling using Klenow polymerase, nick translation, amplification), sequencing, hybridization and the like are well described in the scientific and patent literature, see, e.g., Sambrook, ed., MOLECULAR CLONING: A LABORATORY MANUAL (2ND ED.), Vols. 1-3, Cold Spring Harbor Laboratory, (1989); CURRENT PROTOCOLS IN MOLECULAR BIOLOGY, Ausubel, ed. John Wiley & Sons, Inc., New York (1997); LABORATORY TECHNIQUES IN BIOCHEMISTRY AND MOLECULAR BIOLOGY: HYBRIDIZATION WITH NUCLEIC ACID PROBES, Part I. Theory and Nucleic Acid Preparation, Tijssen, ed. Elsevier, N.Y. (1993).

Another useful means of obtaining and manipulating nucleic acids used to practice the methods of the invention is to clone from genomic samples, and, if desired, screen and re-clone inserts isolated or amplified from, e.g., genomic clones or cDNA clones. Sources of nucleic acid used in the methods of the invention include genomic or cDNA libraries contained in, e.g., mammalian artificial chromosomes (MACs), see, e.g., U.S. Pat. Nos. 5,721,118; 6,025,155; human artificial chromosomes, see, e.g., Rosenfeld (1997) Nat. Genet. 15:333-335; yeast artificial chromosomes (YAC); bacterial artificial chromosomes (BAC); P1 artificial chromosomes, see, e.g., Woon (1998) Genomics 50:306-316; P1-derived vectors (PACs), see, e.g., Kern (1997) Biotechniques 23:120-124; cosmids, recombinant viruses, phages or plasmids.

In one aspect, a nucleic acid encoding a polypeptide of the invention is assembled in appropriate phase with a leader sequence capable of directing secretion of the translated polypeptide or fragment thereof.

The invention provides fusion proteins and nucleic acids encoding them. A polypeptide of the invention can be fused to a heterologous peptide or polypeptide, such as N-terminal identification peptides which impart desired characteristics, such as increased stability or simplified purification. Peptides and polypeptides of the invention can also be synthesized and expressed as fusion proteins with one or more additional domains linked thereto for, e.g., producing a more immunogenic peptide, to more readily isolate a recombinantly synthesized peptide, to identify and isolate antibodies and antibody-expressing B cells, and the like. Detection and purification facilitating domains include, e.g., metal chelating peptides such as polyhistidine tracts and histidine-tryptophan modules that allow purification on immobilized metals, protein A domains that allow purification on immobilized immunoglobulin, and the domain utilized in the FLAGS extension/affinity purification system (Immunex Corp, Seattle Wash.). The inclusion of a cleavable linker sequences such as Factor Xa or enterokinase (Invitrogen, San Diego Calif.) between a purification domain and the motif-comprising peptide or polypeptide to facilitate purification. For example, an expression vector can include an epitope-encoding nucleic acid sequence linked to six histidine residues followed by a thioredoxin and an enterokinase cleavage site (see e.g., Williams (1995) Biochemistry 34:1787-1797; Dobeli (1998) Protein Expr. Purif. 12:404-414). The histidine residues facilitate detection and purification while the enterokinase cleavage site provides a means for purifying the epitope from the remainder of the fusion protein. Technology pertaining to vectors encoding fusion proteins and application of fusion proteins are well described in the scientific and patent literature, see e.g., Kroll (1993) DNA Cell. Biol., 12:441-53.

Transcriptional and Translational Control Sequences

The invention provides nucleic acid (e.g., DNA) sequences of the invention operatively linked to expression (e.g., transcriptional or translational) control sequence(s), e.g., promoters or enhancers, to direct or modulate RNA synthesis/expression. The expression control sequence can be in an expression vector. Exemplary bacterial promoters include lac, lacZ, T3, T7, gpt, lambda PR, PL and trp. Exemplary eukaryotic promoters include CMV immediate early, HSV thymidine kinase, early and late SV40, LTRs from retrovirus, and mouse metallothionein I.

Promoters suitable for expressing a polypeptide in bacteria include the *E. coli* lac or trp promoters, the lacI promoter, the lacZ promoter, the T3 promoter, the T7 promoter, the gpt promoter, the lambda PR promoter, the lambda PL promoter, promoters from operons encoding glycolytic enzymes such as 3-phosphoglycerate kinase (PGK), and the acid phosphatase promoter. Eukaryotic promoters include the CMV immediate early promoter, the HSV thymidine kinase promoter, heat shock promoters, the early and late SV40 promoter, LTRs from retroviruses, and the mouse metallothionein-I promoter. Other promoters known to control expression of genes in prokaryotic or eukaryotic cells or their viruses may also be used. Promoters suitable for expressing the polypeptide or fragment thereof in bacteria include the *E. coli* lac or trp promoters, the lac promoter, the lacZ promoter, the T3 promoter, the T7 promoter, the gpt promoter, the lambda $P_R$ promoter, the lambda $P_L$ promoter, promoters from operons encoding glycolytic enzymes such as 3-phosphoglycerate kinase (PGK) and the acid phosphatase promoter. Fungal promoters include the α-factor promoter. Eukaryotic promoters include the CMV immediate early promoter, the HSV thymidine kinase promoter, heat shock promoters, the early and late SV40 promoter, LTRs from retroviruses and the mouse metallothionein-I promoter. Other promoters known to control expression of genes in prokaryotic or eukaryotic cells or their viruses may also be used.

Tissue-Specific Promoters

The invention provides expression cassettes that can be expressed in a tissue-specific manner, e.g., that can express a polypeptide, enzyme, protein, e.g. structural or binding protein, of the invention in a tissue-specific manner. The invention also provides plants or seeds that express a polypeptide, enzyme, protein, e.g. structural or binding protein, of the invention in a tissue-specific manner. The tissue-specificity can be seed specific, stem specific, leaf specific, root specific, fruit specific and the like.

The term "expression cassette" as used herein refers to a nucleotide sequence which is capable of affecting expression of a structural gene (i.e., a protein coding sequence, such as a polypeptide, enzyme, protein, e.g. structural or binding protein, of the invention) in a host compatible with such sequences. Expression cassettes include at least a promoter operably linked with the polypeptide coding sequence; and, optionally, with other sequences, e.g., transcription termination signals. Additional factors necessary or helpful in effecting expression may also be used, e.g., enhancers, alpha-factors. Thus, expression cassettes also include plasmids, expression vectors, recombinant viruses, any form of recombinant "naked DNA" vector, and the like. A "vector" comprises a nucleic acid which can infect, transfect, transiently or permanently transduce a cell. It will be recognized that a vector can be a naked nucleic acid, or a nucleic acid complexed with protein or lipid. The vector optionally comprises viral or bacterial nucleic acids and/or proteins, and/or membranes (e.g., a cell membrane, a viral lipid envelope, etc.). Vectors include, but are not limited to replicons (e.g., RNA replicons, bacteriophages) to which fragments of DNA may be attached and become replicated. Vectors thus include, but are not limited to RNA, autonomous self-replicating circular or linear DNA or RNA (e.g., plasmids, viruses, and the like, see, e.g., U.S. Pat. No. 5,217,879), and include both the expression and non-expression plasmids. Where a recombinant microorganism or cell culture is described as hosting an "expression vector" this includes both extra-chromosomal circular and linear DNA and DNA that has been incorporated into the host chromosome(s). Where a vector is being maintained by a host cell, the vector may either be stably replicated by the cells during mitosis as an autonomous structure, or is incorporated within the host's genome.

"Tissue-specific" promoters are transcriptional control elements that are only active in particular cells or tissues or organs, e.g., in plants or animals. Tissue-specific regulation may be achieved by certain intrinsic factors which ensure that genes encoding proteins specific to a given tissue are expressed. Such factors are known to exist in mammals and plants so as to allow for specific tissues to develop.

The term "plant" includes whole plants, plant parts (e.g., leaves, stems, flowers, roots, etc.), plant protoplasts, seeds and plant cells and progeny of same. The class of plants which can be used in the method of the invention is generally as broad as the class of higher plants amenable to transformation techniques, including angiosperms (monocotyledonous and dicotyledonous plants), as well as gymnosperms. It includes plants of a variety of ploidy levels, including polyploid, diploid, haploid and hemizygous states. As used herein, the term "transgenic plant" includes plants or plant cells into which a heterologous nucleic acid sequence has been inserted, e.g., the nucleic acids and various recombinant constructs (e.g., expression cassettes) of the invention.

In one aspect, a constitutive promoter such as the CaMV 35S promoter can be used for expression in specific parts of the plant or seed or throughout the plant. For example, for overexpression, a plant promoter fragment can be employed which will direct expression of a nucleic acid in some or all tissues of a plant, e.g., a regenerated plant. Such promoters are referred to herein as "constitutive" promoters and are active under most environmental conditions and states of development or cell differentiation. Examples of constitutive promoters include the cauliflower mosaic virus (CaMV) 35S transcription initiation region, the 1'- or 2'-promoter derived from T-DNA of *Agrobacterium tumefaciens*, and other transcription initiation regions from various plant genes known to those of skill. Such genes include, e.g., ACT11 from *Arabidopsis* (Huang (1996) *Plant Mol. Biol.* 33:125-139); Cat3 from *Arabidopsis* (GenBank No. U43147, Zhong (1996) *Mol. Gen. Genet.* 251:196-203); the gene encoding stearoyl-acyl carrier protein desaturase from *Brassica napus* (Genbank No. X74782, Solocombe (1994) *Plant Physiol.* 104: 1167-1176); GPc1 from maize (GenBank No. X15596; Martinez (1989) *J. Mol. Biol.* 208:551-565); the Gpc2 from maize (GenBank No. U45855, Manjunath (1997) *Plant Mol. Biol.* 33:97-112); plant promoters described in U.S. Pat. Nos. 4,962,028; 5,633,440.

The invention uses tissue-specific or constitutive promoters derived from viruses which can include, e.g., the tobamovirus subgenomic promoter (Kumagai (1995) Proc. Natl. Acad. Sci. USA 92:1679-1683; the rice tungro baciliform virus (RTBV), which replicates only in phloem cells in infected rice plants, with its promoter which drives strong phloem-specific reporter gene expression; the cassaya vein mosaic virus (CVMV) promoter, with highest activity in vascular elements, in leaf mesophyll cells, and in root tips (Verdaguer (1996) Plant Mol. Biol. 31:1129-1139).

Alternatively, the plant promoter may direct expression of a polypeptide, enzyme, protein, e.g. structural or binding protein-expressing nucleic acid in a specific tissue, organ or cell type (i.e. tissue-specific promoters) or may be otherwise under more precise environmental or developmental control or under the control of an inducible promoter. Examples of environmental conditions that may affect transcription include anaerobic conditions, elevated temperature, the presence of light, or sprayed with chemicals/hormones. For example, the invention incorporates the drought-inducible promoter of maize (Busk (1997) supra); the cold, drought, and high salt inducible promoter from potato (Kirch (1997) Plant Mol. Biol. 33:897-909).

Tissue-specific promoters can promote transcription only within a certain time frame of developmental stage within that tissue. See, e.g., Blazquez (1998) Plant Cell 10:791-800, characterizing the *Arabidopsis* LEAFY gene promoter. See also Cardon (1997) *Plant J* 12:367-77, describing the transcription factor SPL3, which recognizes a conserved sequence motif in the promoter region of the *A. thaliana* floral meristem identity gene AP1; and Mandel (1995) Plant Molecular Biology, Vol. 29, pp 995-1004, describing the meristem promoter eIF4. Tissue specific promoters which are active throughout the life cycle of a particular tissue can be used. In one aspect, the nucleic acids of the invention are operably linked to a promoter active primarily only in cotton fiber cells. In one aspect, the nucleic acids of the invention are operably linked to a promoter active primarily during the stages of cotton fiber cell elongation, e.g., as described by Rinehart (1996) supra. The nucleic acids can be operably linked to the Fbl2A gene promoter to be preferentially expressed in cotton fiber cells (Ibid). See also, John (1997) Proc. Natl. Acad. Sci. USA 89:5769-5773; John, et al., U.S. Pat. Nos. 5,608,148 and 5,602,321, describing cotton fiber-specific promoters and methods for the construction of transgenic cotton plants. Root-specific promoters may also be used to express the nucleic acids of the invention. Examples of root-specific promoters include the promoter from the alcohol dehydrogenase gene (DeLisle (1990) Int. Rev. Cytol. 123:39-60). Other promoters that can be used to express the nucleic acids of the invention include, e.g., ovule-specific, embryo-specific, endosperm-specific, integument-specific, seed coat-specific promoters, or some combination thereof; a leaf-specific promoter (see, e.g., Busk (1997) Plant J. 11:1285 1295, describing a leaf-specific promoter in maize); the ORF13 promoter from *Agrobacterium rhizogenes* (which exhibits high activity in roots, see, e.g., Hansen (1997) supra); a maize pollen specific promoter (see, e.g., Guerrero (1990) Mol. Gen. Genet. 224:161 168); a tomato promoter active during fruit ripening, senescence and abscission of leaves and, to a lesser extent, of flowers can be used (see, e.g., Blume (1997) Plant J. 12:731 746); a pistil-specific promoter from the potato SK2 gene (see, e.g., Ficker (1997) Plant Mol. Biol. 35:425 431); the Blec4 gene from pea, which is active in epidermal tissue of vegetative and floral shoot apices of transgenic alfalfa making it a useful tool to target the expression of foreign genes to the epidermal layer of actively growing shoots or fibers; the ovule-specific BEL1 gene (see, e.g., Reiser (1995) Cell 83:735-742, GenBank No. U39944); and/or, the promoter in Klee, U.S. Pat. No. 5,589,583, describing a plant promoter region is capable of conferring high levels of transcription in meristematic tissue and/or rapidly dividing cells.

Alternatively, plant promoters which are inducible upon exposure to plant hormones, such as auxins, are used to express the nucleic acids of the invention. For example, the invention can use the auxin-response elements E1 promoter fragment (AuxREs) in the soybean (*Glycine max* L.) (Liu (1997) Plant Physiol. 115:397-407); the auxin-responsive *Arabidopsis* GST6 promoter (also responsive to salicylic acid and hydrogen peroxide) (Chen (1996) Plant J. 10: 955-966); the auxin-inducible parC promoter from tobacco (Sakai (1996) 37:906-913); a plant biotin response element (Streit (1997) Mol. Plant. Microbe Interact. 10:933-937); and, the promoter responsive to the stress hormone abscisic acid (Sheen (1996) Science 274:1900-1902).

The nucleic acids of the invention can also be operably linked to plant promoters which are inducible upon exposure to chemicals reagents which can be applied to the plant, such as herbicides or antibiotics. For example, the maize In2-2 promoter, activated by benzenesulfonamide herbicide safeners, can be used (De Veylder (1997) Plant Cell Physiol. 38:568-577); application of different herbicide safeners induces distinct gene expression patterns, including expression in the root, hydathodes, and the shoot apical meristem. Coding sequence can be under the control of, e.g., a tetracycline-inducible promoter, e.g., as described with transgenic tobacco plants containing the *Avena sativa* L. (oat) arginine decarboxylase gene (Masgrau (1997) Plant J. 11:465-473); or, a salicylic acid-responsive element (Stange (1997) Plant J. 11:1315-1324). Using chemically- (e.g., hormone- or pesticide-) induced promoters, i.e., promoter responsive to a chemical which can be applied to the transgenic plant in the field, expression of a polypeptide of the invention can be induced at a particular stage of development of the plant. Thus, the invention also provides for transgenic plants containing an inducible gene encoding for polypeptides of the invention whose host range is limited to target plant species, such as corn, rice, barley, wheat, potato or other crops, inducible at any stage of development of the crop.

One of skill will recognize that a tissue-specific plant promoter may drive expression of operably linked sequences in tissues other than the target tissue. Thus, a tissue-specific promoter is one that drives expression preferentially in the target tissue or cell type, but may also lead to some expression in other tissues as well.

The nucleic acids of the invention can also be operably linked to plant promoters which are inducible upon exposure to chemicals reagents. These reagents include, e.g., herbicides, synthetic auxins, or antibiotics which can be applied, e.g., sprayed, onto transgenic plants. Inducible expression of the polypeptide, enzyme, protein, e.g. structural or binding protein-producing nucleic acids of the invention will allow the grower to select plants with the optimal polypeptide, enzyme, protein, e.g. structural or binding protein, expression and/or activity. The development of plant parts can thus controlled. In this way the invention provides the means to facilitate the harvesting of plants and plant parts. For example, in various embodiments, the maize In2-2 promoter, activated by benzenesulfonamide herbicide safeners, is used (De Veylder (1997) Plant Cell Physiol. 38:568-577); application of different herbicide safeners induces distinct gene expression patterns, including expression in the root, hydathodes, and the shoot apical meristem. Coding sequences of the invention are also under the control of a tetracycline-inducible promoter, e.g., as described with transgenic tobacco plants containing the *Avena sativa* L. (oat) arginine decarboxylase gene (Masgrau (1997) Plant J. 11:465-473); or, a salicylic acid-responsive element (Stange (1997) Plant J. 11:1315-1324).

In some aspects, proper polypeptide expression may require polyadenylation region at the 3'-end of the coding region. The polyadenylation region can be derived from the natural gene, from a variety of other plant (or animal or other) genes, or from genes in the Agrobacterial T-DNA.

Expression Vectors and Cloning Vehicles

The invention provides expression vectors and cloning vehicles comprising nucleic acids of the invention, e.g., sequences encoding the polypeptide, enzyme, protein, e.g. structural or binding proteins of the invention. Expression vectors and cloning vehicles of the invention can comprise viral particles, baculovirus, phage, plasmids, phagemids, cosmids, fosmids, bacterial artificial chromosomes, viral DNA (e.g., vaccinia, adenovirus, foul pox virus, pseudorabies and derivatives of SV40), P1-based artificial chromosomes, yeast plasmids, yeast artificial chromosomes, and any other vectors specific for specific hosts of interest (such as bacillus, *Aspergillus* and yeast). Vectors of the invention can include chromosomal, non-chromosomal and synthetic DNA sequences. Large numbers of suitable vectors are known to those of skill in the art, and are commercially available. Exemplary vectors are include: bacterial: pQE vectors (Qiagen), pBLUESCRIPT plasmids, pNH vectors, (lambda-ZAP vectors (Stratagene); ptrc99a, pKK223-3, pDR540, pRIT2T (Pharmacia); Eukaryotic: pXT1, pSG5 (Stratagene), pSVK3, pBPV, pMSG, pSVLSV40 (Pharmacia). However, any other plasmid or other vector may be used so long as they are replicable and viable in the host. Low copy number or high copy number vectors may be employed with the present invention.

The expression vector can comprise a promoter, a ribosome binding site for translation initiation and a transcription terminator. The vector may also include appropriate sequences for amplifying expression. Mammalian expression vectors can comprise an origin of replication, any necessary ribosome binding sites, a polyadenylation site, splice donor and acceptor sites, transcriptional termination sequences, and 5' flanking non-transcribed sequences. In some aspects, DNA sequences derived from the SV40 splice and polyadenylation sites may be used to provide the required non-transcribed genetic elements.

In one aspect, the expression vectors contain one or more selectable marker genes to permit selection of host cells containing the vector. Such selectable markers include genes encoding dihydrofolate reductase or genes conferring neomycin resistance for eukaryotic cell culture, genes conferring tetracycline or ampicillin resistance in *E. coli*, and the *S. cerevisiae* TRP1 gene. Promoter regions can be selected from any desired gene using chloramphenicol transferase (CAT) vectors or other vectors with selectable markers.

Vectors for expressing the polypeptide or fragment thereof in eukaryotic cells can also contain enhancers to increase expression levels. Enhancers are cis-acting elements of DNA that can be from about 10 to about 300 bp in length. They can act on a promoter to increase its transcription. Exemplary enhancers include the SV40 enhancer on the late side of the replication origin bp 100 to 270, the cytomegalovirus early promoter enhancer, the polyoma enhancer on the late side of the replication origin, and the adenovirus enhancers.

A nucleic acid sequence can be inserted into a vector by a variety of procedures. In general, the sequence is ligated to the desired position in the vector following digestion of the insert and the vector with appropriate restriction endonucleases. Alternatively, blunt ends in both the insert and the vector may be ligated. A variety of cloning techniques are known in the art, e.g., as described in Ausubel and Sambrook. Such procedures and others are deemed to be within the scope of those skilled in the art.

The vector can be in the form of a plasmid, a viral particle, or a phage. Other vectors include chromosomal, non-chromosomal and synthetic DNA sequences, derivatives of SV40; bacterial plasmids, phage DNA, baculovirus, yeast plasmids, vectors derived from combinations of plasmids and phage DNA, viral DNA such as vaccinia, adenovirus, fowl pox virus, and pseudorabies. A variety of cloning and expression vectors for use with prokaryotic and eukaryotic hosts are described by, e.g., Sambrook.

Particular bacterial vectors which can be used include the commercially available plasmids comprising genetic elements of the well known cloning vector pBR322 (ATCC 37017), pKK223-3 (Pharmacia Fine Chemicals, Uppsala, Sweden), GEM1 (Promega Biotec, Madison, Wis., USA) pQE70, pQE60, pQE-9 (Qiagen), pD10, psiX174 pBLUE-SCRIPT II KS, pNH8A, pNH16a, pNH18A, pNH46A (Stratagene), ptrc99a, pKK223-3, pKK233-3, DR540, pRIT5 (Pharmacia), pKK232-8 and pCM7. Particular eukaryotic vectors include pSV2CAT, pOG44, pXT1, pSG (Stratagene) pSVK3, pBPV, pMSG, and pSVL (Pharmacia). However, any other vector may be used as long as it is replicable and viable in the host cell.

The nucleic acids of the invention can be expressed in expression cassettes, vectors or viruses and transiently or stably expressed in plant cells and seeds. One exemplary transient expression system uses episomal expression systems, e.g., cauliflower mosaic virus (CaMV) viral RNA generated in the nucleus by transcription of an episomal minichromosome containing supercoiled DNA, see, e.g., Covey (1990) Proc. Natl. Acad. Sci. USA 87:1633-1637. Alternatively, coding sequences, i.e., all or sub-fragments of sequences of the invention can be inserted into a plant host cell genome becoming an integral part of the host chromosomal DNA. Sense or antisense transcripts can be expressed in this manner. A vector comprising the sequences (e.g., promoters or coding regions) from nucleic acids of the invention can comprise a marker gene that confers a selectable phenotype on a plant cell or a seed. For example, the marker may encode biocide resistance, particularly antibiotic resistance, such as resistance to kanamycin, G418, bleomycin, hygromycin, or herbicide resistance, such as resistance to chlorosulfuron or Basta.

Expression vectors capable of expressing nucleic acids and proteins in plants are well known in the art, and can include, e.g., vectors from *Agrobacterium* spp., potato virus X (see, e.g., Angell (1997) EMBO J. 16:3675-3684), tobacco mosaic virus (see, e.g., Casper (1996) Gene 173:69-73), tomato bushy stunt virus (see, e.g., Hillman (1989) Virology 169:42-50), tobacco etch virus (see, e.g., Dolja (1997) Virology 234:243-252), bean golden mosaic virus (see, e.g., Morinaga (1993) Microbiol Immunol. 37:471-476), cauliflower mosaic virus (see, e.g., Cecchini (1997) Mol. Plant. Microbe Interact. 10: 1094-1101), maize Ac/Ds transposable element (see, e.g., Rubin (1997) Mol. Cell. Biol. 17:6294-6302; Kunze (1996) Curr. Top. Microbiol. Immunol. 204:161-194), and the maize suppressor-mutator (Spm) transposable element (see, e.g., Schlappi (1996) Plant Mol. Biol. 32:717-725); and derivatives thereof.

In one aspect, the expression vector can have two replication systems to allow it to be maintained in two organisms, for example in mammalian or insect cells for expression and in a prokaryotic host for cloning and amplification. Furthermore, for integrating expression vectors, the expression vector can contain at least one sequence homologous to the host cell genome. It can contain two homologous sequences which flank the expression construct. The integrating vector can be directed to a specific locus in the host cell by selecting the appropriate homologous sequence for inclusion in the vector. Constructs for integrating vectors are well known in the art.

Expression vectors of the invention may also include a selectable marker gene to allow for the selection of bacterial strains that have been transformed, e.g., genes which render the bacteria resistant to drugs such as ampicillin, chloramphenicol, erythromycin, kanamycin, neomycin and tetracycline. Selectable markers can also include biosynthetic genes, such as those in the histidine, tryptophan and leucine biosynthetic pathways.

The DNA sequence in the expression vector is operatively linked to an appropriate expression control sequence(s) (promoter) to direct RNA synthesis. Particular named bacterial promoters include lacI, lacZ, T3, T7, gpt, lambda $P_R$, $P_L$ and trp. Eukaryotic promoters include CMV immediate early, HSV thymidine kinase, early and late SV40, LTRs from retrovirus and mouse metallothionein-I. Selection of the appropriate vector and promoter is well within the level of ordinary skill in the art. The expression vector also contains a ribosome binding site for translation initiation and a transcription terminator. The vector may also include appropriate sequences for amplifying expression. Promoter regions can be selected from any desired gene using chloramphenicol transferase (CAT) vectors or other vectors with selectable markers. In addition, the expression vectors in one aspect contain one or more selectable marker genes to provide a phenotypic trait for selection of transformed host cells such as dihydrofolate reductase or neomycin resistance for eukaryotic cell culture, or such as tetracycline or ampicillin resistance in *E. coli*.

Mammalian expression vectors may also comprise an origin of replication, any necessary ribosome binding sites, a polyadenylation site, splice donor and acceptor sites, transcriptional termination sequences and 5' flanking nontranscribed sequences. In some aspects, DNA sequences derived from the SV40 splice and polyadenylation sites may be used to provide the required nontranscribed genetic elements.

Vectors for expressing the polypeptide or fragment thereof in eukaryotic cells may also contain enhancers to increase expression levels. Enhancers are cis-acting elements of DNA, usually from about 10 to about 300 bp in length that act on a promoter to increase its transcription. Examples include the SV40 enhancer on the late side of the replication origin bp 100 to 270, the cytomegalovirus early promoter enhancer, the polyoma enhancer on the late side of the replication origin and the adenovirus enhancers.

In addition, the expression vectors typically contain one or more selectable marker genes to permit selection of host cells containing the vector. Such selectable markers include genes encoding dihydrofolate reductase or genes conferring neomycin resistance for eukaryotic cell culture, genes conferring tetracycline or ampicillin resistance in *E. coli* and the *S. cerevisiae* TRP1 gene.

In some aspects, the nucleic acid encoding one of the polypeptides of the invention, or fragments comprising at least about 5, 10, 15, 20, 25, 30, 35, 40, 50, 75, 100, or 150 consecutive amino acids thereof is assembled in appropriate phase with a leader sequence capable of directing secretion of the translated polypeptide or fragment thereof. Optionally, the nucleic acid can encode a fusion polypeptide in which one of the polypeptides of the invention, or fragments comprising at least 5, 10, 15, 20, 25, 30, 35, 40, 50, 75, 100, or 150 consecutive amino acids thereof is fused to heterologous peptides or polypeptides, such as N-terminal identification peptides which impart desired characteristics, such as increased stability or simplified purification.

The appropriate DNA sequence may be inserted into the vector by a variety of procedures. In general, the DNA sequence is ligated to the desired position in the vector following digestion of the insert and the vector with appropriate restriction endonucleases. Alternatively, blunt ends in both the insert and the vector may be ligated. A variety of cloning techniques are disclosed in Ausubel et al. Current Protocols in Molecular Biology, John Wiley 503 Sons, Inc. 1997 and Sambrook et al., Molecular Cloning: A Laboratory Manual 2nd Ed., Cold Spring Harbor Laboratory Press (1989. Such procedures and others are deemed to be within the scope of those skilled in the art.

The vector may be, for example, in the form of a plasmid, a viral particle, or a phage. Other vectors include chromosomal, nonchromosomal and synthetic DNA sequences, derivatives of SV40; bacterial plasmids, phage DNA, baculovirus, yeast plasmids, vectors derived from combinations of plasmids and phage DNA, viral DNA such as vaccinia, adenovirus, fowl pox virus and pseudorabies. A variety of cloning and expression vectors for use with prokaryotic and eukaryotic hosts are described by Sambrook, et al., Molecular Cloning: A Laboratory Manual, 2nd Ed., Cold Spring Harbor, N.Y., (1989).

Host Cells and Transformed Cells

The invention also provides a transformed cell comprising a nucleic acid sequence of the invention, e.g., a sequence encoding a polypeptide, enzyme, protein, e.g. structural or binding protein, of the invention, or a vector of the invention. The host cell may be any of the host cells familiar to those skilled in the art, including prokaryotic cells, eukaryotic cells, such as bacterial cells, fungal cells, yeast cells, mammalian cells, insect cells, or plant cells. Exemplary bacterial cells include *E. coli, Streptomyces, Bacillus subtilis, Bacillus cereus, Salmonella typhimurium* and various species within the genera *Streptomyces* and *Staphylococcus*. Exemplary insect cells include *Drosophila* S2 and *Spodoptera* Sf9. Exemplary animal cells include CHO, COS or Bowes melanoma or any mouse or human cell line. The selection of an appropriate host is within the abilities of those skilled in the art. Techniques for transforming a wide variety of higher plant species are well known and described in the technical and scientific literature. See, e.g., Weising (1988) Ann. Rev. Genet. 22:421-477; U.S. Pat. No. 5,750,870.

The vector can be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis, L., Dibner, M., Battey, I., Basic Methods in Molecular Biology, (1986)).

In one aspect, the nucleic acids or vectors of the invention are introduced into the cells for screening, thus, the nucleic acids enter the cells in a manner suitable for subsequent expression of the nucleic acid. The method of introduction is largely dictated by the targeted cell type. Exemplary methods include $CaPO_4$ precipitation, liposome fusion, lipofection (e.g., LIPOFECTIN™), electroporation, viral infection, etc. The candidate nucleic acids may stably integrate into the genome of the host cell (for example, with retroviral introduction) or may exist either transiently or stably in the cytoplasm (i.e. through the use of traditional plasmids, utilizing standard regulatory sequences, selection markers, etc.). As many pharmaceutically important screens require human or model mammalian cell targets, retroviral vectors capable of transfecting such targets can be used.

Where appropriate, the engineered host cells can be cultured in conventional nutrient media modified as appropriate for activating promoters, selecting transformants or amplifying the genes of the invention. Following transformation of a suitable host strain and growth of the host strain to an appropriate cell density, the selected promoter may be induced by appropriate means (e.g., temperature shift or chemical induction) and the cells may be cultured for an additional period to allow them to produce the desired polypeptide or fragment thereof.

Cells can be harvested by centrifugation, disrupted by physical or chemical means, and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

The constructs in host cells can be used in a conventional manner to produce the gene product encoded by the recombinant sequence. Depending upon the host employed in a recombinant production procedure, the polypeptides produced by host cells containing the vector may be glycosylated or may be non-glycosylated. Polypeptides of the invention may or may not also include an initial methionine amino acid residue.

Cell-free translation systems can also be employed to produce a polypeptide of the invention. Cell-free translation systems can use mRNAs transcribed from a DNA construct comprising a promoter operably linked to a nucleic acid encoding the polypeptide or fragment thereof. In some aspects, the DNA construct may be linearized prior to conducting an in vitro transcription reaction. The transcribed mRNA is then incubated with an appropriate cell-free translation extract, such as a rabbit reticulocyte extract, to produce the desired polypeptide or fragment thereof.

The expression vectors can contain one or more selectable marker genes to provide a phenotypic trait for selection of transformed host cells such as dihydrofolate reductase or neomycin resistance for eukaryotic cell culture, or such as tetracycline or ampicillin resistance in E. coli.

Host cells containing the polynucleotides of interest, e.g., nucleic acids of the invention, can be cultured in conventional nutrient media modified as appropriate for activating promoters, selecting transformants or amplifying genes. The culture conditions, such as temperature, pH and the like, are those previously used with the host cell selected for expression and will be apparent to the ordinarily skilled artisan. The clones which are identified as having the specified enzyme activity may then be sequenced to identify the polynucleotide sequence encoding an enzyme having the enhanced activity.

The invention provides a method for overexpressing a recombinant polypeptide, enzyme, protein, e.g. structural or binding protein, in a cell comprising expressing a vector comprising a nucleic acid of the invention, e.g., a nucleic acid comprising a nucleic acid sequence with at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to an exemplary sequence of the invention over a region of at least about 100 residues, wherein the sequence identities are determined by analysis with a sequence comparison algorithm or by visual inspection, or, a nucleic acid that hybridizes under stringent conditions to a nucleic acid sequence of the invention. The overexpression can be effected by any means, e.g., use of a high activity promoter, a dicistronic vector or by gene amplification of the vector.

The nucleic acids of the invention can be expressed, or overexpressed, in any in vitro or in vivo expression system. Any cell culture systems can be employed to express, or over-express, recombinant protein, including bacterial, insect, yeast, fungal or mammalian cultures. Over-expression can be effected by appropriate choice of promoters, enhancers, vectors (e.g., use of replicon vectors, dicistronic vectors (see, e.g., Gurtu (1996) Biochem. Biophys. Res. Commun. 229:295-8), media, culture systems and the like. In one aspect, gene amplification using selection markers, e.g., glutamine synthetase (see, e.g., Sanders (1987) Dev. Biol. Stand. 66:55-63), in cell systems are used to overexpress the polypeptides of the invention.

The host cell may be any of the host cells familiar to those skilled in the art, including prokaryotic cells, eukaryotic cells, mammalian cells, insect cells, or plant cells. As representative examples of appropriate hosts, there may be mentioned: bacterial cells, such as E. coli, Streptomyces, Bacillus subtilis, Bacillus cereus, Salmonella typhimurium and various species within the genera Streptomyces and Staphylococcus, fungal cells, such as yeast, insect cells such as Drosophila S2 and Spodoptera Sj9, animal cells such as CHO, COS or Bowes melanoma and adenoviruses. The selection of an appropriate host is within the abilities of those skilled in the art.

The vector may be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis, L., Dibner, M., Battey, I., Basic Methods in Molecular Biology, (1986)).

Where appropriate, the engineered host cells can be cultured in conventional nutrient media modified as appropriate for activating promoters, selecting transformants or amplifying the genes of the invention. Following transformation of a suitable host strain and growth of the host strain to an appropriate cell density, the selected promoter may be induced by appropriate means (e.g., temperature shift or chemical induction) and the cells may be cultured for an additional period to allow them to produce the desired polypeptide or fragment thereof.

Cells are typically harvested by centrifugation, disrupted by physical or chemical means and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

Various mammalian cell culture systems can also be employed to express recombinant protein. Examples of mammalian expression systems include the COS-7 lines of monkey kidney fibroblasts (described by Gluzman, Cell, 23:175, 1981) and other cell lines capable of expressing proteins from a compatible vector, such as the C127, 3T3, CHO, HeLa and BHK cell lines.

The constructs in host cells can be used in a conventional manner to produce the gene product encoded by the recombinant sequence. Depending upon the host employed in a recombinant production procedure, the polypeptides produced by host cells containing the vector may be glycosylated or may be non-glycosylated. Polypeptides of the invention may or may not also include an initial methionine amino acid residue.

Alternatively, the polypeptides of the invention, or fragments comprising at least 5, 10, 15, 20, 25, 30, 35, 40, 50, 75, 100, or 150 or more consecutive amino acids thereof can be synthetically produced by conventional peptide synthesizers. In other aspects, fragments or portions of the polypeptides may be employed for producing the corresponding full-length polypeptide by peptide synthesis; therefore, the fragments may be employed as intermediates for producing the full-length polypeptides.

Cell-free translation systems can also be employed to produce one of the polypeptides of the invention, or fragments comprising at least 5, 10, 15, 20, 25, 30, 35, 40, 50, 75, 100, or 150 or more consecutive amino acids thereof using mRNAs transcribed from a DNA construct comprising a promoter operably linked to a nucleic acid encoding the polypeptide or fragment thereof. In some aspects, the DNA construct may be linearized prior to conducting an in vitro transcription reaction. The transcribed mRNA is then incubated with an appropriate cell-free translation extract, such as a rabbit reticulocyte extract, to produce the desired polypeptide or fragment thereof.

Amplification of Nucleic Acids

In practicing the invention, nucleic acids encoding the polypeptides of the invention, or modified nucleic acids, can be reproduced by, e.g., amplification. The invention provides amplification primer sequence pairs for amplifying nucleic acids encoding polypeptides (e.g., enzymes) of the invention. In one aspect, the primer pairs are capable of amplifying nucleic acid sequences of the invention, e.g., including the exemplary SEQ ID NO:1, SEQ ID NO:3, SEQ ID NO:5, SEQ ID NO:7, SEQ ID NO:9, SEQ ID NO:11, etc., including all nucleic acids disclosed in the SEQ ID listing, which include all odd numbered SEQ ID NOs: from SEQ ID NO:1 through SEQ ID NO:26,897, or a subsequence thereof, etc. One of skill in the art can design amplification primer sequence pairs for any part of or the full length of these sequences.

In one aspect, the invention provides a nucleic acid amplified by a primer pair of the invention, e.g., a primer pair as set forth by about the first (the 5') 12, 13, 14, 15, 16, 17, 18, 19, 20, 21, 22, 23, 24, or 25 or more residues of a nucleic acid of the invention, and about the first (the 5') 15, 16, 17, 18, 19, 20, 21, 22, 23, 24, or 25 or more residues of the complementary strand.

The invention provides an amplification primer sequence pair for amplifying a nucleic acid encoding a polypeptide having an enzyme, structural or binding activity, wherein the primer pair is capable of amplifying a nucleic acid comprising a sequence of the invention, or fragments or subsequences thereof. One or each member of the amplification primer sequence pair can comprise an oligonucleotide comprising at least about 10 to 50 or more consecutive bases of the sequence, or about 12, 13, 14, 15, 16, 17, 18, 19, 20, 21, 22, 23, 24, or 25 or more consecutive bases of the sequence. The invention provides amplification primer pairs, wherein the primer pair comprises a first member having a sequence as set forth by about the first (the 5') 12, 13, 14, 15, 16, 17, 18, 19, 20, 21, 22, 23, 24, or 25 or more residues of a nucleic acid of the invention, and a second member having a sequence as set forth by about the first (the 5') 12, 13, 14, 15, 16, 17, 18, 19, 20, 21, 22, 23, 24, or 25 or more residues of the complementary strand of the first member. The invention provides a polypeptide, enzyme, protein, e.g. structural or binding protein, generated by amplification, e.g., polymerase chain reaction (PCR), using an amplification primer pair of the invention. The invention provides methods of making a polypeptide, enzyme, protein, e.g. structural or binding protein, by amplification, e.g., polymerase chain reaction (PCR), using an amplification primer pair of the invention. In one aspect, the amplification primer pair amplifies a nucleic acid from a library, e.g., a gene library, such as an environmental library.

Amplification reactions can also be used to quantify the amount of nucleic acid in a sample (such as the amount of message in a cell sample), label the nucleic acid (e.g., to apply it to an array or a blot), detect the nucleic acid, or quantify the amount of a specific nucleic acid in a sample. In one aspect of the invention, message isolated from a cell or a cDNA library are amplified.

The skilled artisan can select and design suitable oligonucleotide amplification primers. Amplification methods are also well known in the art, and include, e.g., polymerase chain reaction, PCR (see, e.g., PCR PROTOCOLS, A GUIDE TO METHODS AND APPLICATIONS, ed. Innis, Academic Press, N.Y. (1990) and PCR STRATEGIES (1995), ed. Inis, Academic Press, Inc., N.Y., ligase chain reaction (LCR) (see, e.g., Wu (1989) Genomics 4:560; Landegren (1988) Science 241:1077; Barringer (1990) Gene 89:117); transcription amplification (see, e.g., Kwoh (1989) Proc. Natl. Acad. Sci. USA 86:1173); and, self-sustained sequence replication (see, e.g., Guatelli (1990) Proc. Natl. Acad. Sci. USA 87:1874); Q Beta replicase amplification (see, e.g., Smith (1997) J. Clin. Microbiol. 35:1477-1491), automated Q-beta replicase amplification assay (see, e.g., Burg (1996) Mol. Cell. Probes 10:257-271) and other RNA polymerase mediated techniques (e.g., NASBA, Cangene, Mississauga, Ontario); see also Berger (1987) Methods Enzymol. 152:307-316; Sambrook; Ausubel; U.S. Pat. Nos. 4,683,195 and 4,683,202; Sooknanan (1995) Biotechnology 13:563-564.

Determining the Degree of Sequence Identity

The invention provides nucleic acids comprising sequences having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention (e.g., SEQ ID NO:1, SEQ ID NO:3, SEQ ID NO:5, SEQ ID NO:7, SEQ ID NO:9, SEQ ID NO:11, etc., including all nucleic acids disclosed in the SEQ ID listing, which include all even numbered SEQ ID NOs: from SEQ ID NO:1 through SEQ ID NO:26,897, and nucleic acids encoding SEQ ID NO:2, SEQ ID NO:4, SEQ ID NO:6, SEQ ID NO:8, SEQ ID NO:10, etc., and all polypeptides disclosed in the SEQ ID listing, which include all even numbered SEQ ID NOs: from SEQ ID NO:2 through SEQ ID NO:26,898) over a region of at least about 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550 or more, residues. The invention provides polypeptides comprising sequences having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary polypeptide of the invention. The extent of sequence identity (homology) may be determined using any computer program and associated parameters, including those described herein, such as BLAST 2.2.2. or FASTA version 3.0t78, with the default parameters.

As used herein, the terms "computer," "computer program" and "processor" are used in their broadest general contexts and incorporate all such devices, as described in detail, below.

Nucleic acid sequences of the invention can comprise at least 10, 15, 20, 25, 30, 35, 40, 50, 75, 100, 150, 200, 300, 400, or 500 or more consecutive nucleotides of an exemplary sequence of the invention and sequences substantially identical thereto. Homologous sequences and fragments of nucleic acid sequences of the invention can refer to a sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more sequence identity (homology) to these sequences. Homology (sequence identity) may be determined using any of the computer programs and parameters described herein, including FASTA version 3.0t78 with the default parameters. Homologous sequences also include RNA sequences in which uridines replace the thymines in the nucleic acid sequences of the invention. The homologous sequences may be obtained using any of the procedures described herein or may result from the correction of a sequencing error. It will be appreciated that the nucleic acid sequences of the invention can be represented in the traditional single character format (See the inside back cover of Stryer, Lubert. Biochemistry, 3rd Ed., W. H Freeman & Co., New York.) or in any other format which records the identity of the nucleotides in a sequence.

Various sequence comparison programs identified elsewhere in this patent specification are particularly contemplated for use in this aspect of the invention. Protein and/or nucleic acid sequence homologies may be evaluated using any of the variety of sequence comparison algorithms and programs known in the art. Such algorithms and programs include, but are by no means limited to, TBLASTN, BLASTP, FASTA, TFASTA and CLUSTALW (see, e.g., Pearson and Lipman, Proc. Natl. Acad. Sci. USA 85(8):2444-2448, 1988; Altschul et al., J. Mol. Biol. 215(3):403-410, 1990; Thompson Nucleic Acids Res. 22(2):4673-4680, 1994; Higgins et al., Methods Enzymol. 266:383-402, 1996; Altschul et al., J. Mol. Biol. 215(3):403-410, 1990; Altschul et al., Nature Genetics 3:266-272, 1993).

Homology or identity is often measured using sequence analysis software (e.g., Sequence Analysis Software Package of the Genetics Computer Group, University of Wisconsin Biotechnology Center, 1710 University Avenue, Madison, Wis. 53705). Such software matches similar sequences by assigning degrees of homology to various deletions, substitutions and other modifications. The terms "homology" and "identity" in the context of two or more nucleic acids or polypeptide sequences, refer to two or more sequences or subsequences that are the same or have a specified percentage of amino acid residues or nucleotides that are the same when compared and aligned for maximum correspondence over a comparison window or designated region as measured using any number of sequence comparison algorithms or by manual alignment and visual inspection.

For sequence comparison, typically one sequence acts as a reference sequence, to which test sequences are compared. When using a sequence comparison algorithm, test and reference sequences are entered into a computer, subsequence coordinates are designated, if necessary and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequence for comparison are well-known in the art. Optimal alignment of sequences for comparison can be conducted, e.g., by the local homology algorithm of Smith & Waterman, Adv. Appl. Math. 2:482, 1981, by the homology alignment algorithm of Needleman & Wunsch, J. Mol. Biol. 48:443, 1970, by the search for similarity method of person & Lipman, Proc. Nat'l. Acad. Sci. USA 85:2444, 1988, by computerized implementations of these algorithms (GAP, BESTFIT, FASTA and TFASTA in the Wisconsin Genetics Software Package, Genetics Computer Group, 575 Science Dr., Madison, Wis.), or by manual alignment and visual inspection. Other algorithms for determining homology or identity include, for example, in addition to a BLAST program (Basic Local Alignment Search Tool at the National Center for Biological Information), ALIGN, AMAS (Analysis of Multiply Aligned Sequences), AMPS (Protein Multiple Sequence Alignment), ASSET (Aligned Segment Statistical Evaluation Tool), BANDS, BESTSCOR, BIOSCAN (Biological Sequence Comparative Analysis Node), BLIMPS (BLocks IMProved Searcher), FASTA, Intervals & Points, BMB, CLUSTAL V, CLUSTAL W, CONSENSUS, LCONSENSUS, WCONSENSUS, Smith-Waterman algorithm, DARWIN, Las Vegas algorithm, FNAT (Forced Nucleotide Alignment Tool), Framealign, Framesearch, DYNAMIC, FILTER, FSAP (Fristensky Sequence Analysis Package), GAP (Global Alignment Program), GENAL, GIBBS, GenQuest, ISSC (Sensitive Sequence Comparison), LALIGN (Local Sequence Alignment), LCP (Local Content Program), MACAW (Multiple Alignment Construction & Analysis Workbench), MAP (Multiple Alignment Program), MBLKP, MBLKN, PIMA (Pattern-Induced Multi-sequence Alignment), SAGA (Sequence Alignment by Genetic Algorithm) and WHAT-IF. Such alignment programs can also be used to screen genome databases to identify polynucleotide sequences having substantially identical sequences. A number of genome databases are available, for example, a substantial portion of the human genome is available as part of the Human Genome Sequencing Project (Gibbs, 1995). At least twenty-one other genomes have already been sequenced, including, for example, *M. genitalium* (Fraser et al., 1995), *M. jannaschii* (Bult et al., 1996), *H. influenzae* (Fleischmann et al., 1995), *E. coli* (Blattner et al., 1997) and yeast (*S. cerevisiae*) (Mewes et al., 1997) and *D. melanogaster* (Adams et al., 2000). Significant progress has also been made in sequencing the genomes of model organism, such as mouse, *C. elegans* and *Arabadopsis* sp. Several databases containing genomic information annotated with some functional information are maintained by different organizations and may be accessible via internet.

One example of a useful algorithm is BLAST and BLAST 2.0 algorithms, which are described in Altschul et al., Nuc. Acids Res. 25:3389-3402, 1977 and Altschul et al., J. Mol. Biol. 215:403-410, 1990, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a wordlength (W) of 11, an expectation (E) of 10, M=5, N=−4 and a comparison of both strands. For amino acid sequences, the BLASTP program uses as defaults a wordlength of 3 and expectations (E) of 10 and the BLOSUM62 scoring matrix (see Henikoff & Henikoff, Proc. Natl. Acad. Sci. USA 89:10915, 1989) alignments (B) of 50, expectation (E) of 10, M=5, N=−4 and a comparison of both strands.

The BLAST algorithm also performs a statistical analysis of the similarity between two sequences (see, e.g., Karlin & Altschul, Proc. Natl. Acad. Sci. USA 90:5873, 1993). One measure of similarity provided by BLAST algorithm is the smallest sum probability (P(N)), which provides an indication of the probability by which a match between two nucleotide or amino acid sequences would occur by chance. For example, a nucleic acid is considered similar to a references sequence if the smallest sum probability in a comparison of the test nucleic acid to the reference nucleic acid is less than about 0.2, more in one aspect less than about 0.01 and most in one aspect less than about 0.001.

In one aspect, protein and nucleic acid sequence homologies are evaluated using the Basic Local Alignment Search Tool ("BLAST") In particular, five specific BLAST programs are used to perform the following task:
 (1) BLASTP and BLAST3 compare an amino acid query sequence against a protein sequence database;
 (2) BLASTN compares a nucleotide query sequence against a nucleotide sequence database;
 (3) BLASTX compares the six-frame conceptual translation products of a query nucleotide sequence (both strands) against a protein sequence database;
 (4) TBLASTN compares a query protein sequence against a nucleotide sequence database translated in all six reading frames (both strands); and
 (5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is in one aspect obtained from a protein or nucleic acid sequence database. High-scoring segment pairs are in one aspect identified (i.e., aligned) by means of a scoring matrix, many of which are known in the art. In one aspect, the scoring matrix used is the BLOSUM62 matrix (Gonnet (1992) Science 256:1443-1445; Henikoff and Henikoff (1993) Proteins 17:49-61). Less in one aspect, the PAM or PAM250 matrices may also be used (see, e.g., Schwartz and Dayhoff, eds., 1978, *Matrices for Detecting Distance Relationships: Atlas of Protein Sequence and Structure*, Washington: National Biomedical Research Foundation). BLAST programs are accessible through the U.S. National Library of Medicine.

The parameters used with the above algorithms may be adapted depending on the sequence length and degree of homology studied. In some aspects, the parameters may be the default parameters used by the algorithms in the absence of instructions from the user.

Computer Systems and Computer Program Products

To determine and identify sequence identities, structural homologies, motifs and the like in silico, a nucleic acid or polypeptide sequence of the invention can be stored, recorded, and manipulated on any medium which can be read and accessed by a computer.

Accordingly, the invention provides computers, computer systems, computer readable mediums, computer programs products and the like recorded or stored thereon the nucleic acid and polypeptide sequences of the invention. As used herein, the words "recorded" and "stored" refer to a process for storing information on a computer medium. A skilled artisan can readily adopt any known methods for recording information on a computer readable medium to generate manufactures comprising one or more of the nucleic acid and/or polypeptide sequences of the invention.

The polypeptides of the invention include the polypeptide sequences of the invention, e.g., the exemplary sequences of the invention, and sequences substantially identical thereto, and fragments of any of the preceding sequences. Substantially identical, or homologous, polypeptide sequences refer to a polypeptide sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity (homology) to an exemplary sequence of the invention.

Homology (sequence identity) may be determined using any of the computer programs and parameters described herein. A nucleic acid or polypeptide sequence of the invention can be stored, recorded and manipulated on any medium which can be read and accessed by a computer. As used herein, the words "recorded" and "stored" refer to a process for storing information on a computer medium. A skilled artisan can readily adopt any of the presently known methods for recording information on a computer readable medium to generate manufactures comprising one or more of the nucleic acid sequences of the invention, one or more of the polypeptide sequences of the invention. Another aspect of the invention is a computer readable medium having recorded thereon at least 2, 5, 10, 15, or or more nucleic acid or polypeptide sequences of the invention.

Another aspect of the invention is a computer readable medium having recorded thereon one or more of the nucleic acid sequences of the invention. Another aspect of the invention is a computer readable medium having recorded thereon one or more of the polypeptide sequences of the invention. Another aspect of the invention is a computer readable medium having recorded thereon at least 2, 5, 10, 15, or 20 or more of the nucleic acid or polypeptide sequences as set forth above.

Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other types of other media known to those skilled in the art.

Aspects of the invention include systems (e.g., internet based systems), particularly computer systems which store and manipulate the sequence information described herein. One example of a computer system 100 is illustrated in block diagram form in FIG. 1. As used herein, "a computer system" refers to the hardware components, software components and data storage components used to analyze a nucleotide sequence of a nucleic acid sequence of the invention, or a polypeptide sequence of the invention. The computer system 100 typically includes a processor for processing, accessing and manipulating the sequence data. The processor 105 can be any well-known type of central processing unit, such as, for example, the Pentium III from Intel Corporation, or similar processor from Sun, Motorola, Compaq, AMD or International Business Machines.

Typically the computer system 100 is a general purpose system that comprises the processor 105 and one or more internal data storage components 110 for storing data and one or more data retrieving devices for retrieving the data stored on the data storage components. A skilled artisan can readily appreciate that any one of the currently available computer systems are suitable.

In one particular aspect, the computer system 100 includes a processor 105 connected to a bus which is connected to a main memory 115 (in one aspect implemented as RAM) and one or more internal data storage devices 110, such as a hard drive and/or other computer readable media having data recorded thereon. In some aspects, the computer system 100 further includes one or more data retrieving device 118 for reading the data stored on the internal data storage devices 110.

The data retrieving device 118 may represent, for example, a floppy disk drive, a compact disk drive, a magnetic tape drive, or a modem capable of connection to a remote data storage system (e.g., via internet) etc. In some aspects, the internal data storage device 110 is a removable computer readable medium such as a floppy disk, a compact disk, a magnetic tape, etc. containing control logic and/or data recorded thereon. The computer system 100 may advantageously include or be programmed by appropriate software for reading the control logic and/or the data from the data storage component once inserted in the data retrieving device.

The computer system 100 includes a display 120 which is used to display output to a computer user. It should also be noted that the computer system 100 can be linked to other computer systems 125A-C in a network or wide area network to provide centralized access to the computer system 100.

Software for accessing and processing the nucleotide sequences of a nucleic acid sequence of the invention, or a polypeptide sequence of the invention, (such as search tools, compare tools and modeling tools etc.) may reside in main memory 115 during execution.

In some aspects, the computer system 100 may further comprise a sequence comparison algorithm for comparing a nucleic acid sequence of the invention, or a polypeptide sequence of the invention, stored on a computer readable medium to a reference nucleotide or polypeptide sequence(s) stored on a computer readable medium. A "sequence comparison algorithm" refers to one or more programs which are implemented (locally or remotely) on the computer system 100 to compare a nucleotide sequence with other nucleotide sequences and/or compounds stored within a data storage means. For example, the sequence comparison algorithm may compare the nucleotide sequences of a nucleic acid sequence of the invention, or a polypeptide sequence of the invention, stored on a computer readable medium to reference sequences stored on a computer readable medium to identify homologies or structural motifs.

Figure 2:
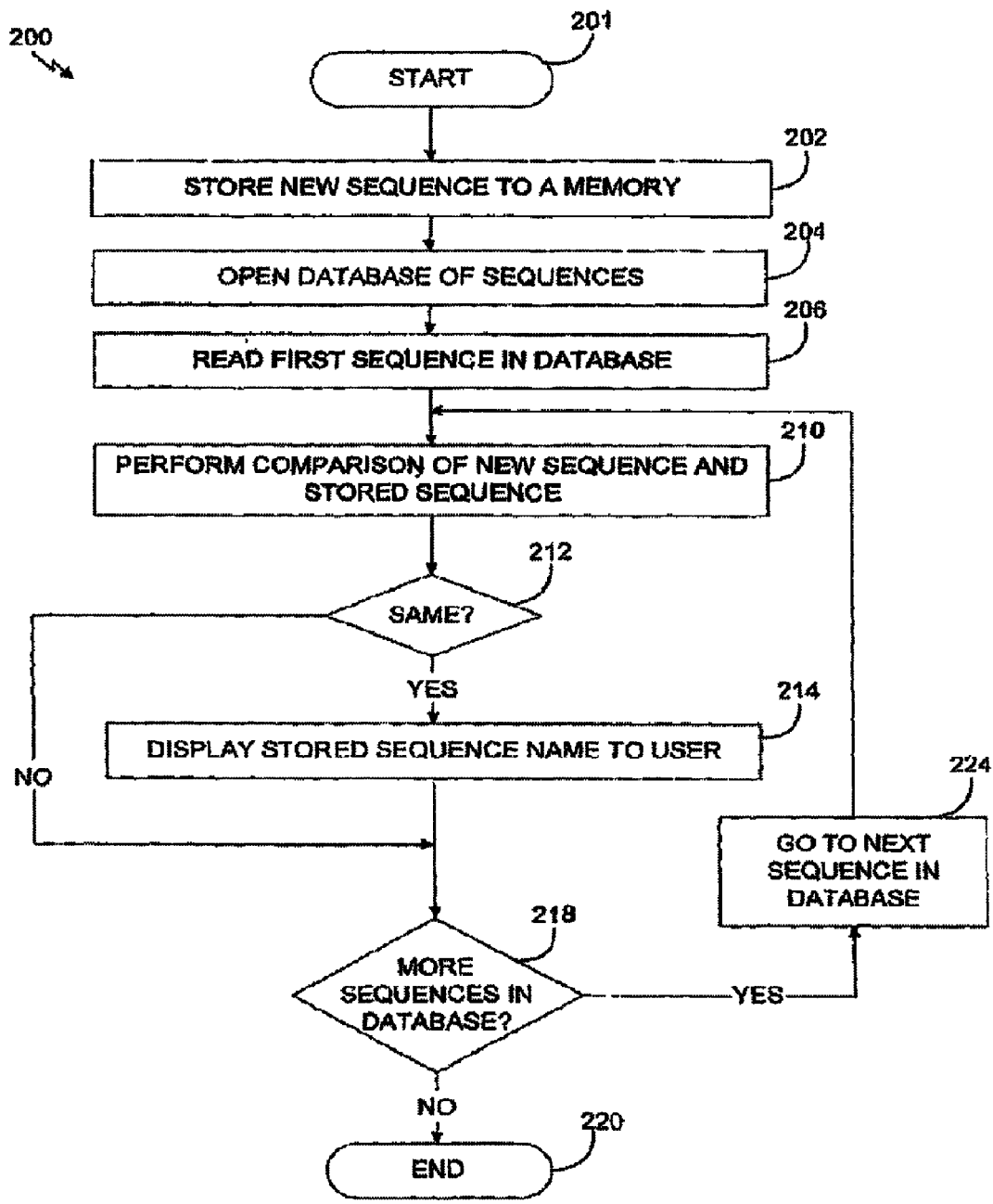
FIG. 2 is a flow diagram illustrating one aspect of a process for comparing a new nucleotide or protein sequence with a database of sequences in order to determine the homology levels between the new sequence and the sequences in the database.

FIG. 2 is a flow diagram illustrating one aspect of a process 200 for comparing a new nucleotide or protein sequence with a database of sequences in order to determine the homology levels between the new sequence and the sequences in the database. The database of sequences can be a private database stored within the computer system 100, or a public database such as GENBANK that is available through the Internet.

The process 200 begins at a start state 201 and then moves to a state 202 wherein the new sequence to be compared is stored to a memory in a computer system 100. As discussed above, the memory could be any type of memory, including RAM or an internal storage device.

The process 200 then moves to a state 204 wherein a database of sequences is opened for analysis and comparison. The process 200 then moves to a state 206 wherein the first sequence stored in the database is read into a memory on the computer. A comparison is then performed at a state 210 to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are introduced into a sequence during comparison are normally entered by the user of the computer system.

Once a comparison of the two sequences has been performed at the state 210, a determination is made at a decision state 210 whether the two sequences are the same. Of course, the term "same" is not limited to sequences that are absolutely identical. Sequences that are within the homology parameters entered by the user will be marked as "same" in the process 200.

If a determination is made that the two sequences are the same, the process 200 moves to a state 214 wherein the name of the sequence from the database is displayed to the user. This state notifies the user that the sequence with the displayed name fulfills the homology constraints that were entered. Once the name of the stored sequence is displayed to the user, the process 200 moves to a decision state 218 wherein a determination is made whether more sequences exist in the database. If no more sequences exist in the database, then the process 200 terminates at an end state 220. However, if more sequences do exist in the database, then the process 200 moves to a state 224 wherein a pointer is moved to the next sequence in the database so that it can be compared to the new sequence. In this manner, the new sequence is aligned and compared with every sequence in the database.

It should be noted that if a determination had been made at the decision state 212 that the sequences were not homologous, then the process 200 would move immediately to the decision state 218 in order to determine if any other sequences were available in the database for comparison.

Accordingly, one aspect of the invention is a computer system comprising a processor, a data storage device having stored thereon a nucleic acid sequence of the invention, or a polypeptide sequence of the invention, a data storage device having retrievably stored thereon reference nucleotide sequences or polypeptide sequences to be compared to a nucleic acid sequence of the invention, or a polypeptide sequence of the invention and a sequence comparer for conducting the comparison. The sequence comparer may indicate a homology level between the sequences compared or identify structural motifs in the above described nucleic acid code a nucleic acid sequence of the invention, or a polypeptide sequence of the invention, or it may identify structural motifs in sequences which are compared to these nucleic acid codes and polypeptide codes. In some aspects, the data storage device may have stored thereon the sequences of at least 2, 5, 10, 15, 20, 25, 30 or 40 or more of the nucleic acid sequences of the invention, or the polypeptide sequences of the invention.

Another aspect of the invention is a method for determining the level of homology between a nucleic acid sequence of the invention, or a polypeptide sequence of the invention and a reference nucleotide sequence. The method including reading the nucleic acid code or the polypeptide code and the reference nucleotide or polypeptide sequence through the use of a computer program which determines homology levels and determining homology between the nucleic acid code or polypeptide code and the reference nucleotide or polypeptide sequence with the computer program. The computer program may be any of a number of computer programs for determining homology levels, including those specifically enumerated herein, (e.g., BLAST2N with the default parameters or with any modified parameters). The method may be implemented using the computer systems described above. The method may also be performed by reading at least 2, 5, 10, 15, 20, 25, 30 or 40 or more of the above described nucleic acid sequences of the invention, or the polypeptide sequences of the invention through use of the computer program and determining homology between the nucleic acid codes or polypeptide codes and reference nucleotide sequences or polypeptide sequences.

Figure 3:
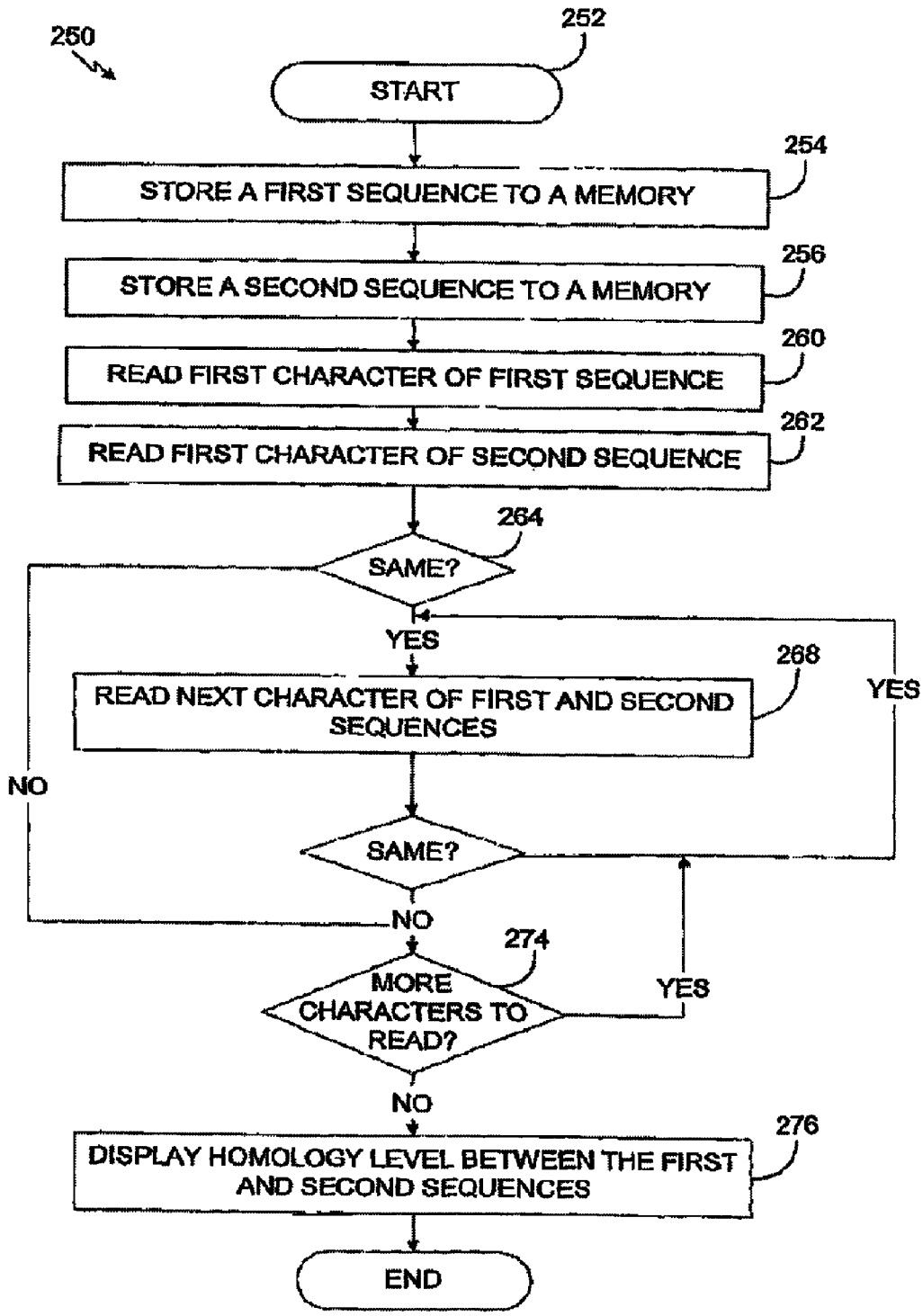
FIG. 3 is a flow diagram illustrating one aspect of a process in a computer for determining whether two sequences are homologous.

FIG. 3 is a flow diagram illustrating one aspect of a process 250 in a computer for determining whether two sequences are homologous. The process 250 begins at a start state 252 and then moves to a state 254 wherein a first sequence to be compared is stored to a memory. The second sequence to be compared is then stored to a memory at a state 256. The process 250 then moves to a state 260 wherein the first character in the first sequence is read and then to a state 262 wherein the first character of the second sequence is read. It should be understood that if the sequence is a nucleotide sequence, then the character would normally be either A, T, C, G or U. If the sequence is a protein sequence, then it is in one aspect in the single letter amino acid code so that the first and sequence sequences can be easily compared.

A determination is then made at a decision state 264 whether the two characters are the same. If they are the same, then the process 250 moves to a state 268 wherein the next characters in the first and second sequences are read. A determination is then made whether the next characters are the same. If they are, then the process 250 continues this loop until two characters are not the same. If a determination is made that the next two characters are not the same, the process 250 moves to a decision state 274 to determine whether there are any more characters either sequence to read.

If there are not any more characters to read, then the process 250 moves to a state 276 wherein the level of homology between the first and second sequences is displayed to the user. The level of homology is determined by calculating the proportion of characters between the sequences that were the same out of the total number of sequences in the first sequence. Thus, if every character in a first 100 nucleotide sequence aligned with a every character in a second sequence, the homology level would be 100%.

Alternatively, the computer program may be a computer program which compares the nucleotide sequences of a nucleic acid sequence as set forth in the invention, to one or more reference nucleotide sequences in order to determine whether the nucleic acid code of the invention, differs from a reference nucleic acid sequence at one or more positions. Optionally such a program records the length and identity of inserted, deleted or substituted nucleotides with respect to the sequence of either the reference polynucleotide or a nucleic acid sequence of the invention. In one aspect, the computer program may be a program which determines whether a nucleic acid sequence of the invention, contains a single nucleotide polymorphism (SNP) with respect to a reference nucleotide sequence.

Accordingly, another aspect of the invention is a method for determining whether a nucleic acid sequence of the invention, differs at one or more nucleotides from a reference nucleotide sequence comprising the steps of reading the nucleic acid code and the reference nucleotide sequence through use of a computer program which identifies differences between nucleic acid sequences and identifying differences between the nucleic acid code and the reference nucleotide sequence with the computer program. In some aspects, the computer program is a program which identifies single nucleotide polymorphisms. The method may be implemented by the computer systems described above and the method illustrated in FIG. 3. The method may also be performed by reading at least 2, 5, 10, 15, 20, 25, 30, or 40 or more of the nucleic acid sequences of the invention and the reference nucleotide sequences through the use of the computer program and identifying differences between the nucleic acid codes and the reference nucleotide sequences with the computer program.

In other aspects the computer based system may further comprise an identifier for identifying features within a nucleic acid sequence of the invention or a polypeptide sequence of the invention.

An "identifier" refers to one or more programs which identifies certain features within a nucleic acid sequence of the invention, or a polypeptide sequence of the invention. In one aspect, the identifier may comprise a program which identifies an open reading frame in a nucleic acid sequence of the invention.

Figure 4:
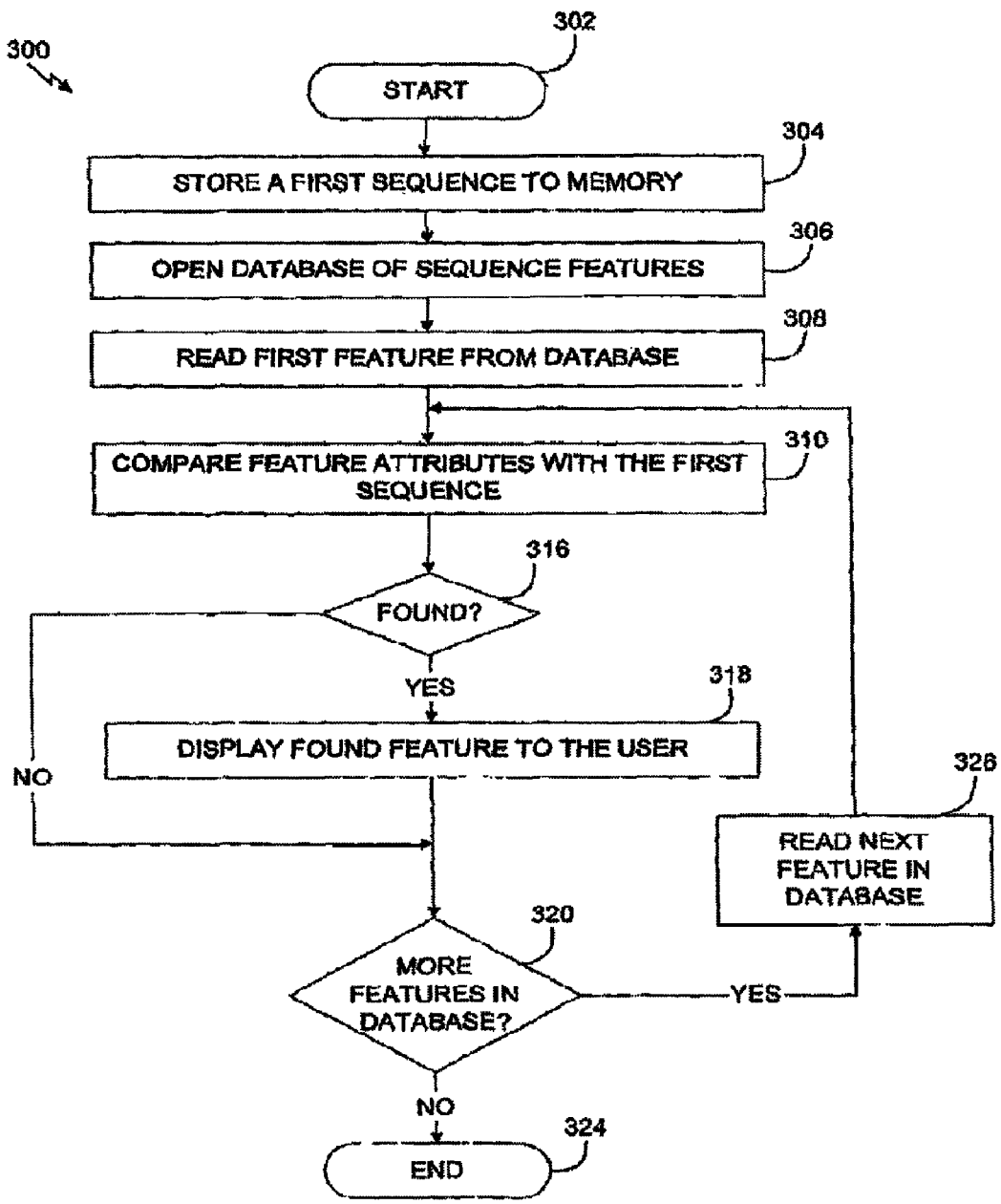
FIG. 4 is a flow diagram illustrating one aspect of an identifier process 300 for detecting the presence of a feature in a sequence.

FIG. 4 is a flow diagram illustrating one aspect of an identifier process 300 for detecting the presence of a feature in a sequence. The process 300 begins at a start state 302 and then moves to a state 304 wherein a first sequence that is to be checked for features is stored to a memory 115 in the computer system 100. The process 300 then moves to a state 306 wherein a database of sequence features is opened. Such a database would include a list of each feature's attributes along with the name of the feature. For example, a feature name could be "Initiation Codon" and the attribute would be "ATG". Another example would be the feature name "TAATAA Box" and the feature attribute would be "TAATAA". An example of such a database is produced by the University of Wisconsin Genetics Computer Group. Alternatively, the features may be structural polypeptide motifs such as alpha helices, beta sheets, or functional polypeptide motifs such as enzymatic active sites, helix-turn-helix motifs or other motifs known to those skilled in the art.

Once the database of features is opened at the state 306, the process 300 moves to a state 308 wherein the first feature is read from the database. A comparison of the attribute of the first feature with the first sequence is then made at a state 310. A determination is then made at a decision state 316 whether the attribute of the feature was found in the first sequence. If the attribute was found, then the process 300 moves to a state 318 wherein the name of the found feature is displayed to the user.

The process 300 then moves to a decision state 320 wherein a determination is made whether move features exist in the database. If no more features do exist, then the process 300 terminates at an end state 324. However, if more features do exist in the database, then the process 300 reads the next sequence feature at a state 326 and loops back to the state 310 wherein the attribute of the next feature is compared against the first sequence. It should be noted, that if the feature attribute is not found in the first sequence at the decision state 316, the process 300 moves directly to the decision state 320 in order to determine if any more features exist in the database.

Accordingly, another aspect of the invention is a method of identifying a feature within a nucleic acid sequence of the invention, or a polypeptide sequence of the invention, comprising reading the nucleic acid code(s) or polypeptide code (s) through the use of a computer program which identifies features therein and identifying features within the nucleic acid code(s) with the computer program. In one aspect, computer program comprises a computer program which identifies open reading frames. The method may be performed by reading a single sequence or at least 2, 5, 10, 15, 20, 25, 30, or 40 of the nucleic acid sequences of the invention, or the polypeptide sequences of the invention, through the use of the computer program and identifying features within the nucleic acid codes or polypeptide codes with the computer program.

A nucleic acid sequence of the invention, or a polypeptide sequence of the invention, may be stored and manipulated in a variety of data processor programs in a variety of formats. For example, a nucleic acid sequence of the invention, or a polypeptide sequence of the invention, may be stored as text in a word processing file, such as Microsoft WORD™ or WORDPERFECT™ or as an ASCII file in a variety of database programs familiar to those of skill in the art, such as DB2™, SYBASE™, or ORACLE™. In addition, many computer programs and databases may be used as sequence comparison algorithms, identifiers, or sources of reference nucleotide sequences or polypeptide sequences to be compared to a nucleic acid sequence of the invention, or a polypeptide sequence of the invention. The following list is intended not to limit the invention but to provide guidance to programs and databases which are useful with the nucleic acid sequences of the invention, or the polypeptide sequences of the invention.

The programs and databases which may be used include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCBI), BLASTN and BLASTX (Altschul et al, J. Mol. Biol. 215: 403, 1990), FASTA (Pearson and Lipman, Proc. Natl. Acad. Sci. USA, 85: 2444, 1988), FASTDB (Brutlag et al. Comp. App. Biosci. 6:237-245, 1990), Catalyst (Molecular Simulations Inc.), Catalyst/SHAPE (Molecular Simulations Inc.), Cerius$^2$.DBAccess (Molecular Simulations Inc.), HypoGen (Molecular Simulations Inc.), Insight II, (Molecular Simulations Inc.), Discover (Molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the MDL Available Chemicals Directory database, the MDL Drug Data Report data base, the Comprehensive Medicinal Chemistry database, Derwents's World Drug Index database, the BioByteMasterFile database, the Genbank database and the Genseqn database. Many other programs and data bases would be apparent to one of skill in the art given the present disclosure.

Motifs which may be detected using the above programs include sequences encoding leucine zippers, helix-turn-helix motifs, glycosylation sites, ubiquitination sites, alpha helices and beta sheets, signal sequences encoding signal peptides which direct the secretion of the encoded proteins, sequences implicated in transcription regulation such as homeoboxes, acidic stretches, enzymatic active sites, substrate binding sites and enzymatic cleavage sites.

Hybridization of Nucleic Acids

The invention provides isolated or recombinant nucleic acids that hybridize under stringent conditions to an exemplary sequence of the invention (e.g., SEQ ID NO:3, SEQ ID NO:5, SEQ ID NO:7, SEQ ID NO:9). The stringent conditions can be highly stringent conditions, medium stringent conditions and/or low stringent conditions, including the high and reduced stringency conditions described herein. In one aspect, it is the stringency of the wash conditions that set forth the conditions which determine whether a nucleic acid is within the scope of the invention, as discussed below.

"Hybridization" refers to the process by which a nucleic acid strand joins with a complementary strand through base pairing. Hybridization reactions can be sensitive and selective so that a particular sequence of interest can be identified even in samples in which it is present at low concentrations. Suitably stringent conditions can be defined by, for example, the concentrations of salt or formamide in the prehybridization and hybridization solutions, or by the hybridization temperature and are well known in the art. In particular, stringency can be increased by reducing the concentration of salt, increasing the concentration of formamide, or raising the hybridization temperature. In alternative aspects, nucleic acids of the invention are defined by their ability to hybridize under various stringency conditions (e.g., high, medium, and low), as set forth herein.

For example, hybridization under high stringency conditions could occur in about 50% formamide at about 37° C. to 42° C. Hybridization could occur under reduced stringency conditions in about 35% to 25% formamide at about 30° C. to 35° C. In one aspect, hybridization occurs under high stringency conditions, e.g., at 42° C. in 50% formamide, 5×SSPE, 0.3% SDS and 200 n/ml sheared and denatured salmon sperm DNA. Hybridization could occur under these reduced stringency conditions, but in 35% formamide at a reduced temperature of 35° C. The temperature range corresponding to a particular level of stringency can be further narrowed by calculating the purine to pyrimidine ratio of the nucleic acid of interest and adjusting the temperature accordingly. Variations on the above ranges and conditions are well known in the art.

In alternative aspects, nucleic acids of the invention as defined by their ability to hybridize under stringent conditions can be between about five residues and the full length of nucleic acid of the invention; e.g., they can be at least 5, 10, 15, 20, 25, 30, 35, 40, 50, 55, 60, 65, 70, 75, 80, 90, 100, 150, 200, 250, 300, 350, 400, 450, 500, 550, 600, 650, 700, 750, 800, 850, 900, 950, 1000, or more, residues in length. Nucleic acids shorter than full length are also included. These nucleic acids can be useful as, e.g., hybridization probes, labeling probes, PCR oligonucleotide probes, iRNA (single or double stranded), antisense or sequences encoding antibody binding peptides (epitopes), motifs, active sites and the like.

In one aspect, nucleic acids of the invention are defined by their ability to hybridize under high stringency comprises conditions of about 50% formamide at about 37° C. to 42° C. In one aspect, nucleic acids of the invention are defined by their ability to hybridize under reduced stringency comprising conditions in about 35% to 25% formamide at about 30° C. to 35° C.

Alternatively, nucleic acids of the invention are defined by their ability to hybridize under high stringency comprising conditions at 42° C. in 50% formamide, 5×SSPE, 0.3% SDS, and a repetitive sequence blocking nucleic acid, such as cot-1 or salmon sperm DNA (e.g., 200 n/ml sheared and denatured salmon sperm DNA). In one aspect, nucleic acids of the invention are defined by their ability to hybridize under reduced stringency conditions comprising 35% formamide at a reduced temperature of 35° C.

In nucleic acid hybridization reactions, the conditions used to achieve a particular level of stringency will vary, depending on the nature of the nucleic acids being hybridized. For example, the length, degree of complementarity, nucleotide sequence composition (e.g., GC v. AT content) and nucleic acid type (e.g., RNA v. DNA) of the hybridizing regions of the nucleic acids can be considered in selecting hybridization conditions. An additional consideration is whether one of the nucleic acids is immobilized, for example, on a filter.

Hybridization may be carried out under conditions of low stringency, moderate stringency or high stringency. As an example of nucleic acid hybridization, a polymer membrane containing immobilized denatured nucleic acids is first prehybridized for 30 minutes at 45° C. in a solution consisting of 0.9 M NaCl, 50 mM $NaH_2PO_4$, pH 7.0, 5.0 mM $Na_2EDTA$, 0.5% SDS, 10×Denhardt's and 0.5 mg/ml polyriboadenylic acid. Approximately $2×10^7$ cpm (specific activity $4-9×10^8$ cpm/ug) of $^{32}P$ end-labeled oligonucleotide probe are then added to the solution. After 12-16 hours of incubation, the membrane is washed for 30 minutes at room temperature in 1×SET (150 mM NaCl, 20 mM Tris hydrochloride, pH 7.8, 1 mM $Na_2EDTA$) containing 0.5% SDS, followed by a 30 minute wash in fresh 1×SET at $T_m-10°$ C. for the oligonucleotide probe. The membrane is then exposed to auto-radiographic film for detection of hybridization signals.

All of the foregoing hybridizations would be considered to be under conditions of high stringency.

Following hybridization, a filter can be washed to remove any non-specifically bound detectable probe. The stringency used to wash the filters can also be varied depending on the nature of the nucleic acids being hybridized, the length of the nucleic acids being hybridized, the degree of complementarity, the nucleotide sequence composition (e.g., GC v. AT content) and the nucleic acid type (e.g., RNA v. DNA). Examples of progressively higher stringency condition washes are as follows: 2×SSC, 0.1% SDS at room temperature for 15 minutes (low stringency); 0.1×SSC, 0.5% SDS at room temperature for 30 minutes to 1 hour (moderate stringency); 0.1×SSC, 0.5% SDS for 15 to 30 minutes at between the hybridization temperature and 68° C. (high stringency); and 0.15M NaCl for 15 minutes at 72° C. (very high stringency). A final low stringency wash can be conducted in 0.1×SSC at room temperature. The examples above are merely illustrative of one set of conditions that can be used to wash filters. One of skill in the art would know that there are numerous recipes for different stringency washes. Some other examples are given below.

In one aspect, hybridization conditions comprise a wash step comprising a wash for 30 minutes at room temperature in a solution comprising 1×150 mM NaCl, 20 mM Tris hydrochloride, pH 7.8, 1 mM $Na_2EDTA$, 0.5% SDS, followed by a 30 minute wash in fresh solution.

Nucleic acids which have hybridized to the probe are identified by autoradiography or other conventional techniques.

The above procedure may be modified to identify nucleic acids having decreasing levels of homology to the probe sequence. For example, to obtain nucleic acids of decreasing homology to the detectable probe, less stringent conditions may be used. For example, the hybridization temperature may be decreased in increments of 5° C. from 68° C. to 42° C. in a hybridization buffer having a $Na^+$ concentration of approximately 1M. Following hybridization, the filter may be washed with 2×SSC, 0.5% SDS at the temperature of hybridization. These conditions are considered to be "moderate" conditions above 50° C. and "low" conditions below 50° C. A specific example of "moderate" hybridization conditions is when the above hybridization is conducted at 55° C. A specific example of "low stringency" hybridization conditions is when the above hybridization is conducted at 45° C.

Alternatively, the hybridization may be carried out in buffers, such as 6×SSC, containing formamide at a temperature of 42° C. In this case, the concentration of formamide in the hybridization buffer may be reduced in 5% increments from 50% to 0% to identify clones having decreasing levels of homology to the probe. Following hybridization, the filter may be washed with 6×SSC, 0.5% SDS at 50° C. These conditions are considered to be "moderate" conditions above 25% formamide and "low" conditions below 25% formamide. A specific example of "moderate" hybridization conditions is when the above hybridization is conducted at 30% formamide. A specific example of "low stringency" hybridization conditions is when the above hybridization is conducted at 10% formamide.

However, the selection of a hybridization format is not critical—it is the stringency of the wash conditions that set forth the conditions which determine whether a nucleic acid is within the scope of the invention. Wash conditions used to identify nucleic acids within the scope of the invention include, e.g.: a salt concentration of about 0.02 molar at pH 7 and a temperature of at least about 50° C. or about 55° C. to about 60° C.; or, a salt concentration of about 0.15 M NaCl at 72° C. for about 15 minutes; or, a salt concentration of about 0.2×SSC at a temperature of at least about 50° C. or about 55° C. to about 60° C. for about 15 to about 20 minutes; or, the hybridization complex is washed twice with a solution with a salt concentration of about 2×SSC containing 0.1% SDS at room temperature for 15 minutes and then washed twice by 0.1×SSC containing 0.1% SDS at 68° C. for 15 minutes; or, equivalent conditions. See Sambrook, Tijssen and Ausubel for a description of SSC buffer and equivalent conditions.

These methods may be used to isolate nucleic acids of the invention. For example, the preceding methods may be used to isolate nucleic acids having a sequence with at least about 97%, at least 95%, at least 90%, at least 85%, at least 80%, at least 75%, at least 70%, at least 65%, at least 60%, at least 55%, or at least 50% sequence identity (homology) to a nucleic acid sequence selected from the group consisting of one of the sequences of the invention, or fragments comprising at least about 10, 15, 20, 25, 30, 35, 40, 50, 75, 100, 150, 200, 300, 400, or 500 consecutive bases thereof and the sequences complementary thereto. Sequence identity (homology) may be measured using the alignment algorithm. For example, the homologous polynucleotides may have a coding sequence which is a naturally occurring allelic variant of one of the coding sequences described herein. Such allelic variants may have a substitution, deletion or addition of one or more nucleotides when compared to the nucleic acids of the invention. Additionally, the above procedures may be used to isolate nucleic acids which encode polypeptides having at least about 99%, 95%, at least 90%, at least 85%, at least 80%, at least 75%, at least 70%, at least 65%, at least 60%, at least 55%, or at least 50% sequence identity (homology) to a polypeptide of the invention, or fragments comprising at least 5, 10, 15, 20, 25, 30, 35, 40, 50, 75, 100, or 150 consecutive amino acids thereof as determined using a sequence alignment algorithm (e.g., such as the FASTA version 3.0t78 algorithm with the default parameters).

Oligonucleotides Probes and Methods for Using Them

The invention also provides nucleic acid probes that can be used, e.g., for identifying nucleic acids encoding a polypeptide with an enzyme, structural or binding activity or fragments thereof or for identifying polypeptide, enzyme, protein, e.g. structural or binding protein, genes. In one aspect, the probe comprises at least 10 consecutive bases of a nucleic acid of the invention. Alternatively, a probe of the invention can be at least about 5, 6, 7, 8, 9, 10, 11, 12, 13, 14, 15, 16, 17, 18, 19, 20, 21, 22, 23, 24, 25, 30, 35, 40, 45, 50, 60, 70, 80, 90, 100, 110, 120, 130, 150 or about 10 to 50, about 20 to 60 about 30 to 70, consecutive bases of a sequence as set forth in a nucleic acid of the invention. The probes identify a nucleic acid by binding and/or hybridization. The probes can be used in arrays of the invention, see discussion below, including, e.g., capillary arrays. The probes of the invention can also be used to isolate other nucleic acids or polypeptides.

The isolated nucleic acids of the invention, the sequences complementary thereto, or a fragment comprising at least 10, 15, 20, 25, 30, 35, 40, 50, 75, 100, 150, 200, 300, 400, or 500 consecutive bases of one of the sequences of the invention, or the sequences complementary thereto may also be used as probes to determine whether a biological sample, such as a soil sample, contains an organism having a nucleic acid sequence of the invention or an organism from which the nucleic acid was obtained. In such procedures, a biological sample potentially harboring the organism from which the nucleic acid was isolated is obtained and nucleic acids are obtained from the sample. The nucleic acids are contacted with the probe under conditions which permit the probe to specifically hybridize to any complementary sequences from which are present therein.

Where necessary, conditions which permit the probe to specifically hybridize to complementary sequences may be determined by placing the probe in contact with complementary sequences from samples known to contain the complementary sequence as well as control sequences which do not contain the complementary sequence. Hybridization conditions, such as the salt concentration of the hybridization buffer, the formamide concentration of the hybridization buffer, or the hybridization temperature, may be varied to identify conditions which allow the probe to hybridize specifically to complementary nucleic acids.

If the sample contains the organism from which the nucleic acid was isolated, specific hybridization of the probe is then detected. Hybridization may be detected by labeling the probe with a detectable agent such as a radioactive isotope, a fluorescent dye or an enzyme capable of catalyzing the formation of a detectable product.

Many methods for using the labeled probes to detect the presence of complementary nucleic acids in a sample are familiar to those skilled in the art. These include Southern Blots, Northern Blots, colony hybridization procedures and dot blots. Protocols for each of these procedures are provided in Ausubel et al. Current Protocols in Molecular Biology, John Wiley 503 Sons, Inc. (1997) and Sambrook et al., Molecular Cloning: A Laboratory Manual 2nd Ed., Cold Spring Harbor Laboratory Press (1989.

Alternatively, more than one probe (at least one of which is capable of specifically hybridizing to any complementary sequences which are present in the nucleic acid sample), may be used in an amplification reaction to determine whether the sample contains an organism containing a nucleic acid sequence of the invention (e.g., an organism from which the nucleic acid was isolated). Typically, the probes comprise oligonucleotides. In one aspect, the amplification reaction may comprise a PCR reaction. PCR protocols are described in Ausubel and Sambrook, supra. Alternatively, the amplification may comprise a ligase chain reaction, 3SR, or strand displacement reaction. (See Barany, F., "The Ligase Chain Reaction in a PCR World", *PCR Methods and Applications* 1:5-16, 1991; E. Fahy et al., "Self-sustained Sequence Replication (3SR): An Isothermal Transcription-based Amplification System Alternative to PCR", *PCR Methods and Applications* 1:25-33, 1991; and Walker G. T. et al., "Strand Displacement Amplification—an Isothermal in vitro DNA Amplification Technique", *Nucleic Acid Research* 20:1691-1696, 1992). In such procedures, the nucleic acids in the sample are contacted with the probes, the amplification reaction is performed and any resulting amplification product is detected. The amplification product may be detected by performing gel electrophoresis on the reaction products and staining the gel with an intercalator such as ethidium bromide. Alternatively, one or more of the probes may be labeled with a radioactive isotope and the presence of a radioactive amplification product may be detected by autoradiography after gel electrophoresis.

Probes derived from sequences near the ends of the sequences of the invention, may also be used in chromosome walking procedures to identify clones containing genomic sequences located adjacent to the sequences of the invention. Such methods allow the isolation of genes which encode additional proteins from the host organism.

The isolated nucleic acids of the invention, the sequences complementary thereto, or a fragment comprising at least 10, 15, 20, 25, 30, 35, 40, 50, 75, 100, 150, 200, 300, 400, or 500 consecutive bases of one of the sequences of the invention, or the sequences complementary thereto may be used as probes to identify and isolate related nucleic acids. In some aspects, the related nucleic acids may be cDNAs or genomic DNAs from organisms other than the one from which the nucleic acid was isolated. For example, the other organisms may be related organisms. In such procedures, a nucleic acid sample is contacted with the probe under conditions which permit the probe to specifically hybridize to related sequences. Hybridization of the probe to nucleic acids from the related organism is then detected using any of the methods described above.

By varying the stringency of the hybridization conditions used to identify nucleic acids, such as cDNAs or genomic DNAs, which hybridize to the detectable probe, nucleic acids having different levels of homology to the probe can be identified and isolated. Stringency may be varied by conducting the hybridization at varying temperatures below the melting temperatures of the probes. The melting temperature, $T_m$, is the temperature (under defined ionic strength and pH) at which 50% of the target sequence hybridizes to a perfectly complementary probe. Very stringent conditions are selected to be equal to or about 5° C. lower than the $T_m$ for a particular probe. The melting temperature of the probe may be calculated using the following formulas:

For probes between 14 and 70 nucleotides in length the melting temperature ($T_m$) is calculated using the formula: $T_m=81.5+16.6(\log [Na+])+0.41(\text{fraction } G+C)-(600/N)$ where N is the length of the probe.

If the hybridization is carried out in a solution containing formamide, the melting temperature may be calculated using the equation: $T_m=81.5+16.6(\log [Na+])+0.41(\text{fraction } G+C)-(0.63\% \text{ formamide})-(600/N)$ where N is the length of the probe.

Prehybridization may be carried out in 6×SSC, 5×Denhardt's reagent, 0.5% SDS, 100 µg denatured fragmented salmon sperm DNA or 6×SSC, 5×Denhardt's reagent, 0.5% SDS, 100 µg denatured fragmented salmon sperm DNA, 50% formamide. The formulas for SSC and Denhardt's solutions are listed in Sambrook et al., supra.

Hybridization is conducted by adding the detectable probe to the prehybridization solutions listed above. Where the probe comprises double stranded DNA, it is denatured before addition to the hybridization solution. The filter is contacted with the hybridization solution for a sufficient period of time to allow the probe to hybridize to cDNAs or genomic DNAs containing sequences complementary thereto or homologous thereto. For probes over 200 nucleotides in length, the hybridization may be carried out at 15-25° C. below the $T_m$. For shorter probes, such as oligonucleotide probes, the hybridization may be conducted at 5-10° C. below the $T_m$. In one aspect, for hybridizations in 6×SSC, the hybridization is conducted at approximately 68° C. Usually, for hybridizations in 50% formamide containing solutions, the hybridization is conducted at approximately 42° C.

Inhibiting Expression of Polypeptides, Enzymes, Proteins

The invention provides nucleic acids complementary to (e.g., antisense sequences to) the nucleic acids of the invention, e.g., nucleic acids comprising antisense, iRNA, ribozymes. Nucleic acids of the invention comprising antisense sequences can be capable of inhibiting the transport, splicing or transcription of polypeptide, enzyme, protein, e.g. structural or binding protein genes. The inhibition can be effected through the targeting of genomic DNA or messenger RNA. The transcription or function of targeted nucleic acid can be inhibited, for example, by hybridization and/or cleavage. In one aspect, inhibitors of the invention include oligonucleotides which are able to either bind a polypeptide, enzyme, protein, e.g. structural or binding protein, gene or message, in either case preventing or inhibiting the production or function of a polypeptide, enzyme, protein, e.g. structural or binding protein. The association can be through sequence specific hybridization. Another useful class of inhibitors includes oligonucleotides which cause inactivation or cleavage of a polypeptide, enzyme, protein, e.g. structural or binding protein, message. The oligonucleotide can have enzyme activity which causes such cleavage, such as ribozymes. The oligonucleotide can be chemically modified or conjugated to an enzyme or composition capable of cleaving the complementary nucleic acid. A pool of many different such oligonucleotides can be screened for those with the desired activity. Thus, the invention provides various compositions for the inhibition of a polypeptide, enzyme, protein, e.g. structural or binding protein, expression on a nucleic acid and/or protein level, e.g., antisense, iRNA and ribozymes comprising a polypeptide, enzyme, protein, e.g. structural or binding protein, sequences of the invention and the antipolypeptide, anti-enzyme, anti-protein, e.g. anti-structural or anti-binding protein antibodies of the invention.

Inhibition of a polypeptide, enzyme, protein, e.g. structural or binding protein, expression can have a variety of industrial applications. For example, inhibition of a polypeptide, enzyme, protein, e.g. structural or binding protein, expression can slow or prevent spoilage. In one aspect, use of compositions of the invention that inhibit the expression and/or activity of a polypeptide, enzyme, protein, e.g. structural or binding protein, e.g., antibodies, antisense oligonucleotides, ribozymes and RNAi, are used to slow or prevent spoilage. Thus, in one aspect, the invention provides methods and compositions comprising application onto a plant or plant product (e.g., a cereal, a grain, a fruit, seed, root, leaf, etc.) antibodies, antisense oligonucleotides, ribozymes and RNAi of the invention to slow or prevent spoilage. These compositions also can be expressed by the plant (e.g., a transgenic plant) or another organism (e.g., a bacterium or other microorganism transformed with a polypeptide, enzyme, protein, e.g. structural or binding protein, gene of the invention).

The compositions of the invention for the inhibition of a polypeptide, enzyme, protein, e.g. structural or binding protein, expression, e.g., antisense, iRNA (e.g., siRNA, miRNA), ribozymes, antibodies, can be used as pharmaceutical compositions, e.g., as anti-pathogen agents or in other therapies, e.g., as anti-microbials for, e.g., *Salmonella*, or to neutralize a biological warfare agent, e.g., anthrax.

Antisense Oligonucleotides

The invention provides antisense oligonucleotides capable of binding a polypeptide, enzyme, protein, e.g. structural or binding protein, message which, in one aspect, can inhibit a polypeptide, enzyme, protein, e.g. structural or binding protein, activity by targeting mRNA. Strategies for designing antisense oligonucleotides are well described in the scientific and patent literature, and the skilled artisan can design such a polypeptide, enzyme, protein, e.g. structural or binding protein, oligonucleotides using the novel reagents of the invention. For example, gene walking/RNA mapping protocols to screen for effective antisense oligonucleotides are well known in the art, see, e.g., Ho (2000) Methods Enzymol. 314:168-183, describing an RNA mapping assay, which is based on standard molecular techniques to provide an easy and reliable method for potent antisense sequence selection. See also Smith (2000) Eur. J. Pharm. Sci. 11:191-198.

Naturally occurring nucleic acids are used as antisense oligonucleotides. The antisense oligonucleotides can be of any length; for example, in alternative aspects, the antisense oligonucleotides are between about 5 to 100, about 10 to 80, about 15 to 60, about 18 to 40. The optimal length can be determined by routine screening. The antisense oligonucleotides can be present at any concentration. The optimal concentration can be determined by routine screening. A wide variety of synthetic, non-naturally occurring nucleotide and nucleic acid analogues are known which can address this potential problem. For example, peptide nucleic acids (PNAs) containing non-ionic backbones, such as N-(2-aminoethyl)glycine units can be used. Antisense oligonucleotides having phosphorothioate linkages can also be used, as described in WO 97/03211; WO 96/39154; Mata (1997) Toxicol Appl Pharmacol 144:189-197; Antisense Therapeutics, ed. Agrawal (Humana Press, Totowa, N.J., 1996). Antisense oligonucleotides having synthetic DNA backbone analogues provided by the invention can also include phosphorodithioate, methylphosphonate, phosphoramidate, alkyl phosphotriester, sulfamate, 3'-thioacetal, methylene(methylimino), 3'-N-carbamate, and morpholino carbamate nucleic acids, as described above.

Combinatorial chemistry methodology can be used to create vast numbers of oligonucleotides that can be rapidly screened for specific oligonucleotides that have appropriate binding affinities and specificities toward any target, such as the sense and antisense a polypeptide, enzyme, protein, e.g. structural or binding protein, sequences of the invention (see, e.g., Gold (1995) J. of Biol. Chem. 270:13581-13584).

Inhibitory Ribozymes

The invention provides ribozymes capable of binding a polypeptide, enzyme, protein, e.g. structural or binding protein, message. These ribozymes can inhibit a polypeptide, enzyme, protein, e.g. structural or binding protein, activity by, e.g., targeting mRNA. Strategies for designing ribozymes and selecting the polypeptide, enzyme, protein, e.g. structural or binding protein-specific antisense sequence for targeting are well described in the scientific and patent literature, and the skilled artisan can design such ribozymes using the novel reagents of the invention. Ribozymes act by binding to a target RNA through the target RNA binding portion of a ribozyme which is held in close proximity to an enzymatic portion of the RNA that cleaves the target RNA. Thus, the ribozyme recognizes and binds a target RNA through complementary base-pairing, and once bound to the correct site, acts enzymatically to cleave and inactivate the target RNA. Cleavage of a target RNA in such a manner will destroy its ability to direct synthesis of an encoded protein if the cleavage occurs in the coding sequence. After a ribozyme has bound and cleaved its RNA target, it can be released from that RNA to bind and cleave new targets repeatedly.

In some circumstances, the enzymatic nature of a ribozyme can be advantageous over other technologies, such as antisense technology (where a nucleic acid molecule simply binds to a nucleic acid target to block its transcription, translation or association with another molecule) as the effective concentration of ribozyme necessary to effect a therapeutic treatment can be lower than that of an antisense oligonucleotide. This potential advantage reflects the ability of the ribozyme to act enzymatically. Thus, a single ribozyme molecule is able to cleave many molecules of target RNA. In addition, a ribozyme is typically a highly specific inhibitor, with the specificity of inhibition depending not only on the base pairing mechanism of binding, but also on the mechanism by which the molecule inhibits the expression of the RNA to which it binds. That is, the inhibition is caused by cleavage of the RNA target and so specificity is defined as the ratio of the rate of cleavage of the targeted RNA over the rate of cleavage of non-targeted RNA. This cleavage mechanism is dependent upon factors additional to those involved in base pairing. Thus, the specificity of action of a ribozyme can be greater than that of antisense oligonucleotide binding the same RNA site.

The ribozyme of the invention, e.g., an enzymatic ribozyme RNA molecule, can be formed in a hammerhead motif, a hairpin motif, as a hepatitis delta virus motif, a group I intron motif and/or an RNaseP-like RNA in association with an RNA guide sequence. Examples of hammerhead motifs are described by, e.g., Rossi (1992) Aids Research and Human Retroviruses 8:183; hairpin motifs by Hampel (1989) Biochemistry 28:4929, and Hampel (1990) Nuc. Acids Res. 18:299; the hepatitis delta virus motif by Perrotta (1992) Biochemistry 31:16; the RNaseP motif by Guerrier-Takada (1983) Cell 35:849; and the group I intron by Cech U.S. Pat. No. 4,987,071. The recitation of these specific motifs is not intended to be limiting. Those skilled in the art will recognize that a ribozyme of the invention, e.g., an enzymatic RNA molecule of this invention, can have a specific substrate binding site complementary to one or more of the target gene RNA regions. A ribozyme of the invention can have a nucleotide sequence within or surrounding that substrate binding site which imparts an RNA cleaving activity to the molecule.

RNA Interference (RNAi)

In one aspect, the invention provides an RNA inhibitory molecule, a so-called "RNAi" molecule, comprising a polypeptide, enzyme, protein, e.g. structural or binding protein, sequence of the invention. The RNAi molecule comprises a double-stranded RNA (dsRNA) molecule. The RNAi can inhibit expression of a polypeptide, enzyme, protein, e.g. structural or binding protein, gene. In one aspect, the RNAi is about 15, 16, 17, 18, 19, 20, 21, 22, 23, 24, 25 or more duplex nucleotides in length. While the invention is not limited by any particular mechanism of action, the RNAi can enter a cell and cause the degradation of a single-stranded RNA (ssRNA) of similar or identical sequences, including endogenous mRNAs. When a cell is exposed to double-stranded RNA (dsRNA), mRNA from the homologous gene is selectively degraded by a process called RNA interference (RNAi). A possible basic mechanism behind RNAi, e.g., siRNA for inhibiting transcription and/or miRNA to inhibit translation, is the breaking of a double-stranded RNA (dsRNA) matching a specific gene sequence into short pieces called short interfering RNA, which trigger the degradation of mRNA that matches its sequence. In one aspect, the RNAi's of the invention are used in gene-silencing therapeutics, see, e.g., Shuey (2002) Drug Discov. Today 7:1040-1046. In one aspect, the invention provides methods to selectively degrade RNA using the RNAi's of the invention. The process may be practiced in vitro, ex vivo or in vivo. In one aspect, the RNAi molecules of the invention can be used to generate a loss-of-function mutation in a cell, an organ or an animal. Methods for making and using RNAi molecules for selectively degrade RNA are well known in the art, see, e.g., U.S. Pat. Nos. 6,506,559; 6,511,824; 6,515,109; 6,489,127.

Modification of Nucleic Acids

The invention provides methods of generating variants of the nucleic acids of the invention, e.g., those encoding a polypeptide, enzyme, protein, e.g. structural or binding protein. These methods can be repeated or used in various combinations to generate a polypeptide, enzyme, protein, e.g. structural or binding protein, having an altered or different activity or an altered or different stability from that of a polypeptide, enzyme, protein, e.g. structural or binding protein, encoded by the template nucleic acid. These methods also can be repeated or used in various combinations, e.g., to generate variations in gene/message expression, message translation or message stability. In another aspect, the genetic composition of a cell is altered by, e.g., modification of a homologous gene ex vivo, followed by its reinsertion into the cell.

A nucleic acid of the invention can be altered by any means. For example, random or stochastic methods, or, non-stochastic, or "directed evolution," methods, see, e.g., U.S. Pat. No. 6,361,974. Methods for random mutation of genes are well known in the art, see, e.g., U.S. Pat. No. 5,830,696. For example, mutagens can be used to randomly mutate a gene. Mutagens include, e.g., ultraviolet light or gamma irradiation, or a chemical mutagen, e.g., mitomycin, nitrous acid, photoactivated psoralens, alone or in combination, to induce DNA breaks amenable to repair by recombination. Other chemical mutagens include, for example, sodium bisulfite, nitrous acid, hydroxylamine, hydrazine or formic acid. Other mutagens are analogues of nucleotide precursors, e.g., nitrosoguanidine, 5-bromouracil, 2-aminopurine, or acridine. These agents can be added to a PCR reaction in place of the nucleotide precursor thereby mutating the sequence. Intercalating agents such as proflavine, acriflavine, quinacrine and the like can also be used.

Any technique in molecular biology can be used, e.g., random PCR mutagenesis, see, e.g., Rice (1992) Proc. Natl. Acad. Sci. USA 89:5467-5471; or, combinatorial multiple cassette mutagenesis, see, e.g., Crameri (1995) Biotechniques 18:194-196. Alternatively, nucleic acids, e.g., genes, can be reassembled after random, or "stochastic," fragmentation, see, e.g., U.S. Pat. Nos. 6,291,242; 6,287,862; 6,287,861; 5,955,358; 5,830,721; 5,824,514; 5,811,238; 5,605,793. In alternative aspects, modifications, additions or deletions are introduced by error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, Gene Site Saturation Mutagenesis (GSSM), synthetic ligation reassembly (SLR), recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation, and/or a combination of these and other methods.

The following publications describe a variety of recursive recombination procedures and/or methods which can be incorporated into the methods of the invention: Stemmer (1999) "Molecular breeding of viruses for targeting and other clinical properties" Tumor Targeting 4:1-4; Ness (1999) Nature Biotechnology 17:893-896; Chang (1999) "Evolution of a cytokine using DNA family shuffling" Nature Biotechnology 17:793-797; Minshull (1999) "Protein evolution by molecular breeding" Current Opinion in Chemical Biology 3:284-290; Christians (1999) "Directed evolution of thymidine kinase for AZT phosphorylation using DNA family shuffling" Nature Biotechnology 17:259-264; Crameri (1998) "DNA shuffling of a family of genes from diverse species accelerates directed evolution" Nature 391:288-291; Crameri (1997) "Molecular evolution of an arsenate detoxification pathway by DNA shuffling," Nature Biotechnology 15:436-438; Zhang (1997) "Directed evolution of an effective fucosidase from a galactosidase by DNA shuffling and screening" Proc. Natl. Acad. Sci. USA 94:4504-4509; Patten et al. (1997) "Applications of DNA Shuffling to Pharmaceuticals and Vaccines" Current Opinion in Biotechnology 8:724-733; Crameri et al. (1996) "Construction and evolution of antibody-phage libraries by DNA shuffling" Nature Medicine 2:100-103; Gates et al. (1996) "Affinity selective isolation of ligands from peptide libraries through display on a lac repressor 'headpiece dimer'" Journal of Molecular Biology 255: 373-386; Stemmer (1996) "Sexual PCR and Assembly PCR" In: The Encyclopedia of Molecular Biology. VCH Publishers, New York. pp. 447-457; Crameri and Stemmer (1995) "Combinatorial multiple cassette mutagenesis creates all the permutations of mutant and wildtype cassettes" BioTechniques 18:194-195; Stemmer et al. (1995) "Single-step assembly of a gene and entire plasmid form large numbers of oligodeoxyribonucleotides" Gene, 164:49-53; Stemmer (1995) "The Evolution of Molecular Computation" Science 270: 1510; Stemmer (1995) "Searching Sequence Space" Bio/Technology 13:549-553; Stemmer (1994) "Rapid evolution of a protein in vitro by DNA shuffling" Nature 370:389-391; and Stemmer (1994) "DNA shuffling by random fragmentation and reassembly: In vitro recombination for molecular evolution." Proc. Natl. Acad. Sci. USA 91:10747-10751.

Mutational methods of generating diversity include, for example, site-directed mutagenesis (Ling et al. (1997) "Approaches to DNA mutagenesis: an overview" Anal Biochem. 254(2): 157-178; Dale et al. (1996) "Oligonucleotide-directed random mutagenesis using the phosphorothioate method" Methods Mol. Biol. 57:369-374; Smith (1985) "In vitro mutagenesis" Ann. Rev. Genet. 19:423-462; Botstein & Shortle (1985) "Strategies and applications of in vitro mutagenesis" Science 229:1193-1201; Carter (1986) "Site-directed mutagenesis" Biochem. J. 237:1-7; and Kunkel (1987) "The efficiency of oligonucleotide directed mutagenesis" in Nucleic Acids & Molecular Biology (Eckstein, F. and Lilley, D. M. J. eds., Springer Verlag, Berlin)); mutagenesis using uracil containing templates (Kunkel (1985) "Rapid and efficient site-specific mutagenesis without phenotypic selection" Proc. Natl. Acad. Sci. USA 82:488-492; Kunkel et al. (1987) "Rapid and efficient site-specific mutagenesis without phenotypic selection" Methods in Enzymol. 154, 367-382; and Bass et al. (1988) "Mutant Trp repressors with new DNA-binding specificities" Science 242:240-245); oligonucleotide-directed mutagenesis (Methods in Enzymol. 100: 468-500 (1983); Methods in Enzymol. 154: 329-350 (1987); Zoller (1982) "Oligonucleotide-directed mutagenesis using M13-derived vectors: an efficient and general procedure for the production of point mutations in any DNA fragment" Nucleic Acids Res. 10:6487-6500; Zoller & Smith (1983) "Oligonucleotide-directed mutagenesis of DNA fragments cloned into M13 vectors" Methods in Enzymol. 100:468-500; and Zoller (1987) Oligonucleotide-directed mutagenesis: a simple method using two oligonucleotide primers and a single-stranded DNA template" Methods in Enzymol. 154: 329-350); phosphorothioate-modified DNA mutagenesis (Taylor (1985) "The use of phosphorothioate-modified DNA in restriction enzyme reactions to prepare nicked DNA" Nucl. Acids Res. 13: 8749-8764; Taylor (1985) "The rapid generation of oligonucleotide-directed mutations at high frequency using phosphorothioate-modified DNA" Nucl. Acids Res. 13: 8765-8787 (1985); Nakamaye (1986) "Inhibition of restriction endonuclease Nci I cleavage by phosphorothioate groups and its application to oligonucleotide-directed mutagenesis" Nucl. Acids Res. 14: 9679-9698; Sayers (1988) "Y-T Exonucleases in phosphorothioate-based oligonucleotide-directed mutagenesis" Nucl. Acids Res. 16:791-802; and Sayers et al. (1988) "Strand specific cleavage of phosphorothioate-containing DNA by reaction with restriction endonucleases in the presence of ethidium bromide" Nucl. Acids Res. 16: 803-814); mutagenesis using gapped duplex DNA (Kramer et al. (1984) "The gapped duplex DNA approach to oligonucleotide-directed mutation construction" Nucl. Acids Res. 12: 9441-9456; Kramer & Fritz (1987) Methods in Enzymol. "Oligonucleotide-directed construction of mutations via gapped duplex DNA" 154:350-367; Kramer (1988) "Improved enzymatic in vitro reactions in the gapped duplex DNA approach to oligonucleotide-directed construction of mutations" Nucl. Acids Res. 16: 7207; and Fritz (1988) "Oligonucleotide-directed construction of mutations: a gapped duplex DNA procedure without enzymatic reactions in vitro" Nucl. Acids Res. 16: 6987-6999).

Additional protocols that can be used to practice the invention include point mismatch repair (Kramer (1984) "Point Mismatch Repair" Cell 38:879-887), mutagenesis using repair-deficient host strains (Carter et al. (1985) "Improved oligonucleotide site-directed mutagenesis using M13 vectors" Nucl. Acids Res. 13: 4431-4443; and Carter (1987) "Improved oligonucleotide-directed mutagenesis using M13 vectors" Methods in Enzymol. 154: 382-403), deletion mutagenesis (Eghtedarzadeh (1986) "Use of oligonucleotides to generate large deletions" Nucl. Acids Res. 14: 5115), restriction-selection and restriction-selection and restriction-purification (Wells et al. (1986) "Importance of hydrogen-bond formation in stabilizing the transition state of subtilisin" Phil. Trans. R. Soc. Lond. A 317: 415-423), mutagenesis by total gene synthesis (Nambiar et al. (1984) "Total synthesis and cloning of a gene coding for the ribonuclease S protein" Science 223: 1299-1301; Sakamar and Khorana (1988) "Total synthesis and expression of a gene for the a-subunit of bovine rod outer segment guanine nucleotide-binding protein (transducin)" Nucl. Acids Res. 14: 6361-6372; Wells et al. (1985) "Cassette mutagenesis: an efficient method for generation of multiple mutations at defined sites" Gene 34:315-323; and Grundstrom et al. (1985) "Oligonucleotide-directed mutagenesis by microscale 'shotgun' gene synthesis" Nucl. Acids Res. 13: 3305-3316), double-strand break repair (Mandecki (1986); Arnold (1993) "Protein engineering for unusual environments" Current Opinion in Biotechnology 4:450-455. "Oligonucleotide-directed double-strand break repair in plasmids of *Escherichia coli*: a method for site-specific mutagenesis" Proc. Natl. Acad. Sci. USA, 83:7177-7181). Additional details on many of the above methods can be found in Methods in Enzymology Volume 154, which also describes useful controls for trouble-shooting problems with various mutagenesis methods.

Protocols that can be used to practice the invention are described, e.g., in U.S. Pat. No. 5,605,793 to Stemmer (Feb. 25, 1997), "Methods for In Vitro Recombination;" U.S. Pat. No. 5,811,238 to Stemmer et al. (Sep. 22, 1998) "Methods for Generating Polynucleotides having Desired Characteristics by Iterative Selection and Recombination;" U.S. Pat. No. 5,830,721 to Stemmer et al. (Nov. 3, 1998), "DNA Mutagenesis by Random Fragmentation and Reassembly;" U.S. Pat. No. 5,834,252 to Stemmer, et al. (Nov. 10, 1998) "End-Complementary Polymerase Reaction;" U.S. Pat. No. 5,837,458 to Minshull, et al. (Nov. 17, 1998), "Methods and Compositions for Cellular and Metabolic Engineering;" WO 95/22625, Stemmer and Crameri, "Mutagenesis by Random Fragmentation and Reassembly;" WO 96/33207 by Stemmer and Lipschutz "End Complementary Polymerase Chain Reaction;" WO 97/20078 by Stemmer and Crameri "Methods for Generating Polynucleotides having Desired Characteristics by Iterative Selection and Recombination;" WO 97/35966 by Minshull and Stemmer, "Methods and Compositions for Cellular and Metabolic Engineering;" WO 99/41402 by Punnonen et al. "Targeting of Genetic Vaccine Vectors;" WO 99/41383 by Punnonen et al. "Antigen Library Immunization;" WO 99/41369 by Punnonen et al. "Genetic Vaccine Vector Engineering;" WO 99/41368 by Punnonen et al. "Optimization of Immunomodulatory Properties of Genetic Vaccines;" EP 752008 by Stemmer and Crameri, "DNA Mutagenesis by Random Fragmentation and Reassembly;" EP 0932670 by Stemmer "Evolving Cellular DNA Uptake by Recursive Sequence Recombination;" WO 99/23107 by Stemmer et al., "Modification of Virus Tropism and Host Range by Viral Genome Shuffling;" WO 99/21979 by Apt et al., "Human Papillomavirus Vectors;" WO 98/31837 by del Cardayre et al. "Evolution of Whole Cells and Organisms by Recursive Sequence Recombination;" WO 98/27230 by Patten and Stemmer, "Methods and Compositions for Polypeptide Engineering;" WO 98/27230 by Stemmer et al., "Methods for Optimization of Gene Therapy by Recursive Sequence Shuffling and Selection," WO 00/00632, "Methods for Generating Highly Diverse Libraries," WO 00/09679, "Methods for Obtaining in Vitro Recombined Polynucleotide Sequence Banks and Resulting Sequences," WO 98/42832 by Arnold et al., "Recombination of Polynucleotide Sequences Using Random or Defined Primers," WO 99/29902 by Arnold et al., "Method for Creating Polynucleotide and Polypeptide Sequences," WO 98/41653 by Vind, "An in Vitro Method for Construction of a DNA Library," WO 98/41622 by Borchert et al., "Method for Constructing a Library Using DNA Shuffling," and WO 98/42727 by Pati and Zarling, "Sequence Alterations using Homologous Recombination."

Protocols that can be used to practice the invention (providing details regarding various diversity generating methods) are described, e.g., in U.S. patent application Ser. No. 09/407,800, "SHUFFLING OF CODON ALTERED GENES" by Patten et al. filed Sep. 28, 1999; "EVOLUTION OF WHOLE CELLS AND ORGANISMS BY RECURSIVE SEQUENCE RECOMBINATION" by del Cardayre et al., U.S. Pat. No. 6,379,964; "OLIGONUCLEOTIDE MEDIATED NUCLEIC ACID RECOMBINATION" by Crameri et al., U.S. Pat. Nos. 6,319,714; 6,368,861; 6,376,246; 6,423,542; 6,426,224 and PCT/US00/01203; "USE OF CODON-VARIED OLIGONUCLEOTIDE SYNTHESIS FOR SYNTHETIC SHUFFLING" by Welch et al., U.S. Pat. No. 6,436,675; "METHODS FOR MAKING CHARACTER STRINGS, POLYNUCLEOTIDES & POLYPEPTIDES HAVING DESIRED CHARACTERISTICS" by Selifonov et al., filed Jan. 18, 2000, (PCT/US00/01202) and, e.g. "METHODS FOR MAKING CHARACTER STRINGS, POLYNUCLEOTIDES & POLYPEPTIDES HAVING DESIRED CHARACTERISTICS" by Selifonov et al., filed Jul. 18, 2000 (U.S. Ser. No. 09/618,579); "METHODS OF POPULATING DATA STRUCTURES FOR USE IN EVOLUTIONARY SIMULATIONS" by Selifonov and Stemmer, filed Jan. 18, 2000 (PCT/US00/01138); and "SINGLE-STRANDED NUCLEIC ACID TEMPLATE-MEDIATED RECOMBINATION AND NUCLEIC ACID FRAGMENT ISOLATION" by Affholter, filed Sep. 6, 2000 (U.S. Ser. No. 09/656,549); and U.S. Pat. Nos. 6,177,263; 6,153,410.

Non-stochastic, or "directed evolution," methods include, e.g., saturation mutagenesis, such as Gene Site Saturation Mutagenesis (GSSM), synthetic ligation reassembly (SLR), or a combination thereof are used to modify the nucleic acids of the invention to generate a polypeptide, enzyme, protein, e.g. structural or binding protein, with new or altered properties (e.g., activity under highly acidic or alkaline conditions, high or low temperatures, and the like). Polypeptides encoded by the modified nucleic acids can be screened for an activity before testing for glucan hydrolysis or other activity. Any testing modality or protocol can be used, e.g., using a capillary array platform. See, e.g., U.S. Pat. Nos. 6,361,974; 6,280,926; 5,939,250.

Gene Site Saturation Mutagenesis, or, GSSM

The invention also provides methods for making enzyme using Gene Site Saturation mutagenesis, or, GSSM, as described herein, and also in U.S. Pat. Nos. 6,171,820 and 6,579,258.

In one aspect, codon primers containing a degenerate N,N,G/T sequence are used to introduce point mutations into a polynucleotide, e.g., a polypeptide, enzyme, protein, e.g. structural or binding protein, or an antibody of the invention, so as to generate a set of progeny polypeptides in which a full range of single amino acid substitutions is represented at each amino acid position, e.g., an amino acid residue in an enzyme active site or ligand binding site targeted to be modified. These oligonucleotides can comprise a contiguous first homologous sequence, a degenerate N,N,G/T sequence, and, optionally, a second homologous sequence. The downstream progeny translational products from the use of such oligonucleotides include all possible amino acid changes at each amino acid site along the polypeptide, because the degeneracy of the N,N,G/T sequence includes codons for all 20 amino acids. In one aspect, one such degenerate oligonucleotide (comprised of, e.g., one degenerate N,N,G/T cassette) is used for subjecting each original codon in a parental polynucleotide template to a full range of codon substitutions. In another aspect, at least two degenerate cassettes are used—either in the same oligonucleotide or not, for subjecting at least two original codons in a parental polynucleotide template to a full range of codon substitutions. For example, more than one N,N,G/T sequence can be contained in one oligonucleotide to introduce amino acid mutations at more than one site. This plurality of N,N,G/T sequences can be directly contiguous, or separated by one or more additional nucleotide sequence(s). In another aspect, oligonucleotides serviceable for introducing additions and deletions can be used either alone or in combination with the codons containing an N,N,G/T sequence, to introduce any combination or permutation of amino acid additions, deletions, and/or substitutions.

In one aspect, simultaneous mutagenesis of two or more contiguous amino acid positions is done using an oligonucleotide that contains contiguous N,N,G/T triplets, i.e. a degenerate (N,N,G/T)n sequence. In another aspect, degenerate cassettes having less degeneracy than the N,N,G/T sequence are used. For example, it may be desirable in some instances to use (e.g. in an oligonucleotide) a degenerate triplet sequence comprised of only one N, where said N can be in the first second or third position of the triplet. Any other bases including any combinations and permutations thereof can be used in the remaining two positions of the triplet. Alternatively, it may be desirable in some instances to use (e.g. in an oligo) a degenerate N,N,N triplet sequence.

In one aspect, use of degenerate triplets (e.g., N,N,G/T triplets) allows for systematic and easy generation of a full range of possible natural amino acids (for a total of 20 amino acids) into each and every amino acid position in a polypeptide (in alternative aspects, the methods also include generation of less than all possible substitutions per amino acid residue, or codon, position). For example, for a 100 amino acid polypeptide, 2000 distinct species (i.e. 20 possible amino acids per position×100 amino acid positions) can be generated. Through the use of an oligonucleotide or set of oligonucleotides containing a degenerate N,N,G/T triplet, 32 individual sequences can code for all 20 possible natural amino acids. Thus, in a reaction vessel in which a parental polynucleotide sequence is subjected to saturation mutagenesis using at least one such oligonucleotide, there are generated 32 distinct progeny polynucleotides encoding 20 distinct polypeptides. In contrast, the use of a non-degenerate oligonucleotide in site-directed mutagenesis leads to only one progeny polypeptide product per reaction vessel. Nondegenerate oligonucleotides can optionally be used in combination with degenerate primers disclosed; for example, nondegenerate oligonucleotides can be used to generate specific point mutations in a working polynucleotide. This provides one means to generate specific silent point mutations, point mutations leading to corresponding amino acid changes, and point mutations that cause the generation of stop codons and the corresponding expression of polypeptide fragments.

In one aspect, each saturation mutagenesis reaction vessel contains polynucleotides encoding at least 20 progeny polypeptide (e.g., a polypeptide, enzyme, protein, e.g. structural or binding protein) molecules such that all 20 natural amino acids are represented at the one specific amino acid position corresponding to the codon position mutagenized in the parental polynucleotide (other aspects use less than all 20 natural combinations). The 32-fold degenerate progeny polypeptides generated from each saturation mutagenesis reaction vessel can be subjected to clonal amplification (e.g. cloned into a suitable host, e.g., *E. coli* host, using, e.g., an expression vector) and subjected to expression screening. When an individual progeny polypeptide is identified by screening to display a favorable change in property (when compared to the parental polypeptide, such as increased glucan hydrolysis activity under alkaline or acidic conditions), it can be sequenced to identify the correspondingly favorable amino acid substitution contained therein.

In one aspect, upon mutagenizing each and every amino acid position in a parental polypeptide using saturation mutagenesis as disclosed herein, favorable amino acid changes may be identified at more than one amino acid position. One or more new progeny molecules can be generated that contain a combination of all or part of these favorable amino acid substitutions. For example, if 2 specific favorable amino acid changes are identified in each of 3 amino acid positions in a polypeptide, the permutations include 3 possibilities at each position (no change from the original amino acid, and each of two favorable changes) and 3 positions. Thus, there are 3×3×3 or 27 total possibilities, including 7 that were previously examined—6 single point mutations (i.e. 2 at each of three positions) and no change at any position.

In yet another aspect, site-saturation mutagenesis can be used together with shuffling, chimerization, recombination and other mutagenizing processes, along with screening. This invention provides for the use of any mutagenizing process (es), including saturation mutagenesis, in an iterative manner. In one exemplification, the iterative use of any mutagenizing process(es) is used in combination with screening.

The invention also provides for the use of proprietary codon primers (containing a degenerate N,N,N sequence) to introduce point mutations into a polynucleotide, so as to generate a set of progeny polypeptides in which a full range of single amino acid substitutions is represented at each amino acid position; e.g., with Gene Site Saturation Mutagenesis (GSSM). The oligos used are comprised contiguously of a first homologous sequence, a degenerate N,N,N sequence and in one aspect but not necessarily a second homologous sequence. The downstream progeny translational products from the use of such oligos include all possible amino acid changes at each amino acid site along the polypeptide, because the degeneracy of the N,N,N sequence includes codons for all 20 amino acids.

In one aspect, one such degenerate oligo (comprised of one degenerate N,N,N cassette) is used for subjecting each original codon in a parental polynucleotide template to a full range of codon substitutions. In another aspect, at least two degenerate N,N,N cassettes are used—either in the same oligo or not, for subjecting at least two original codons in a parental polynucleotide template to a full range of codon substitutions. Thus, more than one N,N,N sequence can be contained in one oligo to introduce amino acid mutations at more than one site. This plurality of N,N,N sequences can be directly contiguous, or separated by one or more additional nucleotide sequence (s). In another aspect, oligos serviceable for introducing additions and deletions can be used either alone or in combination with the codons containing an N,N,N sequence, to introduce any combination or permutation of amino acid additions, deletions and/or substitutions.

In a particular exemplification, it is possible to simultaneously mutagenize two or more contiguous amino acid positions using an oligo that contains contiguous N,N,N triplets, i.e. a degenerate $(N,N,N)_n$ sequence.

In another aspect, the present invention provides for the use of degenerate cassettes having less degeneracy than the N,N,N sequence. For example, it may be desirable in some instances to use (e.g. in an oligo) a degenerate triplet sequence comprised of only one N, where the N can be in the first second or third position of the triplet. Any other bases including any combinations and permutations thereof can be used in the remaining two positions of the triplet. Alternatively, it may be desirable in some instances to use (e.g., in an oligo) a degenerate N,N,N triplet sequence, N,N,G/T, or an N,N, G/C triplet sequence.

It is appreciated, however, that the use of a degenerate triplet (such as N,N,G/T or an N,N, G/C triplet sequence) as disclosed in the instant invention is advantageous for several reasons. In one aspect, this invention provides a means to systematically and fairly easily generate the substitution of the full range of possible amino acids (for a total of 20 amino acids) into each and every amino acid position in a polypeptide. Thus, for a 100 amino acid polypeptide, the invention provides a way to systematically and fairly easily generate 2000 distinct species (i.e., 20 possible amino acids per position times 100 amino acid positions). It is appreciated that there is provided, through the use of an oligo containing a degenerate N,N,G/T or an N,N, G/C triplet sequence, 32 individual sequences that code for 20 possible amino acids. Thus, in a reaction vessel in which a parental polynucleotide sequence is subjected to saturation mutagenesis using one such oligo, there are generated 32 distinct progeny polynucleotides encoding 20 distinct polypeptides. In contrast, the use of a non-degenerate oligo in site-directed mutagenesis leads to only one progeny polypeptide product per reaction vessel.

This invention also provides for the use of nondegenerate oligos, which can optionally be used in combination with degenerate primers disclosed. It is appreciated that in some situations, it is advantageous to use nondegenerate oligos to generate specific point mutations in a working polynucleotide. This provides a means to generate specific silent point mutations, point mutations leading to corresponding amino acid changes and point mutations that cause the generation of stop codons and the corresponding expression of polypeptide fragments.

Thus, in one aspect of this invention, each saturation mutagenesis reaction vessel contains polynucleotides encoding at least 20 progeny polypeptide molecules such that all 20 amino acids are represented at the one specific amino acid position corresponding to the codon position mutagenized in the parental polynucleotide. The 32-fold degenerate progeny polypeptides generated from each saturation mutagenesis reaction vessel can be subjected to clonal amplification (e.g., cloned into a suitable E. coli host using an expression vector) and subjected to expression screening. When an individual progeny polypeptide is identified by screening to display a favorable change in property (when compared to the parental polypeptide), it can be sequenced to identify the correspondingly favorable amino acid substitution contained therein.

It is appreciated that upon mutagenizing each and every amino acid position in a parental polypeptide using saturation mutagenesis as disclosed herein, favorable amino acid changes may be identified at more than one amino acid position. One or more new progeny molecules can be generated that contain a combination of all or part of these favorable amino acid substitutions. For example, if 2 specific favorable amino acid changes are identified in each of 3 amino acid positions in a polypeptide, the permutations include 3 possibilities at each position (no change from the original amino acid and each of two favorable changes) and 3 positions. Thus, there are 3×3×3 or 27 total possibilities, including 7 that were previously examined—6 single point mutations (i.e., 2 at each of three positions) and no change at any position.

Thus, in a non-limiting exemplification, this invention provides for the use of saturation mutagenesis in combination with additional mutagenization processes, such as process where two or more related polynucleotides are introduced into a suitable host cell such that a hybrid polynucleotide is generated by recombination and reductive reassortment.

In addition to performing mutagenesis along the entire sequence of a gene, the instant invention provides that mutagenesis can be use to replace each of any number of bases in a polynucleotide sequence, wherein the number of bases to be mutagenized is in one aspect every integer from 15 to 100,000. Thus, instead of mutagenizing every position along a molecule, one can subject every or a discrete number of bases (in one aspect a subset totaling from 15 to 100,000) to mutagenesis. In one aspect, a separate nucleotide is used for mutagenizing each position or group of positions along a polynucleotide sequence. A group of 3 positions to be mutagenized may be a codon. The mutations can be introduced using a mutagenic primer, containing a heterologous cassette, also referred to as a mutagenic cassette. Exemplary cassettes can have from 1 to 500 bases. Each nucleotide position in such heterologous cassettes be N, A, C, G, T, A/C, A/G, A/T, C/G, C/T, G/T, C/G/T, A/G/T, A/C/T, A/C/G, or E, where E is any base that is not A, C, G, or T (E can be referred to as a designer oligo).

In a general sense, saturation mutagenesis is comprised of mutagenizing a complete set of mutagenic cassettes (wherein each cassette is in one aspect about 1-500 bases in length) in defined polynucleotide sequence to be mutagenized (wherein the sequence to be mutagenized is in one aspect from about 15 to 100,000 bases in length). Thus, a group of mutations (ranging from 1 to 100 mutations) is introduced into each cassette to be mutagenized. A grouping of mutations to be introduced into one cassette can be different or the same from a second grouping of mutations to be introduced into a second cassette during the application of one round of saturation mutagenesis. Such groupings are exemplified by deletions, additions, groupings of particular codons and groupings of particular nucleotide cassettes.

Defined sequences to be mutagenized include a whole gene, pathway, cDNA, an entire open reading frame (ORF) and entire promoter, enhancer, repressor/transactivator, origin of replication, intron, operator, or any polynucleotide functional group. Generally, a "defined sequences" for this purpose may be any polynucleotide that a 15 base-polynucleotide sequence and polynucleotide sequences of lengths between 15 bases and 15,000 bases (this invention specifically names every integer in between). Considerations in choosing groupings of codons include types of amino acids encoded by a degenerate mutagenic cassette.

In one exemplification a grouping of mutations that can be introduced into a mutagenic cassette, this invention specifically provides for degenerate codon substitutions (using degenerate oligos) that code for 2, 3, 4, 5, 6, 7, 8, 9, 10, 11, 12, 13, 14, 15, 16, 17, 18, 19 and 20 amino acids at each position and a library of polypeptides encoded thereby.

Synthetic Ligation Reassembly (SLR)

The invention provides a non-stochastic gene modification system termed "synthetic ligation reassembly," or simply "SLR," a "directed evolution process," to generate polypeptides, e.g., a polypeptide, enzyme, protein, e.g. structural or binding protein, or antibodies of the invention, with new or altered properties. SLR is a method of ligating oligonucleotide fragments together non-stochastically. This method differs from stochastic oligonucleotide shuffling in that the nucleic acid building blocks are not shuffled, concatenated or chimerized randomly, but rather are assembled non-stochastically. See, e.g., U.S. Pat. Nos. 6,773,900; 6,740,506; 6,713,282; 6,635,449; 6,605,449; 6,537,776.

In one aspect, SLR comprises the following steps: (a) providing a template polynucleotide, wherein the template polynucleotide comprises sequence encoding a homologous gene; (b) providing a plurality of building block polynucleotides, wherein the building block polynucleotides are designed to cross-over reassemble with the template polynucleotide at a predetermined sequence, and a building block polynucleotide comprises a sequence that is a variant of the homologous gene and a sequence homologous to the template polynucleotide flanking the variant sequence; (c) combining a building block polynucleotide with a template polynucleotide such that the building block polynucleotide cross-over reassembles with the template polynucleotide to generate polynucleotides comprising homologous gene sequence variations.

SLR does not depend on the presence of high levels of homology between polynucleotides to be rearranged. Thus, this method can be used to non-stochastically generate libraries (or sets) of progeny molecules comprised of over $10^{100}$ different chimeras. SLR can be used to generate libraries comprised of over $10^{1000}$ different progeny chimeras. Thus, aspects of the present invention include non-stochastic methods of producing a set of finalized chimeric nucleic acid molecule shaving an overall assembly order that is chosen by design. This method includes the steps of generating by design a plurality of specific nucleic acid building blocks having serviceable mutually compatible ligatable ends, and assembling these nucleic acid building blocks, such that a designed overall assembly order is achieved.

The mutually compatible ligatable ends of the nucleic acid building blocks to be assembled are considered to be "serviceable" for this type of ordered assembly if they enable the building blocks to be coupled in predetermined orders. Thus, the overall assembly order in which the nucleic acid building blocks can be coupled is specified by the design of the ligatable ends. If more than one assembly step is to be used, then the overall assembly order in which the nucleic acid building blocks can be coupled is also specified by the sequential order of the assembly step(s). In one aspect, the annealed building pieces are treated with an enzyme, such as a ligase (e.g. T4 DNA ligase), to achieve covalent bonding of the building pieces.

In one aspect, the design of the oligonucleotide building blocks is obtained by analyzing a set of progenitor nucleic acid sequence templates that serve as a basis for producing a progeny set of finalized chimeric polynucleotides. These parental oligonucleotide templates thus serve as a source of sequence information that aids in the design of the nucleic acid building blocks that are to be mutagenized, e.g., chimerized or shuffled. In one aspect of this method, the sequences of a plurality of parental nucleic acid templates are aligned in order to select one or more demarcation points. The demarcation points can be located at an area of homology, and are comprised of one or more nucleotides. These demarcation points are in one aspect shared by at least two of the progenitor templates. The demarcation points can thereby be used to delineate the boundaries of oligonucleotide building blocks to be generated in order to rearrange the parental polynucleotides. The demarcation points identified and selected in the progenitor molecules serve as potential chimerization points in the assembly of the final chimeric progeny molecules. A demarcation point can be an area of homology (comprised of at least one homologous nucleotide base) shared by at least two parental polynucleotide sequences. Alternatively, a demarcation point can be an area of homology that is shared by at least half of the parental polynucleotide sequences, or, it can be an area of homology that is shared by at least two thirds of the parental polynucleotide sequences. Even more in one aspect a serviceable demarcation points is an area of homology that is shared by at least three fourths of the parental polynucleotide sequences, or, it can be shared by at almost all of the parental polynucleotide sequences. In one aspect, a demarcation point is an area of homology that is shared by all of the parental polynucleotide sequences.

In one aspect, a ligation reassembly process is performed exhaustively in order to generate an exhaustive library of progeny chimeric polynucleotides. In other words, all possible ordered combinations of the nucleic acid building blocks are represented in the set of finalized chimeric nucleic acid molecules. At the same time, in another aspect, the assembly order (i.e. the order of assembly of each building block in the 5' to 3 sequence of each finalized chimeric nucleic acid) in each combination is by design (or non-stochastic) as described above. Because of the non-stochastic nature of this invention, the possibility of unwanted side products is greatly reduced.

In another aspect, the ligation reassembly method is performed systematically. For example, the method is performed in order to generate a systematically compartmentalized library of progeny molecules, with compartments that can be screened systematically, e.g. one by one. In other words this invention provides that, through the selective and judicious use of specific nucleic acid building blocks, coupled with the selective and judicious use of sequentially stepped assembly reactions, a design can be achieved where specific sets of progeny products are made in each of several reaction vessels. This allows a systematic examination and screening procedure to be performed. Thus, these methods allow a potentially very large number of progeny molecules to be examined systematically in smaller groups. Because of its ability to perform chimerizations in a manner that is highly flexible yet exhaustive and systematic as well, particularly when there is a low level of homology among the progenitor molecules, these methods provide for the generation of a library (or set) comprised of a large number of progeny molecules. Because of the non-stochastic nature of the instant ligation reassembly invention, the progeny molecules generated in one aspect comprise a library of finalized chimeric nucleic acid molecules having an overall assembly order that is chosen by design. The saturation mutagenesis and optimized directed evolution methods also can be used to generate different progeny molecular species. It is appreciated that the invention provides freedom of choice and control regarding the selection of demarcation points, the size and number of the nucleic acid building blocks, and the size and design of the couplings. It is appreciated, furthermore, that the requirement for intermolecular homology is highly relaxed for the operability of this invention. In fact, demarcation points can even be chosen in areas of little or no intermolecular homology. For example, because of codon wobble, i.e. the degeneracy of codons, nucleotide substitutions can be introduced into nucleic acid building blocks without altering the amino acid originally encoded in the corresponding progenitor template. Alternatively, a codon can be altered such that the coding for an originally amino acid is altered. This invention provides that such substitutions can be introduced into the nucleic acid building block in order to increase the incidence of intermolecular homologous demarcation points and thus to allow an increased number of couplings to be achieved among the building blocks, which in turn allows a greater number of progeny chimeric molecules to be generated.

In one aspect, the present invention provides a non-stochastic method termed synthetic gene reassembly, that is somewhat related to stochastic shuffling, save that the nucleic acid building blocks are not shuffled or concatenated or chimerized randomly, but rather are assembled non-stochastically.

The synthetic gene reassembly method does not depend on the presence of a high level of homology between polynucleotides to be shuffled. The invention can be used to non-stochastically generate libraries (or sets) of progeny molecules comprised of over $10^{100}$ different chimeras. Conceivably, synthetic gene reassembly can even be used to generate libraries comprised of over $10^{1000}$ different progeny chimeras.

Thus, in one aspect, the invention provides a non-stochastic method of producing a set of finalized chimeric nucleic acid molecules having an overall assembly order that is chosen by design, which method is comprised of the steps of generating by design a plurality of specific nucleic acid building blocks having serviceable mutually compatible ligatable ends and assembling these nucleic acid building blocks, such that a designed overall assembly order is achieved.

The mutually compatible ligatable ends of the nucleic acid building blocks to be assembled are considered to be "serviceable" for this type of ordered assembly if they enable the building blocks to be coupled in predetermined orders. Thus, in one aspect, the overall assembly order in which the nucleic acid building blocks can be coupled is specified by the design of the ligatable ends and, if more than one assembly step is to be used, then the overall assembly order in which the nucleic acid building blocks can be coupled is also specified by the sequential order of the assembly step(s). In a one aspect of the invention, the annealed building pieces are treated with an enzyme, such as a ligase (e.g., T4 DNA ligase) to achieve covalent bonding of the building pieces.

In a another aspect, the design of nucleic acid building blocks is obtained upon analysis of the sequences of a set of progenitor nucleic acid templates that serve as a basis for producing a progeny set of finalized chimeric nucleic acid molecules. These progenitor nucleic acid templates thus serve as a source of sequence information that aids in the design of the nucleic acid building blocks that are to be mutagenized, i.e. chimerized or shuffled.

In one exemplification, the invention provides for the chimerization of a family of related genes and their encoded family of related products. In a particular exemplification, the encoded products are enzymes. The polypeptide, enzyme, protein, e.g. structural or binding proteins of the present invention can be mutagenized in accordance with the methods described herein.

Thus according to one aspect of the invention, the sequences of a plurality of progenitor nucleic acid templates (e.g., polynucleotides of the invention) are aligned in order to select one or more demarcation points, which demarcation points can be located at an area of homology. The demarcation points can be used to delineate the boundaries of nucleic acid building blocks to be generated. Thus, the demarcation points identified and selected in the progenitor molecules serve as potential chimerization points in the assembly of the progeny molecules.

Typically a serviceable demarcation point is an area of homology (comprised of at least one homologous nucleotide base) shared by at least two progenitor templates, but the demarcation point can be an area of homology that is shared by at least half of the progenitor templates, at least two thirds of the progenitor templates, at least three fourths of the progenitor templates and in one aspect at almost all of the progenitor templates. Even more in one aspect still a serviceable demarcation point is an area of homology that is shared by all of the progenitor templates.

In a one aspect, the gene reassembly process is performed exhaustively in order to generate an exhaustive library. In other words, all possible ordered combinations of the nucleic acid building blocks are represented in the set of finalized chimeric nucleic acid molecules. At the same time, the assembly order (i.e. the order of assembly of each building block in the 5' to 3 sequence of each finalized chimeric nucleic acid) in each combination is by design (or non-stochastic). Because of the non-stochastic nature of the method, the possibility of unwanted side products is greatly reduced.

In another aspect, the method provides that the gene reassembly process is performed systematically, for example to generate a systematically compartmentalized library, with compartments that can be screened systematically, e.g., one by one. In other words the invention provides that, through the selective and judicious use of specific nucleic acid building blocks, coupled with the selective and judicious use of sequentially stepped assembly reactions, an experimental design can be achieved where specific sets of progeny products are made in each of several reaction vessels. This allows a systematic examination and screening procedure to be performed. Thus, it allows a potentially very large number of progeny molecules to be examined systematically in smaller groups.

Because of its ability to perform chimerizations in a manner that is highly flexible yet exhaustive and systematic as well, particularly when there is a low level of homology among the progenitor molecules, the instant invention provides for the generation of a library (or set) comprised of a large number of progeny molecules. Because of the non-stochastic nature of the instant gene reassembly invention, the progeny molecules generated in one aspect comprise a library of finalized chimeric nucleic acid molecules having an overall assembly order that is chosen by design. In a particularly aspect, such a generated library is comprised of greater than $10^3$ to greater than $10^{1000}$ different progeny molecular species.

In one aspect, a set of finalized chimeric nucleic acid molecules, produced as described is comprised of a polynucleotide encoding a polypeptide. According to one aspect, this polynucleotide is a gene, which may be a man-made gene. According to another aspect, this polynucleotide is a gene pathway, which may be a man-made gene pathway. The invention provides that one or more man-made genes generated by the invention may be incorporated into a man-made gene pathway, such as pathway operable in a eukaryotic organism (including a plant).

In another exemplification, the synthetic nature of the step in which the building blocks are generated allows the design and introduction of nucleotides (e.g., one or more nucleotides, which may be, for example, codons or introns or regulatory sequences) that can later be optionally removed in an in vitro process (e.g., by mutagenesis) or in an in vivo process (e.g., by utilizing the gene splicing ability of a host organism). It is appreciated that in many instances the introduction of these nucleotides may also be desirable for many other reasons in addition to the potential benefit of creating a serviceable demarcation point.

Thus, according to another aspect, the invention provides that a nucleic acid building block can be used to introduce an intron. Thus, the invention provides that functional introns may be introduced into a man-made gene of the invention. The invention also provides that functional introns may be introduced into a man-made gene pathway of the invention. Accordingly, the invention provides for the generation of a chimeric polynucleotide that is a man-made gene containing one (or more) artificially introduced intron(s).

Accordingly, the invention also provides for the generation of a chimeric polynucleotide that is a man-made gene pathway containing one (or more) artificially introduced intron(s). In one aspect, the artificially introduced intron(s) are functional in one or more host cells for gene splicing much in the way that naturally-occurring introns serve functionally in gene splicing. The invention provides a process of producing man-made intron-containing polynucleotides to be introduced into host organisms for recombination and/or splicing.

A man-made gene produced using the invention can also serve as a substrate for recombination with another nucleic acid. Likewise, a man-made gene pathway produced using the invention can also serve as a substrate for recombination with another nucleic acid. In one aspect, the recombination is facilitated by, or occurs at, areas of homology between the man-made, intron-containing gene and a nucleic acid, which serves as a recombination partner. In one aspect, the recombination partner may also be a nucleic acid generated by the invention, including a man-made gene or a man-made gene pathway. Recombination may be facilitated by or may occur at areas of homology that exist at the one (or more) artificially introduced intron(s) in the man-made gene.

The synthetic gene reassembly method of the invention utilizes a plurality of nucleic acid building blocks, each of which in one aspect has two ligatable ends. The two ligatable ends on each nucleic acid building block may be two blunt ends (i.e. each having an overhang of zero nucleotides), or in one aspect one blunt end and one overhang, or more in one aspect still two overhangs.

A useful overhang for this purpose may be a 3' overhang or a 5' overhang. Thus, a nucleic acid building block may have a 3' overhang or alternatively a 5' overhang or alternatively two 3' overhangs or alternatively two 5' overhangs. The overall order in which the nucleic acid building blocks are assembled to form a finalized chimeric nucleic acid molecule is determined by purposeful experimental design and is not random.

In one aspect, a nucleic acid building block is generated by chemical synthesis of two single-stranded nucleic acids (also referred to as single-stranded oligos) and contacting them so as to allow them to anneal to form a double-stranded nucleic acid building block.

A double-stranded nucleic acid building block can be of variable size. The sizes of these building blocks can be small or large. Exemplary sizes for building block range from 1 base pair (not including any overhangs) to 100,000 base pairs (not including any overhangs). Other exemplary size ranges are also provided, which have lower limits of from 1 bp to 10,000 bp (including every integer value in between) and upper limits of from 2 bp to 100,000 bp (including every integer value in between).

Many methods exist by which a double-stranded nucleic acid building block can be generated that is serviceable for the invention; and these are known in the art and can be readily performed by the skilled artisan.

According to one aspect, a double-stranded nucleic acid building block is generated by first generating two single stranded nucleic acids and allowing them to anneal to form a double-stranded nucleic acid building block. The two strands of a double-stranded nucleic acid building block may be complementary at every nucleotide apart from any that form an overhang; thus containing no mismatches, apart from any overhang(s). According to another aspect, the two strands of a double-stranded nucleic acid building block are complementary at fewer than every nucleotide apart from any that form an overhang. Thus, according to this aspect, a double-stranded nucleic acid building block can be used to introduce codon degeneracy. In one aspect the codon degeneracy is introduced using the site-saturation mutagenesis described herein, using one or more N,N,G/T cassettes or alternatively using one or more N,N,N cassettes.

The in vivo recombination method of the invention can be performed blindly on a pool of unknown hybrids or alleles of a specific polynucleotide or sequence. However, it is not necessary to know the actual DNA or RNA sequence of the specific polynucleotide.

The approach of using recombination within a mixed population of genes can be useful for the generation of any useful proteins, for example, interleukin I, antibodies, tPA and growth hormone. This approach may be used to generate proteins having altered specificity or activity. The approach may also be useful for the generation of hybrid nucleic acid sequences, for example, promoter regions, introns, exons, enhancer sequences, 31 untranslated regions or 51 untranslated regions of genes. Thus this approach may be used to generate genes having increased rates of expression. This approach may also be useful in the study of repetitive DNA sequences. Finally, this approach may be useful to mutate ribozymes or aptamers.

In one aspect the invention described herein is directed to the use of repeated cycles of reductive reassortment, recombination and selection which allow for the directed molecular evolution of highly complex linear sequences, such as DNA, RNA or proteins thorough recombination.

Optimized Directed Evolution System

The invention provides a non-stochastic gene modification system termed "optimized directed evolution system" to generate polypeptides, e.g., a polypeptide, enzyme, protein, e.g. structural or binding protein, or antibodies of the invention, with new or altered properties. Optimized directed evolution is directed to the use of repeated cycles of reductive reassortment, recombination and selection that allow for the directed molecular evolution of nucleic acids through recombination. Optimized directed evolution allows generation of a large population of evolved chimeric sequences, wherein the generated population is significantly enriched for sequences that have a predetermined number of crossover events.

A crossover event is a point in a chimeric sequence where a shift in sequence occurs from one parental variant to another parental variant. Such a point is normally at the juncture of where oligonucleotides from two parents are ligated together to form a single sequence. This method allows calculation of the correct concentrations of oligonucleotide sequences so that the final chimeric population of sequences is enriched for the chosen number of crossover events. This provides more control over choosing chimeric variants having a predetermined number of crossover events.

In addition, this method provides a convenient means for exploring a tremendous amount of the possible protein variant space in comparison to other systems. Previously, if one generated, for example, $10^{13}$ chimeric molecules during a reaction, it would be extremely difficult to test such a high number of chimeric variants for a particular activity. Moreover, a significant portion of the progeny population would have a very high number of crossover events which resulted in proteins that were less likely to have increased levels of a particular activity. By using these methods, the population of chimerics molecules can be enriched for those variants that have a particular number of crossover events. Thus, although one can still generate $10^{13}$ chimeric molecules during a reaction, each of the molecules chosen for further analysis most likely has, for example, only three crossover events. Because the resulting progeny population can be skewed to have a predetermined number of crossover events, the boundaries on the functional variety between the chimeric molecules is reduced. This provides a more manageable number of variables when calculating which oligonucleotide from the original parental polynucleotides might be responsible for affecting a particular trait.

One method for creating a chimeric progeny polynucleotide sequence is to create oligonucleotides corresponding to fragments or portions of each parental sequence. Each oligonucleotide in one aspect includes a unique region of overlap so that mixing the oligonucleotides together results in a new variant that has each oligonucleotide fragment assembled in the correct order. Alternatively protocols for practicing these methods of the invention can be found in U.S. Pat. Nos. 6,773,900; 6,740,506; 6,713,282; 6,635,449; 6,605,449; 6,537,776; 6,361,974.

The number of oligonucleotides generated for each parental variant bears a relationship to the total number of resulting crossovers in the chimeric molecule that is ultimately created. For example, three parental nucleotide sequence variants might be provided to undergo a ligation reaction in order to find a chimeric variant having, for example, greater activity at high temperature. As one example, a set of 50 oligonucleotide sequences can be generated corresponding to each portions of each parental variant. Accordingly, during the ligation reassembly process there could be up to 50 crossover events within each of the chimeric sequences. The probability that each of the generated chimeric polynucleotides will contain oligonucleotides from each parental variant in alternating order is very low. If each oligonucleotide fragment is present in the ligation reaction in the same molar quantity it is likely that in some positions oligonucleotides from the same parental polynucleotide will ligate next to one another and thus not result in a crossover event. If the concentration of each oligonucleotide from each parent is kept constant during any ligation step in this example, there is a ⅓ chance (assuming 3 parents) that an oligonucleotide from the same parental variant will ligate within the chimeric sequence and produce no crossover.

Accordingly, a probability density function (PDF) can be determined to predict the population of crossover events that are likely to occur during each step in a ligation reaction given a set number of parental variants, a number of oligonucleotides corresponding to each variant, and the concentrations of each variant during each step in the ligation reaction. The statistics and mathematics behind determining the PDF is described below. By utilizing these methods, one can calculate such a probability density function, and thus enrich the chimeric progeny population for a predetermined number of crossover events resulting from a particular ligation reaction. Moreover, a target number of crossover events can be predetermined, and the system then programmed to calculate the starting quantities of each parental oligonucleotide during each step in the ligation reaction to result in a probability density function that centers on the predetermined number of crossover events. These methods are directed to the use of repeated cycles of reductive reassortment, recombination and selection that allow for the directed molecular evolution of a nucleic acid encoding a polypeptide through recombination. This system allows generation of a large population of evolved chimeric sequences, wherein the generated population is significantly enriched for sequences that have a predetermined number of crossover events. A crossover event is a point in a chimeric sequence where a shift in sequence occurs from one parental variant to another parental variant. Such a point is normally at the juncture of where oligonucleotides from two parents are ligated together to form a single sequence. The method allows calculation of the correct concentrations of oligonucleotide sequences so that the final chimeric population of sequences is enriched for the chosen number of crossover events. This provides more control over choosing chimeric variants having a predetermined number of crossover events.

In addition, these methods provide a convenient means for exploring a tremendous amount of the possible protein variant space in comparison to other systems. By using the methods described herein, the population of chimerics molecules can be enriched for those variants that have a particular number of crossover events. Thus, although one can still generate 1013 chimeric molecules during a reaction, each of the molecules chosen for further analysis most likely has, for example, only three crossover events. Because the resulting progeny population can be skewed to have a predetermined number of crossover events, the boundaries on the functional variety between the chimeric molecules is reduced. This provides a more manageable number of variables when calculating which oligonucleotide from the original parental polynucleotides might be responsible for affecting a particular trait.

In one aspect, the method creates a chimeric progeny polynucleotide sequence by creating oligonucleotides corresponding to fragments or portions of each parental sequence. Each oligonucleotide in one aspect includes a unique region of overlap so that mixing the oligonucleotides together results in a new variant that has each oligonucleotide fragment assembled in the correct order. See also U.S. Ser. No. 09/332,835.

Determining Crossover Events

Aspects of the invention include a system and software that receive a desired crossover probability density function (PDF), the number of parent genes to be reassembled, and the number of fragments in the reassembly as inputs. The output of this program is a "fragment PDF" that can be used to determine a recipe for producing reassembled genes, and the estimated crossover PDF of those genes. The processing described herein is in one aspect performed in MATLAB™ (The Mathworks, Natick, Mass.) a programming language and development environment for technical computing.

Iterative Processes

In practicing the invention, these processes can be iteratively repeated. For example, a nucleic acid (or, the nucleic acid) responsible for an altered or new a polypeptide, enzyme, protein, e.g. structural or binding protein, phenotype is identified, re-isolated, again modified, re-tested for activity. This process can be iteratively repeated until a desired phenotype is engineered. For example, an entire biochemical anabolic or catabolic pathway can be engineered into a cell, including, e.g., a polypeptide, enzyme, protein, e.g. structural or binding protein, activity.

Similarly, if it is determined that a particular oligonucleotide has no affect at all on the desired trait (e.g., a new a polypeptide, enzyme, protein, e.g. structural or binding protein, phenotype), it can be removed as a variable by synthesizing larger parental oligonucleotides that include the sequence to be removed. Since incorporating the sequence within a larger sequence prevents any crossover events, there will no longer be any variation of this sequence in the progeny polynucleotides. This iterative practice of determining which oligonucleotides are most related to the desired trait, and which are unrelated, allows more efficient exploration all of the possible protein variants that might be provide a particular trait or activity.

In Vivo Shuffling

In vivo shuffling of molecules is use in methods of the invention that provide variants of polypeptides of the invention, e.g., antibodies, a polypeptide, enzyme, protein, e.g. structural or binding protein, and the like. In vivo shuffling can be performed utilizing the natural property of cells to recombine multimers. While recombination in vivo has provided the major natural route to molecular diversity, genetic recombination remains a relatively complex process that involves 1) the recognition of homologies; 2) strand cleavage, strand invasion, and metabolic steps leading to the production of recombinant chiasma; and finally 3) the resolution of chiasma into discrete recombined molecules. The formation of the chiasma requires the recognition of homologous sequences.

In another aspect, the invention includes a method for producing a hybrid polynucleotide from at, least a first polynucleotide and a second polynucleotide. The invention can be used to produce a hybrid polynucleotide by introducing at least a first polynucleotide and a second polynucleotide (e.g., one, or both, being an exemplary polypeptide-, enzyme-, protein-, e.g. structural or binding protein-encoding sequence of the invention) which share at least one region of partial sequence homology into a suitable host cell. The regions of partial sequence homology promote processes which result in sequence reorganization producing a hybrid polynucleotide. The term "hybrid polynucleotide", as used herein, is any nucleotide sequence which results from the method of the present invention and contains sequence from at least two original polynucleotide sequences. Such hybrid polynucleotides can result from intermolecular recombination events which promote sequence integration between DNA molecules. In addition, such hybrid polynucleotides can result from intramolecular reductive reassortment processes which utilize repeated sequences to alter a nucleotide sequence within a DNA molecule.

In vivo reassortment is focused on "inter-molecular" processes collectively referred to as "recombination" which in bacteria, is generally viewed as a "RecA-dependent" phenomenon. The invention can rely on recombination processes of a host cell to recombine and re-assort sequences, or the cells' ability to mediate reductive processes to decrease the complexity of quasi-repeated sequences in the cell by deletion. This process of "reductive reassortment" occurs by an "intra-molecular", RecA-independent process.

Therefore, in another aspect of the invention, novel polynucleotides can be generated by the process of reductive reassortment. The method involves the generation of constructs containing consecutive sequences (original encoding sequences), their insertion into an appropriate vector and their subsequent introduction into an appropriate host cell. The reassortment of the individual molecular identities occurs by combinatorial processes between the consecutive sequences in the construct possessing regions of homology, or between quasi-repeated units. The reassortment process recombines and/or reduces the complexity and extent of the repeated sequences and results in the production of novel molecular species. Various treatments may be applied to enhance the rate of reassortment. These could include treatment with ultra-violet light, or DNA damaging chemicals and/or the use of host cell lines displaying enhanced levels of "genetic instability". Thus the reassortment process may involve homologous recombination or the natural property of quasi-repeated sequences to direct their own evolution.

Repeated or "quasi-repeated" sequences play a role in genetic instability. In the present invention, "quasi-repeats" are repeats that are not restricted to their original unit structure. Quasi-repeated units can be presented as an array of sequences in a construct; consecutive units of similar sequences. Once ligated, the junctions between the consecutive sequences become essentially invisible and the quasi-repetitive nature of the resulting construct is now continuous at the molecular level. The deletion process the cell performs to reduce the complexity of the resulting construct operates between the quasi-repeated sequences. The quasi-repeated units provide a practically limitless repertoire of templates upon which slippage events can occur. The constructs containing the quasi-repeats thus effectively provide sufficient molecular elasticity that deletion (and potentially insertion) events can occur virtually anywhere within the quasi-repetitive units.

When the quasi-repeated sequences are all ligated in the same orientation, for instance head to tail or vice versa, the cell cannot distinguish individual units. Consequently, the reductive process can occur throughout the sequences. In contrast, when for example, the units are presented head to head, rather than head to tail, the inversion delineates the endpoints of the adjacent unit so that deletion formation will favor the loss of discrete units. Thus, it is preferable with the present method that the sequences are in the same orientation. Random orientation of quasi-repeated sequences will result in the loss of reassortment efficiency, while consistent orientation of the sequences will offer the highest efficiency. However, while having fewer of the contiguous sequences in the same orientation decreases the efficiency, it may still provide sufficient elasticity for the effective recovery of novel molecules. Constructs can be made with the quasi-repeated sequences in the same orientation to allow higher efficiency.

Sequences can be assembled in a head to tail orientation using any of a variety of methods, including the following:
 a) Primers that include a poly-A head and poly-T tail which when made single-stranded would provide orientation can be utilized. This is accomplished by having the first few bases of the primers made from RNA and hence easily removed RNaseH.
 b) Primers that include unique restriction cleavage sites can be utilized. Multiple sites, a battery of unique sequences and repeated synthesis and ligation steps would be required.
 c) The inner few bases of the primer could be thiolated and an exonuclease used to produce properly tailed molecules.

The recovery of the re-assorted sequences relies on the identification of cloning vectors with a reduced repetitive index (RI). The re-assorted encoding sequences can then be recovered by amplification. The products are re-cloned and expressed. The recovery of cloning vectors with reduced RI can be affected by:
1) The use of vectors only stably maintained when the construct is reduced in complexity.
2) The physical recovery of shortened vectors by physical procedures. In this case, the cloning vector would be recovered using standard plasmid isolation procedures and size fractionated on either an agarose gel, or column with a low molecular weight cut off utilizing standard procedures.
3) The recovery of vectors containing interrupted genes which can be selected when insert size decreases.
4) The use of direct selection techniques with an expression vector and the appropriate selection.

Encoding sequences (for example, genes) from related organisms may demonstrate a high degree of homology and encode quite diverse protein products. These types of sequences are particularly useful in the present invention as quasi-repeats. However, while the examples illustrated below demonstrate the reassortment of nearly identical original encoding sequences (quasi-repeats), this process is not limited to such nearly identical repeats.

The following example demonstrates a method of the invention. Encoding nucleic acid sequences (quasi-repeats) derived from three (3) unique species are described. Each sequence encodes a protein with a distinct set of properties. Each of the sequences differs by a single or a few base pairs at a unique position in the sequence. The quasi-repeated sequences are separately or collectively amplified and ligated into random assemblies such that all possible permutations and combinations are available in the population of ligated molecules. The number of quasi-repeat units can be controlled by the assembly conditions. The average number of quasi-repeated units in a construct is defined as the repetitive index (RI).

Once formed, the constructs may, or may not be size fractionated on an agarose gel according to published protocols, inserted into a cloning vector and transfected into an appropriate host cell. The cells are then propagated and "reductive reassortment" is effected. The rate of the reductive reassortment process may be stimulated by the introduction of DNA damage if desired. Whether the reduction in RI is mediated by deletion formation between repeated sequences by an "intramolecular" mechanism, or mediated by recombination-like events through "inter-molecular" mechanisms is immaterial. The end result is a reassortment of the molecules into all possible combinations.

Optionally, the method comprises the additional step of screening the library members of the shuffled pool to identify individual shuffled library members having the ability to bind or otherwise interact, or catalyze a particular reaction (e.g., such as catalytic domain of an enzyme) with a predetermined macromolecule, such as for example a proteinaceous receptor, an oligosaccharide, virion, or other predetermined compound or structure.

The polypeptides that are identified from such libraries can be used for therapeutic, diagnostic, research and related purposes (e.g., catalysts, solutes for increasing osmolarity of an aqueous solution and the like) and/or can be subjected to one or more additional cycles of shuffling and/or selection.

In another aspect, it is envisioned that prior to or during recombination or reassortment, polynucleotides generated by the method of the invention can be subjected to agents or processes which promote the introduction of mutations into the original polynucleotides. The introduction of such mutations would increase the diversity of resulting hybrid polynucleotides and polypeptides encoded therefrom. The agents or processes which promote mutagenesis can include, but are not limited to: (+)-CC-1065, or a synthetic analog such as (+)-CC-1065-(N-3-Adenine (See Sun and Hurley, (1992); an N-acetylated or deacetylated 4'-fluoro-4-aminobiphenyl adduct capable of inhibiting DNA synthesis (See, for example, van de Poll et al. (1992)); or a N-acetylated or deacetylated 4-aminobiphenyl adduct capable of inhibiting DNA synthesis (See also, van de Poll et al. (1992), pp. 751-758); trivalent chromium, a trivalent chromium salt, a polycyclic aromatic hydrocarbon (PAH) DNA adduct capable of inhibiting DNA replication, such as 7-bromomethyl-benz[a]anthracene ("BMA"), tris(2,3-dibromopropyl)phosphate ("Tris-BP"), 1,2-dibromo-3-chloropropane ("DBCP"), 2-bromoacrolein (2BA), benzo[a]pyrene-7,8-dihydrodiol-9-10-epoxide ("BPDE"), a platinum(II) halogen salt, N-hydroxy-2-amino-3-methylimidazo[4,5-f]-quinoline ("N-hydroxy-IQ") and N-hydroxy-2-amino-1-methyl-6-phenylimidazo[4,5-f]-pyridine ("N-hydroxy-PhIP"). Exemplary means for slowing or halting PCR amplification consist of UV light (+)-CC-1065 and (+)-CC-1065-(N3-Adenine). Particularly encompassed means are DNA adducts or polynucleotides comprising the DNA adducts from the polynucleotides or polynucleotides pool, which can be released or removed by a process including heating the solution comprising the polynucleotides prior to further processing.

In another aspect the invention is directed to a method of producing recombinant proteins having biological activity by treating a sample comprising double-stranded template polynucleotides encoding a wild-type protein under conditions according to the invention which provide for the production of hybrid or re-assorted polynucleotides.

Producing Sequence Variants

The invention also provides additional methods for making sequence variants of the nucleic acid (e.g., polypeptide, enzyme, protein, e.g. structural or binding protein) sequences of the invention. The invention also provides additional methods for isolating a polypeptide, enzyme, protein, e.g. structural or binding protein, using the nucleic acids and polypeptides of the invention. In one aspect, the invention provides for variants of a polypeptide, enzyme, protein, e.g. structural or binding protein, coding sequence (e.g., a gene, cDNA or message) of the invention, which can be altered by any means, including, e.g., random or stochastic methods, or, non-stochastic, or "directed evolution," methods, as described above.

The isolated variants may be naturally occurring. Variant can also be created in vitro. Variants may be created using genetic engineering techniques such as site directed mutagenesis, random chemical mutagenesis, Exonuclease III deletion procedures, and standard cloning techniques. Alternatively, such variants, fragments, analogs, or derivatives may be created using chemical synthesis or modification procedures. Other methods of making variants are also familiar to those skilled in the art. These include procedures in which nucleic acid sequences obtained from natural isolates are modified to generate nucleic acids which encode polypeptides having characteristics which enhance their value in industrial or laboratory applications. In such procedures, a large number of variant sequences having one or more nucleotide differences with respect to the sequence obtained from the natural isolate are generated and characterized. These nucleotide differences can result in amino acid changes with respect to the polypeptides encoded by the nucleic acids from the natural isolates.

For example, variants may be created using error prone PCR. In error prone PCR, PCR is performed under conditions where the copying fidelity of the DNA polymerase is low, such that a high rate of point mutations is obtained along the entire length of the PCR product. Error prone PCR is described, e.g., in Leung (1989) Technique 1:11-15) and Caldwell (1992) PCR Methods Applic. 2:28-33. Briefly, in such procedures, nucleic acids to be mutagenized are mixed with PCR primers, reaction buffer, $MgCl_2$, $MnCl_2$, Taq polymerase and an appropriate concentration of dNTPs for achieving a high rate of point mutation along the entire length of the PCR product. For example, the reaction may be performed using 20 fmoles of nucleic acid to be mutagenized, 30 pmole of each PCR primer, a reaction buffer comprising 50 mM KCl, 10 mM Tris HCl (pH 8.3) and 0.01% gelatin, 7 mM MgCl2, 0.5 mM $MnCl_2$, 5 units of Taq polymerase, 0.2 mM dGTP, 0.2 mM dATP, 1 mM dCTP, and 1 mM dTTP. PCR may be performed for 30 cycles of 94° C. for 1 min, 45° C. for 1 min, and 72° C. for 1 min. However, it will be appreciated that these parameters may be varied as appropriate. The mutagenized nucleic acids are cloned into an appropriate vector and the activities of the polypeptides encoded by the mutagenized nucleic acids are evaluated.

Variants may also be created using oligonucleotide directed mutagenesis to generate site-specific mutations in any cloned DNA of interest. Oligonucleotide mutagenesis is described, e.g., in Reidhaar-Olson (1988) Science 241:53-57. Briefly, in such procedures a plurality of double stranded oligonucleotides bearing one or more mutations to be introduced into the cloned DNA are synthesized and inserted into the cloned DNA to be mutagenized. Clones containing the mutagenized DNA are recovered and the activities of the polypeptides they encode are assessed.

Another method for generating variants is assembly PCR. Assembly PCR involves the assembly of a PCR product from a mixture of small DNA fragments. A large number of different PCR reactions occur in parallel in the same vial, with the products of one reaction priming the products of another reaction. Assembly PCR is described in, e.g., U.S. Pat. No. 5,965,408.

Still another method of generating variants is sexual PCR mutagenesis. In sexual PCR mutagenesis, forced homologous recombination occurs between DNA molecules of different but highly related DNA sequence in vitro, as a result of random fragmentation of the DNA molecule based on sequence homology, followed by fixation of the crossover by primer extension in a PCR reaction. Sexual PCR mutagenesis is described, e.g., in Stemmer (1994) Proc. Natl. Acad. Sci. USA 91:10747-10751. Briefly, in such procedures a plurality of nucleic acids to be recombined are digested with DNase to generate fragments having an average size of 50-200 nucleotides. Fragments of the desired average size are purified and resuspended in a PCR mixture. PCR is conducted under conditions which facilitate recombination between the nucleic acid fragments. For example, PCR may be performed by resuspending the purified fragments at a concentration of 10-30 ng/μl in a solution of 0.2 mM of each dNTP, 2.2 mM $MgCl_2$, 50 mM KCL, 110 mM Tris HCl, pH 9.0, and 0.1% Triton X-100. 2.5 units of Taq polymerase per 100:1 of reaction mixture is added and PCR is performed using the following regime: 94° C. for 60 seconds, 94° C. for 30 seconds, 50-55° C. for 30 seconds, 72° C. for 30 seconds (30-45 times) and 72° C. for 5 minutes. However, it will be appreciated that these parameters may be varied as appropriate. In some aspects, oligonucleotides may be included in the PCR reactions. In other aspects, the Klenow fragment of DNA polymerase I may be used in a first set of PCR reactions and Taq polymerase may be used in a subsequent set of PCR reactions. Recombinant sequences are isolated and the activities of the polypeptides they encode are assessed.

Variants may also be created by in vivo mutagenesis. In some aspects, random mutations in a sequence of interest are generated by propagating the sequence of interest in a bacterial strain, such as an E. coli strain, which carries mutations in one or more of the DNA repair pathways. Such "mutator" strains have a higher random mutation rate than that of a wild-type parent. Propagating the DNA in one of these strains will eventually generate random mutations within the DNA. Mutator strains suitable for use for in vivo mutagenesis are described in PCT Publication No. WO 91/16427, published Oct. 31, 1991, entitled "Methods for Phenotype Creation from Multiple Gene Populations".

Variants may also be generated using cassette mutagenesis. In cassette mutagenesis a small region of a double stranded DNA molecule is replaced with a synthetic oligonucleotide "cassette" that differs from the native sequence. The oligonucleotide often contains completely and/or partially randomized native sequence.

Recursive ensemble mutagenesis may also be used to generate variants. Recursive ensemble mutagenesis is an algorithm for protein engineering (protein mutagenesis) developed to produce diverse populations of phenotypically related mutants whose members differ in amino acid sequence. This method uses a feedback mechanism to control successive rounds of combinatorial cassette mutagenesis. Recursive ensemble mutagenesis is described, e.g., in Arkin (1992) Proc. Natl. Acad. Sci. USA 89:7811-7815.

In some aspects, variants are created using exponential ensemble mutagenesis. Exponential ensemble mutagenesis is a process for generating combinatorial libraries with a high percentage of unique and functional mutants, wherein small groups of residues are randomized in parallel to identify, at each altered position, amino acids which lead to functional proteins. Exponential ensemble mutagenesis is described, e.g., in Delegrave (1993) Biotechnology Res. 11:1548-1552. Random and site-directed mutagenesis are described, e.g., in Arnold (1993) Current Opinion in Biotechnology 4:450-455.

In some aspects, the variants are created using shuffling procedures wherein portions of a plurality of nucleic acids which encode distinct polypeptides are fused together to create chimeric nucleic acid sequences which encode chimeric polypeptides as described in U.S. Pat. No. 5,965,408, filed Jul. 9, 1996, entitled, "Method of DNA Reassembly by Interrupting Synthesis" and U.S. Pat. No. 5,939,250, filed May 22, 1996, entitled, "Production of Enzymes Having Desired Activities by Mutagenesis.

The variants of the polypeptides of the invention may be variants in which one or more of the amino acid residues of the polypeptides of the sequences of the invention are substituted with a conserved or non-conserved amino acid residue (in one aspect a conserved amino acid residue) and such substituted amino acid residue may or may not be one encoded by the genetic code.

Conservative substitutions are those that substitute a given amino acid in a polypeptide by another amino acid of like characteristics. Typically seen as conservative substitutions are the following replacements: replacements of an aliphatic amino acid such as Alanine, Valine, Leucine and Isoleucine with another aliphatic amino acid; replacement of a Serine with a Threonine or vice versa; replacement of an acidic residue such as Aspartic acid and Glutamic acid with another acidic residue; replacement of a residue bearing an amide group, such as Asparagine and Glutamine, with another residue bearing an amide group; exchange of a basic residue such as Lysine and Arginine with another basic residue; and replacement of an aromatic residue such as Phenylalanine, Tyrosine with another aromatic residue.

Other variants are those in which one or more of the amino acid residues of a polypeptide of the invention includes a substituent group.

Still other variants are those in which the polypeptide is associated with another compound, such as a compound to increase the half-life of the polypeptide (for example, polyethylene glycol).

Additional variants are those in which additional amino acids are fused to the polypeptide, such as a leader sequence, a secretory sequence, a proprotein sequence or a sequence which facilitates purification, enrichment, or stabilization of the polypeptide.

In some aspects, the fragments, derivatives and analogs retain the same biological function or activity as the polypeptides of the invention. In other aspects, the fragment, derivative, or analog includes a proprotein, such that the fragment, derivative, or analog can be activated by cleavage of the proprotein portion to produce an active polypeptide.

Optimizing Codons to Achieve High Levels of Protein Expression in Host Cells

The invention provides methods for modifying polypeptide-, enzyme-, protein-, e.g. structural or binding protein-encoding nucleic acids to modify codon usage. In one aspect, the invention provides methods for modifying codons in a nucleic acid encoding a polypeptide, enzyme, protein, e.g. structural or binding protein, to increase or decrease its expression in a host cell. The invention also provides nucleic acids encoding a polypeptide, enzyme, protein, e.g. structural or binding protein, modified to increase its expression in a host cell, a polypeptide, enzyme, protein, e.g. structural or binding protein, so modified, and methods of making the modified a polypeptide, enzyme, protein, e.g. structural or binding protein. The method comprises identifying a "non-preferred" or a "less preferred" codon in a polypeptide-, enzyme-, protein-, e.g. structural or binding protein-encoding nucleic acid and replacing one or more of these non-preferred or less preferred codons with a "preferred codon" encoding the same amino acid as the replaced codon and at least one non-preferred or less preferred codon in the nucleic acid has been replaced by a preferred codon encoding the same amino acid. A preferred codon is a codon over-represented in coding sequences in genes in the host cell and a non-preferred or less preferred codon is a codon under-represented in coding sequences in genes in the host cell.

Host cells for expressing the nucleic acids, expression cassettes and vectors of the invention include bacteria, yeast, fungi, plant cells, insect cells and mammalian cells. Thus, the invention provides methods for optimizing codon usage in all of these cells, codon-altered nucleic acids and polypeptides made by the codon-altered nucleic acids. Exemplary host cells include gram negative bacteria, such as *Escherichia coli*; gram positive bacteria, such as *Streptomyces* sp., *Lactobacillus gasseri, Lactococcus lactis, Lactococcus cremoris, Bacillus subtilis, Bacillus cereus*. Exemplary host cells also include eukaryotic organisms, e.g., various yeast, such as *Saccharomyces* sp., including *Saccharomyces cerevisiae, Schizosaccharomyces pombe, Pichia pastoris*, and *Kluyveromyces lactis, Hansenula polymorpha, Aspergillus niger*, and mammalian cells and cell lines and insect cells and cell lines. Thus, the invention also includes nucleic acids and polypeptides optimized for expression in these organisms and species.

For example, the codons of a nucleic acid encoding a polypeptide, enzyme, protein, e.g. structural or binding protein, isolated from a bacterial cell are modified such that the nucleic acid is optimally expressed in a bacterial cell different from the bacteria from which the polypeptide, enzyme, protein, e.g. structural or binding protein was derived, a yeast, a fungi, a plant cell, an insect cell or a mammalian cell. Methods for optimizing codons are well known in the art, see, e.g., U.S. Pat. No. 5,795,737; Baca (2000) Int. J. Parasitol. 30:113-118; Hale (1998) Protein Expr. Purif. 12:185-188; Narum (2001) Infect. Immun. 69:7250-7253. See also Narum (2001) Infect. Immun. 69:7250-7253, describing optimizing codons in mouse systems; Outchkourov (2002) Protein Expr. Purif. 24:18-24, describing optimizing codons in yeast; Feng (2000) Biochemistry 39:15399-15409, describing optimizing codons in *E. coli*; Humphreys (2000) Protein Expr. Purif. 20:252-264, describing optimizing codon usage that affects secretion in *E. coli*.

Transgenic Non-Human Animals

The invention provides transgenic non-human animals comprising a nucleic acid, a polypeptide (e.g., a polypeptide, enzyme, protein, e.g. structural or binding protein), an expression cassette or vector or a transfected or transformed cell of the invention. The invention also provides methods of making and using these transgenic non-human animals.

The transgenic non-human animals can be, e.g., goats, rabbits, sheep, pigs (including all swine, hogs and related animals), cows, rats and mice, comprising the nucleic acids of the invention. These animals can be used, e.g., as in vivo models to study a polypeptide, enzyme, protein, e.g. structural or binding protein, activity, or, as models to screen for agents that change the polypeptide, enzyme, protein, e.g. structural or binding protein activity in vivo. The coding sequences for the polypeptides to be expressed in the transgenic non-human animals can be designed to be constitutive, or, under the control of tissue-specific, developmental-specific or inducible transcriptional regulatory factors. Transgenic non-human animals can be designed and generated using any method known in the art; see, e.g., U.S. Pat. Nos. 6,211,428; 6,187,992; 6,156,952; 6,118,044; 6,111,166; 6,107,541; 5,959,171; 5,922,854; 5,892,070; 5,880,327; 5,891,698; 5,639,940; 5,573,933; 5,387,742; 5,087,571, describing making and using transformed cells and eggs and transgenic mice, rats, rabbits, sheep, pigs and cows. See also, e.g., Pollock (1999) J. Immunol. Methods 231:147-157, describing the production of recombinant proteins in the milk of transgenic dairy animals; Baguisi (1999) Nat. Biotechnol. 17:456-461, demonstrating the production of transgenic goats. U.S. Pat. No. 6,211,428, describes making and using transgenic non-human mammals which express in their brains a nucleic acid construct comprising a DNA sequence. U.S. Pat. No. 5,387,742, describes injecting cloned recombinant or synthetic DNA sequences into fertilized mouse eggs, implanting the injected eggs in pseudo-pregnant females, and growing to term transgenic mice. U.S. Pat. No. 6,187,992, describes making and using a transgenic mouse.

"Knockout animals" can also be used to practice the methods of the invention. For example, in one aspect, the transgenic or modified animals of the invention comprise a "knockout animal," e.g., a "knockout mouse," engineered not to express an endogenous gene, which is replaced with a gene expressing a polypeptide, enzyme, protein, e.g. structural or binding protein, of the invention, or, a fusion protein comprising a polypeptide, enzyme, protein, e.g. structural or binding protein, of the invention.

Transgenic Plants and Seeds

The invention provides transgenic plants and seeds comprising a nucleic acid, a polypeptide (e.g., a polypeptide, enzyme, protein, e.g. structural or binding protein), an expression cassette or vector or a transfected or transformed cell of the invention. The invention also provides plant products, e.g., oils, seeds, leaves, extracts and the like, comprising a nucleic acid and/or a polypeptide (e.g., a polypeptide, enzyme, protein, e.g. structural or binding protein) of the invention. The transgenic plant can be dicotyledonous (a dicot) or monocotyledonous (a monocot). The invention also provides methods of making and using these transgenic plants and seeds. The transgenic plant or plant cell expressing a polypeptide of the present invention may be constructed in accordance with any method known in the art. See, for example, U.S. Pat. No. 6,309,872.

Nucleic acids and expression constructs of the invention can be introduced into a plant cell by any means. For example, nucleic acids or expression constructs can be introduced into the genome of a desired plant host, or, the nucleic acids or expression constructs can be episomes. Introduction into the genome of a desired plant can be such that the host's a polypeptide, enzyme, protein, e.g. structural or binding protein, production is regulated by endogenous transcriptional or translational control elements. The invention also provides "knockout plants" where insertion of gene sequence by, e.g., homologous recombination, has disrupted the expression of the endogenous gene. Means to generate "knockout" plants are well-known in the art, see, e.g., Strepp (1998) Proc Natl. Acad. Sci. USA 95:4368-4373; Miao (1995) Plant J 7:359-365. See discussion on transgenic plants, below.

The nucleic acids of the invention can be used to confer desired traits on essentially any plant, e.g., on starch-producing plants, such as potato, wheat, rice, barley, and the like. Nucleic acids of the invention can be used to manipulate metabolic pathways of a plant in order to optimize or alter host's expression of polypeptide, enzyme, protein, e.g. structural or binding protein. The can change a polypeptide, enzyme, protein, e.g. structural or binding protein, activity in a plant. Alternatively, a polypeptide, enzyme, protein, e.g. structural or binding protein, of the invention can be used in production of a transgenic plant to produce a compound not naturally produced by that plant. This can lower production costs or create a novel product.

In one aspect, the first step in production of a transgenic plant involves making an expression construct for expression in a plant cell. These techniques are well known in the art. They can include selecting and cloning a promoter, a coding sequence for facilitating efficient binding of ribosomes to mRNA and selecting the appropriate gene terminator sequences. One exemplary constitutive promoter is CaMV35S, from the cauliflower mosaic virus, which generally results in a high degree of expression in plants. Other promoters are more specific and respond to cues in the plant's internal or external environment. An exemplary light-inducible promoter is the promoter from the cab gene, encoding the major chlorophyll a/b binding protein.

In one aspect, the nucleic acid is modified to achieve greater expression in a plant cell. For example, a sequence of the invention is likely to have a higher percentage of A-T nucleotide pairs compared to that seen in a plant, some of which prefer G-C nucleotide pairs. Therefore, A-T nucleotides in the coding sequence can be substituted with G-C nucleotides without significantly changing the amino acid sequence to enhance production of the gene product in plant cells.

Selectable marker gene can be added to the gene construct in order to identify plant cells or tissues that have successfully integrated the transgene. This may be necessary because achieving incorporation and expression of genes in plant cells is a rare event, occurring in just a few percent of the targeted tissues or cells. Selectable marker genes encode proteins that provide resistance to agents that are normally toxic to plants, such as antibiotics or herbicides. Only plant cells that have integrated the selectable marker gene will survive when grown on a medium containing the appropriate antibiotic or herbicide. As for other inserted genes, marker genes also require promoter and termination sequences for proper function.

In one aspect, making transgenic plants or seeds comprises incorporating sequences of the invention and, optionally, marker genes into a target expression construct (e.g., a plasmid), along with positioning of the promoter and the terminator sequences. This can involve transferring the modified gene into the plant through a suitable method. For example, a construct may be introduced directly into the genomic DNA of the plant cell using techniques such as electroporation and microinjection of plant cell protoplasts, or the constructs can be introduced directly to plant tissue using ballistic methods, such as DNA particle bombardment. For example, see, e.g., Christou (1997) Plant Mol. Biol. 35:197-203; Pawlowski (1996) Mol. Biotechnol. 6:17-30; Klein (1987) Nature 327:70-73; Takumi (1997) Genes Genet. Syst. 72:63-69, discussing use of particle bombardment to introduce transgenes into wheat; and Adam (1997) supra, for use of particle bombardment to introduce YACs into plant cells. For example, Rinehart (1997) supra, used particle bombardment to generate transgenic cotton plants. Apparatus for accelerating particles is described U.S. Pat. No. 5,015,580; and, the commercially available BioRad (Biolistics) PDS-2000 particle acceleration instrument; see also, John, U.S. Pat. No. 5,608,148; and Ellis, U.S. Pat. No. 5,681,730, describing particle-mediated transformation of gymnosperms.

In one aspect, protoplasts can be immobilized and injected with a nucleic acids, e.g., an expression construct. Although plant regeneration from protoplasts is not easy with cereals, plant regeneration is possible in legumes using somatic embryogenesis from protoplast derived callus. Organized tissues can be transformed with naked DNA using gene gun technique, where DNA is coated on tungsten microprojectiles, shot 1/100 th the size of cells, which carry the DNA deep into cells and organelles. Transformed tissue is then induced to regenerate, usually by somatic embryogenesis. This technique has been successful in several cereal species including maize and rice.

Nucleic acids, e.g., expression constructs, can also be introduced in to plant cells using recombinant viruses. Plant cells can be transformed using viral vectors, such as, e.g., tobacco mosaic virus derived vectors (Rouwendal (1997) Plant Mol. Biol. 33:989-999), see Porta (1996) "Use of viral replicons for the expression of genes in plants," Mol. Biotechnol. 5:209-221.

Alternatively, nucleic acids, e.g., an expression construct, can be combined with suitable T-DNA flanking regions and introduced into a conventional *Agrobacterium tumefaciens* host vector. The virulence functions of the *Agrobacterium tumefaciens* host will direct the insertion of the construct and adjacent marker into the plant cell DNA when the cell is infected by the bacteria. *Agrobacterium tumefaciens*-mediated transformation techniques, including disarming and use of binary vectors, are well described in the scientific literature. See, e.g., Horsch (1984) Science 233:496-498; Fraley (1983) Proc. Natl. Acad. Sci. USA 80:4803 (1983); *Gene Transfer to Plants*, Potrykus, ed. (Springer-Verlag, Berlin 1995). The DNA in an *A. tumefaciens* cell is contained in the bacterial chromosome as well as in another structure known as a Ti (tumor-inducing) plasmid. The Ti plasmid contains a stretch of DNA termed T-DNA (~20 kb long) that is transferred to the plant cell in the infection process and a series of vir (virulence) genes that direct the infection process. *A. tumefaciens* can only infect a plant through wounds: when a plant root or stem is wounded it gives off certain chemical signals, in response to which, the vir genes of *A. tumefaciens* become activated and direct a series of events necessary for the transfer of the T-DNA from the Ti plasmid to the plant's chromosome. The T-DNA enters the plant cell through the wound. One speculation is that the T-DNA waits until the plant DNA is being replicated or transcribed, then inserts itself into the exposed plant DNA. In order to use *A. tumefaciens* as a transgene vector, the tumor-inducing section of T-DNA have to be removed, while retaining the T-DNA border regions and the vir genes. The transgene is then inserted between the T-DNA border regions, where it is transferred to the plant cell and becomes integrated into the plant's chromosomes.

The invention provides for the transformation of monocotyledonous plants using the nucleic acids of the invention, including important cereals, see Hiei (1997) Plant Mol. Biol. 35:205-218. See also, e.g., Horsch, Science (1984) 233:496; Fraley (1983) Proc. Natl. Acad. Sci. USA 80:4803; Thykjaer (1997) supra; Park (1996) Plant Mol. Biol. 32:1135-1148, discussing T-DNA integration into genomic DNA. See also D'Halluin, U.S. Pat. No. 5,712,135, describing a process for the stable integration of a DNA comprising a gene that is functional in a cell of a cereal, or other monocotyledonous plant.

In one aspect, the third step can involve selection and regeneration of whole plants capable of transmitting the incorporated target gene to the next generation. Such regeneration techniques rely on manipulation of certain phytohormones in a tissue culture growth medium, typically relying on a biocide and/or herbicide marker that has been introduced together with the desired nucleotide sequences. Plant regeneration from cultured protoplasts is described in Evans et al., *Protoplasts Isolation and Culture, Handbook of Plant Cell Culture*, pp. 124-176, MacMillilan Publishing Company, New York, 1983; and Binding, *Regeneration of Plants, Plant Protoplasts*, pp. 21-73, CRC Press, Boca Raton, 1985. Regeneration can also be obtained from plant callus, explants, organs, or parts thereof. Such regeneration techniques are described generally in Klee (1987) Ann. Rev. of Plant Phys. 38:467-486. To obtain whole plants from transgenic tissues such as immature embryos, they can be grown under controlled environmental conditions in a series of media containing nutrients and hormones, a process known as tissue culture. Once whole plants are generated and produce seed, evaluation of the progeny begins.

After the expression cassette is stably incorporated in transgenic plants, it can be introduced into other plants by sexual crossing. Any of a number of standard breeding techniques can be used, depending upon the species to be crossed. Since transgenic expression of the nucleic acids of the invention leads to phenotypic changes, plants comprising the recombinant nucleic acids of the invention can be sexually crossed with a second plant to obtain a final product. Thus, the seed of the invention can be derived from a cross between two transgenic plants of the invention, or a cross between a plant of the invention and another plant. The desired effects (e.g., expression of the polypeptides of the invention to produce a plant in which flowering behavior is altered) can be enhanced when both parental plants express the polypeptides (e.g., a polypeptide, enzyme, protein, e.g. structural or binding protein) of the invention. The desired effects can be passed to future plant generations by standard propagation means.

The nucleic acids and polypeptides of the invention are expressed in or inserted in any plant or seed. Transgenic plants of the invention can be dicotyledonous or monocotyledonous. Examples of monocot transgenic plants of the invention are grasses, such as meadow grass (blue grass, *Poa*), forage grass such as festuca, lolium, temperate grass, such as *Agrostis*, and cereals, e.g., wheat, oats, rye, barley, rice, sorghum, and maize (corn). Examples of dicot transgenic plants of the invention are tobacco, legumes, such as lupins, potato, sugar beet, pea, bean and soybean, and cruciferous plants (family Brassicaceae), such as cauliflower, rape seed, and the closely related model organism *Arabidopsis thaliana*. Thus, the transgenic plants and seeds of the invention include a broad range of plants, including, but not limited to, species from the genera *Anacardium, Arachis, Asparagus, Atropa, Avena, Brassica, Citrus, Citrullus, Capsicum, Carthamus, Cocos, Coffea, Cucumis, Cucurbita, Daucus, Elaeis, Fragaria, Glycine, Gossypium, Helianthus, Heterocallis, Hordeum, Hyoscyamus, Lactuca, Linum, Lolium, Lupinus, Lycopersicon, Malus, Manihot, Majorana, Medicago, Nicotiana, Olea, Oryza, Panieum, Pannisetum, Persea, Phaseolus, Pistachia, Pisum, Pyrus, Prunus, Raphanus, Ricinus, Secale, Senecio, Sinapis, Solanum, Sorghum, Theobromus, Trigonella, Triticum, Vicia, Vitis, Vigna*, and *Zea*.

In alternative embodiments, the nucleic acids of the invention are expressed in plants which contain fiber cells, including, e.g., cotton, silk cotton tree (Kapok, Ceiba pentandra), desert willow, creosote bush, winterfat, balsa, ramie, kenaf, hemp, roselle, jute, sisal abaca and flax. In alternative embodiments, the transgenic plants of the invention can be members of the genus *Gossypium*, including members of any *Gossypium* species, such as *G. arboreum, G. herbaceum, G. barbadense*, and *G. hirsutum*.

The invention also provides for transgenic plants to be used for producing large amounts of the polypeptides (e.g., a polypeptide, enzyme, protein, e.g. structural or binding protein, or antibody) of the invention. For example, see Palmgren (1997) Trends Genet. 13:348; Chong (1997) Transgenic Res. 6:289-296 (producing human milk protein beta-casein in transgenic potato plants using an auxin-inducible, bidirectional mannopine synthase (mas1',2') promoter with *Agrobacterium tumefaciens*-mediated leaf disc transformation methods).

Using known procedures, one of skill can screen for plants of the invention by detecting the increase or decrease of transgene mRNA or protein in transgenic plants. Means for detecting and quantitation of mRNAs or proteins are well known in the art.

Polypeptides and Peptides

In one aspect, the invention provides isolated or recombinant polypeptides having a sequence identity (e.g., at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity, or homology) to an exemplary sequence of the invention, e.g., proteins having a sequence as set forth in SEQ ID NO:2, SEQ ID NO:4, SEQ ID NO:6, SEQ ID NO:8, SEQ ID NO:10, etc., and all polypeptides disclosed in the SEQ ID listing, which include all even numbered SEQ ID NOs: from SEQ ID NO:2 through SEQ ID NO:26,898). The percent sequence identity can be over the full length of the polypeptide, or, the identity can be over a region of at least about 50, 60, 70, 80, 90, 100, 150, 200, 250, 300, 350, 400, 450, 500, 550, 600, 650, 700 or more residues.

"Amino acid" or "amino acid sequence" as used herein refer to an oligopeptide, peptide, polypeptide, or protein sequence, or to a fragment, portion, or subunit of any of these and to naturally occurring or synthetic molecules. "Amino acid" or "amino acid sequence" include an oligopeptide, peptide, polypeptide, or protein sequence, or to a fragment, portion, or subunit of any of these, and to naturally occurring or synthetic molecules. The term "polypeptide" as used herein, refers to amino acids joined to each other by peptide bonds or modified peptide bonds, i.e., peptide isosteres and may contain modified amino acids other than the 20 gene-encoded amino acids. The polypeptides may be modified by either natural processes, such as post-translational processing, or by chemical modification techniques which are well known in the art. Modifications can occur anywhere in the polypeptide, including the peptide backbone, the amino acid side-chains and the amino or carboxyl termini. It will be appreciated that the same type of modification may be present in the same or varying degrees at several sites in a given polypeptide. Also a given polypeptide may have many types of modifications. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of a phosphatidylinositol, cross-linking cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristolyation, oxidation, pegylation, glucan hydrolase processing, phosphorylation, prenylation, racemization, selenoylation, sulfation and transfer-RNA mediated addition of amino acids to protein such as arginylation. (See Creighton, T. E., Proteins—Structure and Molecular Properties 2nd Ed., W.H. Freeman and Company, New York (1993); *Posttranslational Covalent Modification of Proteins*, B. C. Johnson, Ed., Academic Press, New York, pp. 1-12 (1983)). The peptides and polypeptides of the invention also include all "mimetic" and "peptidomimetic" forms, as described in further detail, below.

As used herein, the term "isolated" means that the material is removed from its original environment (e.g., the natural environment if it is naturally occurring). For example, a naturally-occurring polynucleotide or polypeptide present in a living animal is not isolated, but the same polynucleotide or polypeptide, separated from some or all of the coexisting materials in the natural system, is isolated. Such polynucleotides could be part of a vector and/or such polynucleotides or polypeptides could be part of a composition and still be isolated in that such vector or composition is not part of its natural environment. As used herein, the term "purified" does not require absolute purity; rather, it is intended as a relative definition. Individual nucleic acids obtained from a library have been conventionally purified to electrophoretic homogeneity. The sequences obtained from these clones could not be obtained directly either from the library or from total human DNA. The purified nucleic acids of the invention have been purified from the remainder of the genomic DNA in the organism by at least 104-106 fold. However, the term "purified" also includes nucleic acids which have been purified from the remainder of the genomic DNA or from other sequences in a library or other environment by at least one order of magnitude, typically two or three orders and more typically four or five orders of magnitude.

"Recombinant" polypeptides or proteins refer to polypeptides or proteins produced by recombinant DNA techniques; i.e., produced from cells transformed by an exogenous DNA construct encoding the desired polypeptide or protein. "Synthetic" polypeptides or protein are those prepared by chemical synthesis. Solid-phase chemical peptide synthesis methods can also be used to synthesize the polypeptide or fragments of the invention. Such method have been known in the art since the early 1960's (Merrifield, R. B., *J. Am. Chem. Soc.*, 85:2149-2154, 1963) (See also Stewart, J. M. and Young, J. D., Solid Phase Peptide Synthesis, 2nd Ed., Pierce Chemical Co., Rockford, Ill., pp. 11-12)) and have recently been employed in commercially available laboratory peptide design and synthesis kits (Cambridge Research Biochemicals). Such commercially available laboratory kits have generally utilized the teachings of H. M. Geysen et al, *Proc. Natl. Acad. Sci., USA,* 81:3998 (1984) and provide for synthesizing peptides upon the tips of a multitude of "rods" or "pins" all of which are connected to a single plate.

Polypeptides of the invention can also be shorter than the full length of exemplary polypeptides. In alternative aspects, the invention provides polypeptides peptides, fragments) ranging in size between about 5 and the full length of a polypeptide, e.g., an enzyme, such as a polypeptide, enzyme, protein, e.g. structural or binding protein; exemplary sizes being of about 5, 10, 15, 20, 25, 30, 35, 40, 45, 50, 55, 60, 65, 70, 75, 80, 85, 90, 100, 125, 150, 175, 200, 250, 300, 350, 400, 450, 500, 550, 600, 650, 700, or more residues, e.g., contiguous residues of an exemplary a polypeptide, enzyme, protein, e.g. structural or binding protein, of the invention. Peptides of the invention (e.g., a subsequence of an exemplary polypeptide of the invention) can be useful as, e.g., labeling probes, antigens, toleragens, motifs, a polypeptide, enzyme, protein, e.g. structural or binding protein, active sites (e.g., "catalytic domains"), signal sequences and/or prepro domains.

In alternative aspects, polypeptides of the invention having enzyme, structural or binding activity are members of a genus of polypeptides sharing specific structural elements, e.g., amino acid residues, that correlate with enzyme, structural or binding activity. These shared structural elements can be used for the routine generation of polypeptide, enzyme, protein, e.g. structural or binding protein, variants. These shared structural elements of a polypeptide, enzyme, protein, e.g. structural or binding protein, of the invention can be used as guidance for the routine generation of a polypeptide, enzyme, protein, e.g. structural or binding protein, variants within the scope of the genus of polypeptides of the invention.

Polypeptides and peptides of the invention can be isolated from natural sources, be synthetic, or be recombinantly generated polypeptides. Peptides and proteins can be recombinantly expressed in vitro or in vivo. The peptides and polypeptides of the invention can be made and isolated using any method known in the art. Polypeptide and peptides of the invention can also be synthesized, whole or in part, using chemical methods well known in the art. See e.g., Caruthers (1980) Nucleic Acids Res. Symp. Ser. 215-223; Horn (1980) Nucleic Acids Res. Symp. Ser. 225-232; Banga, A. K., Therapeutic Peptides and Proteins, Formulation, Processing and Delivery Systems (1995) Technomic Publishing Co., Lancaster, Pa. For example, peptide synthesis can be performed using various solid-phase techniques (see e.g., Roberge (1995) Science 269:202; Merrifield (1997) Methods Enzymol. 289:3-13) and automated synthesis may be achieved, e.g., using the ABI 431A Peptide Synthesizer (Perkin Elmer) in accordance with the instructions provided by the manufacturer.

The peptides and polypeptides of the invention can also be glycosylated. The glycosylation can be added post-translationally either chemically or by cellular biosynthetic mechanisms, wherein the later incorporates the use of known glycosylation motifs, which can be native to the sequence or can be added as a peptide or added in the nucleic acid coding sequence. The glycosylation can be O-linked or N-linked.

The peptides and polypeptides of the invention, as defined above, include all "mimetic" and "peptidomimetic" forms. The terms "mimetic" and "peptidomimetic" refer to a synthetic chemical compound which has substantially the same structural and/or functional characteristics of the polypeptides of the invention. The mimetic can be either entirely composed of synthetic, non-natural analogues of amino acids, or, is a chimeric molecule of partly natural peptide amino acids and partly non-natural analogs of amino acids. The mimetic can also incorporate any amount of natural amino acid conservative substitutions as long as such substitutions also do not substantially alter the mimetic's structure and/or activity. As with polypeptides of the invention which are conservative variants or members of a genus of polypeptides of the invention (e.g., having about 50% or more sequence identity to an exemplary sequence of the invention), routine experimentation will determine whether a mimetic is within the scope of the invention, i.e., that its structure and/or function is not substantially altered. Thus, in one aspect, a mimetic composition is within the scope of the invention if it has a polypeptide, enzyme, protein, e.g. structural or binding protein's activity.

Polypeptide mimetic compositions of the invention can contain any combination of non-natural structural components. In alternative aspect, mimetic compositions of the invention include one or all of the following three structural groups: a) residue linkage groups other than the natural amide bond ("peptide bond") linkages; b) non-natural residues in place of naturally occurring amino acid residues; or c) residues which induce secondary structural mimicry, i.e., to induce or stabilize a secondary structure, e.g., a beta turn, gamma turn, beta sheet, alpha helix conformation, and the like. For example, a polypeptide of the invention can be characterized as a mimetic when all or some of its residues are joined by chemical means other than natural peptide bonds. Individual peptidomimetic residues can be joined by peptide bonds, other chemical bonds or coupling means, such as, e.g., glutaraldehyde, N-hydroxysuccinimide esters, bifunctional maleimides, N,N'-dicyclohexylcarbodiimide (DCC) or N,N'diisopropylcarbodiimide (DIC). Linking groups that can be an alternative to the traditional amide bond ("peptide bond") linkages include, e.g., ketomethylene (e.g., —C(=O)—CH$_2$— for —C(=O)—NH—), aminomethylene (CH$_2$—NH), ethylene, olefin (CH=CH), ether (CH$_2$—O), thioether (CH$_2$—S), tetrazole (CN$_4$—), thiazole, retroamide, thioamide, or ester (see, e.g., Spatola (1983) in Chemistry and Biochemistry of Amino Acids, Peptides and Proteins, Vol. 7, pp 267-357, "Peptide Backbone Modifications," Marcell Dekker, N.Y.).

A polypeptide of the invention can also be characterized as a mimetic by containing all or some non-natural residues in place of naturally occurring amino acid residues. Non-natural residues are well described in the scientific and patent literature; a few exemplary non-natural compositions useful as mimetics of natural amino acid residues and guidelines are described below. Mimetics of aromatic amino acids can be generated by replacing by, e.g., D- or L-naphylalanine; D- or L-phenylglycine; D- or L-2 thieneylalanine; D- or L-1, -2, 3-, or 4-pyreneylalanine; D- or L-3 thieneylalanine; D- or L-(2-pyridinyl)-alanine; D- or L-(3-pyridinyl)-alanine; D- or L-(2-pyrazinyl)-alanine; D- or L-(4-isopropyl)-phenylglycine; D-(trifluoromethyl)-phenylglycine; D-(trifluoromethyl)-phenylalanine; D-p-fluoro-phenylalanine; D- or L-p-biphenylphenylalanine; D- or L-p-methoxy-biphenylphenylalanine; D- or L-2-indole(alkyl)alanines; and, D- or L-alkylainines, where alkyl can be substituted or unsubstituted methyl, ethyl, propyl, hexyl, butyl, pentyl, isopropyl, iso-butyl, sec-isotyl, iso-pentyl, or a non-acidic amino acids. Aromatic rings of a non-natural amino acid include, e.g., thiazolyl, thiophenyl, pyrazolyl, benzimidazolyl, naphthyl, furanyl, pyrrolyl, and pyridyl aromatic rings.

Mimetics of acidic amino acids can be generated by substitution by, e.g., non-carboxylate amino acids while maintaining a negative charge; (phosphono)alanine; sulfated threonine. Carboxyl side groups (e.g., aspartyl or glutamyl) can also be selectively modified by reaction with carbodiimides (R'—N=C=N—R') such as, e.g., 1-cyclohexyl-3(2-morpholinyl-(4-ethyl) carbodiimide or 1-ethyl-3(4-azonia-4, 4-dimethylpentyl) carbodiimide. Aspartyl or glutamyl can also be converted to asparaginyl and glutaminyl residues by reaction with ammonium ions. Mimetics of basic amino acids can be generated by substitution with, e.g., (in addition to lysine and arginine) the amino acids ornithine, citrulline, or (guanidino)-acetic acid, or (guanidino)alkyl-acetic acid, where alkyl is defined above. Nitrile derivative (e.g., containing the CN-moiety in place of COOH) can be substituted for asparagine or glutamine. Asparaginyl and glutaminyl residues can be deaminated to the corresponding aspartyl or glutamyl residues. Arginine residue mimetics can be generated by reacting arginyl with, e.g., one or more conventional reagents, including, e.g., phenylglyoxal, 2,3-butanedione, 1,2-cyclo-hexanedione, or ninhydrin, in one aspect under alkaline conditions. Tyrosine residue mimetics can be generated by reacting tyrosyl with, e.g., aromatic diazonium compounds or tetranitromethane. N-acetylimidizol and tetranitromethane can be used to form O-acetyl tyrosyl species and 3-nitro derivatives, respectively. Cysteine residue mimetics can be generated by reacting cysteinyl residues with, e.g., alpha-haloacetates such as 2-chloroacetic acid or chloroacetamide and corresponding amines; to give carboxymethyl or carboxyamidomethyl derivatives. Cysteine residue mimetics can also be generated by reacting cysteinyl residues with, e.g., bromo-trifluoroacetone, alpha-bromo-beta-(5-imidozoyl) propionic acid; chloroacetyl phosphate, N-alkylmaleimides, 3-nitro-2-pyridyl disulfide; methyl 2-pyridyl disulfide; p-chloromercuribenzoate; 2-chloromercuri-4 nitrophenol; or, chloro-7-nitrobenzo-oxa-1,3-diazole. Lysine mimetics can be generated (and amino terminal residues can be altered) by reacting lysinyl with, e.g., succinic or other carboxylic acid anhydrides. Lysine and other alpha-amino-containing residue mimetics can also be generated by reaction with imidoesters, such as methyl picolinimidate, pyridoxal phosphate, pyridoxal, chloroborohydride, trinitro-benzene-sulfonic acid, O-methylisourea, 2,4, pentanedione, and transamidase-catalyzed reactions with glyoxylate. Mimetics of methionine can be generated by reaction with, e.g., methionine sulfoxide. Mimetics of proline include, e.g., pipecolic acid, thiazolidine carboxylic acid, 3- or 4-hydroxy proline, dehydroproline, 3- or 4-methylproline, or 3,3,-dimethylproline. Histidine residue mimetics can be generated by reacting histidyl with, e.g., diethylprocarbonate or para-bromophenacyl bromide. Other mimetics include, e.g., those generated by hydroxylation of proline and lysine; phosphorylation of the hydroxyl groups of seryl or threonyl residues; methylation of the alpha-amino groups of lysine, arginine and histidine; acetylation of the N-terminal amine; methylation of main chain amide residues or substitution with N-methyl amino acids; or amidation of C-terminal carboxyl groups.

A residue, e.g.; an amino acid, of a polypeptide of the invention can also be replaced by an amino acid (or peptidomimetic residue) of the opposite chirality. Thus, any amino acid naturally occurring in the L-configuration (which can also be referred to as the R or S, depending upon the structure of the chemical entity) can be replaced with the amino acid of the same chemical structural type or a peptidomimetic, but of the opposite chirality, referred to as the D-amino acid, but also can be referred to as the R- or S-form.

The invention also provides methods for modifying the polypeptides of the invention by either natural processes, such as post-translational processing (e.g., phosphorylation, acylation, etc), or by chemical modification techniques, and the resulting modified polypeptides. Modifications can occur anywhere in the polypeptide, including the peptide backbone, the amino acid side-chains and the amino or carboxyl termini. It will be appreciated that the same type of modification may be present in the same or varying degrees at several sites in a given polypeptide. Also a given polypeptide may have many types of modifications. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of a phosphatidylinositol, cross-linking cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristolyation, oxidation, pegylation, proteolytic processing, phosphorylation, prenylation, racemization, selenoylation, sulfation, and transfer-RNA mediated addition of amino acids to protein such as arginylation. See, e.g., Creighton, T. E., Proteins—Structure and Molecular Properties 2nd Ed., W.H. Freeman and Company, New York (1993); Posttranslational Covalent Modification of Proteins, B. C. Johnson, Ed., Academic Press, New York, pp. 1-12 (1983).

Solid-phase chemical peptide synthesis methods can also be used to synthesize the polypeptide or fragments of the invention. Such method have been known in the art since the early 1960's (Merrifield, R. B., J. Am. Chem. Soc., 85:2149-2154, 1963) (See also Stewart, J. M. and Young, J. D., Solid Phase Peptide Synthesis, 2nd Ed., Pierce Chemical Co., Rockford, Ill., pp. 11-12)) and have recently been employed in commercially available laboratory peptide design and synthesis kits (Cambridge Research Biochemicals). Such commercially available laboratory kits have generally utilized the teachings of H. M. Geysen et al, Proc. Natl. Acad. Sci., USA, 81:3998 (1984) and provide for synthesizing peptides upon the tips of a multitude of "rods" or "pins" all of which are connected to a single plate. When such a system is utilized, a plate of rods or pins is inverted and inserted into a second plate of corresponding wells or reservoirs, which contain solutions for attaching or anchoring an appropriate amino acid to the pin's or rod's tips. By repeating such a process step, i.e., inverting and inserting the rod's and pin's tips into appropriate solutions, amino acids are built into desired peptides. In addition, a number of available FMOC peptide synthesis systems are available. For example, assembly of a polypeptide or fragment can be carried out on a solid support using an Applied Biosystems, Inc. Model 431A™ automated peptide synthesizer. Such equipment provides ready access to the peptides of the invention, either by direct synthesis or by synthesis of a series of fragments that can be coupled using other known techniques.

The polypeptides of the invention include a polypeptide, enzyme, protein, e.g. structural or binding protein, in an active or inactive form. For example, the polypeptides of the invention include proproteins before "maturation" or processing of prepro sequences, e.g., by a proprotein-processing enzyme, such as a proprotein convertase to generate an "active" mature protein. The polypeptides of the invention include a polypeptide, enzyme, protein, e.g. structural or binding protein, inactive for other reasons, e.g., before "activation" by a post-translational processing event, e.g., an endo- or exo-peptidase or proteinase action, a phosphorylation event, an amidation, a glycosylation or a sulfation, a dimerization event, and the like. The polypeptides of the invention include all active forms, including active subsequences, e.g., catalytic domains or active sites, of the enzyme.

The invention includes immobilized polypeptides, enzymes, proteins, e.g. structural or binding proteins, anti-polypeptides, anti-enzymes, anti-proteins, e.g. anti-structural or anti-binding proteins, antibodies and fragments thereof. The invention provides methods for inhibiting a polypeptide, enzyme, protein, e.g. structural or binding protein, activity, e.g., using dominant negative mutants or anti-polypeptide, anti-enzyme, anti-protein, e.g. anti-structural or anti-binding protein antibodies of the invention. The invention includes heterocomplexes, e.g., fusion proteins, heterodimers, etc., comprising the polypeptide, enzyme, protein, e.g. structural or binding proteins of the invention.

Polypeptides of the invention can have an enzyme, structural or binding activity under various conditions, e.g., extremes in pH and/or temperature, oxidizing agents, and the like. The invention provides methods leading to alternative a polypeptide, enzyme, protein, e.g. structural or binding protein, preparations with different catalytic efficiencies and stabilities, e.g., towards temperature, oxidizing agents and changing wash conditions. In one aspect, a polypeptide, enzyme, protein, e.g. structural or binding protein, variants can be produced using techniques of site-directed mutagenesis and/or random mutagenesis. In one aspect, directed evolution can be used to produce a great variety of a polypeptide, enzyme, protein, e.g. structural or binding protein, variants with alternative specificities and stability.

The proteins of the invention are also useful as research reagents to identify a polypeptide, enzyme, protein, e.g. structural or binding protein, modulators, e.g., activators or inhibitors of a polypeptide, enzyme, protein, e.g. structural or binding protein, activity. Briefly, test samples (compounds, broths, extracts, and the like) are added to a polypeptide, enzyme, protein, e.g. structural or binding protein, assays to determine their ability to inhibit substrate cleavage. Inhibitors identified in this way can be used in industry and research to reduce or prevent undesired proteolysis. As with a polypeptide, enzyme, protein, e.g. structural or binding protein, inhibitors can be combined to increase the spectrum of activity.

The enzymes of the invention are also useful as research reagents to digest proteins or in protein sequencing. For example, the polypeptide, enzyme, protein, e.g. structural or binding proteins may be used to break polypeptides into smaller fragments for sequencing using, e.g. an automated sequencer.

The invention also provides methods of discovering new a polypeptide, enzyme, protein, e.g. structural or binding protein, using the nucleic acids, polypeptides and antibodies of the invention. In one aspect, phagemid libraries are screened for expression-based discovery of a polypeptide, enzyme, protein, e.g. structural or binding protein. In another aspect, lambda phage libraries are screened for expression-based discovery of a polypeptide, enzyme, protein, e.g. structural or binding protein. Screening of the phage or phagemid libraries can allow the detection of toxic clones; improved access to substrate; reduced need for engineering a host, by-passing the potential for any bias resulting from mass excision of the library; and, faster growth at low clone densities. Screening of phage or phagemid libraries can be in liquid phase or in solid phase. In one aspect, the invention provides screening in liquid phase. This gives a greater flexibility in assay conditions; additional substrate flexibility; higher sensitivity for weak clones; and ease of automation over solid phase screening.

The invention provides screening methods using the proteins and nucleic acids of the invention and robotic automation to enable the execution of many thousands of biocatalytic reactions and screening assays in a short period of time, e.g., per day, as well as ensuring a high level of accuracy and reproducibility (see discussion of arrays, below). As a result, a library of derivative compounds can be produced in a matter of weeks. For further teachings on modification of molecules, including small molecules, see PCT/US94/09174.

In one aspect, polypeptides or fragments of the invention may be obtained through biochemical enrichment or purification procedures. The sequence of potentially homologous polypeptides or fragments may be determined by a polypeptide, enzyme, protein, e.g. structural or binding protein, assays, gel electrophoresis and/or microsequencing. The sequence of the prospective polypeptide or fragment of the invention can be compared to an exemplary polypeptide of the invention, or a fragment, e.g., comprising at least about 5, 10, 15, 20, 25, 30, 35, 40, 50, 75, 100, or 150 or more consecutive amino acids thereof using any of the programs described above.

Another aspect of the invention is an assay for identifying fragments or variants of the invention, which retain the enzymatic function of the polypeptides of the invention. For example the fragments or variants of said polypeptides, may be used to catalyze biochemical reactions (e.g., production of a nootkatone from a valencene), which indicate that the fragment or variant retains the enzymatic activity of a polypeptide of the invention.

An exemplary assay for determining if fragments of variants retain the enzymatic activity of the polypeptides of the invention includes the steps of: contacting the polypeptide fragment or variant with a substrate molecule under conditions which allow the polypeptide fragment or variant to function and detecting either a decrease in the level of substrate or an increase in the level of the specific reaction product of the reaction between the polypeptide and substrate.

The present invention exploits the unique catalytic properties of enzymes. Whereas the use of biocatalysts (i.e., purified or crude enzymes, non-living or living cells) in chemical transformations normally requires the identification of a particular biocatalyst that reacts with a specific starting compound, the present invention uses selected biocatalysts and reaction conditions that are specific for functional groups that are present in many starting compounds, such as small molecules. Each biocatalyst is specific for one functional group, or several related functional groups and can react with many starting compounds containing this functional group.

The biocatalytic reactions produce a population of derivatives from a single starting compound. These derivatives can be subjected to another round of biocatalytic reactions to produce a second population of derivative compounds. Thousands of variations of the original small molecule or compound can be produced with each iteration of biocatalytic derivatization.

Enzymes react at specific sites of a starting compound without affecting the rest of the molecule, a process which is very difficult to achieve using traditional chemical methods. This high degree of biocatalytic specificity provides the means to identify a single active compound within the library. The library is characterized by the series of biocatalytic reactions used to produce it, a so-called "biosynthetic history". Screening the library for biological activities and tracing the biosynthetic history identifies the specific reaction sequence producing the active compound. The reaction sequence is repeated and the structure of the synthesized compound determined. This mode of identification, unlike other synthesis and screening approaches, does not require immobilization technologies and compounds can be synthesized and tested free in solution using virtually any type of screening assay. It is important to note, that the high degree of specificity of enzyme reactions on functional groups allows for the "tracking" of specific enzymatic reactions that make up the biocatalytically produced library.

Many of the procedural steps are performed using robotic automation enabling the execution of many thousands of biocatalytic reactions and screening assays per day as well as ensuring a high level of accuracy and reproducibility. As a result, a library of derivative compounds can be produced in a matter of weeks, which would take years to produce using current chemical methods.

In a particular aspect, the invention provides a method for modifying small molecules, comprising contacting a polypeptide encoded by a polynucleotide described herein or enzymatically active fragments thereof with a small molecule to produce a modified small molecule. A library of modified small molecules is tested to determine if a modified small molecule is present within the library, which exhibits a desired activity. A specific biocatalytic reaction which produces the modified small molecule of desired activity is identified by systematically eliminating each of the biocatalytic reactions used to produce a portion of the library and then testing the small molecules produced in the portion of the library for the presence or absence of the modified small molecule with the desired activity. The specific biocatalytic reactions which produce the modified small molecule of desired activity is optionally repeated. The biocatalytic reactions are conducted with a group of biocatalysts that react with distinct structural moieties found within the structure of a small molecule, each biocatalyst is specific for one structural moiety or a group of related structural moieties; and each biocatalyst reacts with many different small molecules which contain the distinct structural moiety.

A Polypeptide, Enzyme, Protein, e.g. Structural or Binding Protein, Signal Sequences, Prepro and Catalytic Domains The invention provides a polypeptide, enzyme, protein, e.g. structural or binding protein, signal sequences (e.g., signal peptides (SPs)), prepro domains and catalytic domains (CDs). The SPs, prepro domains and/or CDs of the invention can be isolated or recombinant peptides or can be part of a fusion protein, e.g., as a heterologous domain in a chimeric protein. The invention provides nucleic acids encoding these catalytic domains (CDs), prepro domains and signal sequences (SPs, e.g., a peptide having a sequence comprising/consisting of amino terminal residues of a polypeptide of the invention).

The invention provides isolated or recombinant signal sequences (e.g., signal peptides) consisting of or comprising a sequence as set forth in residues 1 to 14, 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 28, 1 to 30, 1 to 31, 1 to 32, 1 to 33, 1 to 34, 1 to 35, 1 to 36, 1 to 37, 1 to 38, 1 to 40, 1 to 41, 1 to 42, 1 to 43, 1 to 44, 1 to 45, 1 to 46, or 1 to 47, or more, of a polypeptide of the invention, e.g., SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, and all polypeptides disclosed in the SEQ ID listing, which include all odd numbered SEQ ID NOs: from SEQ ID NO:3 through SEQ ID NO:26,898. In one aspect, the invention provides signal sequences comprising the first 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70 or more amino terminal residues of a polypeptide of the invention.

The invention also provides isolated or recombinant signal sequences comprising/consisting of the signal sequences set forth in Table 4, and polypeptides comprising these signal sequences. The polypeptide can be enzyme or protein of the invention. For example, reading Table 4, the invention provides an isolated or recombinant signal sequence as set forth by residues 1 to 16 of SEQ ID NO:10010. This can be determined by reading the second column for the first row, "Probability: 0.992 AA1: 16 AA2: 17", wherein the cleavage of signal sequence takes place between amino acid 16 (AA16) and amino acid 17 (AA17), with a probability of 0.992 that this is the correct cleavage site. Therefore, the signal sequence is predicted to be from the amino acid in position 1 of SEQ ID NO:10010 up to and including the amino acid in position 16 of SEQ ID NO:10010. This signal sequence, in one aspect, is encoded by a subsequence of SEQ ID NO:10009.

TABLE 4

| SEQ ID NO: | Signalp Cleavage Site | Predicted Signal Sequence |
|---|---|---|
| 10009, 10010 | Probability: 0.992 AA1: 16 AA2: 17 | MKSYFLLLLFLLPLFA |
| 10111, 10112 | Probability: 0.964 AA1: 17 AA2: 18 | MKYIFIILVFLTTTLFA |
| 1013, 1014 | Probability: 0.584 AA1: 20 AA2: 21 | MKRVLLAIIGIILAIIVVVG |
| 10147, 10148 | Probability: 0.999 AA1: 19 AA2: 20 | MNKILIFIIISLFSLNISA |
| 10157, 10158 | Probability: 0.941 AA1: 19 AA2: 20 | MLKRIFILSLIAILICSNG |
| 10217, 10218 | Probability: 0.999 AA1: 18 AA2: 19 | MKKISILIIFILSTLTLS |
| 10309, 10310 | Probability: 0.994 AA1: 20 AA2: 21 | MRANLKKSYLIGLLLLFSLA |
| 10327, 10328 | Probability: 0.647 AA1: 16 AA2: 17 | MRYLFSLFIFTTLIFA |
| 10355, 10356 | Probability: 0.592 AA1: 19 AA2: 20 | MTKKVIVLSLIILLFINSS |
| 10441, 10442 | Probability: 0.683 AA1: 17 AA2: 18 | MKRTFLTITAAAFILVG |
| 10447, 10448 | Probability: 0.928 AA1: 17 AA2: 18 | MKNKLIILFIFSLFLLA |
| 10525, 10526 | Probability: 0.728 AA1: 16 AA2: 17 | MRVLFFIFISLTTLFA |
| 10537, 10538 | Probability: 0.998 AA1: 17 AA2: 18 | MKKIILLSTLLFLALNA |
| 10543, 10544 | Probability: 0.991 AA1: 17 AA2: 18 | MKRKWFIFILTALVTIA |
| 10591, 10592 | Probability: 0.922 AA1: 17 AA2: 18 | MFKLLIGIFIFISVAYS |
| 10659, 10660 | Probability: 0.967 AA1: 20 AA2: 21 | MKDVIIIGAGGAGLSAGLSA |
| 10673, 10674 | Probability: 0.711 AA1: 19 AA2: 20 | MKIWSTIKLVFISLVALVA |
| 10711, 10712 | Probability: 0.876 AA1: 16 AA2: 17 | MMKGISPGAALVFLMA |
| 10731, 10732 | Probability: 0.997 AA1: 19 AA2: 20 | MLKLLMITILLSTSGVANS |
| 1079, 1080 | Probability: 0.929 AA1: 17 AA2: 18 | MRIIKLFALFFLTCACN |
| 10915, 10916 | Probability: 0.934 AA1: 17 AA2: 18 | MKSRLLLSGFFIFVLMS |
| 11047, 11048 | Probability: 0.530 AA1: 16 AA2: 17 | MPEAAFSMSLPSKVFA |
| 1109, 1110 | Probability: 0.777 AA1: 18 AA2: 19 | MKVLLYILILFSGFKSFG |
| 1111, 1112 | Probability: 0.765 AA1: 18 AA2: 19 | MKVLLYILILFSGFKSFG |
| 1119, 1120 | Probability: 0.870 AA1: 18 AA2: 19 | MKKLFLILCIFFSVESFS |
| 11209, 11210 | Probability: 0.910 AA1: 19 AA2: 20 | MKQIILLFSILFIVGKSYS |
| 11253, 11254 | Probability: 0.987 AA1: 19 AA2: 20 | MKNIFFFSILLFLSFTGKA |
| 11339, 11340 | Probability: 0.510 AA1: 19 AA2: 20 | MLKSISLFILITIVTGCSV |
| 1137, 1138 | Probability: 0.992 AA1: 18 AA2: 19 | MKILTIVFLVGFFCFVQA |
| 11401, 11402 | Probability: 0.992 AA1: 19 AA2: 20 | MTISKNKLLIASLLSVAFT |
| 11495, 11496 | Probability: 0.647 AA1: 16 AA2: 17 | MRYLFSLFIFTTLIFA |
| 11719, 11720 | Probability: 0.998 AA1: 17 AA2: 18 | MKIILLIFFLLLSFSFA |
| 11745, 11746 | Probability: 0.972 AA1: 18 AA2: 19 | MKYKIIFIAAFMAFSTLV |
| 1177, 1178 | Probability: 0.995 AA1: 20 AA2: 21 | MDQKKSLSLLFLIPAVSVIA |
| 11821, 11822 | Probability: 0.663 AA1: 18 AA2: 19 | MSNKSV1STLIISIFFTA |
| 11827, 11828 | Probability: 0.727 AA1: 19 AA2: 20 | MYVMKILLLISILFYCLLA |
| 11935, 11936 | Probability: 1.000 AA1: 20 AA2: 21 | MKKTILIIASLFVAAFIGQA |
| 11965, 11966 | Probability: 0.999 AA1: 19 AA2: 20 | MKKILVLSVLLTVCLISFA |
| 12071, 12072 | Probability: 0.773 AA1: 19 AA2: 20 | MNKELLSFFSIFIALFVGA |

TABLE 4-continued

| SEQ ID NO: | Signalp Cleavage Site | Predicted Signal Sequence |
|---|---|---|
| 12157, 12158 | Probability: 0.983  AA1: 16  AA2: 17 | MRLLLLLSLLVYTVFA |
| 12377, 12378 | Probability: 0.562  AA1: 15  AA2: 16 | MASTTMIVSLIVAVA |
| 12709, 12710 | Probability: 0.993  AA1: 18  AA2: 19 | MNNLKQILAIVMLLSVTA |
| 13005, 13006 | Probability: 0.977  AA1: 20  AA2: 21 | MFLRRLSILILLLFVFFTAK |
| 13017, 13018 | Probability: 0.995  AA1: 17  AA2: 18 | MFKNIIMSLLLGTFLSA |
| 13139, 13140 | Probability: 0.849  AA1: 17  AA2: 18 | MRVVVLVLFSLLHFLFA |
| 13307, 13308 | Probability: 0.995  AA1: 19  AA2: 20 | MKKLILLLILGFSTNLIFS |
| 13347, 13348 | Probability: 0.788  AA1: 18  AA2: 19 | MLLILLICAVYSVGCALA |
| 1343, 1344 | Probability: 0.708  AA1: 18  AA2: 19 | MKSLIIIFSLILFFTACK |
| 13475, 13476 | Probability: 0.998  AA1: 17  AA2: 18 | MKIILLIFFLLLSFSFA |
| 13531, 13532 | Probability: 0.651  AA1: 17  AA2: 18 | MSHLLFSTSVLILLWS |
| 13543, 13544 | Probability: 0.995  AA1: 19  AA2: 20 | MKFILTTLMMAYLILPGMA |
| 13603, 13604 | Probability: 0.734  AA1: 18  AA2: 19 | MNFKNILYSLLISGCLYG |
| 13607, 13608 | Probability: 0.840  AA1: 19  AA2: 20 | MKKIILSLGVATLLLTTNL |
| 13699, 13700 | Probability: 0.544  AA1: 21  AA2: 22 | MMKLHTLISLIFAVLMFIFCM |
| 13711, 13712 | Probability: 0.815  AA1: 20  AA2: 21 | MSNKSVISTLIISIFFTACT |
| 13719, 13720 | Probability: 1.000  AA1: 20  AA2: 21 | MKLTKIITVFMMVFSLSLMA |
| 13777, 13778 | Probability: 0.682  AA1: 19  AA2: 20 | MKSMRTIFISFLIILLLQG |
| 13829, 13830 | Probability: 0.940  AA1: 19  AA2: 20 | MKNLGLILLVLFLGLISTS |
| 13891, 13892 | Probability: 0.993  AA1: 16  AA2: 17 | MKYFLLLLIITTLNA |
| 13915, 13916 | Probability: 1.000  AA1: 20  AA2: 21 | MKKFFLALFLTSIVTISIAA |
| 13933, 13934 | Probability: 0.962  AA1: 19  AA2: 20 | MFMNKKVYISLITALVVNA |
| 14081, 14082 | Probability: 0.918  AA1: 18  AA2: 19 | MTYLFLAIAIGLITAASK |
| 14133, 14134 | Probability: 0.989  AA1: 20  AA2: 21 | MNNLIKLILLITLSFSSLLS |
| 14197, 14198 | Probability: 0.995  AA1: 18  AA2: 19 | MKKITLILFAIFTALSMS |
| 14267, 14268 | Probability: 0.815  AA1: 20  AA2: 21 | MSNKSVISTLIISIFFTACT |
| 14369, 14370 | Probability: 0.669  AA1: 17  AA2: 18 | MKKYIIIFCIFSGFLYG |
| 14505, 14506 | Probability: 0.951  AA1: 20  AA2: 21 | MIRFGSSSSSILYFFRNTMA |
| 14573, 14574 | Probability: 0.992  AA1: 19  AA2: 20 | MLRWFILLISVIVCLNVNA |
| 1461, 1462 | Probability: 0.908  AA1: 19  AA2: 20 | MKKFLIFCLFLFLNKPLIS |
| 14655, 14656 | Probability: 0.773  AA1: 22  AA2: 23 | MAQAVAISIAFFSVLLSLLLFN |
| 14705, 14706 | Probability: 0.599  AA1: 21  AA2: 22 | MGGLIAIIILSSRTVAPLGQA |
| 14835, 14836 | Probability: 0.999  AA1: 17  AA2: 18 | MVKKLLFLALAFSISFA |
| 14857, 14858 | Probability: 1.000  AA1: 21  AA2: 22 | MIRQKIVLTMLLFCFSLITVA |
| 14863, 14864 | Probability: 0.990  AA1: 17  AA2: 18 | MRKYFLVLLLFCTSLLS |
| 15045, 15046 | Probability: 0.984  AA1: 21  AA2: 22 | MKNIILSTLAFVLALFFSGCT |
| 15049, 15050 | Probability: 0.845  AA1: 19  AA2: 20 | MNFFIMPFLLMFLFIGIFA |
| 15055, 15056 | Probability: 0.669  AA1: 15  AA2: 16 | MKFNLNSFLMSVSLA |
| 15111, 15112 | Probability: 0.835  AA1: 17  AA2: 18 | MIKRLFSIVLSLGLVFN |

TABLE 4-continued

| SEQ ID NO: | Signalp Cleavage Site | Predicted Signal Sequence |
|---|---|---|
| 15135, 15136 | Probability: 0.853 AA1: 15 AA2: 16 | MKYLLALCIFLLLTG |
| 15173, 15174 | Probability: 0.513 AA1: 19 AA2: 20 | MKKLNVAIYIVIVILSLFS |
| 15179, 15180 | Probability: 0.645 AA1: 16 AA2: 17 | MRYLFSLFIFTTLIPA |
| 15201, 15202 | Probability: 0.883 AA1: 20 AA2: 21 | MKLLGIGSILLQVLLCSVSA |
| 15235, 15236 | Probability: 0.792 AA1: 19 AA2: 20 | MNFKQLFLSVLLILTIVLS |
| 15251, 15252 | Probability: 0.998 AA1: 17 AA2: 18 | MKIILLIFFLLLSFSFA |
| 153, 154 | Probability: 0.824 AA1: 20 AA2: 21 | MIKTIXSLARCIIAFGILNA |
| 15329, 15330 | Probability: 0.557 AA1: 20 AA2: 21 | MKNIYKIILLSLLIISIILG |
| 1541, 1542 | Probability: 1.000 AA1: 19 AA2: 20 | MKRNSLLLVLLALSLFTAA |
| 15473, 15474 | Probability: 0.934 AA1: 19 AA2: 20 | MRGTICSILILSFIFLITA |
| 15475, 15476 | Probability: 0.934 AA1: 20 AA2: 21 | MAAGDFFAIFGIFMSLSLLA |
| 15495, 15496 | Probability: 0.645 AA1: 16 AA2: 17 | MRYLFSLFIFTTLIFA |
| 15521, 15522 | Probability: 0.972 AA1: 18 AA2: 19 | MIKVSIYIVLLLTSYIHA |
| 15585, 15586 | Probability: 0.993 AA1: 16 AA2: 17 | MKLLLLLFLVLLNVNA |
| 15589, 15590 | Probability: 0.967 AA1: 17 AA2: 18 | MNKKILILMIILGLAVA |
| 15623, 15624 | Probability: 0.553 AA1: 18 AA2: 19 | MSSRVFLTSFLIIVPLTA |
| 15635, 15636 | Probability: 1.000 AA1: 19 AA2: 20 | MKNILSIALAVLMIGSLHS |
| 15659, 15660 | Probability: 1.000 AA1: 20 AA2: 21 | MYKFITALISLFLLTTHSYA |
| 15697, 15698 | Probability: 0.561 AA1: 18 AA2: 19 | MISIKTAIAIILVIVATN |
| 15765, 15766 | Probability: 0.936 AA1: 18 AA2: 19 | MKFHKSLLLLLLLSFIVS |
| 15783, 15784 | Probability: 0.951 AA1: 20 AA2: 21 | MKIAVLGAGISGLGSAYLLS |
| 1585, 1586 | Probability: 0.668 AA1: 19 AA2: 20 | MMFFTSISIXSXFPXIXLX |
| 15855, 15856 | Probability: 0.677 AA1: 18 AA2: 19 | MKKLKLILGSVLSIVAFT |
| 15873, 15874 | Probability: 0.784 AA1: 16 AA2: 17 | MIFFFIFVILFTFSVA |
| 15907, 15908 | Probability: 0.998 AA1: 20 AA2: 21 | MSLKKYIFILTFLFISNLFA |
| 15909, 15910 | Probability: 0.935 AA1: 20 AA2: 21 | MKQKLLKITLLTTLLTSAIA |
| 16005, 16006 | Probability: 0.932 AA1: 20 AA2: 21 | MLKNLKNILFFLFFLIFCLN |
| 16015, 16016 | Probability: 0.541 AA1: 16 AA2: 17 | MIIIAISALIATTIIA |
| 16171, 16172 | Probability: 0.985 AA1: 20 AA2: 21 | MKLNLGKIFLLLIFPIITFA |
| 16175, 16176 | Probability: 0.957 AA1: 17 AA2: 18 | MMKTFIVFCVMSISIFA |
| 16183, 16184 | Probability: 0.999 AA1: 20 AA2: 21 | MKLISKILLILAIITSGVLS |
| 16237, 16238 | Probability: 0.792 AA1: 19 AA2: 20 | MNFKQLFLSVLLILTIVLS |
| 16289, 16290 | Probability: 0.995 AA1: 16 AA2: 17 | MRISILLAVVSSIIFA |
| 163, 164 | Probability: 0.860 AA1: 20 AA2: 21 | MQINRLIVLLLIMISHKNFA |
| 1633, 1634 | Probability: 0.993 AA1: 19 AA2: 20 | MKIYVILALLIFSSRSIYS |
| 16339, 16340 | Probability: 1.000 AA1: 18 AA2: 19 | MKKLLLIYILLLSTITFA |
| 16345, 16346 | Probability: 0.776 AA1: 19 AA2: 20 | MGNIKVILVFISLFLIAIT |
| 16373, 16374 | Probability: 0.995 AA1: 16 AA2: 17 | MRISILLAVVSSIIFA |
| 1641, 1642 | Probability: 0.879 AA1: 18 AA2: 19 | MKKFILFLGFFYLISFFA |

TABLE 4-continued

| SEQ ID NO: | Signalp Cleavage Site | Predicted Signal Sequence |
|---|---|---|
| 16455, 16456 | Probability: 0.890 AA1: 19 AA2: 20 | MKKFNIKLIIIFISSLFLA |
| 16467, 16468 | Probability: 0.681 AA1: 20 AA2: 21 | MERRLFLKGATILASSAVIA |
| 1647, 1648 | Probability: 0.812 AA1: 20 AA2: 21 | MRLKLSLLILLLFSGINGIA |
| 16487, 16488 | Probability: 0.987 AA1: 19 AA2: 20 | MRIFNYLIMSILLSVTLMA |
| 1669, 1670 | Probability: 0.999 AA1: 18 AA2: 19 | MRATFIVLSVLLTSSVMS |
| 16711, 16712 | Probability: 0.626 AA1: 17 AA2: 18 | MFKTILFTFILITNIFS |
| 16747, 16748 | Probability: 0.628 AA1: 19 AA2: 20 | MKNIFFLFIAVLILSNCKN |
| 16825, 16826 | Probability: 0.975 AA1: 18 AA2: 19 | MFKKALLVFYIFLGITMA |
| 16833, 16834 | Probability: 0.857 AA1: 20 AA2: 21 | MNNKTKIFLPILLAMAIVLG |
| 16885, 16886 | Probability: 0.993 AA1: 16 AA2: 17 | MKLLLLLFLVLLNVNA |
| 16967, 16968 | Probability: 0.888 AA1: 20 AA2: 21 | MKPTKLLFGLFILIFTFTTS |
| 17035, 17036 | Probability: 0.977 AA1: 16 AA2: 17 | MMKKYIIALISTFLYA |
| 17065, 17066 | Probability: 0.982 AA1: 17 AA2: 18 | MKHFLLCSVLLLGVLDA |
| 171, 172 | Probability: 0.956 AA1: 21 AA2: 22 | MKRIIYIILLPSVAVILSSCT |
| 17157, 17158 | Probability: 0.952 AA1: 16 AA2: 17 | MKILLIVILFISSLFS |
| 17331, 17332 | Probability: 0.981 AA1: 17 AA2: 18 | MLKKLLILTFITTISFA |
| 17347, 17348 | Probability: 0.999 AA1: 16 AA2: 17 | MSKIILILSFLIANA |
| 17353, 17354 | Probability: 0.993 AA1: 20 AA2: 21 | MKLKYLLIIIITLGQFVIA |
| 17359, 17360 | Probability: 0.932 AA1: 19 AA2: 20 | MKIKHFILLFLFSLIALYS |
| 17367, 17368 | Probability: 0.912 AA1: 20 AA2: 21 | MKKSKILFLLLTLLIIMGIG |
| 1749, 1750 | Probability: 0.990 AA1: 18 AA2: 19 | MNRIFLIVVLFISSTCFS |
| 17537, 17538 | Probability: 0.999 AA1: 17 AA2: 18 | MKFFF1LLILFMFNALS |
| 17547, 17548 | Probability: 0.959 AA1: 19 AA2: 20 | MKNIITIYLFMLMSLFLLS |
| 1771, 1772 | Probability: 0.931 AA1: 20 AA2: 21 | MVMKSILGIVSFLIGLSLIA |
| 17751, 17752 | Probability: 0.561 AA1: 18 AA2: 19 | MKYLLILILLVFTGCNNV |
| 17783, 17784 | Probability: 0.987 AA1: 19 AA2: 20 | MTKIKVVGLLVLILSIALA |
| 1785, 1786 | Probability: 0.716 AA1: 17 AA2: 18 | MKLLSATFFMWFSVIS |
| 17915, 17916 | Probability: 0.898 AA1: 17 AA2: 18 | MVKIFLSIILFVNIVFA |
| 18019, 18020 | Probability: 0.993 AA1: 18 AA2: 19 | MKKITFLLILFVTTFSFS |
| 18039, 18040 | Probability: 0.867 AA1: 19 AA2: 20 | MQKVILTLVCIITSFFFQA |
| 18057, 18058 | Probability: 0.874 AA1: 19 AA2: 20 | MRFLFVLFTFLIFSCSKNS |
| 18131, 18132 | Probability: 1.000 AA1: 19 AA2: 20 | MKKTQIILLLILLSMASHA |
| 18237, 18238 | Probability: 0.975 AA1: 18 AA2: 19 | MKKVLIFYCVLFSLQGFS |
| 18249, 18250 | Probability: 0.719 AA1: 18 AA2: 19 | MKTKTLLTVLTILFSLQS |
| 18329, 18330 | Probability: 0.988 AA1: 17 AA2: 18 | MSKLAVLFLFLFLACNN |
| 18377, 18378 | Probability: 0.983 AA1: 18 AA2: 19 | MKKARIIILSFFIGMVAA |
| 18403, 18404 | Probability: 1.000 AA1: 19 AA2: 20 | MKKTILVLICLFSISALFA |
| 18435, 18436 | Probability: 0.611 AA1: 19 AA2: 20 | MKIGFILILSIAICTSCKV |
| 18489, 18490 | Probability: 0.914 AA1: 17 AA2: 18 | MKKLTYLFLSITLLSFG |

TABLE 4-continued

| SEQ ID NO: | Signalp Cleavage Site | Predicted Signal Sequence |
|---|---|---|
| 18495, 18496 | Probability: 0.627 AA1: 19 AA2: 20 | MKNSIAFLFLSLLIFTGCK |
| 18507, 18508 | Probability: 0.783 AA1: 20 AA2: 21 | MKKIYLILASTIVLASCGNK |
| 1851, 1852 | Probability: 0.998 AA1: 18 AA2: 19 | MKKFLAIFLFFIAFHGNA |
| 18529, 18530 | Probability: 0.999 AA1: 19 AA2: 20 | MKKNTILLFGIVLVFAAYG |
| 18587, 18588 | Probability: 0.956 AA1: 19 AA2: 20 | MSFFKPSFVLFFGLLGLHG |
| 18607, 18608 | Probability: 0.636 AA1: 18 AA2: 19 | MHGLHSIFSLLFLCTLSA |
| 18713, 18714 | Probability: 1.000 AA1: 18 AA2: 19 | MKKTLLLFLFLSTLVVQA |
| 18747, 18748 | Probability: 0.985 AA1: 18 AA2: 19 | MKKIIYIFVILLSVSVSG |
| 18825, 18826 | Probability: 0.999 AA1: 18 AA2: 19 | MKFILLAFFTLISNYALS |
| 18841, 18842 | Probability: 1.000 AA1: 19 AA2: 20 | MLKSAIFLVLLSLVGSAFG |
| 18919, 18920 | Probability: 0.995 AA1: 20 AA2: 21 | MHIFLKSFILFIFLSFILQA |
| 18921, 18922 | Probability: 0.998 AA1: 18 AA2: 19 | MKNLIVLIFVVLTQLSVA |
| 18957, 18958 | Probability: 0.719 AA1: 18 AA2: 19 | MKTKTLLTVLTILFSLQS |
| 18971, 18972 | Probability: 0.775 AA1: 17 AA2: 18 | MKKLIALFFLCILISCN |
| 18977, 18978 | Probability: 1.000 AA1: 17 AA2: 18 | MKKLFLLILMLPFSLLA |
| 19079, 19080 | Probability: 0.895 AA1: 19 AA2: 20 | MKFFSALLILTLVITSCKS |
| 19143, 19144 | Probability: 0.610 AA1: 18 AA2: 19 | MKKNQLSFLLLVFLISNT |
| 1919, 1920 | Probability: 0.996 AA1: 19 AA2: 20 | MKTLIFFLILFFGSIPSYS |
| 19211, 19212 | Probability: 0.517 AA1: 19 AA2: 20 | MFNKKQAITLFSGLLFCFT |
| 19265, 19266 | Probability: 1.000 AA1: 19 AA2: 20 | MKKTILVLICLFSISALFA |
| 19277, 19278 | Probability: 0.945 AA1: 19 AA2: 20 | MKFTSYLFFLFFIFMNCTA |
| 19385, 19386 | Probability: 0.835 AA1: 18 AA2: 19 | MKKIIPYILSCMLLSLAA |
| 19391, 19392 | Probability: 0.999 AA1: 19 AA2: 20 | MKSFLTILFSLFLTGSINS |
| 19421, 19422 | Probability: 0.998 AA1: 20 AA2: 21 | MRKHQLLILIILMLTSVSNS |
| 19467, 19468 | Probability: 0.994 AA1: 20 AA2: 21 | MSNYLLSVILLAFILASCST |
| 19475, 19476 | Probability: 0.998 AA1: 19 AA2: 20 | MKIRFYLSALFACLLFASS |
| 19527, 19528 | Probability: 0.998 AA1: 17 AA2: 18 | MKKILLLLPLISILSYA |
| 19535, 19536 | Probability: 0.596 AA1: 20 AA2: 21 | MKSIKKLFIFIFLIILVVYL |
| 1955, 1956 | Probability: 1.000 AA1: 19 AA2: 20 | MRKIYGLLAFCLLMNTAKA |
| 19563, 19564 | Probability: 0.940 AA1: 20 AA2: 21 | MKNSIAFLFLSLLIFTGCKS |
| 19657, 19658 | Probability: 0.994 AA1: 20 AA2: 21 | MIAKKITLLILFVFNQYVIA |
| 19733, 19734 | Probability: 0.938 AA1: 20 AA2: 21 | MNITIIGSGYVGLVSGTCFA |
| 19785, 19786 | Probability: 0.936 AA1: 19 AA2: 20 | MRTLSFLIVTFSVLISGCA |
| 19797, 19798 | Probability: 1.000 AA1: 18 AA2: 19 | MKTALFILFCTLGQMSLA |
| 19915, 19916 | Probability: 0.999 AA1: 17 AA2: 18 | MKKLILLFLFNSNLFA |
| 19919, 19920 | Probability: 0.676 AA1: 20 AA2: 21 | MRISVFFYISLFIISSTKFS |
| 19953, 19954 | Probability: 1.000 AA1: 19 AA2: 20 | MKKFLLLFVLPLLAISGFA |
| 19993, 19994 | Probability: 0.575 AA1: 20 AA2: 21 | MRTTLKRIAFLFFFSFLIFS |
| 20001, 20002 | Probability: 0.674 AA1: 18 AA2: 19 | MKKIIFLLVTLIIFNSCK |

TABLE 4-continued

| SEQ ID NO: | Signalp Cleavage Site | Predicted Signal Sequence |
|---|---|---|
| 2003, 2004 | Probability: 1.000 AA1: 18 AA2: 19 | MKVRYLLAFLIISSASLA |
| 20069, 20070 | Probability: 1.000 AA1: 20 AA2: 21 | MKIKIRCLLIFLTLSPFVQA |
| 20083, 20084 | Probability: 0.637 AA1: 20 AA2: 21 | MILGLLLFALIAIVFLFLLK |
| 20111, 20112 | Probability: 1.000 AA1: 19 AA2: 20 | MRKILFTCFLLILSLFSYA |
| 20143, 20144 | Probability: 0.946 AA1: 17 AA2: 18 | MKKFIFSVLTLLLVGLS |
| 20161, 20162 | Probability: 0.602 AA1: 19 AA2: 20 | MKSIIYMAALIILSVKGTS |
| 20187, 20188 | Probability: 0.585 AA1: 20 AA2: 21 | MKPMRNLLFLIVLIANTSLL |
| 20225, 20226 | Probability: 1.000 AA1: 20 AA2: 21 | MLQKTILVLLFLLTTSNSFS |
| 20229, 20230 | Probability: 0.522 AA1: 20 AA2: 21 | MKFIINPILILLAVIILSLN |
| 20253, 20254 | Probability: 0.906 AA1: 20 AA2: 21 | MKTILRLTICGLILLNASLA |
| 203, 204 | Probability: 0.824 AA1: 19 AA2: 20 | MENKMKRLLTIFVFLIVFS |
| 20301, 20302 | Probability: 0.675 AA1: 19 AA2: 20 | MIRIISFLLPLLFFLNCQK |
| 20309, 20310 | Probability: 0.989 AA1: 19 AA2: 20 | MKMKFTFLLLIISTIS1YG |
| 20349, 20350 | Probability: 0.967 AA1: 19 AA2: 20 | MKKHLLFFLTTILSISGYS |
| 20371, 20372 | Probability: 0.605 AA1: 18 AA2: 19 | MNKLISIVLVCITLMSTG |
| 2045, 2046 | Probability: 0.906 AA1: 20 AA2: 21 | MKKHLFITALLMLTVINYTG |
| 20485, 20486 | Probability: 0.951 AA1: 17 AA2: 18 | MKNLFLFLTILSLSCMQ |
| 20487, 20488 | Probability: 0.951 AA1: 17 AA2: 18 | MKNLFLFLTILSLSCMQ |
| 20531, 20532 | Probability: 0.895 AA1: 19 AA2: 20 | MFSFLGVILIAFFGFIGFS |
| 20569, 20570 | Probability: 0.819 AA1: 19 AA2: 20 | MKILLRISLLLITTISCTS |
| 20571, 20572 | Probability: 0.819 AA1: 19 AA2: 20 | MKILLRISLLLITTISCTS |
| 20665, 20666 | Probability: 0.989 AA1: 18 AA2: 19 | MRKKIFLVLIILMSLSLG |
| 2071, 2072 | Probability: 0.994 AA1: 19 AA2: 20 | MKKIVSILVFVLLANLSQA |
| 20735, 20736 | Probability: 1.000 AA1: 18 AA2: 19 | MKLFVTLSVLFFCVFATA |
| 20743, 20744 | Probability: 0.998 AA1: 19 AA2: 20 | MKNVIVLFSVASMAFSCFS |
| 20805, 20806 | Probability: 0.962 AA1: 19 AA2: 20 | MMLKKSILLSIAALFISSA |
| 20881, 20882 | Probability: 0.574 AA1: 18 AA2: 19 | MRVFILIISLFFTLFSCQ |
| 2093, 2094 | Probability: 0.641 AA1: 18 AA2: 19 | MNFIIFCFVLLLSGFLTG |
| 21115, 21116 | Probability: 0.990 AA1: 19 AA2: 20 | MMKLYLFVFFFFIVAAGYA |
| 21121, 21122 | Probability: 0.680 AA1: 17 AA2: 18 | MKPIYLIFSLLTFISLS |
| 21133, 21134 | Probability: 0.998 AA1: 19 AA2: 20 | MKRTLVIMVFLMTISQIQA |
| 2115, 2116 | Probability: 0.699 AA1: 20 AA2: 21 | MKRHNIIYFAA1LFACNGNT |
| 2117, 2118 | Probability: 0.999 AA1: 19 AA2: 20 | MNKLFLSIVLILTGCQLSA |
| 21307, 21308 | Probability: 0.814 AA1: 16 AA2: 17 | MRKIILSILGVLFIIA |
| 21361, 21362 | Probability: 0.856 AA1: 19 AA2: 20 | MKKSLLFFTIIFCILFLSQ |
| 21363, 21364 | Probability: 0.856 AA1: 19 AA2: 20 | MKKSLLFFTIIFCILFLSQ |
| 21395, 21396 | Probability: 0.698 AA1: 19 AA2: 20 | MMKRVIVGLSGGVDSSVAA |
| 21427, 21428 | Probability: 0.971 AA1: 19 AA2: 20 | MRNSVIISLIFVMISNQLS |
| 21563, 21564 | Probability: 0.984 AA1: 18 AA2: 19 | MIRLITILLLIISTNIYS |

TABLE 4-continued

| SEQ ID NO: | Signalp Cleavage Site | Predicted Signal Sequence |
|---|---|---|
| 21595, 21596 | Probability: 0.871 AA1: 18 AA2: 19 | MNYSKLVAIIFFIAMLSA |
| 21755, 21756 | Probability: 0.998 AA1: 18 AA2: 19 | MKNILLLTIALSFVNLFA |
| 21773, 21774 | Probability: 0.895 AA1: 19 AA2: 20 | MKKKKKKNXSGVSLSFDSA |
| 21777, 21778 | Probability: 0.845 AA1: 19 AA2: 20 | MKYFVFFFSIILCSCSSSE |
| 21845, 21846 | Probability: 0.940 AA1: 19 AA2: 20 | MKMILHTLFILLISIPLYA |
| 21851, 21852 | Probability: 0.976 AA1: 18 AA2: 19 | MKKFFKFLGILLVVLIVA |
| 21863, 21864 | Probability: 0.818 AA1: 16 AA2: 17 | MKALFFIIIFVAIAVA |
| 21939, 21940 | Probability: 0.993 AA1: 18 AA2: 19 | MKGIFFYLLLFVSALSFS |
| 21987, 21988 | Probability: 0.875 AA1: 16 AA2: 17 | MKKIMLVLGILIVVFM |
| 22293, 22294 | Probability: 0.615 AA1: 20 AA2: 21 | MRKSFKIILFSILGILLLLL |
| 22337, 22338 | Probability: 1.000 AA1: 19 AA2: 20 | MKKIITLVALVFFSVSTFA |
| 22363, 22364 | Probability: 0.997 AA1: 18 AA2: 19 | MKRLIMVIFLFLGVQSIA |
| 22455, 22456 | Probability: 1.000 AA1: 18 AA2: 19 | MKTVLLLLSILVSSYSLA |
| 22467, 22468 | Probability: 0.546 AA1: 17 AA2: 18 | MARMRISVLFFMFCVFA |
| 22491, 22492 | Probability: 1.000 AA1: 18 AA2: 19 | MKKKLFLLLLVTSATFA |
| 22509, 22510 | Probability: 1.000 AA1: 18 AA2: 19 | MKKTLFFIAILLTFNSNA |
| 22513, 22514 | Probability: 0.542 AA1: 13 AA2: 14 | MKKILTGVILTLA |
| 22657, 22658 | Probability: 1.000 AA1: 19 AA2: 20 | MTKNLILLILVLIFNIGFA |
| 22701, 22702 | Probability: 0.970 AA1: 17 AA2: 18 | MKKIIALLVLVSLFSCG |
| 22703, 22704 | Probability: 0.984 AA1: 16 AA2: 17 | MIYKKIVFLVTLLAFA |
| 22767, 22768 | Probability: 0.988 AA1: 14 AA2: 15 | MRLILLFTLCLAMA |
| 22803, 22804 | Probability: 0.575 AA1: 19 AA2: 20 | MKKTTILIAIFLLIGLKIN |
| 2281, 2282 | Probability: 0.999 AA1: 18 AA2: 19 | MKLFISLSLLFISIFVIA |
| 22817, 22818 | Probability: 0.934 AA1: 18 AA2: 19 | MKKSIIISAIVLGFSLVS |
| 22903, 22904 | Probability: 0.996 AA1: 20 AA2: 21 | MKKLFTLLIMSLVLSSCTDA |
| 22953, 22954 | Probability: 0.593 AA1: 18 AA2: 19 | MTKILMVCLGNICRSPLA |
| 22993, 22994 | Probability: 1.000 AA1: 19 AA2: 20 | MKNLVLSLFLIAISISAFS |
| 23055, 23056 | Probability: 0.757 AA1: 18 AA2: 19 | MKSIKFILVLFITVSIFS |
| 23107, 23108 | Probability: 0.782 AA1: 18 AA2: 19 | MKKLFITFTTLLLLIACK |
| 23167, 23168 | Probability: 0.816 AA1: 18 AA2: 19 | MKKFLLIVCIGLLMFSFT |
| 23175, 23176 | Probability: 0.631 AA1: 18 AA2: 19 | MNRLLILLFSIFLISCYN |
| 2321, 2322 | Probability: 1.000 AA1: 20 AA2: 21 | MFRKTILGGLAIIAALTINA |
| 23253, 23254 | Probability: 0.930 AA1: 19 AA2: 20 | MKKIIFVLLIVLLFASCSK |
| 23277, 23278 | Probability: 0.814 AA1: 16 AA2: 17 | MRKIILSILGVLFIIA |
| 23279, 23280 | Probability: 0.771 AA1: 18 AA2: 19 | MKQYLVITFLLSLTLGFS |
| 23323, 23324 | Probability: 0.536 AA1: 19 AA2: 20 | MKYYISILITVLITCNNHS |
| 23339, 23340 | Probability: 0.821 AA1: 18 AA2: 19 | MMKKISLLILIIIGSCQT |
| 2339, 2340 | Probability: 1.000 AA1: 18 AA2: 19 | MKKIFLSFCLLSSFIGFA |
| 23415, 23416 | Probability: 0.882 AA1: 19 AA2: 20 | MIKSIIYLLFLIFSLTIIA |

TABLE 4-continued

| SEQ ID NO: | Signalp Cleavage Site | Predicted Signal Sequence |
|---|---|---|
| 23431, 23432 | Probability: 0.926 AA1: 16 AA2: 17 | MKNTILLSVILLLLFS |
| 23549, 23550 | Probability: 0.516 AA1: 17 AA2: 18 | MNKLAVILLVVIVAFLS |
| 23559, 23560 | Probability: 0.998 AA1: 20 AA2: 21 | MKKLFCILSILILFGCGSTS |
| 23587, 23588 | Probability: 0.862 AA1: 18 AA2: 19 | MKKICFLFFCFMTYIAVG |
| 23631, 23632 | Probability: 0.676 AA1: 18 AA2: 19 | MKKLAVLIVLVCTILSCN |
| 23635, 23636 | Probability: 0.886 AA1: 16 AA2: 17 | MKKIAVVFLLLIVVIS |
| 23649, 23650 | Probability: 0.993 AA1: 16 AA2: 17 | MKKILTSLFFLLVLTA |
| 23723, 23724 | Probability: 0.996 AA1: 18 AA2: 19 | MKLLKKILFALVILLAIA |
| 23817, 23818 | Probability: 0.635 AA1: 19 AA2: 20 | MIMNKRSISVLLIAMMALL |
| 23827, 23828 | Probability: 0.871 AA1: 17 AA2: 18 | MKNYILTTAALLAFLFT |
| 23841, 23842 | Probability: 0.647 AA1: 19 AA2: 20 | MKKYFLIFMISALYSCGSA |
| 23851, 23852 | Probability: 0.861 AA1: 18 AA2: 19 | MKKIITFLLLTIVLVSCG |
| 23879, 23880 | Probability: 0.710 AA1: 19 AA2: 20 | MKEILSFILFTSVAINIIA |
| 23913, 23914 | Probability: 1.000 AA1: 19 AA2: 20 | MKKSIIIVIVLIFGFSVNA |
| 23937, 23938 | Probability: 0.997 AA1: 19 AA2: 20 | MKKTILLITCLLSIFSIYS |
| 23941, 23942 | Probability: 0.988 AA1: 17 AA2: 18 | MKYIYLCLFLFSSFTFS |
| 23967, 23968 | Probability: 0.991 AA1: 19 AA2: 20 | MKKFLITLVLIPFFGIAQT |
| 24023, 24024 | Probability: 0.572 AA1: 20 AA2: 21 | MNKYFIIILIF1CFDSGSQN |
| 24063, 24064 | Probability: 1.000 AA1: 17 AA2: 18 | MKKILILFLLISSTVSA |
| 2411, 2412 | Probability: 1.000 AA1: 21 AA2: 22 | MKKIVVLLALITAMVPAGVFA |
| 24141, 24142 | Probability: 0.985 AA1: 20 AA2: 21 | MNMMKGFLLFFLFSVHILSA |
| 2415, 2416 | Probability: 0.907 AA1: 20 AA2: 21 | MIMNQRIKKIVGIMLLSWA |
| 24159, 24160 | Probability: 0.994 AA1: 20 AA2: 21 | MNKIKYFLLTITLFSLSACT |
| 24161, 24162 | Probability: 0.578 AA1: 20 AA2: 21 | MNKFLQRISFTLLLSCILLG |
| 24267, 24268 | Probability: 0.993 AA1: 20 AA2: 21 | MKQLLALALLVLFCACKSTK |
| 2429, 2430 | Probability: 0.925 AA1: 18 AA2: 19 | MKYCLILFSIVNSLFTNA |
| 24317, 24318 | Probability: 0.592 AA1: 21 AA2: 22 | MLFIAPLVFYILLLTGTNNFA |
| 2435, 2436 | Probability: 0.594 AA1: 20 AA2: 21 | MKKKINYIAFIILLICSVPA |
| 24359, 24360 | Probability: 0.943 AA1: 18 AA2: 19 | MKKLIHLALIILISVSFS |
| 24367, 24368 | Probability: 0.968 AA1: 20 AA2: 21 | MNMKILLSILSLFLLFNCVN |
| 24397, 24398 | Probability: 1.000 AA1: 20 AA2: 21 | MKLKIVLLILFVSITTLVNA |
| 24469, 24470 | Probability: 0.998 AA1: 18 AA2: 19 | MKKILLIAIFLVSWVSTA |
| 24473, 24474 | Probability: 0.996 AA1: 18 AA2: 19 | MKLLKKILFALVILLAIA |
| 24525, 24526 | Probability: 0.992 AA1: 19 AA2: 20 | MNRIKPFLILLFLTSLTYS |
| 24535, 24536 | Probability: 1.000 AA1: 18 AA2: 19 | MKKLILICALLISVFSTA |
| 24579, 24580 | Probability: 0.998 AA1: 19 AA2: 20 | MRKNMLIIIFVFLTTISFG |
| 24807, 24608 | Probability: 0.998 AA1: 19 AA2: 20 | MKNVLFILIMTFGILSCNA |
| 24633, 24634 | Probability: 0.537 AA1: 19 AA2: 20 | MKLKKYIALMLFCLFIGFV |
| 24655, 24656 | Probability: 1.000 AA1: 21 AA2: 22 | MKKLSPALLILLFLIPNFLQA |

TABLE 4-continued

| SEQ ID NO: | Signalp Cleavage Site | Predicted Signal Sequence |
|---|---|---|
| 24707, 24708 | Probability: 0.704 AA1: 18 AA2: 19 | MKLTTHIILIIPFXCFA |
| 24719, 24720 | Probability: 0.989 AA1: 19 AA2: 20 | MNKRHISILMLAMTALLSG |
| 24821, 24822 | Probability: 0.945 AA1: 19 AA2: 20 | MQKILLIIVMFVFTIKVYS |
| 24823, 24824 | Probability: 0.975 AA1: 18 AA2: 19 | MKNSITFFILLLTIIVSA |
| 24853, 24854 | Probability: 1.000 AA1: 21 AA2: 22 | MRVFFINCLMVFLLSSCTSYA |
| 24879, 24880 | Probability: 0.996 AA1: 18 AA2: 19 | MNRLIILILIFFSQISIA |
| 25057, 25058 | Probability: 0.548 AA1: 20 AA2: 21 | MTFHLKPILVFALLFMSCNT |
| 25085, 25086 | Probability: 0.900 AA1: 19 AA2: 20 | MQKKLYFSSLLFFLIVSFT |
| 25115, 25116 | Probability: 0.748 AA1: 18 AA2: 19 | MKNSILIFTTLFSFICGT |
| 25169, 25170 | Probability: 0.703 AA1: 19 AA2: 20 | MKTLKQLLFITAFALLSFT |
| 25203, 25204 | Probability: 0.505 AA1: 18 AA2: 19 | MRLTFIFTLLIIGQFSYG |
| 25225, 25226 | Probability: 0.998 AA1: 19 AA2: 20 | MSKTIFLFLILTTVLSAQN |
| 25299, 25300 | Probability: 0.513 AA1: 17 AA2: 18 | MKKFLVGSCFSITMLMG |
| 25307, 25308 | Probability: 1.000 AA1: 19 AA2: 20 | MKKHIITLLVLVFSFSAIA |
| 25311, 25312 | Probability: 0.999 AA1: 20 AA2: 21 | MKKSIITIILLVFVATQSFA |
| 25355, 25356 | Probability: 0.751 AA1: 16 AA2: 17 | MKKIFLLLIIVFVSCS |
| 25361, 25362 | Probability: 0.708 AA1: 18 AA2: 19 | MNRLLILLFSIFLISCYN |
| 25395, 25396 | Probability: 0.982 AA1: 18 AA2: 19 | MKSCFVLIILLCSSFCIS |
| 25449, 25450 | Probability: 0.969 AA1: 19 AA2: 20 | MKKLAVLIVLVCTILSCNE |
| 25563, 25564 | Probability: 0.960 AA1: 19 AA2: 20 | MKPIFSFFICMSICTTIFS |
| 25571, 25572 | Probability: 0.997 AA1: 20 AA2: 21 | MHSRYFIILLLVLFTINSFS |
| 25615, 25616 | Probability: 0.955 AA1: 20 AA2: 21 | MMSVVLLGLIASVITQYVAS |
| 25621, 25622 | Probability: 0.511 AA1: 21 AA2: 22 | MIKNRPRKTYTJLSLLVASYS |
| 2571, 2572 | Probability: 0.871 AA1: 20 AA2: 21 | MKKLKLLTLSSLAFLSTVPV |
| 25761, 25762 | Probability: 0.989 AA1: 19 AA2: 20 | MNKRHISILMLAMTALLSG |
| 25797, 25798 | Probability: 0.999 AA1: 18 AA2: 19 | MKNLILILALSIGFNAFS |
| 25833, 25834 | Probability: 0.998 AA1: 18 AA2: 19 | MKKITTLLILFTSIISFS |
| 25865, 25866 | Probability: 0.745 AA1: 15 AA2: 16 | MKKIIIALATTLVFG |
| 25867, 25868 | Probability: 0.949 AA1: 18 AA2: 19 | MKKTIVILLIFISCSSTK |
| 25899, 25900 | Probability: 1.000 AA1: 19 AA2: 20 | MKKIITLVALVFFSVSTFA |
| 25985, 25986 | Probability: 0.776 AA1: 20 AA2: 21 | MNFKASLFFVVTIFSIGLMS |
| 26069, 26070 | Probability: 0.730 AA1: 18 AA2: 19 | MKKNIYRIFLTILSIALA |
| 26081, 26082 | Probability: 1.000 AA1: 18 AA2: 19 | MKNLFFTAIFLFCLPALA |
| 26085, 26086 | Probability: 0.980 AA1: 17 AA2: 18 | MKWSFLILFVLSFPSSA |
| 26127, 26128 | Probability: 0.985 AA1: 17 AA2: 18 | MKRNLAILLLILTTVLS |
| 26133, 26134 | Probability: 0.846 AA1: 20 AA2: 21 | MPMKNASFLIVLLLFFSACK |
| 26249, 26250 | Probability: 0.999 AA1: 17 AA2: 18 | MKQILILFSLLYFSAQA |
| 26305, 26306 | Probability: 0.996 AA1: 18 AA2: 19 | MASGLLVFLALHPTQSNA |
| 26341, 26342 | Probability: 0.629 AA1: 20 AA2: 21 | MKKSNSIIYLLSLTLLFFSS |

TABLE 4-continued

| SEQ ID NO: | Signalp Cleavage Site | Predicted Signal Sequence |
|---|---|---|
| 26431, 26432 | Probability: 0.663 AA1: 18 AA2: 19 | MNIVILFFLLSFLALVLS |
| 26445, 26446 | Probability: 0.527 AA1: 13 AA2: 14 | MKTKSLSFFMAHN |
| 26489, 26490 | Probability: 0.999 AA1: 20 AA2: 21 | MKRTFSMSIILILALSFFNA |
| 26595, 26596 | Probability: 0.979 AA1: 19 AA2: 20 | MKYYLFILLVGLSTTFGFS |
| 26609, 26610 | Probability: 0.997 AA1: 20 AA2: 21 | MHSRYFIILLLVLFTINSFS |
| 26625, 26626 | Probability: 0.901 AA1: 20 AA2: 21 | MKRSTLSLFLVITLSLFQIG |
| 26627, 26628 | Probability: 0.998 AA1: 19 AA2: 20 | MNKYIPLLMLVLFANLSFS |
| 26675, 26676 | Probability: 0.939 AA1: 17 AA2: 18 | MKKLLICMSALAIVACK |
| 26681, 26682 | Probability: 0.715 AA1: 18 AA2: 19 | MKRTVILTLVFLPLILIG |
| 26719, 26720 | Probability: 0.996 AA1: 18 AA2: 19 | MNKFILLIGLCVCSNIFS |
| 26747, 26748 | Probability: 0.689 AA1: 18 AA2: 19 | MIKVFKLVWALLCLACK |
| 2675, 2676 | Probability: 1.000 AA1: 18 AA2: 19 | MKKTMSLLLFFVSAIAFS |
| 2683, 2684 | Probability: 0.939 AA1: 19 AA2: 20 | MKKIILSFLFLLYCTFVQN |
| 26855, 26856 | Probability: 0.619 AA1: 18 AA2: 19 | MNKLGIIIGLLIGLGLFG |
| 26857, 26858 | Probability: 0.501 AA1: 20 AA2: 21 | MYVMKSIFFLFFLMCMNISN |
| 275, 276 | Probability: 0.999 AA1: 21 AA2: 22 | MLKNISIFSILFILLINASNA |
| 2761, 2762 | Probability: 0.980 AA1: 17 AA2: 18 | MKKIHIVFLILIVAALA |
| 2927, 2928 | Probability: 0.964 AA1: 18 AA2: 19 | MLKNISIFSILFILLINA |
| 2941, 2942 | Probability: 0.997 AA1: 19 AA2: 20 | MKSTLVTFFILLFSQFIVA |
| 2985, 2986 | Probability: 0.957 AA1: 19 AA2: 20 | MLRSKWGFLALCALLISWQ |
| 303, 304 | Probability: 0.997 AA1: 19 AA2: 20 | MSKIFLAVLTVFTGIGVQA |
| 3055, 3056 | Probability: 0.545 AA1: 19 AA2: 20 | MNSMNKVLIFIILLFSSVS |
| 3113, 3114 | Probability: 0.978 AA1: 19 AA2: 20 | MKRAILITFIIIFTNQLYA |
| 3117, 3118 | Probability: 0.623 AA1: 19 AA2: 20 | MKTKTIFILFFSIVSFCFK |
| 3119, 3120 | Probability: 0.999 AA1: 20 AA2: 21 | MKIILLYAAIVGSLFVSCNA |
| 3221, 3222 | Probability: 0.995 AA1: 20 AA2: 21 | MIKAKIFSGLLLFISTALFS |
| 3231, 3232 | Probability: 0.992 AA1: 19 AA2: 20 | MRIIAIILIIVLPLISQG |
| 3233, 3234 | Probability: 1.000 AA1: 20 AA2: 21 | MKKDLILTLLIFLFTVSLTA |
| 3235, 3236 | Probability: 1.000 AA1: 20 AA2: 21 | MKKDLILTLLIFLXTVSLTA |
| 3245, 3246 | Probability: 0.975 AA1: 19 AA2: 20 | MKTNLKLFLLIMLSISIEA |
| 3277, 3278 | Probability: 0.979 AA1: 20 AA2: 21 | MRNSLTLLIFALLLTNCNNS |
| 3337, 3338 | Probability: 0.994 AA1: 19 AA2: 20 | MKKIVSILVFVLLANLsQA |
| 3397, 3398 | Probability: 0.643 AA1: 19 AA2: 20 | MEESMRLFVLLFLIFPWA |
| 3405, 3406 | Probability: 0.534 AA1: 20 AA2: 21 | MIKKGLSLLRGILSPSITWK |
| 3471, 3472 | Probability: 0.954 AA1: 19 AA2: 20 | MKRIFFAFSILFISVCGFA |
| 3515, 3516 | Probability: 0.686 AA1: 19 AA2: 20 | MAFIFFALVIGTMVGISMT |
| 3525, 3526 | Probability: 0.873 AA1: 20 AA2: 21 | MKRKIFFYTLMSILLAGIFA |
| 3565, 3566 | Probability: 0.646 AA1: 19 AA2: 20 | MKRFSYLFLLILLINQCRN |
| 365, 366 | Probability: 0.540 AA1: 21 AA2: 22 | MHNSSPMkNLLILFASFILsS |

TABLE 4-continued

| SEQ ID NO: | Signalp Cleavage Site | Predicted Signal Sequence |
|---|---|---|
| 3705, 3706 | Probability: 0.845 AA1: 19 AA2: 20 | MkPTLLIMAAGMASRYGSM |
| 3711, 3712 | Probability: 0.994 AA1: 19 AA2: 20 | MKKIVSILVFVLLANLSQA |
| 373, 374 | Probability: 0.665 AA1: 20 AA2: 21 | MNKRIIILISATWSlSLQv |
| 3771, 3772 | Probability: 0.860 AA1: 20 AA2: 21 | MQINRLIVLLLIMISHKNFA |
| 3843, 3844 | Probability: 1.000 AA1: 19 AA2: 20 | MKSFIFFLFFVLAFSVANA |
| 3871, 3872 | Probability: 0.973 AA1: 18 AA2: 19 | MNKSVLVVGAGLGGMALA |
| 3913, 3914 | Probability: 0.999 AA1: 19 AA2: 20 | MNRFLIFIFVICFCGTAVS |
| 397, 398 | Probability: 0.978 AA1: 18 AA2: 19 | MIRFVIPVFFLLPFFSNA |
| 4037, 4038 | Probability: 0.904 AA1: 19 AA2: 20 | MKKEFLKIGIAILVLFAIA |
| 4087, 4088 | Probability: 1.000 AA1: 18 AA2: 19 | MRKIFAVMLFTSSQLM |
| 4153, 4154 | Probability: 0.515 AA1: 18 AA2: 19 | MLKSLFLFTSFSSFFLLV |
| 4167, 4168 | Probability: 0.784 AA1: 17 AA2: 18 | MARLVLVFILLHQTLVA |
| 419, 420 | Probability: 0.708 AA1: 18 AA2: 19 | MKSLIIIFSLILFFTAcK |
| 4223, 4224 | Probability: 0.659 AA1: 19 AA2: 20 | MRSKIFLLMLXTASFYSPS |
| 4241, 4242 | Probability: 1.000 AA1: 20 AA2: 21 | MKKKlTILILFFFICLFALS |
| 4259, 4260 | Probability: 0.788 AA1: 17 AA2: 18 | MKTIIISTILIITSCA |
| 4273, 4274 | Probability: 0.987 AA1: 19 AA2: 20 | MKAHIRIILLALFFGTAVQ |
| 4291, 4292 | Probability: 1.000 AA1: 18 AA2: 19 | MKKIFLSFCLLSSFIGFA |
| 4309, 4310 | Probability: 0.924 AA1:.18 AA2: 19 | MKYCLILFSIVNSLFTNA |
| 4313, 4314 | Probability: 0.834 AA1: 18 AA2: 19 | MKNkVLLSFLCFFLyTHV |
| 4319, 4320 | Probability: 0.670 AA1: 15 AA2: 16 | MKLAALILLIIFTQS |
| 4337, 4338 | Probability: 0.537 AA1: 20 AA2: 21 | MKKLTVILFFVIGVTyQVIG |
| 4361, 4362 | Probability: 0.850 AA1: 17 AA2: 18 | MKKILFSLIVCVFCLSS |
| 4405, 4406 | Probability: 0.873 AA1: 20 AA2: 21 | MKRKIFFYTLMSILLAGIFA |
| 4415, 4416 | Probability: 0.923 AA1: 18 AA2: 19 | MKQMLAA1FCFCFFISHs |
| 4483, 4484 | Probability: 0.575 AA1: 18 AA2: 19 | MRTIVILYLVMFSLSCQQ |
| 4623, 4624 | Probability: 0.540 AA1: 21 AA2: 22 | MHNSSPMKNLLILFASFILSS |
| 463, 464 | Probability: 0.643 AA1: 21 AA2: 22 | MIRTKGXXXXXXXXXXXXXX |
| 4641, 4642 | Probability: 0.976 AA1: 20 AA2: 21 | MKRMIIITGMLAFLGTTGFG |
| 4771, 4772 | Probability: 0.998 AA1: 19 AA2: 20 | MSKIFLAVLTVFTGIGVQA |
| 4903, 4904 | Probability: 0.998 AA1: 17 AA2: 18 | MFRFIIVSVFAISVSFA |
| 4937, 4938 | Probability: 0.977 AA1: 19 AA2: 20 | MTIMKYKLITLFLLFQTLA |
| 4939, 4940 | Probability: 0.600 AA1: 19 AA2: 20 | MKTTVRILCVCILVCSSVS |
| 495, 496 | Probability: 0.674 AA1: 20 AA2: 21 | MGRHAVCXXXXXXXXXXXX |
| 5031, 5032 | Probability: 0.713 AA1: 18 AA2: 19 | MKKSLTMTLFAGLFLINS |
| 5037, 5038 | Probability: 0.987 AA1: 19 AA2: 20 | MKAHIRIILLALFFGTAVQ |
| 5057, 5058 | Probability: 0.990 AA1: 19 AA2: 20 | MRNYILTILTFFFSITLFA |
| 509, 510 | Probability: 0.558 AA1: 18 AA2: 19 | MKVLLSTALPIALCCLLL |
| 5261, 5262 | Probability: 0.558 AA1: 18 AA2: 19 | MKVLLSTALPIALCCLLL |

TABLE 4-continued

| SEQ ID NO: | Signalp Cleavage Site | Predicted Signal Sequence |
|---|---|---|
| 5289, 5290 | Probability: 0.979 AA1: 15 AA2: 16 | MANKYLLCLLFLVSA |
| 5351, 5352 | Probability: 0.928 AA1: 18 AA2: 19 | MKFLLALLIITCSDICTA |
| 5371, 5372 | Probability: 0.588 AA1: 20 AA2: 21 | MKKLILLPFLALLLGFILPG |
| 5421, 5422 | Probability: 1.000 AA1: 19 AA2: 20 | MLKILLAVTVAFSFLPAFS |
| 5571, 5572 | Probability: 0.836 AA1: 18 AA2: 19 | MKLTVTAIFLCVAIQAIS |
| 5573, 5574 | Probability: 0.985 AA1: 20 AA2: 21 | MKKYFGILLITSLICLVQLQ |
| 5575, 5576 | Probability: 0.999 AA1: 19 AA2: 20 | MRTNCILLSVLLFTFSTSS |
| 5617, 5618 | Probability: 0.968 AA1: 19 AA2: 20 | MKNKIIAFLPLLICAGVIT |
| 5693, 5694 | Probability: 0.992 AA1: 18 AA2: 19 | MKILTIVFLVGFFCFVQA |
| 5801, 5802 | Probability: 1.000 AA1: 20 AA2: 21 | MKKILFIAATAVLFSTTTMA |
| 5811, 5812 | Probability: 0.875 AA1: 18 AA2: 19 | MKSFYFLIAMGISLNASA |
| 5943, 5944 | Probability: 0.983 AA1: 16 AA2: 17 | MTTNTILLLLLSLVIA |
| 5951, 5952 | Probability: 0.722 AA1: 20 AA2: 21 | MKLKKGIILIIAFLGFGLSN |
| 5953, 5954 | Probability: 0.973 AA1: 20 AA2: 21 | MMPKLKLLLLGCLLILLKNA |
| 6027, 6028 | Probability: 0.682 AA1: 18 AA2: 19 | MKSLIIIFSLILFFTACK |
| 6041, 6042 | Probability: 0.873 AA1: 18 AA2: 19 | MTTSKTLLFILFLVMTQL |
| 6185, 6186 | Probability: 0.997 AA1: 19 AA2: 20 | MKSTLVTFFILLFSQFIVA |
| 6245, 6246 | Probability: 0.854 AA1: 17 AA2: 18 | MKYFLFIFLLSCPVTLS |
| 6289, 6290 | Probability: 0.999 AA1: 19 AA2: 20 | MKKLFPVVLFLLSMNVLQA |
| 6323, 6324 | Probability: 1.000 AA1: 20 AA2: 21 | MKFFSLFYCFLLLGLNFALA |
| 6469, 6470 | Probability: 0.997 AA1: 19 AA2: 20 | MKSTLVTFFILLFSQFIVA |
| 6667, 6668 | Probability: 0.912 AA1: 18 AA2: 19 | MRKNFQIVLAFAMTIATS |
| 6719, 6720 | Probability: 1.000 AA1: 18 AA2: 19 | MRKVLLTMLFLSCFSGNA |
| 6741, 6742 | Probability: 0.551 AA1: 18 AA2: 19 | MKKVLLTGCLLITIISTG |
| 6755, 6756 | Probability: 0.909 AA1: 19 AA2: 20 | MKKFLIFCLFLFLNKPLIS |
| 6789, 6790 | Probability: 0.707 AA1: 18 AA2: 19 | MRAFLSITVCFFLFVNFA |
| 6885, 6886 | Probability: 0.693 AA1: 19 AA2: 20 | MKILKLFFLLFILPITTLQ |
| 6893, 6894 | Probability: 0.911 AA1: 16 AA2: 17 | MKYLILIIALCTLTFS |
| 6943, 6944 | Probability: 1.000 AA1: 18 AA2: 19 | MKKLILSLFILISLNVFA |
| 6951, 6952 | Probability: 0.903 AA1: 19 AA2: 20 | MLFMKKIILLLIVTAVVS |
| 7029, 7030 | Probability: 0.852 AA1: 16 AA2: 17 | MKKIFLLIFTFIYLNA |
| 711, 712 | Probability: 0.936 AA1: 19 AA2: 20 | MKNQIFSGFLLLFIVNQVA |
| 7357, 7358 | Probability: 0.610 AA1: 16 AA2: 17 | MLRVILISIFVLNIYA |
| 7389, 7390 | Probability: 0.987 AA1: 19 AA2: 20 | MKYFTLIFLFTYLSLSSFG |
| 7491, 7492 | Probability: 0.682 AA1: 19 AA2: 20 | MKSMRTIFISFLIILLLQG |
| 7505, 7506 | Probability: 0.995 AA1: 19 AA2: 20 | MRRLILALMCVILLSSFVV |
| 7543, 7544 | Probability: 0.997 AA1: 19 AA2: 20 | MLIKNIVILSFLFVLFAQG |
| 759, 760 | Probability: 0.711 AA1: 19 AA2: 20 | MKFKLAIFALILISINLIS |
| 7765, 7766 | Probability: 0.529 AA1: 18 AA2: 19 | MKICIIGLGYVGLPLAHA |

TABLE 4-continued

| SEQ ID NO: | Signalp Cleavage Site | Predicted Signal Sequence |
|---|---|---|
| 7785, 7786 | Probability: 0.983 AA1: 19 AA2: 20 | MFKKVGILLFLIALSLVVL |
| 7835, 7836 | Probability: 0.878 AA1: 15 AA2: 16 | MRIIFLVLISFSLYA |
| 7907, 7908 | Probability: 0.926 AA1: 19 AA2: 20 | MKKSSLLLLITFVVVLFQG |
| 821, 822 | Probability: 1.000 AA1: 20 AA2: 21 | MKKWRFSLSIFLFVCVTCLA |
| 8247, 8248 | Probability: 0.995 AA1: 16 AA2: 17 | MRISILLAVVSSIIFA |
| 827, 828 | Probability: 1.000 AA1: 19 AA2: 20 | MKKFFSLIIFLIFSFASFA |
| 8279, 8280 | Probability: 0.672 AA1: 15 AA2: 16 | MKFNLNSFLMSVSLA |
| 8313, 8314 | Probability: 0.992 AA1: 19 AA2: 20 | MKHIKKALLILLFLFLSFS |
| 8349, 8350 | Probability: 0.562 AA1: 17 AA2: 18 | MFKTILFTIVFVTNIFS |
| 8437, 8438 | Probability: 0.820 AA1: 16 AA2: 17 | MKKRVMSSMKSGGVVA |
| 8461, 8462 | Probability: 0.857 AA1: 17 AA2: 18 | MKKYLALFAFILLVLSS |
| 8513, 8514 | Probability: 0.993 AA1: 16 AA2: 17 | MKLLLLLFLVLLNVNA |
| 8561, 8562 | Probability: 0.618 AA1: 17 AA2: 18 | MKLNEGAILVLSGPSGA |
| 8585, 8586 | Probability: 0.997 AA1: 17 AA2: 18 | MKKFTLSILISSSLAFG |
| 8727, 8728 | Probability: 0.825 AA1: 19 AA2: 20 | MKKITKILLIFALVAIFSG |
| 8793, 8794 | Probability: 0.582 AA1: 19 AA2: 20 | MKNKCLLIILLRVISTFLL |
| 8853, 8854 | Probability: 0.649 AA1: 17 AA2: 18 | MMKILILTITTTAILCA |
| 9021, 9022 | Probability: 0.998 AA1: 19 AA2: 20 | MNYKSFLALTAAVIISFSA |
| 9039, 9040 | Probability: 0.977 AA1: 19 AA2: 20 | MQKAFYILILLSVSLSSFG |
| 9213, 9214 | Probability: 0.772 AA1: 17 AA2: 18 | MKKKILIVGGGTAGTMT |
| 9351, 9352 | Probability: 0.744 AA1: 18 AA2: 19 | MIKRTTGILLLIFISIFA |
| 9373, 9374 | Probability: 0.931 AA1: 17 AA2: 18 | MKHILFITLFFLTSLFA |
| 9413, 9414 | Probability: 0.540 AA1: 15 AA2: 16 | MSNIALSLGSCFTIA |
| 9613, 9614 | Probability: 0.998 AA1: 17 AA2: 18 | MKIFSLIFILLFTSLSA |
| 9713, 9714 | Probability: 0.911 AA1: 17 AA2: 18 | MKKVITLSLITLNILFA |
| 9829, 9830 | Probability: 0.768 AA1: 19 AA2: 20 | MKNILKIIFIIFLFSSCQT |
| 9881, 9882 | Probability: 0.963 AA1: 19 AA2: 20 | MNKNLITAALLFVFGYTML |
| 9925, 9926 | Probability: 0.751 AA1: 18 AA2: 19 | MLQKSFISILLSLLLSLS |
| 9979, 9980 | Probability: 0.799 AA1: 19 AA2: 20 | MIMKDLILTLLLLSVYCLV |

Methods for identifying "prepro" domain sequences and signal sequences are well known in the art, see, e.g., Van de Ven (1993) Crit. Rev. Oncog. 4(2):115-136. For example, to identify a prepro sequence, the protein is purified from the extracellular space and the N-terminal protein sequence is determined and compared to the unprocessed form.

The invention includes polypeptides with or without a signal sequence and/or a prepro sequence. The invention includes polypeptides with heterologous signal sequences and/or prepro sequences. The prepro sequence (including a sequence of the invention used as a heterologous prepro domain) can be located on the amino terminal or the carboxy terminal end of the protein. The invention also includes isolated or recombinant signal sequences, prepro sequences and catalytic domains (e.g., "active sites") comprising sequences of the invention. The polypeptide comprising a signal sequence of the invention can be a polypeptide, enzyme, protein, e.g. structural or binding protein, of the invention or another polypeptide, enzyme, protein, e.g. structural or binding protein, or another enzyme or other polypeptide.

The polypeptide, enzyme, protein, e.g. structural or binding protein signal sequences (SPs) and/or prepro sequences of the invention can be isolated peptides, or, sequences joined to another a polypeptide, enzyme, protein, e.g. structural or binding protein, or a non-polypeptide, non-enzyme, non-protein, e.g. non-structural or non-binding protein, e.g., as a fusion (chimeric) protein. In one aspect, the invention provides polypeptides comprising a polypeptide, enzyme, protein, e.g. structural or binding protein, signal sequences of the invention. In one aspect, polypeptides comprising polypeptide, enzyme, protein, e.g. structural or binding protein signal sequences SPs and/or prepro of the invention comprise sequences heterologous to a polypeptide, enzyme, protein, e.g. structural or binding protein, of the invention (e.g., a fusion protein comprising an SP and/or prepro of the invention and sequences from another a polypeptide, enzyme, protein, e.g. structural or binding protein, or a non-polypeptide, non-enzyme, non-protein, e.g. non-structural or non-binding protein). In one aspect, the invention provides a polypeptide, enzyme, protein, e.g. structural or binding protein, of the invention with heterologous SPs and/or prepro sequences, e.g., sequences with a yeast signal sequence. A polypeptide, enzyme, protein, e.g. structural or binding protein, of the invention can comprise a heterologous SP and/or prepro in a vector, e.g., a pPIC series vector (Invitrogen, Carlsbad, Calif.).

In one aspect, SPs and/or prepro sequences of the invention are identified following identification of novel a polypeptide, enzyme, protein, e.g. structural or binding protein. The pathways by which proteins are sorted and transported to their proper cellular location are often referred to as protein targeting pathways. One of the most important elements in all of these targeting systems is a short amino acid sequence at the amino terminus of a newly synthesized polypeptide called the signal sequence. This signal sequence directs a protein to its appropriate location in the cell and is removed during transport or when the protein reaches its final destination. Most lysosomal, membrane, or secreted proteins have an amino-terminal signal sequence that marks them for translocation into the lumen of the endoplasmic reticulum. The signal sequences can vary in length from about 10 to 65, or more, amino acid residues. Various methods of recognition of signal sequences are known to those of skill in the art. For example, in one aspect, novel a polypeptide, enzyme, protein, e.g. structural or binding protein, signal peptides are identified by a method referred to as SignalP. SignalP uses a combined neural network which recognizes both signal peptides and their cleavage sites. (Nielsen (1997) "Identification of prokaryotic and eukaryotic signal peptides and prediction of their cleavage sites." Protein Engineering 10:1-6.

It should be understood that in some aspects a polypeptide, enzyme, protein, e.g. structural or binding protein, of the invention may not have SPs and/or prepro sequences, or "domains." In one aspect, the invention provides the polypeptide, enzyme, protein, e.g. structural or binding proteins of the invention lacking all or part of an SP and/or a prepro domain. In one aspect, the invention provides a nucleic acid sequence encoding a signal sequence (SP) and/or prepro from one a polypeptide, enzyme, protein, e.g. structural or binding protein, operably linked to a nucleic acid sequence of a different a polypeptide, enzyme, protein, e.g. structural or binding protein, or, optionally, a signal sequence (SPs) and/or prepro domain from a non-enzyme or non-protein, e.g. non-structural or non-binding protein, may be desired.

The invention also provides isolated or recombinant polypeptides comprising signal sequences (SPs), prepro domain and/or catalytic domains (CDs) of the invention and heterologous sequences. The heterologous sequences are sequences not naturally associated (e.g., to a enzyme) with an SP, prepro domain and/or CD. The sequence to which the SP, prepro domain and/or CD are not naturally associated can be on the SP's, prepro domain and/or CD's amino terminal end, carboxy terminal end, and/or on both ends of the SP and/or CD. In one aspect, the invention provides an isolated or recombinant polypeptide comprising (or consisting of) a polypeptide comprising a signal sequence (SP), prepro domain and/or catalytic domain (CD) of the invention with the proviso that it is not associated with any sequence to which it is naturally associated (e.g., a polypeptide, enzyme, protein, e.g. structural or binding protein, sequence). Similarly in one aspect, the invention provides isolated or recombinant nucleic acids encoding these polypeptides. Thus, in one aspect, the isolated or recombinant nucleic acid of the invention comprises coding sequence for a signal sequence (SP), prepro domain and/or catalytic domain (CD) of the invention and a heterologous sequence (i.e., a sequence not naturally associated with the a signal sequence (SP), prepro domain and/or catalytic domain (CD) of the invention). The heterologous sequence can be on the 3' terminal end, 5' terminal end, and/or on both ends of the SP, prepro domain and/or CD coding sequence.

Hybrid (Chimeric) a Polypeptide, Enzyme, Protein, e.g. Structural or Binding Protein, and Peptide Libraries In one aspect, the invention provides hybrid a polypeptide, enzyme, protein, e.g. structural or binding protein, and fusion proteins, including peptide libraries, comprising sequences of the invention. The peptide libraries of the invention can be used to isolate peptide modulators (e.g., activators or inhibitors) of targets, such as a polypeptide, enzyme, protein, e.g. structural or binding protein, substrates, receptors, enzymes. The peptide libraries of the invention can be used to identify formal binding partners of targets, such as ligands, e.g., cytokines, hormones and the like. In one aspect, the invention provides chimeric proteins comprising a signal sequence (SP), prepro domain and/or catalytic domain (CD) of the invention or a combination thereof and a heterologous sequence (see above).

In one aspect, the fusion proteins of the invention (e.g., the peptide moiety) are conformationally stabilized (relative to linear peptides) to allow a higher binding affinity for targets. The invention provides fusions of a polypeptide, enzyme, protein, e.g. structural or binding protein, of the invention and other peptides, including known and random peptides. They can be fused in such a manner that the structure of the polypeptide, enzyme, protein, e.g. structural or binding proteins is not significantly perturbed and the peptide is metabolically or structurally conformationally stabilized. This allows the creation of a peptide library that is easily monitored both for its presence within cells and its quantity.

Amino acid sequence variants of the invention can be characterized by a predetermined nature of the variation, a feature that sets them apart from a naturally occurring form, e.g., an allelic or interspecies variation of a polypeptide, enzyme, protein, e.g. structural or binding protein, sequence. In one aspect, the variants of the invention exhibit the same qualitative biological activity as the naturally occurring analogue. Alternatively, the variants can be selected for having modified characteristics. In one aspect, while the site or region for introducing an amino acid sequence variation is predetermined, the mutation per se need not be predetermined. For example, in order to optimize the performance of a mutation at a given site, random mutagenesis may be conducted at the target codon or region and the expressed a polypeptide, enzyme, protein, e.g. structural or binding protein, variants screened for the optimal combination of desired activity. Techniques for making substitution mutations at predetermined sites in DNA having a known sequence are well known, as discussed herein for example, M13 primer mutagenesis and PCR mutagenesis. Screening of the mutants can be done using, e.g., assays of glucan hydrolysis. In alternative aspects, amino acid substitutions can be single residues; insertions can be on the order of from about 1 to 20 amino acids, although considerably larger insertions can be done. Deletions can range from about 1 to about 20, 30, 40, 50, 60, 70 residues or more. To obtain a final derivative with the optimal properties, substitutions, deletions, insertions or any combination thereof may be used. Generally, these changes are done on a few amino acids to minimize the alteration of the molecule. However, larger changes may be tolerated in certain circumstances.

The invention provides a polypeptide, enzyme, protein, e.g. structural or binding protein, where the structure of the polypeptide backbone, the secondary or the tertiary structure, e.g., an alpha-helical or beta-sheet structure, has been modified. In one aspect, the charge or hydrophobicity has been modified. In one aspect, the bulk of a side chain has been modified. Substantial changes in function or immunological identity are made by selecting substitutions that are less conservative. For example, substitutions can be made which more significantly affect: the structure of the polypeptide backbone in the area of the alteration, for example a alpha-helical or a beta-sheet structure; a charge or a hydrophobic site of the molecule, which can be at an active site; or a side chain. The invention provides substitutions in polypeptide of the invention where (a) a hydrophilic residues, e.g. seryl or threonyl, is substituted for (or by) a hydrophobic residue, e.g. leucyl, isoleucyl, phenylalanyl, valyl or alanyl; (b) a cysteine or proline is substituted for (or by) any other residue; (c) a residue having an electropositive side chain, e.g. lysyl, arginyl, or histidyl, is substituted for (or by) an electronegative residue, e.g. glutamyl or aspartyl; or (d) a residue having a bulky side chain, e.g. phenylalanine, is substituted for (or by) one not having a side chain, e.g. glycine. The variants can exhibit the same qualitative biological activity (i.e., an enzyme, structural or binding activity) although variants can be selected to modify the characteristics of the polypeptide, enzyme, protein, e.g. structural or binding proteins as needed.

In one aspect, a polypeptide, enzyme, protein, e.g. structural or binding protein, of the invention comprise epitopes or purification tags, signal sequences or other fusion sequences, etc. In one aspect, the polypeptide, enzyme, protein, e.g. structural or binding proteins of the invention can be fused to a random peptide to form a fusion polypeptide. By "fused" or "operably linked" herein is meant that the random peptide and the polypeptide, enzyme, protein, e.g. structural or binding protein are linked together, in such a manner as to minimize the disruption to the stability of the polypeptide, enzyme, protein, e.g. structural or binding protein structure, e.g., it retains a polypeptide, enzyme, protein, e.g. structural or binding protein, activity. The fusion polypeptide (or fusion polynucleotide encoding the fusion polypeptide) can comprise further components as well, including multiple peptides at multiple loops.

In one aspect, the peptides and nucleic acids encoding them are randomized, either fully randomized or they are biased in their randomization, e.g. in nucleotide/residue frequency generally or per position. "Randomized" means that each nucleic acid and peptide consists of essentially random nucleotides and amino acids, respectively. In one aspect, the nucleic acids which give rise to the peptides can be chemically synthesized, and thus may incorporate any nucleotide at any position. Thus, when the nucleic acids are expressed to form peptides, any amino acid residue may be incorporated at any position. The synthetic process can be designed to generate randomized nucleic acids, to allow the formation of all or most of the possible combinations over the length of the nucleic acid, thus forming a library of randomized nucleic acids. The library can provide a sufficiently structurally diverse population of randomized expression products to affect a probabilistically sufficient range of cellular responses to provide one or more cells exhibiting a desired response. Thus, the invention provides an interaction library large enough so that at least one of its members will have a structure that gives it affinity for some molecule, protein, or other factor.

In one aspect, a polypeptide, enzyme, protein, e.g. structural or binding protein, of the invention is a multidomain enzyme that comprises a signal peptide, a carbohydrate binding module, a polypeptide, enzyme, protein, e.g. structural or binding protein, catalytic domain, a linker and/or another catalytic domain.

The invention provides a means for generating chimeric polypeptides which may encode biologically active hybrid polypeptides (e.g., hybrid a polypeptide, enzyme, protein, e.g. structural or binding protein). In one aspect, the original polynucleotides encode biologically active polypeptides. The method of the invention produces new hybrid polypeptides by utilizing cellular processes which integrate the sequence of the original polynucleotides such that the resulting hybrid polynucleotide encodes a polypeptide demonstrating activities derived from the original biologically active polypeptides. For example, the original polynucleotides may encode a particular enzyme from different microorganisms. An enzyme encoded by a first polynucleotide from one organism or variant may, for example, function effectively under a particular environmental condition, e.g. high salinity. An enzyme encoded by a second polynucleotide from a different organism or variant may function effectively under a different environmental condition, such as extremely high temperatures. A hybrid polynucleotide containing sequences from the first and second original polynucleotides may encode an enzyme which exhibits characteristics of both enzymes encoded by the original polynucleotides. Thus, the enzyme encoded by the hybrid polynucleotide may function effectively under environmental conditions shared by each of the enzymes encoded by the first and second polynucleotides, e.g., high salinity and extreme temperatures.

A hybrid polypeptide resulting from the method of the invention may exhibit specialized enzyme activity not displayed in the original enzymes. For example, following recombination and/or reductive reassortment of polynucleotides encoding a polypeptide, enzyme, protein, e.g. structural or binding protein, the resulting hybrid polypeptide encoded by a hybrid polynucleotide can be screened for specialized non-enzyme, non-structural or non-binding activities, obtained from each of the original enzymes. Thus, for example, the hybrid polypeptide may be screened to ascertain those chemical functionalities which distinguish the hybrid polypeptide from the original parent polypeptides, such as the temperature, pH or salt concentration at which the hybrid polypeptide functions.

In one aspect, the invention relates to a method for producing a biologically active hybrid polypeptide and screening such a polypeptide for enhanced activity by:

1) introducing at least a first polynucleotide in operable linkage and a second polynucleotide in operable linkage, the at least first polynucleotide and second polynucleotide sharing at least one region of partial sequence homology, into a suitable host cell;
2) growing the host cell under conditions which promote sequence reorganization resulting in a hybrid polynucleotide in operable linkage;
3) expressing a hybrid polypeptide encoded by the hybrid polynucleotide;
4) screening the hybrid polypeptide under conditions which promote identification of enhanced biological activity; and 5) isolating the a polynucleotide encoding the hybrid polypeptide.

Isolating and Discovering a Polypeptide, Enzyme, Protein e.g. Structural or Binding Protein The invention provides methods for isolating and discovering a polypeptide, enzyme, protein, e.g. structural or binding protein, and the nucleic acids that encode them. Polynucleotides or enzymes may be isolated from individual organisms ("isolates"), collections of organisms that have been grown in defined media ("enrichment cultures"), or, uncultivated organisms ("environmental samples"). The organisms can be isolated by, e.g., in vivo biopanning (see discussion, below). The use of a culture-independent approach to derive polynucleotides encoding novel bioactivities from environmental samples is most preferable since it allows one to access untapped resources of biodiversity. Polynucleotides or enzymes also can be isolated from any one of numerous organisms, e.g. bacteria. In addition to whole cells, polynucleotides or enzymes also can be isolated from crude enzyme preparations derived from cultures of these organisms, e.g., bacteria.

"Environmental libraries" are generated from environmental samples and represent the collective genomes of naturally occurring organisms archived in cloning vectors that can be propagated in suitable prokaryotic hosts. Because the cloned DNA is initially extracted directly from environmental samples, the libraries are not limited to the small fraction of prokaryotes that can be grown in pure culture. Additionally, a normalization of the environmental DNA present in these samples could allow more equal representation of the DNA from all of the species present in the original sample. This can dramatically increase the efficiency of finding interesting genes from minor constituents of the sample which may be under-represented by several orders of magnitude compared to the dominant species.

For example, gene libraries generated from one or more uncultivated microorganisms are screened for an activity of interest. Potential pathways encoding bioactive molecules of interest are first captured in prokaryotic cells in the form of gene expression libraries. Polynucleotides encoding activities of interest are isolated from such libraries and introduced into a host cell. The host cell is grown under conditions which promote recombination and/or reductive reassortment creating potentially active biomolecules with novel or enhanced activities.

In vivo biopanning may be performed utilizing a FACS-based and non-optical (e.g., magnetic) based machines. Complex gene libraries are constructed with vectors which contain elements which stabilize transcribed RNA. For example, the inclusion of sequences which result in secondary structures such as hairpins which are designed to flank the transcribed regions of the RNA would serve to enhance their stability, thus increasing their half life within the cell. The probe molecules used in the biopanning process consist of oligonucleotides labeled with reporter molecules that only fluoresce upon binding of the probe to a target molecule. These probes are introduced into the recombinant cells from the library using one of several transformation methods. The probe molecules bind to the transcribed target mRNA resulting in DNA/RNA heteroduplex molecules. Binding of the probe to a target will yield a fluorescent signal which is detected and sorted by the FACS machine during the screening process.

Additionally, subcloning may be performed to further isolate sequences of interest. In subcloning, a portion of DNA is amplified, digested, generally by restriction enzymes, to cut out the desired sequence, the desired sequence is ligated into a recipient vector and is amplified. At each step in subcloning, the portion is examined for the activity of interest, in order to ensure that DNA that encodes the structural protein has not been excluded. The insert may be purified at any step of the subcloning, for example, by gel electrophoresis prior to ligation into a vector or where cells containing the recipient vector and cells not containing the recipient vector are placed on selective media containing, for example, an antibiotic, which will kill the cells not containing the recipient vector. Specific methods of subcloning cDNA inserts into vectors are well-known in the art (Sambrook et al., Molecular Cloning: A Laboratory Manual, 2nd Ed., Cold Spring Harbor Laboratory Press (1989)). In another aspect, the enzymes of the invention are subclones. Such subclones may differ from the parent clone by, for example, length, a mutation, a tag or a label.

In one aspect, the signal sequences of the invention are identified following identification of a novel polypeptide, enzyme, protein, e.g. structural or binding protein. The pathways by which proteins are sorted and transported to their proper cellular location are often referred to as protein targeting pathways. One of the most important elements in all of these targeting systems is a short amino acid sequence at the amino terminus of a newly synthesized polypeptide called the signal sequence. This signal sequence directs a protein to its appropriate location in the cell and is removed during transport or when the protein reaches its final destination. Most lysosomal, membrane, or secreted proteins have an amino-terminal signal sequence that marks them for translocation into the lumen of the endoplasmic reticulum. More than 100 signal sequences for proteins in this group have been determined. The sequences vary in length from 13 to 36 amino acid residues. Various methods of recognition of signal sequences are known to those of skill in the art. In one aspect, the peptides are identified by a method referred to as SignalP. SignalP uses a combined neural network which recognizes both signal peptides and their cleavage sites. See, e.g., Nielsen (1997) "Identification of prokaryotic and eukaryotic signal peptides and prediction of their cleavage sites." Protein Engineering, vol. 10, no. 1, p. 1-6. It should be understood that some of the polypeptide, enzyme, protein, e.g. structural or binding proteins of the invention may or may not contain signal sequences. It may be desirable to include a nucleic acid sequence encoding a signal sequence from a polypeptide, enzyme, protein, e.g. structural or binding protein, operably linked to a nucleic acid sequence of a different a polypeptide, enzyme, protein, e.g. structural or binding protein may be desired.

The microorganisms from which the polynucleotide may be discovered, isolated or prepared include prokaryotic microorganisms, such as Eubacteria and Archaebacteria and lower eukaryotic microorganisms such as fungi, some algae and protozoa. Polynucleotides may be discovered, isolated or prepared from environmental samples in which case the nucleic acid may be recovered without culturing of an organism or recovered from one or more cultured organisms. In one aspect, such microorganisms may be extremophiles, such as hyperthermophiles, psychrophiles, psychrotrophs, halophiles, barophiles and acidophiles. Polynucleotides encoding enzymes isolated from extremophilic microorganisms can be used. Such enzymes may function at temperatures above 100° C. in terrestrial hot springs and deep searmal vents, at temperatures below 0° C. in arctic waters, in the saturated salt environment of the Dead Sea, at pH values around 0 in coal deposits and geothermal sulfur-rich springs, or at pH values greater than 11 in sewage sludge. For example, several esterases and lipases cloned and expressed from extremophilic organisms show high activity throughout a wide range of temperatures and pHs.

Polynucleotides selected and isolated as hereinabove described are introduced into a suitable host cell. A suitable host cell is any cell which is capable of promoting recombination and/or reductive reassortment. The selected polynucleotides are in one aspect already in a vector which includes appropriate control sequences. The host cell can be a higher eukaryotic cell, such as a manimalian cell, or a lower eukaryotic cell, such as a yeast cell, or in one aspect, the host cell can be a prokaryotic cell, such as a bacterial cell. Introduction of the construct into the host cell can be effected by calcium phosphate transfection, DEAE-Dextran mediated transfection, or electroporation (Davis et al., 1986).

As representative examples of appropriate hosts, there may be mentioned: bacterial cells, such as *E. coli, Streptomyces, Salmonella typhimurium*; fungal cells, such as yeast; insect cells such as *Drosophila* S2 and *Spodoptera* Sf9; animal cells such as CHO, COS or Bowes melanoma; adenoviruses; and plant cells. The selection of an appropriate host is deemed to be within the scope of those skilled in the art from the teachings herein.

With particular references to various mammalian cell culture systems that can be employed to express recombinant protein, examples of mammalian expression systems include the COS-7 lines of monkey kidney fibroblasts, described in "SV40-transformed simian cells support the replication of early SV40 mutants" (Gluzman, 1981) and other cell lines capable of expressing a compatible vector, for example, the C127, 3T3, CHO, HeLa and BHK cell lines. Mammalian expression vectors will comprise an origin of replication, a suitable promoter and enhancer and also any necessary ribosome binding sites, polyadenylation site, splice donor and acceptor sites, transcriptional termination sequences and 5' flanking nontranscribed sequences. DNA sequences derived from the SV40 splice and polyadenylation sites may be used to provide the required nontranscribed genetic elements.

In another aspect, it is envisioned the method of the present invention can be used to generate novel polynucleotides encoding biochemical pathways from one or more operons or gene clusters or portions thereof. For example, bacteria and many eukaryotes have a coordinated mechanism for regulating genes whose products are involved in related processes. The genes are clustered, in structures referred to as "gene clusters," on a single chromosome and are transcribed together under the control of a single regulatory sequence, including a single promoter which initiates transcription of the entire cluster. Thus, a gene cluster is a group of adjacent genes that are either identical or related, usually as to their function. An example of a biochemical pathway encoded by gene clusters are polyketides.

Gene cluster DNA can be isolated from different organisms and ligated into vectors, particularly vectors containing expression regulatory sequences which can control and regulate the production of a detectable protein or protein-related array activity from the ligated gene clusters. Use of vectors which have an exceptionally large capacity for exogenous DNA introduction are particularly appropriate for use with such gene clusters and are described by way of example herein to include the f-factor (or fertility factor) of *E. coli*. This f-factor of *E. coli* is a plasmid which affects high-frequency transfer of itself during conjugation and is ideal to achieve and stably propagate large DNA fragments, such as gene clusters from mixed microbial samples. One aspect is to use cloning vectors, referred to as "fosmids" or bacterial artificial chromosome (BAC) vectors. These are derived from *E. coli* f-factor which is able to stably integrate large segments of genomic DNA. When integrated with DNA from a mixed uncultured environmental sample, this makes it possible to achieve large genomic fragments in the form of a stable "environmental DNA library." Another type of vector for use in the present invention is a cosmid vector. Cosmid vectors were originally designed to clone and propagate large segments of genomic DNA. Cloning into cosmid vectors is described in detail in Sambrook et al., Molecular Cloning: A Laboratory Manual, 2nd Ed., Cold Spring Harbor Laboratory Press (1989). Once ligated into an appropriate vector, two or more vectors containing different polyketide synthase gene clusters can be introduced into a suitable host cell. Regions of partial sequence homology shared by the gene clusters will promote processes which result in sequence reorganization resulting in a hybrid gene cluster. The novel hybrid gene cluster can then be screened for enhanced activities not found in the original gene clusters.

Methods for screening for various enzyme activities are known to those of skill in the art and are discussed throughout the present specification. Such methods may be employed when isolating the polypeptides and polynucleotides of the invention.

In one aspect, the invention provides methods for discovering and isolating polypeptides, enzymes, proteins, e.g. structural or binding proteins or compounds to modify the enzymatic activity, using a whole cell approach. Putative clones encoding polypeptides, enzymes, proteins, e.g. structural or binding proteins from genomic DNA library can be screened.

Screening Methodologies and "On-Line" Monitoring Devices

In practicing the methods of the invention, a variety of apparatus and methodologies can be used to in conjunction with the polypeptides and nucleic acids of the invention, e.g., to screen polypeptides for a polypeptide, enzyme, protein, e.g. structural or binding protein, activity, to screen compounds as potential modulators, e.g., activators or inhibitors, of an enzyme, structural or binding activity, for antibodies that bind to a polypeptide of the invention, for nucleic acids that hybridize to a nucleic acid of the invention, to screen for cells expressing a polypeptide of the invention and the like. In addition to the array formats described in detail below for screening samples, alternative formats can also be used to practice the methods of the invention. Such formats include, for example, mass spectrometers, chromatographs, e.g., high-throughput HPLC and other forms of liquid chromatography, and smaller formats, such as 1536-well plates, 384-well plates and so on. High throughput screening apparatus can be adapted and used to practice the methods of the invention, see, e.g., U.S. Patent Application No. 20020001809.

Capillary Arrays

Nucleic acids or polypeptides of the invention can be immobilized to or applied to an array. Arrays can be used to screen for or monitor libraries of compositions (e.g., small molecules, antibodies, nucleic acids, etc.) for their ability to bind to or modulate the activity of a nucleic acid or a polypeptide of the invention. Capillary arrays, such as the GIGAMATRIX™, Diversa Corporation, San Diego, Calif.; and arrays described in, e.g., U.S. Patent Application No. 20020080350 A1; WO 0231203 A; WO 0244336 A, provide an alternative apparatus for holding and screening samples. In one aspect, the capillary array includes a plurality of capillaries formed into an array of adjacent capillaries, wherein each capillary comprises at least one wall defining a lumen for retaining a sample. The lumen may be cylindrical, square, hexagonal or any other geometric shape so long as the walls form a lumen for retention of a liquid or sample. The capillaries of the capillary array can be held together in close proximity to form a planar structure. The capillaries can be bound together, by being fused (e.g., where the capillaries are made of glass), glued, bonded, or clamped side-by-side. Additionally, the capillary array can include interstitial material disposed between adjacent capillaries in the array, thereby forming a solid planar device containing a plurality of through-holes.

A capillary array can be formed of any number of individual capillaries, for example, a range from 100 to 4,000,000 capillaries. Further, a capillary array having about 100,000 or more individual capillaries can be formed into the standard size and shape of a Microtiter® plate for fitment into standard laboratory equipment. The lumens are filled manually or automatically using either capillary action or microinjection using a thin needle. Samples of interest may subsequently be removed from individual capillaries for further analysis or characterization. For example, a thin, needle-like probe is positioned in fluid communication with a selected capillary to either add or withdraw material from the lumen.

In a single-pot screening assay, the assay components are mixed yielding a solution of interest, prior to insertion into the capillary array. The lumen is filled by capillary action when at least a portion of the array is immersed into a solution of interest. Chemical or biological reactions and/or activity in each capillary are monitored for detectable events. A detectable event is often referred to as a "hit", which can usually be distinguished from "non-hit" producing capillaries by optical detection. Thus, capillary arrays allow for massively parallel detection of "hits".

In a multi-pot screening assay, a polypeptide or nucleic acid, e.g., a ligand, can be introduced into a first component, which is introduced into at least a portion of a capillary of a capillary array. An air bubble can then be introduced into the capillary behind the first component. A second component can then be introduced into the capillary, wherein the second component is separated from the first component by the air bubble. The first and second components can then be mixed by applying hydrostatic pressure to both sides of the capillary array to collapse the bubble. The capillary array is then monitored for a detectable event resulting from reaction or non-reaction of the two components.

In a binding screening assay, a sample of interest can be introduced as a first liquid labeled with a detectable particle into a capillary of a capillary array, wherein the lumen of the capillary is coated with a binding material for binding the detectable particle to the lumen. The first liquid may then be removed from the capillary tube, wherein the bound detectable particle is maintained within the capillary, and a second liquid may be introduced into the capillary tube. The capillary is then monitored for a detectable event resulting from reaction or non-reaction of the particle with the second liquid.

Arrays, or "Biochips"

Nucleic acids or polypeptides of the invention can be immobilized to or applied to an array. Arrays can be used to screen for or monitor libraries of compositions (e.g., small molecules, antibodies, nucleic acids, etc.) for their ability to bind to or modulate the activity of a nucleic acid or a polypeptide of the invention. For example, in one aspect of the invention, a monitored parameter is transcript expression of a polypeptide, enzyme, protein, e.g. structural or binding protein, gene. One or more, or, all the transcripts of a cell can be measured by hybridization of a sample comprising transcripts of the cell, or, nucleic acids representative of or complementary to transcripts of a cell, by hybridization to immobilized nucleic acids on an array, or "biochip." By using an "array" of nucleic acids on a microchip, some or all of the transcripts of a cell can be simultaneously quantified. Alternatively, arrays comprising genomic nucleic acid can also be used to determine the genotype of a newly engineered strain made by the methods of the invention. Polypeptide arrays" can also be used to simultaneously quantify a plurality of proteins. The present invention can be practiced with any known "array," also referred to as a "microarray" or "nucleic acid array" or "polypeptide array" or "antibody array" or "biochip," or variation thereof. Arrays are generically a plurality of "spots" or "target elements," each target element comprising a defined amount of one or more biological molecules, e.g., oligonucleotides, immobilized onto a defined area of a substrate surface for specific binding to a sample molecule, e.g., mRNA transcripts.

The terms "array" or "microarray" or "biochip" or "chip" as used herein is a plurality of target elements, each target element comprising a defined amount of one or more polypeptides (including antibodies) or nucleic acids immobilized onto a defined area of a substrate surface, as discussed in further detail, below.

In practicing the methods of the invention, any known array and/or method of making and using arrays can be incorporated in whole or in part, or variations thereof, as described, for example, in U.S. Pat. Nos. 6,277,628; 6,277,489; 6,261,776; 6,258,606; 6,054,270; 6,048,695; 6,045,996; 6,022,963; 6,013,440; 5,965,452; 5,959,098; 5,856,174; 5,830,645; 5,770,456; 5,632,957; 5,556,752; 5,143,854; 5,807,522; 5,800,992; 5,744,305; 5,700,637; 5,556,752; 5,434,049; see also, e.g., WO 99/51773; WO 99/09217; WO 97/46313; WO 96/17958; see also, e.g., Johnston (1998) Curr. Biol. 8:R171-R174; Schummer (1997) Biotechniques 23:1087-1092; Kern (1997) Biotechniques 23:120-124; Solinas-Toldo (1997) Genes, Chromosomes & Cancer 20:399-407; Bowtell (1999) Nature Genetics Supp. 21:25-32. See also published U.S. patent applications Nos. 20010018642; 20010019827; 20010016322; 20010014449; 20010014448; 20010012537; 20010008765.

Antibodies and Antibody-Based Screening Methods

The invention provides isolated or recombinant antibodies that specifically bind to a polypeptide, enzyme, protein, e.g. structural or binding protein, of the invention. These antibodies can be used to isolate, identify or quantify the polypeptide, enzyme, protein, e.g. structural or binding proteins of the invention or related polypeptides. These antibodies can be used to isolate other polypeptides within the scope the invention or other related a polypeptide, enzyme, protein, e.g. structural or binding protein. The antibodies can be designed to bind to an active site of a polypeptide, enzyme, protein, e.g. structural or binding protein. Thus, the invention provides methods of inhibiting a polypeptide, enzyme, protein, e.g. structural or binding protein, using the antibodies of the invention (see discussion above regarding applications for anti-polypeptide, anti-enzyme, anti-protein, e.g., anti-structural or anti-binding protein compositions of the invention).

The invention provides fragments of the enzymes of the invention, including immunogenic fragments of a polypeptide of the invention. The invention provides compositions comprising a polypeptide or peptide of the invention and adjuvants or carriers and the like.

The term "antibody" includes a peptide or polypeptide derived from, modeled after or substantially encoded by an immunoglobulin gene or immunoglobulin genes, or fragments thereof, capable of specifically binding an antigen or epitope, see, e.g. Fundamental Immunology, Third Edition, W. E. Paul, ed., Raven Press, N.Y. (1993); Wilson (1994) J. Immunol. Methods 175:267-273; Yarmush (1992) J. Biochem. Biophys. Methods 25:85-97. The term antibody includes antigen-binding portions, i.e., "antigen binding sites," (e.g., fragments, subsequences, complementarity determining regions (CDRs)) that retain capacity to bind antigen, including (i) a Fab fragment, a monovalent fragment consisting of the VL, VH, CL and CH1 domains; (ii) a F(ab')2 fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) Nature 341:544-546), which consists of a VH domain; and (vi) an isolated complementarity determining region (CDR). Single chain antibodies are also included by reference in the term "antibody."

The antibodies can be used in immunoprecipitation, staining, immunoaffinity columns, and the like. If desired, nucleic acid sequences encoding for specific antigens can be generated by immunization followed by isolation of polypeptide or nucleic acid, amplification or cloning and immobilization of polypeptide onto an array of the invention. Alternatively, the methods of the invention can be used to modify the structure of an antibody produced by a cell to be modified, e.g., an antibody's affinity can be increased or decreased. Furthermore, the ability to make or modify antibodies can be a phenotype engineered into a cell by the methods of the invention.

Methods of immunization, producing and isolating antibodies (polyclonal and monoclonal) are known to those of skill in the art and described in the scientific and patent literature, see, e.g., Coligan, CURRENT PROTOCOLS IN IMMUNOLOGY, Wiley/Greene, N.Y. (1991); Stites (eds.) BASIC AND CLINICAL IMMUNOLOGY (7th ed.) Lange Medical Publications, Los Altos, Calif. ("Stites"); Goding, MONOCLONAL ANTIBODIES: PRINCIPLES AND PRACTICE (2d ed.) Academic Press, New York, N.Y. (1986); Kohler (1975) Nature 256:495; Harlow (1988) ANTIBODIES, A LABORATORY MANUAL, Cold Spring Harbor Publications, New York. Antibodies also can be generated in vitro, e.g., using recombinant antibody binding site expressing phage display libraries, in addition to the traditional in vivo methods using animals. See, e.g., Hoogenboom (1997) Trends Biotechnol. 15:62-70; Katz (1997) Annu. Rev. Biophys. Biomol. Struct. 26:27-45.

The polypeptides of the invention or fragments comprising at least 5, 10, 15, 20, 25, 30, 35, 40, 50, 75, 100, or 150 consecutive amino acids thereof, may also be used to generate antibodies which bind specifically to the polypeptides or fragments. The resulting antibodies may be used in immunoaffinity chromatography procedures to isolate or purify the polypeptide or to determine whether the polypeptide is present in a biological sample. In such procedures, a protein preparation, such as an extract, or a biological sample is contacted with an antibody capable of specifically binding to one of the polypeptides of the invention, or fragments comprising at least 5, 10, 15, 20, 25, 30, 35, 40, 50, 75, 100, or 150 consecutive amino acids thereof.

In immunoaffinity procedures, the antibody is attached to a solid support, such as a bead or other column matrix. The protein preparation is placed in contact with the antibody under conditions in which the antibody specifically binds to one of the polypeptides of the invention, or fragment thereof. After a wash to remove non-specifically bound proteins, the specifically bound polypeptides are eluted.

The ability of proteins in a biological sample to bind to the antibody may be determined using any of a variety of procedures familiar to those skilled in the art. For example, binding may be determined by labeling the antibody with a detectable label such as a fluorescent agent, an enzymatic label, or a radioisotope. Alternatively, binding of the antibody to the sample may be detected using a secondary antibody having such a detectable label thereon. Particular assays include ELISA assays, sandwich assays, radioimmunoassays and Western Blots.

Polyclonal antibodies generated against the polypeptides of the invention, or fragments comprising at least 5, 10, 15, 20, 25, 30, 35, 40, 50, 75, 100, or 150 consecutive amino acids thereof can be obtained by direct injection of the polypeptides into an animal or by administering the polypeptides to an animal, for example, a nonhuman. The antibody so obtained can bind the polypeptide itself. In this manner, even a sequence encoding only a fragment of the polypeptide can be used to generate antibodies which may bind to the whole native polypeptide. Such antibodies can then be used to isolate the polypeptide from cells expressing that polypeptide.

For preparation of monoclonal antibodies, any technique which provides antibodies produced by continuous cell line cultures can be used. Examples include the hybridoma technique (Kohler and Milstein, Nature, 256:495-497, 1975), the trioma technique, the human B-cell hybridoma technique (Kozbor et al., Immunology Today 4:72, 1983) and the EBV-hybridoma technique (Cole, et al., 1985, in Monoclonal Antibodies and Cancer Therapy, Alan R. Liss, Inc., pp. 77-96).

Techniques described for the production of single chain antibodies (U.S. Pat. No. 4,946,778) can be adapted to produce single chain antibodies to the polypeptides of the invention, or fragments comprising at least 5, 10, 15, 20, 25, 30, 35, 40, 50, 75, 100, or 150 consecutive amino acids thereof. Alternatively, transgenic mice may be used to express humanized antibodies to these polypeptides or fragments thereof.

Antibodies generated against the polypeptides of the invention, or fragments comprising at least 5, 10, 15, 20, 25, 30, 35, 40, 50, 75, 100, or 150 consecutive amino acids thereof may be used in screening for similar polypeptides from other organisms and samples. In such techniques, polypeptides from the organism are contacted with the antibody and those polypeptides which specifically bind the antibody are detected. Any of the procedures described above may be used to detect antibody binding. One such screening assay is described in "Methods for Measuring Cellulase Activities", *Methods in Enzymology*, Vol 160, pp. 87-116.

Kits

The invention provides kits comprising the compositions, e.g., nucleic acids, expression cassettes, vectors, cells, transgenic seeds or plants or plant parts, polypeptides and/or antibodies of the invention. The kits also can contain instructional material teaching the methodologies and uses of the enzymes of the invention (see, e.g., Table 3), including the industrial, experimental, food and feed processing and medical uses of the compositions and methods of the invention, as described herein.

Whole Cell Engineering and Measuring Metabolic Parameters

The methods of the invention provide whole cell evolution, or whole cell engineering, of a cell to develop a new cell strain having a new phenotype, e.g., a new or modified a polypeptide, enzyme, protein, e.g. structural or binding protein, activity, by modifying the genetic composition of the cell. The genetic composition can be modified by addition to the cell of a nucleic acid of the invention, e.g., a coding sequence for an enzyme of the invention. See, e.g., WO0229032; WO0196551.

To detect the new phenotype, at least one metabolic parameter of a modified cell is monitored in the cell in a "real time" or "on-line" time frame. In one aspect, a plurality of cells, such as a cell culture, is monitored in "real time" or "on-line." In one aspect, a plurality of metabolic parameters is monitored in "real time" or "on-line." Metabolic parameters can be monitored using the polypeptide, enzyme, protein, e.g. structural or binding proteins of the invention.

Metabolic flux analysis (MFA) is based on a known biochemistry framework. A linearly independent metabolic matrix is constructed based on the law of mass conservation and on the pseudo-steady state hypothesis (PSSH) on the intracellular metabolites. In practicing the methods of the invention, metabolic networks are established, including the:

- identity of all pathway substrates, products and intermediary metabolites
- identity of all the chemical reactions interconverting the pathway metabolites, the stoichiometry of the pathway reactions,
- identity of all the enzymes catalyzing the reactions, the enzyme reaction kinetics,
- the regulatory interactions between pathway components, e.g. allosteric interactions, enzyme-enzyme interactions etc.
- intracellular compartmentalization of enzymes or any other supramolecular organization of the enzymes, and,
- the presence of any concentration gradients of metabolites, enzymes or effector molecules or diffusion barriers to their movement.

Once the metabolic network for a given strain is built, mathematic presentation by matrix notion can be introduced to estimate the intracellular metabolic fluxes if the on-line metabolome data is available. Metabolic phenotype relies on the changes of the whole metabolic network within a cell. Metabolic phenotype relies on the change of pathway utilization with respect to environmental conditions, genetic regulation, developmental state and the genotype, etc. In one aspect of the methods of the invention, after the on-line MFA calculation, the dynamic behavior of the cells, their phenotype and other properties are analyzed by investigating the pathway utilization. For example, if the glucose supply is increased and the oxygen decreased during the yeast fermentation, the utilization of respiratory pathways will be reduced and/or stopped, and the utilization of the fermentative pathways will dominate. Control of physiological state of cell cultures will become possible after the pathway analysis. The methods of the invention can help determine how to manipulate the fermentation by determining how to change the substrate supply, temperature, use of inducers, etc. to control the physiological state of cells to move along desirable direction. In practicing the methods of the invention, the MFA results can also be compared with transcriptome and proteome data to design experiments and protocols for metabolic engineering or gene shuffling, etc.

In practicing the methods of the invention, any modified or new phenotype can be conferred and detected, including new or improved characteristics in the cell. Any aspect of metabolism or growth can be monitored.

Monitoring Expression of an mRNA Transcript

In one aspect of the invention, the engineered phenotype comprises increasing or decreasing the expression of an mRNA transcript (e.g., a polypeptide, enzyme, protein, e.g. structural or binding protein, message) or generating new (e.g., polypeptide, enzyme, protein, e.g. structural or binding protein) transcripts in a cell. This increased or decreased expression can be traced by testing for the presence of a polypeptide, enzyme, protein, e.g. structural or binding protein, of the invention or by a polypeptide, enzyme, protein, e.g. structural or binding protein, activity assays. Such assays are well known in the art. mRNA transcripts, or messages, also can be detected and quantified by any method known in the art, including, e.g., Northern blots, quantitative amplification reactions, hybridization to arrays, and the like. Quantitative amplification reactions include, e.g., quantitative PCR, including, e.g., quantitative reverse transcription polymerase chain reaction, or RT-PCR; quantitative real time RT-PCR, or "real-time kinetic RT-PCR" (see, e.g., Kreuzer (2001) Br. J. Haematol. 114:313-318; Xia (2001) Transplantation 72:907-914).

In one aspect of the invention, the engineered phenotype is generated by knocking out expression of a homologous gene. The gene's coding sequence or one or more transcriptional control elements can be knocked out, e.g., promoters or enhancers. Thus, the expression of a transcript can be completely ablated or only decreased.

In one aspect of the invention, the engineered phenotype comprises increasing the expression of a homologous gene. This can be effected by knocking out of a negative control element, including a transcriptional regulatory element acting in cis- or trans-, or, mutagenizing a positive control element. One or more, or, all the transcripts of a cell can be measured by hybridization of a sample comprising transcripts of the cell, or, nucleic acids representative of or complementary to transcripts of a cell, by hybridization to immobilized nucleic acids on an array.

Monitoring Expression of a Polypeptides, Peptides and Amino Acids

In one aspect of the invention, the engineered phenotype comprises increasing or decreasing the expression of a polypeptide (e.g., a polypeptide, enzyme, protein, e.g. structural or binding protein) or generating new polypeptides in a cell. This increased or decreased expression can be traced by determining the amount of a polypeptide, enzyme, protein, e.g. structural or binding protein, present or by a polypeptide, enzyme, protein, e.g. structural or binding protein, activity assays.

Polypeptides, peptides and amino acids also can be detected and quantified by any method known in the art, including, e.g., nuclear magnetic resonance (NMR), spectrophotometry, radiography (protein radiolabeling), electrophoresis, capillary electrophoresis, high performance liquid chromatography (HPLC), thin layer chromatography (TLC), hyperdiffusion chromatography, various immunological methods, e.g. immunoprecipitation, immunodiffusion, immuno-electrophoresis, radioimmunoassays (RIAs), enzyme-linked immunosorbent assays (ELISAs), immunofluorescent assays, gel electrophoresis (e.g., SDS-PAGE), staining with antibodies, fluorescent activated cell sorter (FACS), pyrolysis mass spectrometry, Fourier-Transform Infrared Spectrometry, Raman spectrometry, GC-MS, and LC-Electrospray and cap-LC-tandem-electrospray mass spectrometries, and the like. Novel bioactivities can also be screened using methods, or variations thereof, described in U.S. Pat. No. 6,057,103. Furthermore, as discussed below in detail, one or more, or, all the polypeptides of a cell can be measured using a protein array.

Pharmaceutical Compositions and Dietary Supplements

The invention provides pharmaceutical compositions, e.g., formulations, comprising a composition (including polypeptide, nucleic acid, or antibody) of the invention and a pharmaceutically acceptable excipient. The invention provides enteral and parenteral formulations comprising compositions of the invention. For example, the invention provides oral formulations (including or dietary supplements) comprising a composition of the invention. The invention provides formulations and methods for treating, ameliorating, diagnosing or preventing disease of condition of interest; e.g., in one aspect the invention provides methods comprising providing a pharmaceutical composition or dietary supplement comprising a composition of the invention; and administering an effective amount of the pharmaceutical composition or dietary supplement to a subject in need thereof.

The compositions and methods of the invention can also be practiced ex vivo or in vitro, or on a non-biological fluid or substance. In one aspect, the compositions and methods comprise providing a pharmaceutical composition or dietary supplement comprising a formulation of the invention; and administering an effective amount of the pharmaceutical composition or dietary supplement to a subject in need thereof.

The pharmaceutical compositions and dietary supplements used in the methods of the invention can be administered by any means known in the art, e.g., parenterally, topically, orally, or by local administration, such as by aerosol or transdermally. The compositions and dietary supplements of the invention can be formulated as a tablet, gel, geltab, pill, implant, liquid, spray, powder, food, feed pellet, as an injectable formulation or as an encapsulated formulation. The pharmaceutical compositions and dietary supplements can be formulated in any way and can be administered in a variety of unit dosage forms depending upon the condition or disease and the degree of illness, the general medical condition of each patient, the resulting preferred method of administration and the like. Details on techniques for formulation and administration are well described in the scientific and patent literature, see, e.g., the latest edition of Remington's Pharmaceutical Sciences, Maack Publishing Co, Easton Pa. ("Remington's") (e.g., Remington, The Science and Practice of Pharmacy, 21st Edition, by University of the Sciences in Philadelphia, Editor).

Pharmaceutical formulations and dietary supplements can be prepared according to any method known to the art for the manufacture of pharmaceuticals and dietary supplements. Such drugs and dietary supplements can contain sweetening agents, flavoring agents, coloring agents and preserving agents. A formulation (which includes "dietary supplements") can be admixtured with nontoxic pharmaceutically or orally acceptable excipients which are suitable for manufacture. Formulations may comprise one or more diluents, emulsifiers, preservatives, buffers, excipients, etc. and may be provided in such forms as liquids, powders, emulsions, lyophilized powders, sprays, creams, lotions, controlled release formulations, tablets, pills, gels, on patches, in implants, etc.

Pharmaceutical formulations and dietary supplements for oral administration can be formulated using pharmaceutically acceptable carriers well known in the art in appropriate and suitable dosages. Such carriers enable the pharmaceuticals and dietary supplements to be formulated in unit dosage forms as tablets, pills, powder, dragees, capsules, liquids, lozenges, gels, syrups, slurries, suspensions, etc., suitable for ingestion by the patient. Pharmaceutical preparations and dietary supplements for oral use can be formulated as a solid excipient, optionally grinding a resulting mixture, and processing the mixture of granules, after adding suitable additional compounds, if desired, to obtain tablets or dragee cores. Suitable solid excipients are carbohydrate or protein fillers include, e.g., sugars, including lactose, sucrose, mannitol, or sorbitol; starch from corn, wheat, rice, potato, or other plants; cellulose such as methyl cellulose, hydroxypropylmethylcellulose, or sodium carboxy-methylcellulose; and gums including arabic and tragacanth; and proteins, e.g., gelatin and collagen. Disintegrating or solubilizing agents may be added, such as the cross-linked polyvinyl pyrrolidone, agar, alginic acid, or a salt thereof, such as sodium alginate.

Dragee cores are provided with suitable coatings such as concentrated sugar solutions, which may also contain gum arabic, talc, polyvinylpyrrolidone, carbopol gel, polyethylene glycol, and/or titanium dioxide, lacquer solutions, and suitable organic solvents or solvent mixtures. Dyestuffs or pigments may be added to the tablets or dragee coatings for product identification or to characterize the quantity of active compound (i.e., dosage). Pharmaceutical preparations and dietary supplements of the invention can also be used orally using, e.g., push-fit capsules made of gelatin, as well as soft, sealed capsules made of gelatin and a coating such as glycerol or sorbitol. Push-fit capsules can contain active agents mixed with a filler or binders such as lactose or starches, lubricants such as talc or magnesium stearate, and, optionally, stabilizers. In soft capsules, the active agents can be dissolved or suspended in suitable liquids, such as fatty oils, liquid paraffin, or liquid polyethylene glycol with or without stabilizers.

Aqueous suspensions can contain an active agent (e.g., an enzyme or peptidomimetic of the invention) in admixture with excipients suitable for the manufacture of aqueous suspensions. Such excipients include a suspending agent, such as sodium carboxymethylcellulose, methylcellulose, hydroxypropylmethylcellulose, sodium alginate, polyvinylpyrrolidone, gum tragacanth and gum acacia, and dispersing or wetting agents such as a naturally occurring phosphatide (e.g., lecithin), a condensation product of an alkylene oxide with a fatty acid (e.g., polyoxyethylene stearate), a condensation product of ethylene oxide with a long chain aliphatic alcohol (e.g., heptadecaethylene oxycetanol), a condensation product of ethylene oxide with a partial ester derived from a fatty acid and a hexitol (e.g., polyoxyethylene sorbitol mono-oleate), or a condensation product of ethylene oxide with a partial ester derived from fatty acid and a hexitol anhydride (e.g., polyoxyethylene sorbitan mono-oleate). The aqueous suspension can also contain one or more preservatives such as ethyl or n-propyl p-hydroxybenzoate, one or more coloring agents, one or more flavoring agents and one or more sweetening agents, such as sucrose, aspartame or saccharin. Formulations can be adjusted for osmolarity.

Oil-based pharmaceuticals are particularly useful for administration of hydrophobic formulations or active agents of the invention. Oil-based suspensions can be formulated by suspending an active agent (e.g., a composition of the invention) in a vegetable oil, such as arachis oil, olive oil, sesame oil or coconut oil, or in a mineral oil such as liquid paraffin; or a mixture of these. See e.g., U.S. Pat. No. 5,716,928 describing using essential oils or essential oil components for increasing bioavailability and reducing inter- and intra-individual variability of orally administered hydrophobic pharmaceutical compounds (see also U.S. Pat. No. 5,858,401). The oil suspensions can contain a thickening agent, such as beeswax, hard paraffin or cetyl alcohol. Sweetening agents can be added to provide a palatable oral preparation, such as glycerol, sorbitol or sucrose. These formulations and dietary supplements can be preserved by the addition of an antioxidant such as ascorbic acid. As an example of an injectable oil vehicle, see Minto (1997) J. Pharmacol. Exp. Ther. 281:93-102.

The pharmaceutical formulations and dietary supplements of the invention can also be in the form of oil-in-water emulsions. The oily phase can be a vegetable oil or a mineral oil, described above, or a mixture of these. Suitable emulsifying agents include naturally-occurring gums, such as gum acacia and gum tragacanth, naturally occurring phosphatides, such as soybean lecithin, esters or partial esters derived from fatty acids and hexitol anhydrides, such as sorbitan mono-oleate, and condensation products of these partial esters with ethylene oxide, such as polyoxyethylene sorbitan mono-oleate. The emulsion can also contain sweetening agents and flavoring agents, as in the formulation of syrups and elixirs. Such formulations can also contain a demulcent, a preservative, or a coloring agent.

In the methods of the invention, the pharmaceutical compounds and dietary supplements can also be administered by in intranasal, intraocular and intravaginal routes including suppositories, insufflation, powders and aerosol formulations (for examples of steroid inhalants, see Rohatagi (1995) J. Clin. Pharmacol. 35:1187-1193; Tjwa (1995) Ann. Allergy Asthma Immunol. 75:107-111). Suppositories formulations can be prepared by mixing the drug with a suitable non-irritating excipient which is solid at ordinary temperatures but liquid at body temperatures and will therefore melt in the body to release the drug. Such materials are cocoa butter and polyethylene glycols.

In the methods of the invention, the pharmaceutical compounds and dietary supplements can be delivered by transdermally, by a topical route, formulated as applicator sticks, solutions, suspensions, emulsions, gels, creams, ointments, pastes, jellies, paints, powders, and aerosols.

In the methods of the invention, the pharmaceutical compounds and dietary supplements can also be delivered as microspheres for slow release in the body. For example, microspheres can be administered via intradermal injection of drug which slowly release subcutaneously; see Rao (1995) J. Biomater Sci. Polym. Ed. 7:623-645; as biodegradable and injectable gel formulations, see, e.g., Gao (1995) Pharm. Res. 12:857-863 (1995); or, as microspheres for oral administration, see, e.g., Eyles (1997) J. Pharm. Pharmacol. 49:669-674.

In the methods of the invention, the pharmaceutical compounds can be parenterally administered, such as by intravenous (IV) administration or administration into a body cavity or lumen of an organ. These formulations can comprise a solution of active agent dissolved in a pharmaceutically acceptable carrier. Acceptable vehicles and solvents that can be employed are water and Ringer's solution, an isotonic sodium chloride. In addition, sterile fixed oils can be employed as a solvent or suspending medium. For this purpose any bland fixed oil can be employed including synthetic mono- or diglycerides. In addition, fatty acids such as oleic acid can likewise be used in the preparation of injectables. These solutions are sterile and generally free of undesirable matter. These formulations may be sterilized by conventional, well known sterilization techniques. The formulations may contain pharmaceutically acceptable auxiliary substances as required to approximate physiological conditions such as pH adjusting and buffering agents, toxicity adjusting agents, e.g., sodium acetate, sodium chloride, potassium chloride, calcium chloride, sodium lactate and the like. The concentration of active agent in these formulations can vary widely, and will be selected primarily based on fluid volumes, viscosities, body weight, and the like, in accordance with the particular mode of administration selected and the patient's needs. For IV administration, the formulation can be a sterile injectable preparation, such as a sterile injectable aqueous or oleaginous suspension. This suspension can be formulated using those suitable dispersing or wetting agents and suspending agents. The sterile injectable preparation can also be a suspension in a nontoxic parenterally-acceptable diluent or solvent, such as a solution of 1,3-butanediol. The administration can be by bolus or continuous infusion (e.g., substantially uninterrupted introduction into a blood vessel for a specified period of time).

The pharmaceutical compounds, formulations and dietary supplements of the invention can be lyophilized. The invention provides a stable lyophilized formulation comprising a composition of the invention, which can be made by lyophilizing a solution comprising a pharmaceutical of the invention and a bulking agent, e.g., mannitol, trehalose, raffinose, and sucrose or mixtures thereof. A process for preparing a stable lyophilized formulation can include the equivalent of lyophilizing a solution about 2.5 mg/mL protein, about 15 mg/mL sucrose, about 19 mg/mL NaCl, and a sodium citrate buffer having a pH greater than 5.5 but less than 6.5. See, e.g., U.S. patent app. no. 20040028670.

The compositions (e.g., formulations, including dietary supplements) of the invention can be delivered by the use of liposomes. By using liposomes, particularly where the liposome surface carries ligands specific for target cells, or are otherwise preferentially directed to a specific organ, one can focus the delivery of the active agent into target cells in vivo. See, e.g., U.S. Pat. Nos. 6,063,400; 6,007,839; Al-Muhammed (1996) J. Microencapsul. 13:293-306; Chonn (1995) Curr. Opin. Biotechnol. 6:698-708; Ostro (1989) Am. J. Hosp. Pharm. 46:1576-1587.

The compositions (e.g., formulations, including dietary supplements) of the invention can be administered for prophylactic and/or therapeutic treatments. In therapeutic applications, compositions are administered to a subject already suffering from a condition, infection or disease of interest in an amount sufficient to cure, alleviate or partially arrest the clinical manifestations of the condition, infection or disease and its complications (a "therapeutically effective amount"). In the methods of the invention, a pharmaceutical composition is administered in an amount sufficient to treat (e.g., ameliorate) or prevent a disease-related condition, a diseases or a symptoms, or to decrease or increase the amount of substance in a body fluid such as blood, serum, CSF and the like. The amount of composition (e.g., pharmaceutical compositions, formulations, including dietary supplements) adequate to accomplish this is defined as a "therapeutically effective dose." The dosage schedule and amounts effective for this use, i.e., the "dosing regimen," will depend upon a variety of factors, including the stage of the disease or condition, the severity of the disease or condition, the general state of the patient's health, the patient's physical status, age and the like. In calculating the dosage regimen for a patient, the mode of administration also is taken into consideration.

The dosage regimen also takes into consideration pharmacokinetics parameters well known in the art, i.e., the active agents' rate of absorption, bioavailability, metabolism, clearance, and the like (see, e.g., Hidalgo-Aragones (1996) J. Steroid Biochem. Mol. Biol. 58:611-617; Groning (1996) Pharmazie 51:337-341; Fotherby (1996) Contraception 54:59-69; Johnson (1995) J. Pharm. Sci. 84:1144-1146; Rohatagi (1995) Pharmazie 50:610-613; Brophy (1983) Eur. J. Clin. Pharmacol. 24:103-108; the latest Remington's, supra). The state of the art allows the clinician to determine the dosage regimen for each individual patient, active agent and disease or condition treated. Guidelines provided for similar compositions used as pharmaceuticals can be used as guidance to determine the dosage regiment, i.e., dose schedule and dosage levels, administered practicing the methods of the invention are correct and appropriate.

Single or multiple administrations of compositions (e.g., pharmaceutical compositions, formulations, including dietary supplements) of the invention can be given depending on the dosage and frequency as required and tolerated by the patient. The compositions should provide a sufficient quantity of active agent to effectively treat, ameliorate or prevent PKU or other PKU-related conditions, diseases or symptoms. For example, an exemplary pharmaceutical formulation for oral administration of a protein of the invention is in a daily amount of between about 0.1 to 0.5 to about 20, 50, 100 or 1000 or more ug per kilogram of body weight per day. In an alternative embodiment, dosages are from about 1 mg to about 4 mg per kg of body weight per patient per day are used. Lower dosages can be used, in contrast to administration orally, into the blood stream, into a body cavity or into a lumen of an organ. Substantially higher dosages can be used in topical or oral administration or administering by powders, spray or inhalation. Actual methods for preparing parenterally or non-parenterally administrable formulations will be known or apparent to those skilled in the art and are described in more detail in such publications as Remington's, supra.

The compositions (e.g., pharmaceutical compositions, formulations, including dietary supplements) of the invention can further comprise other drugs or pharmaceuticals, e.g., compositions for treating a disease of interest and related symptoms or conditions. The methods of the invention can further comprise co-administration with other drugs or pharmaceuticals, e.g., compositions for treating septic shock, infection, fever, pain and related symptoms or conditions. For example, the methods and/or compositions and formulations of the invention can be co-formulated with and/or co-administered with antibiotics (e.g., antibacterial or bacteriostatic peptides or proteins), particularly those effective against bacteria or toxins, e.g., germ warfare agents, gram negative bacteria, fluids, cytokines, immunoregulatory agents, anti-inflammatory agents, complement activating agents, such as peptides or proteins comprising collagen-like domains or fibrinogen-like domains (e.g., a ficolin), carbohydrate-binding domains, and the like and combinations thereof.

In one aspect, the polypeptide (e.g., including a pharmaceutical composition or dietary supplement) of the invention is chemically modified. For example, the polypeptide can be chemically modified to produce a protected form that possesses better specific activity, prolonged half-life, and/or reduced immunogenicity in vivo. A polypeptide of the invention can be modified by any means known in the art, for example, by glycosylation, pegylation or a combination thereof.

In one aspect, the polypeptide (e.g., including a pharmaceutical composition or dietary supplement) of the invention is formulated by encapsulation in a liposome, or a micro- or nano-structure, such as a nanotubule or a nano- or microcapsule.

In one aspect, the polypeptide is formulated in a matrix stabilized enzyme crystal. The invention also provides matrix stabilized enzyme crystals comprising a polypeptide of the invention for use as pharmaceutical composition or dietary supplement, e.g., to treat or ameliorate a disease or condition of interest, e.g., as described in U.S. Patent App. No. 20020182201; for example, the formulation can be a cross-linked crystalline enzyme and a polymer with a reactive moiety effective to adhere to the crystal layer of the crystalline enzyme. The invention also provides polypeptides of the invention as polymers in the form of multimerized (e.g., multi-functional) cross-linking forms; which in one aspect comprise a matrix stabilized enzyme crystal, e.g., a form resistant to degradation by proteolytic enzymes; and in alternative aspects, the cross-linking reagents comprise a dialdehyde cross-linking reagent, such as a linear or branched dialdehyde, or a substituted or unsubstituted glutaraldehyde (1,5-pentanedial), malonaldehyde (1,3-propanedial), succinaldehyde (1,4-butanedial), adipaldehyde (1,6-hexanedial), pimelaldehyde (1,7-heptanedial), or, glutaraldehyde; in other alternative aspects, the cross-linking reagents comprise carbodiimides, isoxazolium derivatives, chloroformates, carbonyldiimidazole, bis-imidoesters, bis-succinimidyl derivatives, di-isocyanates, di-isothiocyanates, di-sylfonyl halides, bis-nitrophenyl esters, dialdehydes, diacylazides, bis-maleimides, bis-haloacetyl derivatives, di-alkyl halides and bis-oxiranes (e.g., as described in U.S. Pat. No. 5,753,487).

The compositions of the invention can also be manufactured into biocompatible matrices, e.g., sol-gels, for encapsulating a polypeptide of the invention for use as pharmaceutical composition or dietary supplement, e.g., to treat or ameliorate a disease or condition of interest. In one aspect, compositions of the invention are manufactured as silica-based (e.g., oxysilane) sol-gel matrices, e.g., as described in U.S. Pat. No. 6,395,299, Pat. App. No. 20040241205. The invention also provides nano- or microcapsules comprising a composition of the invention for use as pharmaceutical composition or dietary supplement, e.g., to treat or ameliorate a disease or condition of interest, e.g., as described in U.S. Patent App. No. 20030157181.

The pharmaceutical compositions of the invention can be manufactured using any conventional method, e.g., mixing, dissolving, granulating, dragée-making, levigating, emulsifying, encapsulating, entrapping, melt-spinning, spray-drying, or lyophilizing processes. Alternative pharmaceutical formulations can be determined depending on the patient (e.g., adult or pediatric), condition, route of administration (e.g., oral) and the desired dosage.

Applications—Industrial, Medical Experimental, Food and Feed Processing

Polypeptides (including enzymes and antibodies) and nucleic acids of the invention can be used for a variety of industrial, experimental, food and feed processing, nutritional and pharmaceutical applications, e.g., for food and feed supplements, colorants, neutraceuticals, cosmetic and pharmaceutical needs.

Polypeptides of the invention (e.g., having enzyme, structural or binding activity) can be highly selective catalysts. The invention provides methods using enzymes of the invention in the food and feed industries, e.g., in methods for making food and feed products and food and feed additives. In one aspect, the invention provides processes using enzymes of the invention in the medical industry, e.g., to make pharmaceuticals.

The enzymes of the invention can catalyze reactions with exquisite stereo-, regio- and chemo-selectivities. The polypeptide, enzyme, protein, e.g. structural or binding proteins of the invention can be engineered to function in various solvents, operate at extreme pHs (for example, high pHs and low pHs) extreme temperatures (for example, high temperatures and low temperatures), extreme salinity levels (for example, high salinity and low salinity) and catalyze reactions with compounds that are structurally unrelated to their natural, physiological substrates.

Animal Feeds and Food or Feed Additives

The invention provides compositions (e.g., enzymes of the invention, as those described in Tables 1, 2, and 3) methods for treating animal feeds and foods and food or feed additives using a polypeptide, enzyme, protein, e.g. structural or binding protein, of the invention, and/or the antibodies of the invention. The invention provides animal feeds, foods, and additives comprising a polypeptide, enzyme, protein, e.g. structural or binding protein, of the invention, antibodies of the invention. The animal can be any farm animal or any animal raised for its meat, e.g., a pig, goat, cattle, sheep, horse and the like.

The animal feed additive of the invention may be a granulated enzyme product that may readily be mixed with feed components. Alternatively, feed additives of the invention can form a component of a pre-mix. The granulated enzyme product of the invention may be coated or uncoated. The particle size of the enzyme granulates can be compatible with that of feed and pre-mix components. This provides a safe and convenient mean of incorporating enzymes into feeds. Alternatively, the animal feed additive of the invention may be a stabilized liquid composition. This may be an aqueous or oil-based slurry. See, e.g., U.S. Pat. No. 6,245,546.

A polypeptide, enzyme, protein, e.g. structural or binding protein, of the present invention, in the modification of animal feed or a food, can process the food or feed either in vitro (by modifying components of the feed or food) or in vivo. Polypeptides of the invention can be added to animal feed or food compositions.

In one aspect, an enzyme of the invention has any of the following enzyme activities, or is added in combination with another enzyme, e.g., beta-galactosidases, catalases, laccases, cellulases, endoglycosidases, endo-beta-1,4-laccases, amyloglucosidases, glucose isomerases, glycosyltransferases, lipases, phospholipases, lipooxygenases, beta-laccases, endo-beta-1,3(4)-laccases, cutinases, peroxidases, amylases, glucoamylases, pectinases, reductases, oxidases, decarboxylases, phenoloxidases, ligninases, pullulanases, arabinanases, hemicellulases, mannanases, xylolaccases, xylanases, pectin acetyl esterases, rhamnogalacturonan acetyl esterases, proteases, peptidases, proteinases, polygalacturonases, rhamnogalacturonases, galactanases, pectin lyases, transglutaminases, pectin methylesterases, cellobiohydrolases and/or transglutaminases. These enzyme digestion products are more digestible by the animal. Thus, a polypeptide, enzyme, protein, e.g. structural or binding protein, of the invention can contribute to the available energy of the feed or food. Also, a polypeptide, enzyme, protein, e.g. structural or binding protein, of the invention can improve the digestibility and uptake of carbohydrate and non-carbohydrate feed or food constituents such as protein, fat and minerals.

In another aspect, a polypeptide, enzyme, protein, e.g. structural or binding protein, of the invention can be supplied by expressing the enzymes directly in transgenic feed crops (as, e.g., transgenic plants, seeds and the like), such as grains, cereals, corn, soy bean, rape seed, lupin and the like. As discussed above, the invention provides transgenic plants, plant parts and plant cells comprising a nucleic acid sequence encoding a polypeptide of the invention. In one aspect, the nucleic acid is expressed such that the polypeptide, enzyme, protein, e.g. structural or binding protein of the invention is produced in recoverable quantities. The polypeptide, enzyme, protein, e.g. structural or binding protein can be recovered from any plant or plant part. Alternatively, the plant or plant part containing the recombinant polypeptide can be used as such for improving the quality of a food or feed, e.g., improving nutritional value, palatability, etc.

The enzyme delivery matrix of the invention is in the form of discrete plural particles, pellets or granules. By "granules" is meant particles that are compressed or compacted, such as by a pelletizing, extrusion, or similar compacting to remove water from the matrix. Such compression or compacting of the particles also promotes intraparticle cohesion of the particles. For example, the granules can be prepared by pelletizing the grain-based substrate in a pellet mill. The pellets prepared thereby are ground or crumbled to a granule size suitable for use as an adjuvant in animal feed. Since the matrix is itself approved for use in animal feed, it can be used as a diluent for delivery of enzymes in animal feed.

The polypeptide, enzyme, protein, e.g. structural or binding protein contained in the invention enzyme delivery matrix and methods is in one aspect thermostable polypeptide, enzyme, protein, e.g. structural or binding protein, as described herein, so as to resist inactivation of the polypeptide, enzyme, protein, e.g. structural or binding protein during manufacture where elevated temperatures and/or steam may be employed to prepare the palletized enzyme delivery matrix. During digestion of feed containing the invention enzyme delivery matrix, aqueous digestive fluids will cause release of the active enzyme. Other types of thermostable enzymes and nutritional supplements that are thermostable can also be incorporated in the delivery matrix for release under any type of aqueous conditions.

A coating can be applied to the invention enzyme matrix particles for many different purposes, such as to add a flavor or nutrition supplement to animal feed, to delay release of animal feed supplements and enzymes in gastric conditions, and the like. Or, the coating may be applied to achieve a functional goal, for example, whenever it is desirable to slow release of the enzyme from the matrix particles or to control the conditions under which the enzyme will be released. The composition of the coating material can be such that it is selectively broken down by an agent to which it is susceptible (such as heat, acid or base, enzymes or other chemicals). Alternatively, two or more coatings susceptible to different such breakdown agents may be consecutively applied to the matrix particles.

The invention is also directed towards a process for preparing an enzyme-releasing matrix. In accordance with the invention, the process comprises providing discrete plural particles of a grain-based substrate in a particle size suitable for use as an enzyme-releasing matrix, wherein the particles comprise a polypeptide, enzyme, protein, e.g. structural or binding protein, encoded by an amino acid sequence of the invention. In one aspect, the process includes compacting or compressing the particles of enzyme-releasing matrix into granules, which most in one aspect is accomplished by pelletizing. The mold inhibitor and cohesiveness agent, when used, can be added at any suitable time, and in one aspect are mixed with the grain-based substrate in the desired proportions prior to pelletizing of the grain-based substrate. Moisture content in the pellet mill feed in one aspect is in the ranges set forth above with respect to the moisture content in the finished product, and in one aspect is about 14-15%. In one aspect, moisture is added to the feedstock in the form of an aqueous preparation of the enzyme to bring the feedstock to this moisture content. The temperature in the pellet mill in one aspect is brought to about 82° C. with steam. The pellet mill may be operated under any conditions that impart sufficient work to the feedstock to provide pellets. The pelleting process itself is a cost-effective process for removing water from the enzyme-containing composition.

The compositions and methods of the invention can be practiced in conjunction with various nutritional and environmental factors including, e.g., (1) manipulation of gut microflora by supplementing feed with prebiotics and/or antibiotics, (2) low fiber diet (low energy and low purine diet), (3) restricting feed for 48 hours and withholding feed for 12 hours before slaughter, (4) increasing consumption of water, and/or (5) keeping animals clean.

The compositions and methods of the invention can be practiced in conjunction with administration of prebiotics, which are high molecular weight sugars, e.g., fructo-oligosaccharides (FOS); galacto-oligosaccharides (GOS), GRAS (Generally Recognized As Safe) material. These prebiotics can be metabolized by some probiotic lactic acid bacteria (LAB). They are non-digestible by the majority of intestinal microbes.

Treating Foods and Food Processing

The polypeptide, enzyme, protein, e.g. structural or binding proteins of the invention, e.g., as described in Tables 1, 2, and 3, have numerous applications in food processing industry. The invention provides treatment compositions, including, e.g., a plant cell, a bacterial cell, a yeast cell, an insect cell, or an animal cell, or any plant or plant part, or any food or feed, a waste product and the like.

The invention provides feeds or foods comprising a polypeptide, enzyme, protein, e.g. structural or binding protein, the invention, e.g., a feed, a liquid, e.g., a beverage (such as a fruit juice or a beer), a bread or a dough or a bread product, or a beverage precursor (e.g., a wort).

The food treatment processes of the invention can comprise use of any enzyme of the invention, which can have the following enzymatic activities, and also include the use of any combination of any enzyme, including lyases, laccases, catalases, laccases, cellulases, endoglycosidases, endo-beta-1,4-laccases, amyloglucosidases, glucose isomerases, glycosyltransferases, lipases, phospholipases, lipooxygenases, beta-laccases, endo-beta-1,3(4)-laccases, cutinases, peroxidases, amylases, glucoamylases, pectinases, reductases, oxidases, decarboxylases, phenoloxidases, ligninases, pullulanases, arabinanases, hemicellulases, mannanases, xylolaccases, xylanases, pectin acetyl esterases, rhamnogalacturonan acetyl esterases, proteases, peptidases, proteinases, polygalacturonases, rhamnogalacturonases, galactanases, pectin lyases, transglutaminases, pectin methylesterases, cellobiohydrolases and/or transglutaminases.

Confectionaries, Cacao Butter and Foods

In one aspect, the compositions and methods of the invention can be used to make and process hard butters, such as cacao butter (cocao butter). The compositions and methods of the invention can be used to make cocoa butter alternatives by "structured" synthetic techniques using the enzymes of the invention, e.g., as described in Tables 1, 2, and 3, including esterases, acylases, lipases, phospholipases or proteases of the invention. For example, in one aspect, the methods of the invention process or synthesize triacylglycerides, diacylglycerides and/or monoacylglycerides for use as, e.g., cocoa butter alternatives. In one aspect, the methods of the invention generate a hard butter with a defined "plastic region" to maintain sufficient hardness below or at room temperature. In one aspect, the processed or synthesized lipid is designed to have a very narrow "plastic region," e.g., in one aspect, where it rapidly melts at about body temperature. Natural cacao butter begins to soften at approximately 30° C. to 32° C., and completely melts at approximately 36° C. Natural cacao butter can contain 70 wt % or more of three 1,3-disaturated-2-oleoyl glycerols, which are 1,3-dipalmitoyl-2-oleoyl glycerol (POP), 1-palmitoyl-2-oleoyl glycerol (POSt) and 1,3-distearoyl-2-oleoyl glycerol (StOSt). These three glycerols show a similar melting behavior to each other and are responsible for melting properties of the cacao butter, exhibiting a very narrow plastic region. The invention provides synthetic cacao butters or processed cacao butters (synthesized or processed using a hydrolase of the invention, all possible composition are referred to as cocoa-butter alternatives) with varying percentages of, 3-dipalmitoyl-2-oleoyl glycerol (POP), 1-palmitoyl-2-oleoyl glycerol (POSt) and 1,3-distearoyl-2-oleoyl glycerol (StOSt), depending on the desired properties of the synthetic cacao butter, and, synthetic cacao butters with more or less than 70 wt % of the three 1,3-disaturated-2-oleoyl glycerols. The synthetic cacao butters of the invention can partially or completely replace natural or unprocessed cacao butters and can maintain or improve essential hard butter properties.

The invention provides synthetic cacao butters or processed cacao butters (synthesized or processed using a hydrolase of the invention) with desired properties for use in confectionary, bakery and pharmaceutical products. In one aspect, the invention provides confectionary, bakery and pharmaceutical products comprising a hydrolase of the invention. In one aspect, the methods of the invention make or process a lipid (a fat) from a confection (e.g., a chocolate) or to be used in a confection. In one aspect, a lipid is made or processed such that the chocolate shows less finger-imprinting than chocolate made from natural cocoa butter, while still having sharp melting characteristics in the mouth. In one aspect, a lipid is made or processed such that a confection (e.g., chocolate) can be made at a comparatively high ambient temperature, or, be made using a cooling water at a comparatively high temperature. In one aspect, the lipid is made or processed such that a confection (e.g., chocolate) can be stored under relatively warmer conditions, e.g., tropical or semi-tropical conditions or in centrally heated buildings. In one aspect, the lipids are made or processed such that a confection (e.g., chocolate) will have a lipid (fat) content of consistent composition and quality. The enzymes of the invention can be used to provide a substitute composition for cacao butter which can significantly improve its thermal stability and replace it in a wide range of applications.

Margarine and Shortening Production

The invention provides synthetic or processed fats, e.g., margarine and shortening synthesized or processed using an enzyme of the invention, e.g., as described in Tables 1, 2, and 3, such as a hydrolase of the invention. In one aspect, the invention provides processed fats comprising a vegetable oil, such as soybean oil, corn oil, rapeseed oil, palm oil or lauric type oils synthesized or processed using a hydrolase of the invention. The synthetic or processed fats, e.g., margarine and shortening, are designed to have a desired "plasticity." Many of the plastic fat products, such as margarine and shortening, are produced from hard stocks and liquid oils as raw materials. For example, liquid oils such as soybean oil, corn oil, palm oil and rapeseed oil, are blended with their hardened oils (hard stocks), and the blend is adjusted to have an appropriate consistency (plasticity). The plastic fat products such as margarine and shortening so produced tend to cause the formation of relatively coarse crystallines because fats and oils used as the raw materials are composed of fatty acids having almost the same carbon chain length. In other words, they have a highly-unified composition of fatty acids. For this reason, the plasticity of these products can be maintained at an appropriate degree only within a narrow temperature range, so that the liquid oils contained therein have a tendency to exude. In one aspect, the invention provides methods of making or processing fats designed such that they have a varied (and defined) composition of fatty acids. The resultant oil, e.g., margarine or shortening, can have a broader range of plasticity.

In one aspect, the methods and compositions of the invention are used to make or process vegetable oils, such as soybean oil, corn oil, rapeseed oil, palm oil or lauric type oils using the hydrolases of the invention, including inter-esterification and enzymatic transesterification, see e.g., U.S. Pat. No. 5,288,619. The methods and compositions of the invention can be used in place of random inter-esterification as described in, e.g., U.S. Pat. No. 3,949,105. In one aspect, the methods and compositions of the invention are used to in enzymatic transesterification for preparing an oil, e.g., a margarine oil, having both low trans-acid and low intermediate chain fatty acid content.

In one aspect, the symmetric structure of an oil, e.g., a palm or lauric type oils is modified, e.g., into a random structure. Thus, the methods of the invention can be used to modify the properties of plastic fat products. In one aspect, the modification of oils by the methods of the invention can be designed to prevent or slow gradually hardening of the oil with time, particularly when the products are being stored.

In one aspect, the methods and compositions of the invention in a trans-esterification reaction mixture comprising a stearic acid source material and an edible liquid vegetable oil, trans-esterifying the stearic acid source material and the vegetable oil using a 1-, 3-positionally specific lipase of the invention, and then hydrogenating the fatty acid mixture to provide a recycle stearic acid source material for a recyclic reaction with the vegetable oil. See e.g., U.S. Pat. No. 5,288,619.

In one aspect, an inter-esterification reaction is conducted with a lipase of the invention. In one aspect, the lipase of the invention has a selectivity for the 1- and 3-positions of triglyceride to slow or inhibit an increase in the amount of tri-saturated triglycerides in the oil. In this reaction of the invention, deficiencies of conventional random inter-esterification and the difficulty of inter-esterification with a non-specific lipase can be overcome because the inter-esterification is conducted by an enzyme of the invention having a specificity for the 1- and 3-positions of triglycerides. In one aspect, the exudation of liquid oils contained in the products is slowed or prevented with a temperature increase in the reaction to inhibit a rise in the melting point caused by an increase in the amount of tri-saturated triglycerides. This addresses the problem of hardening of products during long-term storage.

Brewing and Fermenting

The invention provides methods of brewing (e.g., fermenting) beer comprising hydrolases of the invention. In one exemplary process, starch-containing raw materials are disintegrated and processed to form a malt. A hydrolase of the invention is used at any point in the fermentation process. For example, hydrolases (e.g., proteases) of the invention can be used in the processing of barley malt. The major raw material of beer brewing is barley malt. This can be a three stage process. First, the barley grain can be steeped to increase water content, e.g., to around about 40%. Second, the grain can be germinated by incubation at 15 to 25° C. for 3 to 6 days when enzyme synthesis is stimulated under the control of gibberellins. In one aspect, hydrolases of the invention are added at this (or any other) stage of the process. The action of hydrolases results in an increase in fermentable reducing sugars. This can be expressed as the diastatic power, DP, which can rise from around 80 to 190 in 5 days at 12° C. Hydrolases (e.g., proteases) of the invention can be used in any beer or alcoholic beverage producing process, as described, e.g., in U.S. Pat. Nos. 5,762,991; 5,536,650; 5,405,624; 5,021,246; 4,788,066.

Waste Treatment

The polypeptide, enzyme, protein, e.g. structural or binding proteins of the invention, e.g., as described in Tables 1, 2, and 3, can be used in a variety of other industrial applications, e.g., in waste treatment (in addition to, e.g., biomass conversion to fuels). For example, in one aspect, the invention provides a solid waste digestion process using a polypeptide, enzyme, protein, e.g. structural or binding protein, of the invention. The methods can comprise reducing the mass and volume of substantially untreated solid waste. Solid waste can be treated with an enzymatic digestive process in the presence of an enzymatic solution (including a polypeptide, enzyme, protein, e.g. structural or binding protein, of the invention) at a controlled temperature. This results in a reaction without appreciable bacterial fermentation from added microorganisms. The solid waste is converted into a liquefied waste and any residual solid waste. The resulting liquefied waste can be separated from said any residual solidified waste. See e.g., U.S. Pat. No. 5,709,796.

In one aspect, the compositions and methods of the invention are used for odor removal or odor reduction in animal waste lagoons, e.g., on swine farms, and other animal waste management systems.

The waste treatment processes of the invention can comprise use of any enzyme of the invention, which can have the following enzymatic activities, and also include the use of any combination of any enzyme or protein, including e.g. structural or binding protein, catalases, lyases, laccases, cellulases, endoglycosidases, endo-beta-1,4-laccases, amyloglucosidases, glucose isomerases, glycosyltransferases, lipases, phospholipases, lipooxygenases, beta-laccases, endo-beta-1,3(4)-laccases, cutinases, peroxidases, amylases, glucoamylases, pectinases, reductases, oxidases, decarboxylases, phenoloxidases, ligninases, pullulanases, phytases, arabinanases, hemicellulases, mannanases, xylolaccases, xylanases, pectin acetyl esterases, rhamnogalacturonan acetyl esterases, proteases, peptidases, proteinases, polygalacturonases, rhamnogalacturonases, galactanases, pectin lyases, transglutaminases, pectin methylesterases, cellobiohydrolases and/or transglutaminases.

Increasing the Flow of Production Fluids from a Subterranean Formation

The invention also includes a method using an enzyme of the invention, e.g., as described in Tables 1, 2, and 3, wherein the method increases the flow of production fluids from a subterranean formation by removing viscous (e.g., starch-containing) damaging fluids formed during production operations; these fluids can be found within the subterranean formation which surrounds a completed well bore. Thus, this method of the invention results in production fluids being able to flow from the well bore. This method of the invention also addresses the problem of damaging fluids reducing the flow of production fluids from a formation below expected flow rates. In one aspect, the invention provides for formulating an enzyme treatment (using an enzyme of the invention) by blending together an aqueous fluid and a polypeptide of the invention; pumping the enzyme treatment to a desired location within the well bore; allowing the enzyme treatment to degrade the viscous (e.g., starch-containing) damaging fluid, whereby the fluid can be removed from the subterranean formation to the well surface; and wherein the enzyme treatment is effective to attack linkages in the viscous (e.g., starch-containing) fluid.

The subterranean formation enzyme treatment processes of the invention can comprise use of any enzyme of the invention, which can have the following enzymatic activities, and also include the use of any combination of any enzyme, including tryptophanases or tyrosine decarboxylases, laccases, catalases, lyases, laccases, other cellulases, endoglycosidases, endo-beta-1,4-laccases, amyloglucosidases, other glucosidases, glucose isomerases, glycosyltransferases, lipases, phospholipases, lipooxygenases, beta-laccases, endo-beta-1,3(4)-laccases, cutinases, peroxidases, amylases, glucoamylases, pectinases, reductases, oxidases, decarboxylases, phenoloxidases, ligninases, pullulanases, arabinanases, hemicellulases, mannanases, xylolaccases, xylanases, pectin acetyl esterases, rhamnogalacturonan acetyl esterases, proteases, peptidases, proteinases, polygalacturonases, rhamnogalacturonases, galactanases, pectin lyases, transglutaminases, pectin methylesterases, other cellobiohydrolases and/or transglutaminases.

Latex Processing

The methods and compositions (e.g., enzymes of the invention, e.g., as described in Tables 1, 2, and 3, including esterases, acylases, lipases, phospholipases or proteases of the invention) of the invention can be used to selectively hydrolyze saturated esters over unsaturated esters into acids or alcohols. In one aspect, the invention provides for the selective hydrolysis of ethyl propionate over ethyl acrylate. In one aspect, these methods are used to remove undesired esters from monomer feeds used in latex polymerization and from the latexes after polymerization. The methods and compositions (hydrolases) of the invention can be used to treat latexes for a variety of purposes, e.g., to treat latexes used in hair fixative compositions to remove unpleasant odors. Latexes treated by the methods and compositions of the invention include, e.g., polymers containing acrylic, vinyl and unsaturated acid monomers, including alkyl acrylate monomers such as methyl acrylate, ethyl acrylate, propyl acrylate and butyl acrylate, and acrylate acids such as acrylic acid, methacrylic acid, crotonic acid, itaconic acid and mixtures thereof. See, e.g., U.S. Pat. No. 5,856,150.

Biomass Conversion and Production of Clean Bio Fuels

The invention provides enzymes, e.g., as described in Tables 1, 2, and 3 (including mixtures, or "cocktails" of enzymes) and methods for the conversion of a biomass or any lignocellulosic material (e.g., any composition comprising cellulose, hemicellulose and lignin), to fuels (e.g., bioethanol, biodiesel), in addition to feeds, foods and chemicals. Thus, the compositions and methods of the invention provide effective and sustainable alternatives or adjuncts to use of petroleum-based products, e.g., as a mixture of bioethanol and gasoline. The invention provides organisms expressing enzymes of the invention for participation in chemical cycles involving natural biomass conversion. In one aspect, enzymes and methods for the conversion are used in enzyme ensembles for the efficient depolymerization of cellulosic and hemicellulosic polymers to metabolizeable carbon moieties. The invention provides methods for discovering and implementing the most effective of enzymes to enable these important new "biomass conversion" and alternative energy industrial processes.

The methods of the invention also include taking the converted lignocellulosic material (processed by enzymes of the invention) and making it into a fuel (e.g. a bioethanol, a biodiesel) by fermentation and/or by chemical synthesis. In one aspect, the produced sugars are fermented and/or the non-fermentable products are gasified.

The enzymes of the invention (including, for example, organisms, such as microorganisms, e.g., fungi, yeast or bacteria, making and in some aspects secreting recombinant enzymes of the invention) can be used in or included/integrated at any stage of any biomass conversion process, e.g., at any one step, several steps, or included in all of the steps, or all of the following methods of biomass conversion processes, or all of these biofuel alternatives:

Direct combustion: the burning of material by direct heat and is the simplest biomass technology; can be very economical if a biomass source is nearby.

Pyrolysis: is the thermal degradation of biomass by heat in the absence of oxygen. In one aspect, biomass is heated to a temperature between about 800 and 1400 degrees Fahrenheit, but no oxygen is introduced to support combustion resulting in the creation of gas, fuel oil and charcoal.

Gasification: biomass can be used to produce methane through heating or anaerobic digestion. Syngas, a mixture of carbon monoxide and hydrogen, can be derived from biomass.

Landfill Gas: is generated by the decay (anaerobic digestion) of buried garbage in landfills. When the organic waste decomposes, it generates gas consisting of approximately 50% methane, the major component of natural gas.

Anaerobic digestion: converts organic matter to a mixture of methane, the major component of natural gas, and carbon dioxide. In one aspect, biomass such as waterwaste (sewage), manure, or food processing waste, is mixed with water and fed into a digester tank without air.

Fermentation

Alcohol Fermentation: fuel alcohol is produced by converting starch to sugar, fermenting the sugar to alcohol, then separating the alcohol water mixture by distillation. Feedstocks such as wheat, barley, potatoes, and waste paper, sawdust, and straw containing sugar, starch, or cellulose can be converted to alcohol by fermentation with yeast.

Transesterification: An exemplary reaction for converting oil to biodiesel is called transesterification. The transesterification process reacts an alcohol (like methanol) with the triglyceride oils contained in vegetable oils, animal fats, or recycled greases, forming fatty acid alkyl esters (biodiesel) and glycerin. The reaction requires heat and a strong base catalyst, such as sodium hydroxide or potassium hydroxide.

Biodiesel: Biodiesel is a mixture of fatty acid alkyl esters made from vegetable oils, animal fats or recycled greases. Biodiesel can be used as a fuel for vehicles in its pure form, but it is usually used as a petroleum diesel additive to reduce levels of particulates, carbon monoxide, hydrocarbons and air toxics from diesel-powered vehicles.

Hydrolysis: includes hydrolysis of a compound, e.g., a biomass, such as a lignocellulosic material, catalyzed using an enzyme of the instant invention.

Congeneration: is the simultaneous production of more than one form of energy using a single fuel and facility. In one aspect, biomass cogeneration has more potential growth than biomass generation alone because cogeneration produces both heat and electricity.

In one aspect, the polypeptides of the invention have cellulolytic activity, e.g., cellulases activity, such as endoglucanase, cellobiohydrolase and/or β-glucosidase (beta-glucosidase) activity, or other enzymatic activity for generating biodiesel or bioethanol from an organic material, e.g., a biomass, such as compositions derived from plants and animals, including any agricultural crop or other renewable feedstock, an agricultural residue or an animal waste, or the organic components of municipal and industrial wastes, or microorganisms such as algae or yeast. In one aspect, polypeptides of the invention are used in processes for converting lignocellulosic biomass to ethanol, or otherwise are used in processes for hydrolyzing or digesting biomaterials such that they can be used as a biofuel (including biodiesel or bioethanol), or for making it easier for the biomass to be processed into a fuel. In an alternative aspect, polypeptides of the invention are used in processes for a transesterification process reacting an alcohol (like methanol) with a triglyceride oil contained in a vegetable oil, animal fat or recycled greases, forming fatty acid alkyl esters (biodiesel) and glycerin. In one aspect, biodiesel is made from soybean oil or recycled cooking oils. Animal's fats, other vegetable oils, and other recycled oils can also be used to produce biodiesel, depending on their costs and availability. In another aspect, blends of all kinds of fats and oils are used to produce a biodiesel fuel of the invention.

Enzymes of the invention can also be used in glycerin refining. The glycerin by-product contains unreacted catalyst and soaps that are neutralized with an acid. Water and alcohol are removed to produce 50% to 80% crude glycerin. The remaining contaminants include unreacted fats and oils, which can be processes using the polypeptides of the invention. In a large biodiesel plants of the invention, the glycerin can be further purified, e.g., to 99% or higher purity, for the pharmaceutical and cosmetic industries.

Both bioethanol and biodiesel made using the polypeptides of the invention can be used with fuel oxygenates to improve combustion characteristics. Adding oxygen results in more complete combustion, which reduces carbon monoxide emissions. This is another environmental benefit of replacing petroleum fuels with biofuels (e.g., a fuel of the invention). A bioethanol made using the compositions and/or methods of this invention can be blended with gasoline to form an E10 blend (about 5% to 10% ethanol and about 90% to 95% gasoline), but it can be used in higher concentrations such as E85 or in its pure form. A bioethanol made using the compositions and/or methods of this invention can be blended with petroleum diesel to form a B20 blend (20% biodiesel and 80% petroleum diesel), although other blend levels can be used up to B100 (pure biodiesel).

The invention also provides processes for making ethanol ("bioethanol") from compositions comprising lignocellulosic biomass. The lignocellulose biomass material can be obtained from agricultural crops, as a byproduct of food or feed production, or as lignocellulosic waste products, such as plant residues and waste paper. Examples of suitable plant sources or plant residues for treatment with polypeptides of the invention include kelp, algae, grains, seeds, stems, leaves, hulls, husks, corn cobs, corn stover, straw, grasses (e.g., Indian grass, such as *Sorghastrum nutans*; or, switch grass, e.g., *Panicum* species, such as *Panicum virgatum*), and the like, as well as wood, wood chips, wood pulp, and sawdust. Examples of paper waste suitable for treatment with polypeptides of the invention include discard photocopy paper, computer printer paper, notebook paper, notepad paper, typewriter paper, and the like, as well as newspapers, magazines, cardboard, and paper-based packaging materials.

In one aspect, the enzymes and methods of the invention can be used in conjunction with more "traditional" means of making ethanol from biomass, e.g., as methods comprising hydrolyzing lignocellulosic materials by subjecting dried lignocellulosic material in a reactor to a catalyst comprised of a dilute solution of a strong acid and a metal salt; this can lower the activation energy, or the temperature, of cellulose hydrolysis to obtain higher sugar yields; see, e.g., U.S. Pat. Nos. 6,660,506; 6,423,145.

Another exemplary method that incorporated use of enzymes of the invention comprises hydrolyzing lignocellulosic material containing hemicellulose, cellulose and lignin by subjecting the material to a first stage hydrolysis step in an aqueous medium at a temperature and a pressure chosen to effect primarily depolymerization of hemicellulose without major depolymerization of cellulose to glucose. This step results in a slurry in which the liquid aqueous phase contains dissolved monosaccharides resulting from depolymerization of hemicellulose and a solid phase containing cellulose and lignin. A second stage hydrolysis step can comprise conditions such that at least a major portion of the cellulose is depolymerized, such step resulting in a liquid aqueous phase containing dissolved/soluble depolymerization products of cellulose. See, e.g., U.S. Pat. No. 5,536,325. Enzymes of the invention can be added at any stage of this exemplary process.

Another exemplary method that incorporated use of enzymes of the invention comprises processing a lignocellulose-containing biomass material by one or more stages of dilute acid hydrolysis with about 0.4% to 2% strong acid; and treating an unreacted solid lignocellulosic component of the acid hydrolyzed biomass material by alkaline delignification to produce precursors for biodegradable thermoplastics and derivatives. See, e.g., U.S. Pat. No. 6,409,841. Enzymes of the invention can be added at any stage of this exemplary process.

Another exemplary method that incorporated use of enzymes of the invention comprises prehydrolyzing lignocellulosic material in a prehydrolysis reactor; adding an acidic liquid to the solid lignocellulosic material to make a mixture; heating the mixture to reaction temperature; maintaining reaction temperature for time sufficient to fractionate the lignocellulosic material into a solubilized portion containing at least about 20% of the lignin from the lignocellulosic material and a solid fraction containing cellulose; removing a solubilized portion from the solid fraction while at or near reaction temperature wherein the cellulose in the solid fraction is rendered more amenable to enzymatic digestion; and recovering a solubilized portion. See, e.g., U.S. Pat. No. 5,705,369. Enzymes of the invention can be added at any stage of this exemplary process.

The invention provides methods for making motor fuel compositions (e.g., for spark ignition motors) based on liquid hydrocarbons blended with a fuel grade alcohol made by using an enzyme or a method of the invention. In one aspect, the fuels made by use of an enzyme of the invention comprise, e.g., coal gas liquid- or natural gas liquid-ethanol blends. In one aspect, a co-solvent is biomass-derived 2-methyltetrahydrofuran (MTHF). See, e.g., U.S. Pat. No. 6,712,866.

In one aspect, methods of the invention for the enzymatic degradation of lignocellulose, e.g., for production of ethanol from lignocellulosic material, can also comprise use of ultrasonic treatment of the biomass material; see, e.g., U.S. Pat. No. 6,333,181.

In another aspect, methods of the invention for producing bioethanol from a cellulosic substrate comprise providing a reaction mixture in the form of a slurry comprising cellulosic substrate, an enzyme of this invention and a fermentation agent (e.g., within a reaction vessel, such as a semi-continuously solids-fed bioreactor), and the reaction mixture is reacted under conditions sufficient to initiate and maintain a fermentation reaction (as described, e.g., in U.S. Pat. App. No. 20060014260). In one aspect, experiment or theoretical calculations can determine an optimum feeding frequency. In one aspect, additional quantities of the cellulosic substrate and the enzyme are provided into the reaction vessel at an interval(s) according to the optimized feeding frequency.

One exemplary process for making a biofuels and biodiesels of the invention is described in U.S. Pat. App. Pub. Nos. 20050069998; 20020164730; and in one aspect comprises stages of grinding the lignocellulosic biomass (e.g., to a size of 15-30 mm), subjecting the product obtained to steam explosion pre-treatment (e.g., at a temperature of 190-230° C.) for between 1 and 10 minutes in a reactor; collecting the pre-treated material in a cyclone or related product of manufacture; and separating the liquid and solid fractions by filtration in a filter press, introducing the solid fraction in a fermentation deposit and adding one or more enzymes of the invention, e.g., a cellulase and/or beta-glucosidase enzyme (e.g., dissolved in citrate buffer pH 4.8).

Another exemplary process for making a biofuels and biodiesels of the invention comprising ethanol using enzymes of the invention comprises pretreating a starting material comprising a lignocellulosic feedstock comprising at least hemicellulose and cellulose. In one aspect, the starting material comprises potatoes, soybean (rapeseed), barley, rye, corn, oats, wheat, beets or sugar cane or a component or waste or food or feed production byproduct. The starting material ("feedstock") is reacted at conditions which disrupt the plant's fiber structure to effect at least a partial hydrolysis of the hemicellulose and cellulose. Disruptive conditions can comprise, e.g., subjecting the starting material to an average temperature of 180° C. to 270° C. at pH 0.5 to 2.5 for a period of about 5 seconds to 60 minutes; or, temperature of 220° C. to 270° C., at pH 0.5 to 2.5 for a period of 5 seconds to 120 seconds, or equivalent. This generates a feedstock with increased accessibility to being digested by an enzyme, e.g., a cellulase enzyme of the invention. U.S. Pat. No. 6,090,595.

Exemplary conditions for cellulase hydrolysis of lignocellulosic material include reactions at temperatures between about 30° C. and 48° C., and/or a pH between about 4.0 and 6.0. Other exemplary conditions include a temperature between about 30° C. and 60° C. and a pH between about 4.0 and 8.0.

Detergent Compositions

The invention provides detergent compositions comprising one or more polypeptides of the invention (e.g., enzymes as described in Tables 1, 2, and 3, e.g., having cellulase, endoglucanase, cellobiohydrolase, mannanase and/or beta-glucosidase activity) and methods of making and using these compositions. The invention incorporates all methods of making and using detergent compositions, see, e.g., U.S. Pat. Nos. 6,413,928; 6,399,561; 6,365,561; 6,380,147. The detergent compositions can be a one and two part aqueous composition, a non-aqueous liquid composition, a cast solid, a granular form, a particulate form, a compressed tablet, a gel and/or a paste and a slurry form. The invention also provides methods capable of a rapid removal of gross food soils, films of food residue and other minor food compositions using these detergent compositions. Enzymes of the invention can facilitate the removal of starchy stains by means of catalytic hydrolysis of the starch polysaccharide. Enzymes of the invention can be used in dishwashing detergents in textile laundering detergents.

The actual active enzyme content depends upon the method of manufacture of a detergent composition and is not critical, assuming the detergent solution has the desired enzymatic activity. In one aspect, the amount of glucosidase present in the final solution ranges from about 0.001 mg to 0.5 mg per gram of the detergent composition. The particular enzyme chosen for use in the process and products of this invention depends upon the conditions of final utility, including the physical product form, use pH, use temperature, and soil types to be degraded or altered. The enzyme can be chosen to provide optimum activity and stability for any given set of utility conditions. In one aspect, the polypeptides of the present invention are active in the pH ranges of from about 4 to about 12 and in the temperature range of from about 20° C. to about 95° C. The detergents of the invention can comprise cationic, semi-polar nonionic or zwitterionic surfactants; or, mixtures thereof.

Enzymes of the present invention (e.g., enzymes having cellulase, endoglucanase, cellobiohydrolase, mannanase and/or beta-glucosidase activity) can be formulated into powdered and liquid detergents having pH between 4.0 and 12.0 at levels of about 0.01 to about 5% (preferably 0.1% to 0.5%) by weight. These detergent compositions can also include other enzymes such as known proteases, cellulases, lipases or endoglycosidases, as well as builders and stabilizers. The addition of enzymes of the invention to conventional cleaning compositions does not create any special use limitation. In other words, any temperature and pH suitable for the detergent is also suitable for the present compositions as long as the pH is within the above range, and the temperature is below the described enzyme's denaturing temperature. In addition, the polypeptides of the invention can be used in a cleaning composition without detergents, again either alone or in combination with builders and stabilizers.

The present invention provides cleaning compositions including detergent compositions for cleaning hard surfaces, detergent compositions for cleaning fabrics, dishwashing compositions, oral cleaning compositions, denture cleaning compositions, and contact lens cleaning solutions.

In one aspect, the invention provides a method for washing an object comprising contacting the object with a polypeptide of the invention under conditions sufficient for washing. A polypeptide of the invention may be included as a detergent additive. The detergent composition of the invention may, for example, be formulated as a hand or machine laundry detergent composition comprising a polypeptide of the invention. A laundry additive suitable for pre-treatment of stained fabrics can comprise a polypeptide of the invention. A fabric softener composition can comprise a polypeptide of the invention. Alternatively, a polypeptide of the invention can be formulated as a detergent composition for use in general household hard surface cleaning operations. In alternative aspects, detergent additives and detergent compositions of the invention may comprise one or more other enzymes such as a protease, a lipase, a cutinase, another glucosidase, a carbohydrase, another cellulase, a pectinase, a mannanase, an arabinase, a galactanase, a xylanase, an oxidase, e.g., a lactase, and/or a peroxidase. The properties of the enzyme(s) of the invention are chosen to be compatible with the selected detergent (i.e. pH-optimum, compatibility with other enzymatic and non-enzymatic ingredients, etc.) and the enzyme(s) is present in effective amounts. In one aspect, enzymes of the invention are used to remove malodorous materials from fabrics. Various detergent compositions and methods for making them that can be used in practicing the invention are described in, e.g., U.S. Pat. Nos. 6,333,301; 6,329,333; 6,326,341; 6,297,038; 6,309,871; 6,204,232; 6,197,070; 5,856,164.

The detergents and related processes of the invention can also include the use of any combination of other enzymes such as tryptophanases or tyrosine decarboxylases, laccases, catalases, laccases, other cellulases, endoglycosidases, endo-beta-1,4-laccases, amyloglucosidases, other glucosidases, glucose isomerases, glycosyltransferases, lipases, phospholipases, lipooxygenases, beta-laccases, endo-beta-1,3(4)-laccases, cutinases, peroxidases, amylases, glucoamylases, pectinases, reductases, oxidases, decarboxylases, phenoloxidases, ligninases, pullulanases, arabinanases, hemicellulases, mannanases, xylolaccases, xylanases, pectin acetyl esterases, rhamnogalacturonan acetyl esterases, proteases, peptidases, proteinases, polygalacturonases, rhamnogalacturonases, galactanases, pectin lyases, transglutaminases, pectin methylesterases, other cellobiohydrolases and/or transglutaminases.

Treating Fabrics and Textiles

The invention provides compositions and methods of treating fabrics and textiles using one or more polypeptides of the invention, e.g., enzymes as described in Tables 1, 2, and 3, including enzymes having cellulase, endoglucanase, cellobiohydrolase, mannanase and/or beta-glucosidase activity. The polypeptides of the invention can be used in any fabric-treating method, which are well known in the art, see, e.g., U.S. Pat. No. 6,077,316. For example, in one aspect, the feel and appearance of a fabric is improved by a method comprising contacting the fabric with an enzyme of the invention in a solution. In one aspect, the fabric is treated with the solution under pressure.

In one aspect, the enzymes of the invention are applied during or after the weaving of textiles, or during the desizing stage, or one or more additional fabric processing steps. During the weaving of textiles, the threads are exposed to considerable mechanical strain. Prior to weaving on mechanical looms, warp yarns are often coated with sizing starch or starch derivatives in order to increase their tensile strength and to prevent breaking. The enzymes of the invention can be applied to remove these sizing starch or starch derivatives. After the textiles have been woven, a fabric can proceed to a desizing stage. This can be followed by one or more additional fabric processing steps. Desizing is the act of removing size from textiles. After weaving, the size coating must be removed before further processing the fabric in order to ensure a homogeneous and wash-proof result. The invention provides a method of desizing comprising enzymatic hydrolysis of the size by the action of an enzyme of the invention.

The enzymes of the invention (e.g., enzymes having cellulase, endoglucanase, cellobiohydrolase, mannanase and/or beta-glucosidase activity) can be used to desize fabrics, including cotton-containing fabrics, as detergent additives, e.g., in aqueous compositions. The invention provides methods for producing a stonewashed look on indigo-dyed denim fabric and garments. For the manufacture of clothes, the fabric can be cut and sewn into clothes or garments, which is afterwards finished. In particular, for the manufacture of denim jeans, different enzymatic finishing methods have been developed. The finishing of denim garment normally is initiated with an enzymatic desizing step, during which garments are subjected to the action of amylolytic enzymes in order to provide softness to the fabric and make the cotton more accessible to the subsequent enzymatic finishing steps. The invention provides methods of finishing denim garments (e.g., a "bio-stoning process"), enzymatic desizing and providing softness to fabrics using the Enzymes of the invention. The invention provides methods for quickly softening denim garments in a desizing and/or finishing process.

The invention also provides disinfectants comprising enzymes of the invention (e.g., enzymes having cellulase, endoglucanase, cellobiohydrolase, mannanase and/or beta-glucosidase activity).

The fabric or textile treatment processes of the invention can also include the use of any combination of other enzymes such as tryptophanases or tyrosine decarboxylases, laccases, catalases, laccases, other cellulases, endoglycosidases, endo-beta-1,4-laccases, amyloglucosidases, other glucosidases, glucose isomerases, glycosyltransferases, lipases, phospholipases, lipooxygenases, beta-laccases, endo-beta-1,3(4)-laccases, cutinases, peroxidases, amylases, glucoamylases, pectinases, reductases, oxidases, decarboxylases, phenoloxidases, ligninases, pullulanases, arabinanases, hemicellulases, mannanases, xylolaccases, xylanases, pectin acetyl esterases, rhamnogalacturonan acetyl esterases, proteases, peptidases, proteinases, polygalacturonases, rhamnogalacturonases, galactanases, pectin lyases, transglutaminases, pectin methylesterases, other cellobiohydrolases and/or transglutaminases.

Paper or Pulp Treatment

The enzymes of the invention e.g., enzymes as described in Tables 1, 2, and 3, including enzymes having cellulase, endoglucanase, cellobiohydrolase, mannanase and/or beta-glucosidase activity) can be in paper or pulp treatment or paper deinking. For example, in one aspect, the invention provides a paper treatment process using enzymes of the invention. In one aspect, the enzymes of the invention can be used to modify starch in the paper thereby converting it into a liquefied form. In another aspect, paper components of recycled photocopied paper during chemical and enzymatic deinking processes. In one aspect, Enzymes of the invention can be used in combination with other enzymes, including other cellulases (including other endoglucanases, cellobiohydrolases and/or beta-glucosidases). The wood, paper, paper product or pulp can be treated by the following three processes: 1) disintegration in the presence of an enzyme of the invention, 2) disintegration with a deinking chemical and an enzyme of the invention, and/or 3) disintegration after soaking with an enzyme of the invention. The recycled paper treated with an enzyme of the invention can have a higher brightness due to removal of toner particles as compared to the paper treated with just cellulase. While the invention is not limited by any particular mechanism, the effect of an enzyme of the invention may be due to its behavior as surface-active agents in pulp suspension.

The invention provides methods of treating paper and paper pulp using one or more polypeptides of the invention. The polypeptides of the invention can be used in any paper- or pulp-treating method, which are well known in the art, see, e.g., U.S. Pat. Nos. 6,241,849; 6,066,233; 5,582,681. For example, in one aspect, the invention provides a method for deinking and decolorizing a printed paper containing a dye, comprising pulping a printed paper to obtain a pulp slurry, and dislodging an ink from the pulp slurry in the presence of an enzyme of the invention (other enzymes can also be added). In another aspect, the invention provides a method for enhancing the freeness of pulp, e.g., pulp made from secondary fiber, by adding an enzymatic mixture comprising an enzyme of the invention (can also include other enzymes, e.g., pectinase enzymes) to the pulp and treating under conditions to cause a reaction to produce an enzymatically treated pulp. The freeness of the enzymatically treated pulp is increased from the initial freeness of the secondary fiber pulp without a loss in brightness.

The paper, wood or pulp treatment or recycling processes of the invention can also include the use of any combination of other enzymes such as tryptophanases or tyrosine decarboxylases, laccases, catalases, laccases, other cellulases, endoglycosidases, endo-beta-1,4-laccases, amyloglucosidases, other glucosidases, glucose isomerases, glycosyltransferases, lipases, phospholipases, lipooxygenases, beta-laccases, endo-beta-1,3(4)-laccases, cutinases, peroxidases, amylases, glucoamylases, pectinases, reductases, oxidases, decarboxylases, phenoloxidases, ligninases, pullulanases, arabinanases, hemicellulases, mannanases, xylolaccases, xylanases, pectin acetyl esterases, rhamnogalacturonan acetyl esterases, proteases, peptidases, proteinases, polygalacturonases, rhamnogalacturonases, galactanases, pectin lyases, transglutaminases, pectin methylesterases, other cellobiohydrolases and/or transglutaminases.

Repulping: Treatment of Lignocellulosic Materials

The invention also provides a method for the treatment of lignocellulosic fibers, wherein the fibers are treated with a polypeptide of the invention e.g., enzymes as described in Tables 1, 2, and 3, including enzymes having cellulase, endoglucanase, cellobiohydrolase, mannanase and/or beta-glucosidase activity), in an amount which is efficient for improving the fiber properties. The enzymes of the invention may also be used in the production or recycling of lignocellulosic materials such as pulp, paper and cardboard, from starch reinforced waste paper and cardboard, especially where repulping or recycling occurs at pH above 7 and where the enzymes of the invention can facilitate the disintegration of the waste material through degradation of the reinforcing starch. The enzymes of the invention can be useful in a process for producing a papermaking pulp from starch-coated printed paper. The process may be performed as described in, e.g., WO 95/14807. An exemplary process comprises disintegrating the paper to produce a pulp, treating with a starch-degrading enzyme before, during or after the disintegrating, and separating ink particles from the pulp after disintegrating and enzyme treatment. See also U.S. Pat. No. 6,309,871 and other US patents cited herein. Thus, the invention includes a method for enzymatic deinking of recycled paper pulp, wherein the polypeptide is applied in an amount which is efficient for effective de-inking of the fiber surface.

Brewing and Fermenting

The invention provides compositions for and methods of brewing (e.g., fermenting) beer comprising an enzyme of the invention, e.g., enzymes as described in Tables 1, 2, and 3, including enzymes having cellulase, endoglucanase, cellobiohydrolase, mannanase and/or beta-glucosidase activity. In one exemplary process, starch-containing raw materials are disintegrated and processed to form a malt. An enzyme of the invention is used at any point in the fermentation process. For example, enzymes of the invention can be used in the processing of barley malt. The major raw material of beer brewing is barley malt. This can be a three stage process. First, the barley grain can be steeped to increase water content, e.g., to around about 40%. Second, the grain can be germinated by incubation at 15-25° C. for 3 to 6 days when enzyme synthesis is stimulated under the control of gibberellins. During this time enzyme levels rise significantly. In one aspect, enzymes of the invention are added at this (or any other) stage of the process. The action of the enzyme results in an increase in fermentable reducing sugars. This can be expressed as the diastatic power, DP, which can rise from around 80 to 190 in 5 days at 12° C.

Enzymes of the invention can be used in any beer producing process, as described, e.g., in U.S. Pat. Nos. 5,762,991; 5,536,650; 5,405,624; 5,021,246; 4,788,066.

Pharmaceutical Compositions and Dietary Supplements

The invention also provides pharmaceutical compositions and dietary supplements (e.g., dietary aids) comprising an enzyme of the invention (e.g., an exemplary enzyme of the invention, including those described in Tables 1, 2, and 3). In one aspect, the pharmaceutical compositions and dietary supplements (e.g., dietary aids) are formulated for oral ingestion, e.g., to improve the digestibility of foods and feeds having a high cellulose or lignocellulosic component. See also discussion, above.

Periodontal treatment compounds can comprise an enzyme of the invention, e.g., as described in U.S. Pat. No. 6,776,979. Compositions and methods for the treatment or prophylaxis of acidic gut syndrome can comprise an enzyme of the invention, e.g., as described in U.S. Pat. No. 6,468,964.

In another aspect, wound dressings, implants and the like comprise antimicrobial (e.g., antibiotic-acting) enzymes, including an enzyme of the invention (including, e.g., exemplary sequences of the invention). Enzymes of the invention can also be used in alginate dressings, antimicrobial barrier dressings, burn dressings, compression bandages, diagnostic tools, gel dressings, hydro-selective dressings, hydrocellular (foam) dressings, hydrocolloid dressings, I.V dressings, incise drapes, low adherent dressings, odor absorbing dressings, paste bandages, post operative dressings, scar management, skin care, transparent film dressings and/or wound closure. Enzymes of the invention can be used in wound cleansing, wound bed preparation, to treat pressure ulcers, leg ulcers, burns, diabetic foot ulcers, scars, IV fixation, surgical wounds and minor wounds. Enzymes of the invention can be used to in sterile enzymatic debriding compositions, e.g., ointments. In various aspects, the cellulase is formulated as a tablet, gel, pill, implant, liquid, spray, powder, food, feed pellet or as an encapsulated formulation.

The polypeptides of the invention, such as those having hydrolases activity (e.g., lipases, esterase, protease and/or phospholipases) of the invention can be used in detoxification processes, e.g., for the detoxification of endotoxins, e.g., compositions comprising lipopolysaccharides (LPS), and, the invention provides detoxification processes using at least one enzyme of the invention. In one aspect, a lipase and/or an esterase of the invention is used to detoxify a lipopolysaccharide (LPS). In one aspect, this detoxification is by deacylation of 2' and/or 3' fatty acid chains from lipid A. In one aspect, a hydrolase (e.g., a lipase and/or an esterase) of the invention is used to hydrolyze a 2'-lauroyl and/or a 3'-myristoyl chain from a lipid, e.g., a lipid A (e.g., from a bacterial endotoxin). In one aspect, the process of the invention is used to destroy an endotoxin, e.g., a toxin from a gram negative bacteria, as from E. coli. In one aspect, a hydrolase (e.g., a lipase and/or an esterase) of the invention is used to ameliorate the effects of toxin poisoning (e.g., from an on-going gram negative infection), or, to prophylactically to prevent the effects of endotoxin during an infection (e.g., an infection in an animal or a human). Accordingly, the invention provides a pharmaceutical composition comprising a hydrolase (e.g., a lipase and/or an esterase) of the invention, and method using a hydrolase of the invention, for the amelioration or prevention of lipopolysaccharide (LPS) toxic effects, e.g., during sepsis.

Biodefense Applications

In other aspects, an enzyme of the invention (e.g., an exemplary enzyme of the invention, including those described in Tables 1, 2, and 3) can be used in biodefense (e.g., destruction of spores or bacteria comprising a lignocellulosic material). Use of enzymes of the invention in biodefense applications offer a significant benefit, in that they can be very rapidly developed against any currently unknown or biological warfare agents of the future. In addition, enzymes of the invention can be used for decontamination of affected environments. In aspect, the invention provides a biodefense or bio-detoxifying agent comprising a polypeptide of the invention (including, e.g., exemplary sequences of the invention), or a polypeptide encoded by a nucleic acid of the invention (including, e.g., exemplary sequences of the invention).

Nutraceuticals

In one aspect, the compositions, e.g., an exemplary enzyme of the invention, including those described in Tables 1, 2, and 3, and methods of the invention can be used to make nutraceuticals by processing or synthesizing lipids and oils using the enzymes of the invention, e.g., esterases, acylases, lipases, phospholipases or proteases of the invention. In one aspect, the processed or synthesized lipids or oils include poly-unsaturated fatty acids (PUFAs), diacylglycerides, e.g., 1,3-diacyl glycerides (DAGs), monoacylglycerides, e.g., 2-monoacylglycerides (MAGs) and triacylglycerides (TAGs). In one aspect, the nutraceuticals is made by processing diacylglycerides, e.g., 1,3-diacyl glycerides (DAGs), monoacylglycerides, e.g., 2-monoacylglycerides (MAGs) and/or triacylglycerides (TAGs) from plant (e.g., oilseed) sources or from animal (e.g., fish oil) sources.

In one aspect, the compositions and methods of the invention can be used to fortify dietary compositions, especially cow's milk based products, e.g., cow's milk-based infant formulas, with bile salt-activated hydrolases. The compositions made by the methods and compositions of the invention can be used to feed newborn and premature infants, including administration of a bile salt-activated hydrolase of the invention to increase fat digestion and therefore growth rate. Similarly, the invention provides compositions and methods for treating subjects for inadequate pancreatic enzyme production by administration of bile salt-activated hydrolase in conjunction with ingestion of fats; see also discussion, below.

In one aspect, the invention provides a dietary composition comprising a hydrolase of the invention, e.g., bile salt-activated hydrolase of the invention. In one aspect, the invention provides a dietary composition comprising a nutritional base comprising a fat and an effective amount of bile salt-activated hydrolase of the invention. In one aspect, the invention provides a cow's milk-based infant formula comprising a hydrolase of the invention, e.g., bile salt-activated hydrolase of the invention. In one aspect, the hydrolase of the invention is active in the digestion of long chain fatty acids, e.g., $C_{12}$ to $C_{22}$, which make up a very high percentage of most milks, e.g., 99% of human breast milk. See, e.g., U.S. Pat. No. 5,000,975.

In one aspect, the invention provides a dietary composition comprising a vegetable oil fat and a hydrolase of the invention. The invention provides methods of processing milk based products and/or vegetable oil-comprising compositions to make dietary compositions. In one aspect, the processed compositions comprise a lauric acid oil, an oleic acid oil, a palmitic acid oil and/or a linoleic acid oil. In one aspect, a rice bran oil, sunflower oleic oil and/or canola oil may be used as oleic acids oils. In one aspect, fats and oils, e.g., oilseeds, from plants, including, e.g., rice, canola, sunflower, olive, palm, soy or lauric type oils for use in the nutraceuticals and dietary compositions are processed or made using a hydrolase of the invention. See, e.g., U.S. Pat. No. 4,944,944.

In one aspect, the enzymes of the invention are provided in a form that is stable to storage in the formula and/or the stomach, but active when the formulation reaches the portion of the gastrointestinal tract where the formula would normally be digested. Formulations (e.g., microcapsules) for release in the intestine are well known in the art, e.g., biodegradable polymers such as polylactide and polyglycolide, as described, e.g., in U.S. Pat. Nos. 4,767,628; 4,897,268; 4,925,673; 5,902,617.

A number of aspects of the invention have been described. Nevertheless, it will be understood that various modifications may be made without departing from the spirit and scope of the invention. Accordingly, other aspects are within the scope of the following claims.

Lengthy table referenced here

US08119385-20120221-T00001

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US08119385B2). An electronic copy of the table will also be available from the USPTO upon request and payment of the fee set forth in 37 CFR 1.19(b)(3).

SEQUENCE LISTING (26898 sequences)

SEQ ID NO: 1 - DNA, 372 bp, Unknown
  Obtained from environmental sample
  misc_feature (1)..(372): n is a, c, g, or t
atgactacctactgcgattactgcaattctcaccccgaagacacgtacaaccgaatgtatcacgatacacaatatggctttcccctcaaagatgacagcctgttgtttgagcgcttcatccttgagatcaatcaggcaggtctttcctggatcacgatcctgaagaaagccgagaatttccataaagcctatcatggctttaacatcgataaagttgcgaaatacggagaanaagaccgcgctcgtctgcttacggacccgggcatcatccgcaatcgtctgaaggtcaaatgcgcgatcgtcaacgcacagaagatcaaagagttacagaaggaatacggttccttcaaagctggctggacgcaatcgaac

SEQ ID NO: 2 - protein, 124 aa, Unknown
  Obtained from environmental sample
  DOMAIN (7)...(124): Methyladenine glycosylase
  misc_feature (1)..(124): Xaa is any amino acid
MTTYCDYCNSHPEDTYNRMYHDTQYGFPLKDDSLLFERFILEINQAGLSWITILKKAENFHKAYHGFNIDKVAKYGEXDRARLLTDPGIIRNRLKVKCAIVNAQKIKELQKEYGSFKAGWTQSN

SEQ ID NO: 3 - DNA, 531 bp, Unknown
  Obtained from environmental sample
  misc_feature (1)..(531): n is a, c, g, or t
atgcgttatgaaagaagtataaataacacaagccttgtcctggctattcaatttgaagatagtgaacgcgttttattgtttcctggagacgcagaatttggaaattggcaaagctggcatttaaatatggaatggccggttaagatcaatgggcaggttgtaaataaaaatgccgaatacctgttaaataaagctgttttttataaagtaagtcatcaccttagccagaacggaaccgcaaaaggcaaaggaatagaaatgatgacaagcggagaattaactgcgatggtaacattggatttcaaaaaaattaataaaagctggttgagcacaatgccaaatgatcttcttggtgcagaccttattcgcagaacaaaaggtaggttatattttataggcgaccgggcaaaaatactttctaatattaatacggatcgggtgactgtgaaaaaggcggatgaaaaaatattgaatgaggtgaataagaaatttgatggaaaattttttttagagtgtgagatcgggggatga

SEQ ID NO: 4 - protein, 176 aa, Unknown
  Obtained from environmental sample
  misc_feature (1)..(176): Xaa is any amino acid
MRYERSINNTSLVLAIQFEDSERVLLFPGDAEFGNWQSWHLNMEWPVKINGQVVNKNAEYLLNKAVFYKVSHHLSQNGTAKGKGIEMMTSGELTAMVTLDFKKINKSWLSTMPNDLLGADLIRRTKGRLYFIGDRAKILSNINTDRVTVKKADEKILNEVNKKFDGKFFLECEIGG

SEQ ID NO: 5 - DNA, 411 bp, Unknown
  Obtained from environmental sample
  misc_feature (1)..(411): n is a, c, g, or t
atgcaaacagaacaaaaaacatccggtaaaaaaccagattatattcgtaaagcagcccgcatcctgatgaaggtgatcctttttttgatgctctttgttgttgttctttttctttttgctttaacccctcccgctcaaaaaatagctactaacaaagtagaaaactatcttcagaaaaagctcaaaacaaaagttgagatcggcagcattagcgtaggcctgggcggatggataaatttaaaagacgtttacgtagaagaccagacaaaagatacacttattgccggtggtaatatccaggctcacattacgcttagaaaacttcttaccaacgaagtggaagtaaaagagatcacactcgatcatataaccgcaaaaattaaaagaattttaccggatacggttttcatt

SEQ ID NO: 6 - protein, 137 aa, Unknown
  Obtained from environmental sample
  misc_feature (1)..(137): Xaa is any amino acid
MQTEQKTSGKKPDYIRKAARILMKVILFLMLFVVVLFLFALTPPAQKIATNKVENYLQKKLKTKVEIGSISVGLGGWINLKDVYVEDQTKDTLIAGGNIQAHITLRKLLTNEVEVKEITLDHITAKIKRILPDTVFI

SEQ ID NO: 7 - DNA, 369 bp, Unknown
  Obtained from environmental sample
  misc_feature (1)..(369): n is a, c, g, or t
ttgttaactcgtaagattataccatcgcatctcaattttttcgtgctaatattgatatatacactgaaaaaggaggtaattatgatgggtaattggagtaattttcaaatgatgggttgggaacaaggaccctggactaaacctggttttggacttttactaatctgggttttagtatggaaaggtctcgctttatggaaatcagctcgtaatgatcagcgttactggtttgtcgccctactactaatcaatactgtcgggattctggagatactttatctctttgtctttgccaaaaataaacttgtcttagttagtgaaccacccgccgtcaaagctaaatccacctctaaacgcaaaaccaaataa

SEQ ID NO: 8 - protein, 122 aa, Unknown
  Obtained from environmental sample
  misc_feature (1)..(122): Xaa is any amino acid
MLTRKIIPSHLNFFVLILIYTLKKEVIMMGNWSNFQMMGWEQGPWTKPGFGLLLIWVLVWKGLALWKSARNDQRYWFVALLLINTVGILEILYLFVFAKNKLVLVSEPPAVKAKSTSKRKTK

SEQ ID NO: 9 - DNA, 636 bp, Unknown
  Obtained from environmental sample
  misc_feature (1)..(636): n is a, c, g, or t
ttgcgcattaagatctcattggaggagtacaaaaatggcaatttatattgcagagaaataaaatactttaaggagctagaagatgattccataagaggagatccttttgaggctgttataaaactagggattctcggcccaaatagtgagtttttaatcaggccaaaggatcagcccgaccagccgtggaagaaattaaatattataaaagggaggtatcaagcagctttgccaaacccattgggcaacttgttctgcatgtctttaattccagttgagtttaatgaggatccaaccttatttaaatttgatgaagagttcgaaaagttcggaaattatttcttactggtatataaccaaaaagagttttggaagagattaaaaaaagggttacgaaagaataaaattaagggtgttgggaaaatagtggactatgtagatttcagtacttatagtggcaaaaaaacactatttcaaaaggatgcaagttatgcgtggcaaaaggaaatcagattatacttagacactgaagctgatcgcccttttttattctctataggagatatatcagatatttcgatgatttacgatctcaaccaatacaaaggatttgtaataaagaaggggccactatga

SEQ ID NO: 10 - protein, 211 aa, Unknown
  Obtained from environmental sample
  misc_feature (1)..(211): Xaa is any amino acid
MRIKISLEEYKNGNLYCREIKYFKELEDDSIRGDPFEAVIKLGILGPNSEFLIRPKDQPDQPWKKLNIIKGRYQAALPNPLGNLFCMSLIPVEFNEDPTLFKFDEEFEKFGNYFLLVYNQKEFWKRLKKGLRKNKIKGVGKIVDYVDFSTYSGKKTLFQKDASYAWQKEIRLYLDTEADRPFLFSIGDISDISMIYDLNQYKGFVIKKGPL

SEQ ID NO: 11 - DNA, 447 bp, Unknown
  Obtained from environmental sample
  misc_feature (1)..(447): n is a, c, g, or t
ttgctcaagcaaaaagattttttgcaggataatacttttttaactatcaatgttgatatactcacagacctgaatcttaaatattttctttcatttcaccagcaacagcaagctttaataacccttgcagtaagtgaccgcaaaacatcaaggtatttgttgttcaataaatacaacaggttgtgcggttggcgaaacaaaaaaacaggcgaagaaaaaatcgtgattcattcacctggtctagttgaaaaagcatacagcggtatagccatttttgaaccgaccgtttttaatagtatcagcttttcgggaaaattttcggtgattgacctgtatttgtctttggcaaaagaaaataagattgcagaattcgatcatagcaacgataggtttatcgatgtcggaaagcctgatagtgtggcattggcagaacaaatgttttcttaa

SEQ ID NO: 12 - protein, 148 aa, Unknown
  Obtained from environmental sample
  misc_feature (1)..(148): Xaa is any amino acid
MLKQKDFLQDNTFLTINVDILTDLNLKYFLSFHQQQQALITLAVSDRKTSRYLLFNKYNRLCGWRNKKTGEEKIVIHSPGLVEKAYSGIAIFEPTVFNSISFSGKFSVIDLYLSLAKENKIAEFDHSNDRFIDVGKPDSVALAEQMFS

SEQ ID NO: 13 - DNA, 624 bp, Unknown
  Obtained from environmental sample
  misc_feature (1)..(624): n is a, c, g, or t
atgggccatattttcagtgtattatatgactggacgtatcctaagagaaaaccgggaatgaaaaagagaaagcttttgatacttgatcagagtcaatttggttatcatactggtaattatcattattgcaagtatttatatgacgaatatgaaattatttttctttgctgggatcaaaaccttccgaaaatcgaattggatggagttcgagtagtttatgtaagcagaaaaggcaatcttataacaaggagcttgcgttttctgaaatgcgctttggcggaaatttcaaataaaccggtagttgttttcattaaatatttcaaaatcatgtcattagttttaaaactttgtaaaccttctcaatgctttgttcttgatattagaacaggcgccgttgatcgccaagttataaaacgtatcattaatgatacacttctgaaattcgagactagatttttcaaacatattactgtaatttctaaaagtttagcagaaaaattgaatattgctcataaagctcatattttaccattaggggcagacatcatctcccagcagaataagatattnaagaatgcatttgcttatgtngnaacactagaggcgaatattgatgcactataa

SEQ ID NO: 14 - protein, 207 aa, Unknown
  Obtained from environmental sample
  misc_feature (1)..(207): Xaa is any amino acid
MGHIFSVLYDWTYPKRKPGMKKRKLLILDQSQFGYHTGNYHYCKYLYDEYEIIFLCWDQNLPKIELDGVRVVYVSRKGNLITRSLRFLKCALAEISNKPVVVFIKYFKIMSLVLKLCKPSQCFVLDIRTGAVDRQVIKRIINDTLLKFETRFFKHITVISKSLAEKLNIAHKAHILPLGADIISQQNKIXKNAFAYVXTLEANIDAL

SEQ ID NO: 15 - DNA, 738 bp, Unknown
  Obtained from environmental sample
  misc_feature (1)..(738): n is a, c, g, or t
atgaaatacgcagtaatgtattcttcatctactacagcaaacctattcaaggaaaatgtcttaccatatttattagataaagagtcacctaatcaaccatcttcttttgagatagtgtttttcagaggcacaaggaaataccgatatggcttcgaaatcaaagatggatttataagtcaagaatggttgttctattccgaaccaggaataaggcaaaatcatttgtttgttcgtcaaggggcttctataacattcaataaaaagtggaacgaagaaactgacggcatggttgaaactatgatgaaacgagtcaaacaaacggatcactttctattcctttcgtttctcggaattcttcaagttgaaccagcctcggacatacttaaatggtttcaaaagataaatattattgagtcgtttgacagtgaactgttcagtcattatacagctgatctgttaaacaacgaaaggtttcgatacaatatccttaccatgttaaagaatgcagaactcggattcagcatggttaaggagaaaaaaataggtgatggagaaaaggcagatgataggtattcccacgacttcctttcatttatggttaagaatgaaattctacctaaaggtaaatatganataaccacgaaacacctagtatatgacaaggaccataatgctattgacactgtctactttgatttggaactcaggaatcaccggatcaaaaagttctttgcgtga

SEQ ID NO: 16 - protein, 245 aa, Unknown
  Obtained from environmental sample
  misc_feature (1)..(245): Xaa is any amino acid
MKYAVMYSSSTTANLFKENVLPYLLDKESPNQPSSFEIVFFRGTRKYRYGFEIKDGFISQEWLFYSEPGIRQNHLFVRQGASITFNKKWNEETDGMVETMMKRVKQTDHFLFLSFLGILQVEPASDILKWFQKINIIESFDSELFSHYTADLLNNERFRYNILTMLKNAELGFSMVKEKKIGDGEKADDRYSHDFLSFMVKNEILPKGKYXITTKHLVYDKDHNAIDTVYFDLELRNHRIKKFFA

SEQ ID NO: 17 - DNA, 462 bp, Unknown
  Obtained from environmental sample
  misc_feature (1)..(462): n is a, c, g, or t
ttgcgaagtttaaaaagcactttatatcttgattttttagtgatgcctnttctgtacggaacgatatttttattatgcatgcagctttcgatgaagtttcaaattgtcggaagaatcttttttcaaatgctgggctggttgcagatcctggcgtggatcttcgacattattggaaacgtgtacctgctaaaaaagatacatcctaaaacgattccttcagctaaaaatctgcattcgatgatgcaaaaaaatacgttgtctaaatacattatttacctcggaactgttgtaatttgtatttccataatgatttatttctggctcacaggaaattattcgtatatttctctacactattttattattattattttggagataatcgcctttcttattttaaaaaaagcaacagcaaaagatccgaaaattattttggatgaatatagtggcgttgtaaattaa

SEQ ID NO: 18 - protein, 153 aa, Unknown
  Obtained from environmental sample
  misc_feature (1)..(153): Xaa is any amino acid
MRSLKSTLYLDFLVMPXLYGTIFLLCMQLSMKFQIVGRIFFQMLGWLQILAWIFDIIGNVYLLKKIHPKTIPSAKNLHSMMQKNTLSKYIIYLGTVVICISIMIYFWLTGNYSYISLHYFIIIILEIIAFLILKKATAKDPKIILDEYSGVVN

SEQ ID NO: 19 - DNA, 603 bp, Unknown
  Obtained from environmental sample
  misc_feature (1)..(603): n is a, c, g, or t
ttgggtactgcaaaagttgcggtaacactcccggtgaatatgaatttttccgaagaagtaattaaaactgcgattgctgaagaaaaagaagaacctgttattgaaccggtactttccaaaagtcaaattgaagaacctgttcagcaatctccttatcagcaaaaggaatacagtttacgcaggccggtaattactgatgaagttccggaggaacccgtatcccgatatgcgccacagtcacagcaggtattgaatcctgcattcagttcgttggtggaagcgccaactttaacacagtatcagccgaaaagggaagtgaatgaagccattgctgaaaaaaaagaatccctgaatgatcgtttgaagcaggaaaaaacagaagtagcacatgcgttgaaagagacgccgataaaagatcttcgtaaaggagttggtatcaatgaccgcttcacttttgtaagggaattgtttcgcggcgatgatgctttttatgaaagaagcatcaagaccattaacggattccatattttttcagaagctgaatattggatcaacagggaattaaaatacaagatcggctgggatgaagataaagaaatgtaa

SEQ ID NO: 20 - protein, 200 aa, Unknown
  Obtained from environmental sample
  misc_feature (1)..(200): Xaa is any amino acid
MGTAKVAVTLPVNMNFSEEVIKTAIAEEKEEPVIEPVLSKSQIEEPVQQSPYQQKEYSLRRPVITDEVPEEPVSRYAPQSQQVLNPAFSSLVEAPTLTQYQPKREVNEAIAEKKESLNDRLKQEKTEVAHALKETPIKDLRKGVGINDRFTFVRELFRGDDAFYERSIKTINGFHIFSEAEYWINRELKYKIGWDEDKEM

SEQ ID NO: 21 - DNA, 750 bp, Unknown
  Obtained from environmental sample
  misc_feature (1)..(750): n is a, c, g, or t
gtgggcgaagccatgcaatggttaaaccagttgaataatgaatatgaattaaccggcgatgaatatggtatcggtgattttattgaggacctgaagaagaaaggttttatcactgaaaatgaagtgaacggcgaaataaagattacaccaaaaaccgagcagggcattcgtaaaaaaagcctcgaagagatttttggcaaattaaaaaaatcaaggcagggtgagcaccagacatttaagccgggcctgggtgatgatacaaatcctgatacgcggccttttcaatttggcgaccaggtggaacaaattgattttaccgaatccattcgcaatgcgcagatcaatcatggcatagatagttttcaaatgcaggaagatgatctttccatcagggagatggattttaaaacacaaacatcaacggtgctgatgattgatatttcacattcaatgatcctgtatggtgaagaccgcattacgccggcaaaaaaagtggcgatggcattgagtgaactgatcaccacaaaatatcctaaggacacacttgatatagttgtatttggcaatgatgcatggccggtggaaattaaagatttgccttacctgcaagtagggccctttcatacaaacacggtagcgggtttacaaatggcgatggatattttgcgaagaagaaaaaatccgaacaaacaaatttttatgatcaccgatggaaagcctacctgcttaaagaanggncagcgtatataa

SEQ ID NO: 22 - protein, 249 aa, Unknown
  Obtained from environmental sample
  misc_feature (1)..(249): Xaa is any amino acid
MGEAMQWLNQLNNEYELTGDEYGIGDFIEDLKKKGFITENEVNGEIKITPKTEQGIRKKSLEEIFGKLKKSRQGEHQTFKPGLGDDTNPDTRPFQFGDQVEQIDFTESIRNAQINHGIDSFQMQEDDLSIREMDFKTQTSTVLMIDISHSMILYGEDRITPAKKVAMALSELITTKYPKDTLDIVVFGNDAWPVEIKDLPYLQVGPFHTNTVAGLQMAMDILRRRKNPNKQIFMITDGKPTCLKXGQRI

SEQ ID NO: 23 - DNA, 312 bp, Unknown
  Obtained from environmental sample
  misc_feature (1)..(312): n is a, c, g, or t
ttgagaaaaaaaattaggatattattatatgcatttagtaaatccggaaaaactcatttaatcaaatcggtaacaataaagttaattttggtcttgttttacaattcgacaataattccagataagtatattctagagggtttcgacaaggaattaaataaaaatacggatcgcgaattgaatattaaaaaaggaataagcctaatacgggggttgctgcctcgtttattgtttgatgatataatttcggcaataaatcaaaacgataaactttggaaatgtttatcagcacatttagacattataatataa

SEQ ID NO: 24 - protein, 103 aa, Unknown
  Obtained from environmental sample
  misc_feature (1)..(103): Xaa is any amino acid
MRKKIRILLYAFSKSGKTHLIKSVTIKLILVLFYNSTIIPDKYILEGFDKELNKNTDRELNIKKGISLIRGLLPRLLFDDIISAINQNDKLWKCLSAHLDIII

SEQ ID NO: 25 - DNA, 747 bp, Unknown
  Obtained from environmental sample
  misc_feature (1)..(747): n is a, c, g, or t
atgtctatttttgaatattctgactatcgtaagcttatcaaggacaaattcgcgcaaatgcccaagaaaggttttgggcaaatgagtcgcttagcagaggcacttggagtgcatacaacacttgttagtcaggtgttatcgggacataagcaattttctgaagaacagataattttggccgcacaatttttcggatttaatgaacttgaatcagaatatgcggttggcctagtcgaacattctcgcgccggaaataccgcgctaaaatccctcaagttaaaaaaacttgaaagtctgcgagctcaagcaatgcaactctcaaatagggtaaaaaaagatattgttctaaaaccagaggacatggcgctattttattcaagctggatgtattcgtctgttcgccaaatagtcactttaaagggcatacgtactcctcacgatatttcgaataaacttaatataccgattaaacatgtacatcaaattgtctcttttttagtggatagtgggctcatgataaatactgcaaagggacttacagttggtccgcggagcacacatatcgattccaattcgccttgggttaagaatcatcatttgaactggaggcaaaagtctatccagaatctcgaaggccataatgaacggaaccttttttatacttctccgctcactanttccaangcggatttctnnnaaagtcgggagatcttnattgagacgatncatcgtataancttattgtag

SEQ ID NO: 26 - protein, 248 aa, Unknown
  Obtained from environmental sample
  misc_feature (1)..(248): Xaa is any amino acid
MSIFEYSDYRKLIKDKFAQMPKKGFGQMSRLAEALGVHTTLVSQVLSGHKQFSEEQIILAAQFFGFNELESEYAVGLVEHSRAGNTALKSLKLKKLESLRAQAMQLSNRVKKDIVLKPEDMALFYSSWMYSSVRQIVTLKGIRTPHDISNKLNIPIKHVHQIVSFLVDSGLMINTAKGLTVGPRSTHIDSNSPWVKNHHLNWRQKSIQNLEGHNERNLFYTSPLTXSXADFXXSREIXIETXHRIXLL

SEQ ID NO: 27 - DNA, 348 bp, Unknown
  Obtained from environmental sample
  misc_feature (1)..(348): n is a, c, g, or t
ttgacgctattcagaaataaaatggttgatttcgaaaaagaaaaacttcgagctgaatgtgctcgactttttacctgcgatactttaaatgaaagttacgaattgattttagtttacattgaattcctatttcaggttgcaaaaaaacatcacgaagaaccagtaaaatcacaggcggacgctgatgccaaaatggtttttcaaatgatgctaaccaaagcattacatttacagagtattgtcaaaggaatttcttatncatcgaatgacgggacgaaacttaatcatataatcgatcccagtgtcgntactggnntagtaaagaatattnatgaaaccgttncgatt

SEQ ID NO: 28 - protein, 116 aa, Unknown
  Obtained from environmental sample
  misc_feature (1)..(116): Xaa is any amino acid
MTLFRNKMVDFEKEKLRAECARLFTCDTLNESYELILVYIEFLFQVAKKHHEEPVKSQADADAKMVFQMMLTKALHLQSIVKGISYXSNDGTKLNHIIDPSVXTGXVKNIXETVXI

SEQ ID NO: 29 - DNA, 330 bp, Unknown
  Obtained from environmental sample
  misc_feature (1)..(330): n is a, c, g, or t
ttgaacctagaggaatggtgtaaaatggatgagacattgtatagtgccgaaacaaatgaacaatatttacaatttgcaggctatgactatgataaaaaaaatattgaaaatttgtcaaagatgaaatatttggtctcagagatgtttgtaagatctttatctgaacctagaatattgttactatcttcaatcgaaaacatttctgatgcgataacaaaaccttttgaactgaaattgcatgaattgaggggtagtaagattanaatagagattttaatatgggggaagcaggtagctgaacacgtgnagcagtttatagtgccgaattga

SEQ ID NO: 30 - protein, 109 aa, Unknown
  Obtained from environmental sample
  misc_feature (1)..(109): Xaa is any amino acid
MNLEEWCKMDETLYSAETNEQYLQFAGYDYDKKNIENLSKMKYLVSEMFVRSLSEPRILLLSSIENISDAITKPFELKLHELRGSKIXIEILIWGKQVAEHVXQFIVPN

SEQ ID NO: 31 - DNA, 438 bp, Unknown
  Obtained from environmental sample
  misc_feature (1)..(438): n is a, c, g, or t
gtgattatgctcaatgtttgcccgatattttttgaaatgccatttcttataggtacgaatagcggtgattcccaaaataagaaggagactggctatcagaagaacggtatatttttgtttcattcaagaggtaacaaatgcattgcagctaattcctgctatctgatttatccttttttgaaccacatagcccgaagtttcggagatagtagacataaatttccacataaaaggaaatcatcaacatcaaacgaattaataaatccagggatcaaacaaatactatccgacctaaacaaccagaaaccaaaaaccagaaaccagaaacgggtttatataacttcaaacctcaaaccccaaactttcctcaggacttcttcaacggttttcccacttcgatggaacagtcatgaccgggttggccatgggctggattga

SEQ ID NO: 32 - protein, 145 aa, Unknown
  Obtained from environmental sample
  misc_feature (1)..(145): Xaa is any amino acid
MIMLNVCPIFFEMPFLIGTNSGDSQNKKETGYQKNGIFLFHSRGNKCIAANSCYLIYPFLNHIARSFGDSRHKFPHKRKSSTSNELINPGIKQILSDLNNQKPKTRNQKRVYITSNLKPQTFLRTSSTVFPLRWNSHDRVGHGLD

SEQ ID NO: 33 - DNA, 372 bp, Unknown
  Obtained from environmental sample
  misc_feature (1)..(372): n is a, c, g, or t
atgctctccggcaaagtcttcaaatggctggtgggtttcgtaatatacgcccgcaaaacgggcactgtcggggggaagcggaatgccatccagctccacctttccgggattttcaacaagaagggcctccccttcagacccaccatccctgaactggaacatgcaggtcacatggtccagtccttcctccgcccagattttataatcgaggtaaaggcctaccgtatcctccttttgatcggaggactcttctgcatcagtgcaggcaaagaggagaagagggaaaacagcgaccaggatgatgacacgaaacataaggttttatatttttcgaacggtttgatcatcagcactccaccctgcggttggtga

SEQ ID NO: 34 - protein, 123 aa, Unknown
  Obtained from environmental sample
  misc_feature (1)..(123): Xaa is any amino acid
MLSGKVFKWLVGFVIYARKTGTVGGKRNAIQLHLSGIFNKKGLPFRPTIPELEHAGHMVQSFLRPDFIIEVKAYRILLLIGGLFCISAGKEEKRENSDQDDDTKHKVLYFSNGLIISTPPCGW

SEQ ID NO: 35 - DNA, 588 bp, Unknown
  Obtained from environmental sample
  misc_feature (1)..(588): n is a, c, g, or t
atgacgacaaagcaagaaattacttcgttatcagtcactctatcctcattggttcacaaacgacgtgagccgatcgctattttaatctgcggtatgtatggagtaggaaaaacaacattatcatacaatctgtcaaagcatttaaaaattaaacaaagggcttccttagggatcatcacaaagacactgcatgttattgaaaacggcaatagaaatacaagaagtttggatgatttgattttagaaaaaggagatttctcatcattcattctaaaagtgaaaaaaataaccaaaatagtaaactatgtactaaaaatagctaaattagatggagttacgtatttaattgatggtgtacaactatcccctaaatatttacaaaaggataaaaacttactttgtatatttataaaaacgccaagtacaaagatgtataaagaaatattaaattcgtcctcaactcatccgaaaagatatgggaatattggtgaaaaagaaattgaaatacttaaaaagcttgaggaaaatatgctgactgattttaaagtgaatgggaatgcaaaaataattgaatttaaaaaagngtga

SEQ ID NO: 36 - protein, 195 aa, Unknown
  Obtained from environmental sample
  misc_feature (1)..(195): Xaa is any amino acid
MTTKQEITSLSVTLSSLVHKRREPIAILICGMYGVGKTTLSYNLSKHLKIKQRASLGIITKTLHVIENGNRNTRSLDDLILEKGDFSSFILKVKKITKIVNYVLKIAKLDGVTYLIDGVQLSPKYLQKDKNLLCIFIKTPSTKMYKEILNSSSTHPKRYGNIGEKEIEILKKLEENMLTDFKVNGNAKIIEFKKX

SEQ ID NO: 37 - DNA, 732 bp, Unknown
  Obtained from environmental sample
  misc_feature (1)..(732): n is a, c, g, or t
gtggccttaaaaaataatacgacttgtccaagtaaagactgtgtccctattgaaatgaaaatacttattatcgaaatgggaggattaggaagtattttgagaaccacaaccgtttctcaagcgctaaaaagtattcataaaaatacgcatatcacctttttaacaaccgcatacggcaaaggagtattagagtattcaaaaagtatcgatagtgtaattccttattcagaatctacgtttccggttctactagcacaagaatttgatgtaattatcaattatgaagttaatgaattagcaaccagtttaactacacttttaaaaggagtaaaaaagtatggttttggcatgaataaattgggattaccgtatttgttaaataagagtgcgtttgaactataccggtttcaggtagatgattcctttaggcagcgtaataaaaaatcaattcaacaattattaattgaatctgtagagttaccttggaagaaacaaaaatatgatatatcgttgcataatgatgacgatacctatgttaaaaattttataaagtccaatggtatttcaacaaaacgattggttggattgaacatcggttctagaaagatacatgcacgtaaaagatggccagccgattattttattcaattagcccgtaaaataaaaaacatggataatgtcgcgcctctaatacttgcaggacccgacgaagctgaattaatacccatatag

SEQ ID NO: 38 - protein, 243 aa, Unknown
  Obtained from environmental sample
  misc_feature (1)..(243): Xaa is any amino acid
MALKNNTTCPSKDCVPIEMKILIIEMGGLGSILRTTTVSQALKSIHKNTHITFLTTAYGKGVLEYSKSIDSVIPYSESTFPVLLAQEFDVIINYEVNELATSLTTLLKGVKKYGFGMNKLGLPYLLNKSAFELYRFQVDDSFRQRNKKSIQQLLIESVELPWKKQKYDISLHNDDDTYVKNFIKSNGISTKRLVGLNIGSRKIHARKRWPADYFIQLARKIKNMDNVAPLILAGPDEAELIPI

SEQ ID NO: 39 - DNA, 804 bp, Unknown
  Obtained from environmental sample
  misc_feature (1)..(804): n is a, c, g, or t
atgatggagtcagacacacgaattctggccaatgcacttcctgcattgaaagagaatggtattttgatttattcaacctgttcttactctaaagaagaagatgaaaaaattatggattggctcgttgatgaaatgggaatggagaatttagtgttgagaacagagaatgattggaatatcatcgaaacagatttttcaaaaaatgaggctaaaggatatcgtttctatccggataaaataaagggagaaggtttgtttctggcctgctttcaaaaaaagatttcggttaaagaatccaagtatcgtccggcgaaattggagagagcagcaaaaaaggaaattgagattattcaaccatggctgaatacgaatactattgaattactcaaggacaatacttctttttttgctttgccattttccatggttgctgaatattcaattctgaattctgttttaaatattcaatacaaaggaacagggattggacaaatcatgaaggaccgtcttgttcctgatcattctttggctgtgagcactattgtttctgataaaattccttttaatgaactttcttatgagcaggcaataaaatatttgcagcggcagaacgttaacgttatcagttcggggaaaggttggcagttggtgcggtatcagggtcacaatttaggctggataaatgttttgccgaaacgcattaataattattatccgaaggaatccgtatttttgaacagncgaatgattccggttttgagaaataatagcatatttgtaaagctacccgaacctgatcgatca

SEQ ID NO: 40 - protein, 268 aa, Unknown
  Obtained from environmental sample
  misc_feature (1)..(268): Xaa is any amino acid
MMESDTRILANALPALKENGILIYSTCSYSKEEDEKIMDWLVDEMGMENLVLRTENDWNIIETDFSKNEAKGYRFYPDKIKGEGLFLACFQKKISVKESKYRPAKLERAAKKEIEIIQPWLNTNTIELLKDNTSFFALPFSMVAEYSILNSVLNIQYKGTGIGQIMKDRLVPDHSLAVSTIVSDKIPFNELSYEQAIKYLQRQNVNVISSGKGWQLVRYQGHNLGWINVLPKRINNYYPKESVFLNXRMIPVLRNNSIFVKLPEPDRS

SEQ ID NO: 41 - DNA, 486 bp, Unknown
  Obtained from environmental sample
  misc_feature (1)..(486): n is a, c, g, or t
atgaanggaaacaggagctcatgctgtaaaactgaaggtggagaagaagtaattgaatcggtaaaaaaaataatttcggccggcattccggtgatggcacatcttggtctcacgccacaatccatttacaagtttggtacatacggtgtaagggccaaagaagttgacgaagccaataaacttaaaaaagacgcaaagatattagaggaagtaggatgtttttcgcttgtgctcgaaaaaattccggctgcattggcaaaagaagtttctgaaagtcttgaaatacccaccattggaattggcgctggaaaattttgtgatgggcaagtgttggtgatgcatgatatgcttggcattaataccgaatttaagcctcgctttttacgtcagtatttaaatttgcatgagctaactacaaaggcagtacagcaatatatagatgatgtgcgcaaaaatgattttccaaatgatgctgaatcctattaa

SEQ ID NO: 42 - protein, 161 aa, Unknown
  Obtained from environmental sample
  DOMAIN (1)...(158): Ketopantoate hydroxymethyltransferase
  misc_feature (1)..(161): Xaa is any amino acid
MXGNRSSCCKTEGGEEVIESVKKIISAGIPVMAHLGLTPQSIYKFGTYGVRAKEVDEANKLKKDAKILEEVGCFSLVLEKIPAALAKEVSESLEIPTIGIGAGKFCDGQVLVMHDMLGINTEFKPRFLRQYLNLHELTTKAVQQYIDDVRKNDFPNDAESY

SEQ ID NO: 43 - DNA, 576 bp, Unknown
  Obtained from environmental sample
  misc_feature (1)..(576): n is a, c, g, or t
gtgaaaaccgcttcgaccttcatccgtttccgggaacgtcatcactttacaaaaaaagaagacctcaaaaaagtatatggcttttctgacgctttatatgctcaactggagccgtatgtggtgattgaaacttcccgcaggaaacatccaccagaacaattcacggcaaaaacatcaaccccccaacagttaatgattgaactgaacagtgctgacagcataaagcttgaatcgttaaaggggatcggtccggcctttgcccgccgtatcatcaaatacagggctatgctgggcgggtttgtgaacaagcgtcagttgctggaagtgtatgggttcacagaagagaaatacggcgtcatagaaaacgaaatagaagttgatccgtcgctggtgcacaaaatcaatttgaactcggatgattttaagaccgtgaaccatcatccgtatatcacgtacgagctgacgaaaaagatctttgatgcgagaagaagatccgcgatcactgaaggcagttttaaggaattgctgtctgatgacgtcctgttctcgaagctgttaccctacctgaacttctga

SEQ ID NO: 44 - protein, 191 aa, Unknown
  Obtained from environmental sample
  misc_feature (1)..(191): Xaa is any amino acid
MKTASTFIRFRERHHFTKKEDLKKVYGFSDALYAQLEPYVVIETSRRKHPPEQFTAKTSTPQQLMIELNSADSIKLESLKGIGPAFARRIIKYRAMLGGFVNKRQLLEVYGFTEEKYGVIENEIEVDPSLVHKINLNSDDFKTVNHHPYITYELTKKIFDARRRSAITEGSFKELLSDDVLFSKLLPYLNF

SEQ ID NO: 45 - DNA, 321 bp, Unknown
  Obtained from environmental sample
  misc_feature (1)..(321): n is a, c, g, or t
atgaaaaatactaaattcaaatcatttaattctttactacacaaaaccagcagctgtttttttttattgcttattttcattttcggattaaaaattacacatgcacaatcgggtaaagtatccgaatcaaataactaccaggattccaccaataaacttattactcttgtaaaagatgcagccgagctaatancaataaaaggagaagcagcatttaacgattttcgtattcccggtagcccgttgcggcaaaacgatacttatatttttgttcctgatcctgatggtaacatgctggtgcatgcacagcctgaanttgaa

SEQ ID NO: 46 - protein, 107 aa, Unknown
  Obtained from environmental sample
  misc_feature (1)..(107): Xaa is any amino acid
MKNTKFKSFNSLLHKTSSCFFLLLIFIFGLKITHAQSGKVSESNNYQDSTNKLITLVKDAAELIXIKGEAAFNDFRIPGSPLRQNDTYIFVPDPDGNMLVHAQPEXE

SEQ ID NO: 47 - DNA, 744 bp, Unknown
  Obtained from environmental sample
  misc_feature (1)..(744): n is a, c, g, or t
ttggatatctcgttggtacgccatagtatcgagggatcagtaggaggtacggcccctgatgaaagctggacgataaacgggttaccggttcttatgcgcaacccggtgcgaaagaagaaatggaaaggttatgaaatccagcaacctgaagccggcctcaatagccgcattgtagttatacatcgcccgggaatcctgccatatatacctgtcacccggaaacaatacctcgattactgtatcttatttcacggcaaaatgtgggatgaaatgatcaaacggcaggaacaaataccggtacgcactccggaagaggaggaaaaggaaaaaaaagcaaagcttgccaaatttgaaaaagattttggcaacgatccaaaacgtttgaaatctgcagtagattattatctctccggttatcaaaccgaccagcaacggagggatgagcaggtagaaaaaatgaaaaagaataaagaagacatagtaaaaccttttcgtgatgagctggaaaaatctgctaaagaggggttgcttgaaaccccggctgttgttttggtaaaatatcatcacagtcctgtatttgaaacagataccgaaaaaggttatatgcttgtcacggaaaaccaggcctatattcgtaaagacctgccgggatatgtgccgcaggtttttgttttgcgatggacctgcaatgatcattctccacagaaagatatcggaagaattattgaggagaatttccaatag

SEQ ID NO: 48 - protein, 247 aa, Unknown
  Obtained from environmental sample
  misc_feature (1)..(247): Xaa is any amino acid
MDISLVRHSIEGSVGGTAPDESWTINGLPVLMRNPVRKKKWKGYEIQQPEAGLNSRIVVIHRPGILPYIPVTRKQYLDYCILFHGKMWDEMIKRQEQIPVRTPEEEEKEKKAKLAKFEKDFGNDPKRLKSAVDYYLSGYQTDQQRRDEQVEKMKKNKEDIVKPFRDELEKSAKEGLLETPAVVLVKYHHSPVFETDTEKGYMLVTENQAYIRKDLPGYVPQVFVLRWTCNDHSPQKDIGRIIEENFQ

SEQ ID NO: 49 - DNA, 525 bp, Unknown
  Obtained from environmental sample
  misc_feature (1)..(525): n is a, c, g, or t
ttgagcccggtcccttttactttacttaaattcaatcacgaaacgcttgcaaccgcactttcaaacaaattgactcctgttgcggtaacaaaagccagaactccatataaatatttcaaagagtatttcggagatcaagacgatggacttaatgcaaaaacaataataatagaaaataaatatgtaagtaaatcatacttgattgatttttctaattattattcaacctgtttcaaagagtatgatcgtttttgtaaaagggtgcactttttttcattcaagtttacaaaaaaacaatttgaagaagctataagggatccatccaaaggaaataagatctgggataattatctgggctacattgtaataaaaccaataccaacattggtaatcggtgcaactcttttaaaaacatatcagcggacatcagcgaataagcggatattcactgtttctaaaaaatattcgattgatcttttcggcaaacatttaactattgactctctcgctttccagaacaaataa

SEQ ID NO: 50 - protein, 174 aa, Unknown
  Obtained from environmental sample
  misc_feature (1)..(174): Xaa is any amino acid
MSPVPFTLLKFNHETLATALSNKLTPVAVTKARTPYKYFKEYFGDQDDGLNAKTIIIENKYVSKSYLIDFSNYYSTCFKEYDRFCKRVHFFSFKFTKKQFEEAIRDPSKGNKIWDNYLGYIVIKPIPTLVIGATLLKTYQRTSANKRIFTVSKKYSIDLFGKHLTIDSLAFQNK

SEQ ID NO: 51 - DNA, 315 bp, Unknown
  Obtained from environmental sample
  misc_feature (1)..(315): n is a, c, g, or t
ttgcgttgggtaaccatcaacaaaaaaactaagtgtatctttttttttattaaaaacaagaccgaaagacccatcctgtccactataatacaagtatccagtactggcttgcagaatgcttacattttgcaatggtttacctgtttcatcctttacatcgcctttaagatagaattgttgcgcaacagcaacagaatgaagaaaaaaaatggcggttatataaatgacgttctttatcaaaacattgtgggcaaaaaagtacaaaaaatctttcgtggcatcaaatgcgttcgaccagctggtaaatttctttaa

SEQ ID NO: 52 - protein, 104 aa, Unknown
  Obtained from environmental sample
  misc_feature (1)..(104): Xaa is any amino acid
MRWVTINKKTKCIFFFIKNKTERPILSTIIQVSSTGLQNAYILQWFTCFILYIAFKIELLRNSNRMKKKNGGYINDVLYQNIVGKKVQKIFRGIKCVRPAGKFL

SEQ ID NO: 53 - DNA, 399 bp, Unknown
  Obtained from environmental sample
  misc_feature (1)..(399): n is a, c, g, or t
atgctcagaatgaaatatcgcgcaaagaaattgatatacagatttatttctgataagttagtctttgcatacgatgataaacaaaaacttactcttaatagtgccaacattcttattcctaagattgataattatcctattaaagtaatattagcattattcaattcatctttgtatcaattcatttattcaaaaaaattcaacacaataaaagtcttaagaggcaaccttgaagagttgcctttaccaacattaagcgaagagaattataacaaaataactaagtacatagatgaaataatttcctcaagtaaaactcacagccaacttgacttattaatatttaagttatttgatatttcagaatctgaaaaagaatatattttagcatctatttaa

SEQ ID NO: 54 - protein, 132 aa, Unknown
  Obtained from environmental sample
  misc_feature (1)..(132): Xaa is any amino acid
MLRMKYRAKKLIYRFISDKLVFAYDDKQKLTLNSANILIPKIDNYPIKVILALFNSSLYQFIYSKKFNTIKVLRGNLEELPLPTLSEENYNKITKYIDEIISSSKTHSQLDLLIFKLFDISESEKEYILASI

SEQ ID NO: 55 - DNA, 666 bp, Unknown
  Obtained from environmental sample
  misc_feature (1)..(666): n is a, c, g, or t
ttgatgacatgtgcaaaatgtaggtcaaatttttatggtaggataaaaccggacgaacgcgtgtacatgtgtagctcgaaacgaaaaaatttctgcggaactaaaagcattaatattgacgtcttaaataacatagtatttgatattgttaccgacaataaacttcagctaaaactaattagagatgagattgacaatagcaaaaacgcatcggtgaaacctgttttggaaaaagagcttaacaaactaacaaatgaattaacggctttagcaaagaggcgtgaaaatttaatagtgctttttgaaaaagaaaaaattaccctcgaggattttgacagcagagttttatctcttgattcggaaaaaaaaggcctttcaacccgtattaaccaaacaaaaagtcaattaatgttgcttgacacgcaaatggcagaactaaaatctttagaagatgctgatatacgcactcacataaaaaactggactgacgctgaaaaacaacagtttttaaacaagaaagttaagcgggttgaaattgcgtggttgcctaaacattaccgacatattattgagataactttttcagcaggtncaatattcaccgaggttgcaattttcaacaaaaatgaatttgaaaaaaagtttgacagtgacgaattttactag

SEQ ID NO: 56 - protein, 221 aa, Unknown
  Obtained from environmental sample
  misc_feature (1)..(221): Xaa is any amino acid
MMTCAKCRSNFYGRIKPDERVYMCSSKRKNFCGTKSINIDVLNNIVFDIVTDNKLQLKLIRDEIDNSKNASVKPVLEKELNKLTNELTALAKRRENLIVLFEKEKITLEDFDSRVLSLDSEKKGLSTRINQTKSQLMLLDTQMAELKSLEDADIRTHIKNWTDAEKQQFLNKKVKRVEIAWLPKHYRHIIEITFSAGXIFTEVAIFNKNEFEKKFDSDEFY

SEQ ID NO: 57 - DNA, 651 bp, Unknown
  Obtained from environmental sample
  misc_feature (1)..(651): n is a, c, g, or t
atgaagatgattaccggctacctcgctccggatgatggggaaattgttgtgagtggagtcgatgtaaaaaagtctccacttgagtcaaagaaaaaaataggctacctgcccgagtccaatgccttgtattacgacatgtatgtaaaagaatacctgggttttgttgccgatgtacaccagattgccaatagcaaaaaggttattgaagatgtgataacacaggtaggactaactcccgaaaaacataaacgtatcgggcagctttcaaaaggctacaaacaacgggtaggcatagcagcggccttgttacacaaccctgaagtactcattttagatgaaccaaccagcggcttagacccaaaccagattttagagatacggcaagtaatcaaggaccagggaaaggataagatcgttttgttttcatcgcacatattacaggaagtagaagctatttgcgatcgggtaatcattatcaataaaggaaagattgtggctgacgaccggttaagcaatcttcaaaaccaatcttcattaaatatagtgcgggtgagttttaaggaaccgttggaacaggaatggctacaacgattaaaacaagtaaaatcagtaaataaggtagacagtttcagctggagttggaaacgatga

SEQ ID NO: 58 - protein, 216 aa, Unknown
  Obtained from environmental sample
  DOMAIN (1)...(162): ABC transporter
  misc_feature (1)..(216): Xaa is any amino acid
MKMITGYLAPDDGEIVVSGVDVKKSPLESKKKIGYLPESNALYYDMYVKEYLGFVADVHQIANSKKVIEDVITQVGLTPEKHKRIGQLSKGYKQRVGIAAALLHNPEVLILDEPTSGLDPNQILEIRQVIKDQGKDKIVLFSSHILQEVEAICDRVIIINKGKIVADDRLSNLQNQSSLNIVRVSFKEPLEQEWLQRLKQVKSVNKVDSFSWSWKR

SEQ ID NO: 59 - DNA, 495 bp, Unknown
  Obtained from environmental sample
  misc_feature (1)..(495): n is a, c, g, or t
ttgtacagcaaagttgctaaccgcaaacaccaactaaaaaatgaaacatttattatgatagagcttcaacatatttccaaatggttcaacattggaaacaggccaaacttcattttaaaagatattaatctgaaaattgctgaaggagaatttgtatctgtaatggggccctcagggtctggtaaatcaactctgcttaatattatcggcatgctggatacgccatctgaaggcttgtacaattttatggaccagccagtttatgaaatgaaagaaaaacaacgttcagcattgtataaaagaaatatcggtttcattttccaggcatatcacctgattgatgaattaacggtttatgaaaatattgagacgcctttgctttaccaggatgtaaaaggatctgaacgaaaagctatggttgctgatatattggaccgctttcagattgtaggtaagaaagatctttccccgcacaacttgaggcgtcacaaataa

SEQ ID NO: 60 - protein, 164 aa, Unknown
  Obtained from environmental sample
  DOMAIN (49)...(164): ABC transporter
  misc_feature (1)..(164): Xaa is any amino acid
MYSKVANRKHQLKNETFIMIELQHISKWFNIGNRPNFILKDINLKIAEGEFVSVMGPSGSGKSTLLNIIGMLDTPSEGLYNFMDQPVYEMKEKQRSALYKRNIGFIFQAYHLIDELTVYENIETPLLYQDVKGSERKAMVADILDRFQIVGKKDLSPHNLRRHK

SEQ ID NO: 61 - DNA, 654 bp, Unknown
  Obtained from environmental sample
  misc_feature (1)..(654): n is a, c, g, or t
atgggcgaccagatggatgcacagcgaaatgtctggtttgaaggtataatgggtcgccccgacctagttaggaaagataattccataattctggaactcaaggataccaacagtttcatcaccgtctcaccttttaacgacgacgaaataaccgacgcctatccaaaagcctatgaaatattgggggttgataagatgaccaagacaaattccaaacgtaaaaaatacaattcattccccggctatctggtacagctagttacttatatggtcatgatggatattgaatacggcacagttgtaatccgtcacaacaaccacaagttcataatgaaactaaagaacattgatgtatctcaaagcccgttcaaggaatggaagatatatctaccgaaggacgacccaattcgggccaaagtaaaagagaacctgatgataaagaaacactttttcgtggaggcgattaaaaccaagaacatcggtatgataccaaagtgtaatgactattacacggaaggccccgataacgtaaagtgtaaacgctgttgtttcaaggaagaatgtcataaaataaatgatacggtgcccgactatttacgggagatactggacccgctctacatctacaacgagtttaaaaatgaaataaaatag

SEQ ID NO: 62 - protein, 217 aa, Unknown
  Obtained from environmental sample
  misc_feature (1)..(217): Xaa is any amino acid
MGDQMDAQRNVWFEGIMGRPDLVRKDNSIILELKDTNSFITVSPFNDDEITDAYPKAYEILGVDKMTKTNSKRKKYNSFPGYLVQLVTYMVMMDIEYGTVVIRHNNHKFIMKLKNIDVSQSPFKEWKIYLPKDDPIRAKVKENLMIKKHFFVEAIKTKNIGMIPKCNDYYTEGPDNVKCKRCCFKEECHKINDTVPDYLREILDPLYIYNEFKNEIK

SEQ ID NO: 63 - DNA, 336 bp, Unknown
  Obtained from environmental sample
  misc_feature (1)..(336): n is a, c, g, or t
atgagtgatttaaaccagtccacagaaaaccagaagagaaaaagtaaacgaatcctcatagctgaaccagaaccagatattcagtttctttattctctttttgcaaaacagtatggattttcaatatcagatgtgaatatagtagaaagtggtaacaaatgtttagaaattgtattttctaatactagagaagatagtaacaacaaagactatgatatcattatgttagatactcatcttcacgatatttcaggctttgaagttgcaagaaagattcgtgatagattaccacataaaaaaataatattaactacaacgtattcattagataattaa

SEQ ID NO: 64 - protein, 111 aa, Unknown
  Obtained from environmental sample
  misc_feature (1)..(111): Xaa is any amino acid
MSDLNQSTENQKRKSKRILIAEPEPDIQFLYSLFAKQYGFSISDVNIVESGNKCLEIVFSNTREDSNNKDYDIIMLDTHLHDISGFEVARKIRDRLPHKKIILTTTYSLDN

SEQ ID NO: 65 - DNA, 630 bp, Unknown
  Obtained from environmental sample
  misc_feature (1)..(630): n is a, c, g, or t
atgatagatgtaaggatgagtagacaatggcttcaacaacgacaatcagatattccaaaaaaacattatcttttaatttattctgatgatgattccatattaggattactaaagtctatggatagacttgccaaagaaagtgatttatttagatgtttttgtggtccttcttctacaaattctactaaattattatctaaactaaattggtataatggtatagtaatgccttattattatgatgaacctgaaacattaaaacaaaaacagaaacaaaatcaatctgaaaataacaaaagcattatgagatattgtagcaaggttatggaaaatatagtagaagccgcaaacgataccaataataaacaggtttgctgcattgattttcttataaatgatatagcaaaatcttcattacaacaagctctaaaaattgaaaaagcctatgatgatagtagaattccaggacttatgtattgtacatacaagactgaaactttgctaagcgcagagataaaagaccttgtagaattgtttgaaggacatgatcaggtctttatactaaaacaagatgatgtctataaacttcatatcacaaaggaaaatgtgcataaacttttcttaaattaa

SEQ ID NO: 66 - protein, 209 aa, Unknown
  Obtained from environmental sample
  misc_feature (1)..(209): Xaa is any amino acid
MIDVRMSRQWLQQRQSDIPKKHYLLIYSDDDSILGLLKSMDRLAKESDLFRCFCGPSSTNSTKLLSKLNWYNGIVMPYYYDEPETLKQKQKQNQSENNKSIMRYCSKVMENIVEAANDTNNKQVCCIDFLINDIAKSSLQQALKIEKAYDDSRIPGLMYCTYKTETLLSAEIKDLVELFEGHDQVFILKQDDVYKLHITKENVHKLFLN

SEQ ID NO: 67 - DNA, 423 bp, Unknown
  Obtained from environmental sample
  misc_feature (1)..(423): n is a, c, g, or t
ttgttttcagaaacttattaccaggcaaagattaataatcagactgaaactatcaaaaaaacggctgaattatatcttttttattgtgaaaaattatttgaattttatgaaaatttttctctgaatttatttggcaggcaaataaaacaaatactgatgctacattataatgatttaaatatcgattgtttaacaagtatatgcaatattttgaaaaaaaggggatattcttttattaaccttgaagaagcactgctggaaccggtctatcagctaaaagacaattacattggggctgatggactgacatggctgcaccgctgcaattttaatctgaaaggttatgaaaaattccgttatgattattatgaaaataataaaatttctgtttctatcaaagcagaattatcagctatgcagtaa

SEQ ID NO: 68 - protein, 140 aa, Unknown
  Obtained from environmental sample
  misc_feature (1)..(140): Xaa is any amino acid
MFSETYYQAKINNQTETIKKTAELYLFYCEKLFEFYENFSLNLFGRQIKQILMLHYNDLNIDCLTSICNILKKRGYSFINLEEALLEPVYQLKDNYIGADGLTWLHRCNFNLKGYEKFRYDYYENNKISVSIKAELSAMQ

SEQ ID NO: 69 - DNA, 723 bp, Unknown
  Obtained from environmental sample
  misc_feature (1)..(723): n is a, c, g, or t
atcgattattttataactggcagtgaatgtgaagtaatcgaaaatcttagtgaaaattattctgaacgagcgggtgtatttcctggagttgggttatacccggtttatccggattatagacccccttctgaagactatccccttcgactccgctcagggggcgttgaacggagtcgaaacgacaaagaggaaaaagaaaatagcgaatttatcattatttgtccctggtccaaaagaaaaattaattatccccatttactaaatttaaaaaagataattgaaaactctaacagaaaaataaagttcaggttttttccttctattcagaatgacagtaagttacatgccctgggaaaagaaatagcaagtattctgggcaagaaaaattttgaaatttatgcatcatgtgattatcagaaatatatggctttaattgaagaagctgatttagtaatagattcctttcactttggcggttataacacaataatagatgccctgtatttatataaaccatttattaccctggaaggagataaagcctataataggtttgcccctgcggtattgcgcagtatcggccttgatgaattaatagctgtaaattctcaggagtatatcaataaaatcctaatggttatcaataatgatctttacagggataccctgaatattaaaattaaaagcggaaatctttatgaaaagttgtnntcagacaggtag

SEQ ID NO: 70 - protein, 240 aa, Unknown
  Obtained from environmental sample
  misc_feature (1)..(240): Xaa is any amino acid
MDYFITGSECEVIENLSENYSERAGVFPGVGLYPVYPDYRPPSEDYPLRLRSGGVERSRNDKEEKENSEFIIICPWSKRKINYPHLLNLKKIIENSNRKIKFRFFPSIQNDSKLHALGKEIASILGKKNFEIYASCDYQKYMALIEEADLVIDSFHFGGYNTIIDALYLYKPFITLEGDKAYNRFAPAVLRSIGLDELIAVNSQEYINKILMVINNDLYRDTLNIKIKSGNLYEKLXSDR

SEQ ID NO: 71 - DNA, 747 bp, Unknown
  Obtained from environmental sample
  misc_feature (1)..(747): n is a, c, g, or t
atgttcaaaaactatttgctcactgcacttcggagttattacatcggtaaaaaaattggtaaccgttctttctttacctacattaatttattaggccttattattggcctcgccgcatttttggtgattgcgcatctggtacgttacgagttgagttatgatcgctttccttcacacgcaaaagatatttatcggcttgtagttgaaaaaacagagaacggcgaatctaccatggccagtgcgaaaacctatccgggtgctggtgccattttaaaaaatgatatccccgaagtgcaaagcttcgcaagagtgatgaaggaagaatgcatgctgcattacaagaaaacagacatcaaattcaaccggcagtatacctattgggctgatagaagttttctgaccatgtttggtttggaatttttagcaaaaggtgatacttccactttagacaaaccaaataattgtgtcatttctgcatccacggctgaacgtttttttggaaaagactggctgaaaaaaaaatcacctgttggtgaaaccattcatctgaatgaaagcctgccttttttaatacaaggtgtttataaagaccttccggctaactcgcatatgaatgttgactttatcgtttcgtatgcttctttgatagcacttaccatccctgacctggattttggaatgcctccatttggtaatgttgtttatacttacgttttggcaaagccaggcagctctcaagaaagatag

SEQ ID NO: 72 - protein, 248 aa, Unknown
  Obtained from environmental sample
  misc_feature (1)..(248): Xaa is any amino acid
MFKNYLLTALRSYYIGKKIGNRSFFTYINLLGLIIGLAAFLVIAHLVRYELSYDRFPSHAKDIYRLVVEKTENGESTMASAKTYPGAGAILKNDIPEVQSFARVMKEECMLHYKKTDIKFNRQYTYWADRSFLTMFGLEFLAKGDTSTLDKPNNCVISASTAERFFGKDWLKKKSPVGETIHLNESLPFLIQGVYKDLPANSHMNVDFIVSYASLIALTIPDLDFGMPPFGNVVYTYVLAKPGSSQER

SEQ ID NO: 73 - DNA, 300 bp, Unknown
  Obtained from environmental sample
  misc_feature (1)..(300): n is a, c, g, or t
ttgtctaattctatagtctcatcttcagatcattcttttgtaaggttttatggcaggaatacttctagtggtcattattggtacaattatctttatataaagaaagaacttgagccttgggtagatagaataacaaacttaaaaaatcaaactaaaaaacttagaatatattttaacaaccattatggaggaaaagctgtgattaatgcattacagtttaaggaaatgaatagtgtatcattaaacgataaagagagaaagattctacaaaatgcggaaaattattatcattatcattga

SEQ ID NO: 74 - protein, 99 aa, Unknown
  Obtained from environmental sample
  misc_feature (1)..(99): Xaa is any amino acid
MSNSIVSSSDHSFVRFYGRNTSSGHYWYNYLYIKKELEPWVDRITNLKNQTKKLRIYFNNHYGGKAVINALQFKEMNSVSLNDKERKILQNAENYYHYH

SEQ ID NO: 75 - DNA, 366 bp, Unknown
  Obtained from environmental sample
  misc_feature (1)..(366): n is a, c, g, or t
atgagcggtttattggttttttactggagcattatgcaggaaaatttccaaacatggctggcgccggtgcaggtaaaaattctacctataagcgacaagtttttggactatgcaaaagatgtgctacaaaaattaaaaaaagctgatattcgtgccgggattgacgaccgcaatgaaaagataggcaagaaaataagagacacagaattgatgcgggtaccatacatgttggtgataggagagaaagaagtgaatgaaaaaaaggtgtcaataagaaggcagggaaaaggtgatcttggagcaaaaaatgtagatgaatttctaaatgaaataatggaggaagtgaaagaaagaagagaagggtaa

SEQ ID NO: 76 - protein, 121 aa, Unknown
  Obtained from environmental sample
  DOMAIN (24)...(114): Anticodon binding domain
  misc_feature (1)..(121): Xaa is any amino acid
MSGLLVFYWSIMQENFQTWLAPVQVKILPISDKFLDYAKDVLQKLKKADIRAGIDDRNEKIGKKIRDTELMRVPYMLVIGEKEVNEKKVSIRRQGKGDLGAKNVDEFLNEIMEEVKERREG

SEQ ID NO: 77 - DNA, 570 bp, Unknown
  Obtained from environmental sample
  misc_feature (1)..(570): n is a, c, g, or t
ttgtactccaatagtgaaagttctgattcctattattcttctaacttccactttataaaaaaatttgatagaaatggaaatctcatagatagttggggcactgttggatccgaagatgggaattttctccatgctcatggaataactattgattcagaagataatgtctatgttagtgatgcagaaaattgtaatatccaaaaatttgataaagatggaaattttattactaaatggggctcaaaaggaataggtcctggtaaatttctgcaacctgaaagtatggctgtagattctctgaataacatctatgttgcagaatattcaggcaaaaatattcaaaaattcgataatgatggtaactttataacaatgtggggaaaagaaggtgaaaatataggtgaatttaaaaaaccgtggggtgttgcggtagattcagaagataatgtgtatattagtgaccaatcaattccaagaatacaaaaatttgacagtaatggtaattttataaagatgtgngggaaagcaanggctcagagaaaggtcaattgtacattacatgatacataa

SEQ ID NO: 78 - protein, 189 aa, Unknown
  Obtained from environmental sample
  DOMAIN (136)...(163): NHL repeat
  misc_feature (1)..(189): Xaa is any amino acid
MYSNSESSDSYYSSNFHFIKKFDRNGNLIDSWGTVGSEDGNFLHAHGITIDSEDNVYVSDAENCNIQKFDKDGNFITKWGSKGIGPGKFLQPESMAVDSLNNIYVAEYSGKNIQKFDNDGNFITMWGKEGENIGEFKKPWGVAVDSEDNVYISDQSIPRIQKFDSNGNFIKMXGKAXAQRKVNCTLHDT

SEQ ID NO: 79 - DNA, 669 bp, Unknown
  Obtained from environmental sample
  misc_feature (1)..(669): n is a, c, g, or t
ttggaaggcaaaattgaagtggattatgtatttcaaaattttgatcttaaacagtttggaattgaagaagaaatctacagagaaaagccctggggaactgcccatgctatcttatcaggaagaaaagcggtgaaagagccattttgtgttattaatgctgatgatttctacggtttcgaagcctttaaaaaaatggttgagtttttaagtgaggaagctaccgatagcaatttttcaattattggttatcagatcgggaaaacactttcagattttggtgccgtgtctagaggagtttgtaaagttgatgaaagcggaaatttggaagaaatcattgaacgcacaaaagtctatcaagaagatggtgttattgtgtatgaagaagatgacaaaaagtatcctttagcttttgaaacccctgtttcaatgaatttttggggatttacacctgcagtctttaaaattacggaagatctatttaaagaatttgccttagcaaacaaggctaaccctaaagcagagtttttcattccattaattggagaaaatttagtgaaaagcaattcagcgaccttcaaggtcgttccaacagcaaatcaatggtttggcgttacttataaggaagataaaccatttgtgcaggcaagcatagatcaatatccaaaataa

SEQ ID NO: 80 - protein, 222 aa, Unknown
  Obtained from environmental sample
  misc_feature (1)..(222): Xaa is any amino acid
MEGKIEVDYVFQNFDLKQFGIEEEIYREKPWGTAHAILSGRKAVKEPFCVINADDFYGFEAFKKMVEFLSEEATDSNFSIIGYQIGKTLSDFGAVSRGVCKVDESGNLEEIIERTKVYQEDGVIVYEEDDKKYPLAFETPVSMNFWGFTPAVFKITEDLFKEFALANKANPKAEFFIPLIGENLVKSNSATFKVVPTANQWFGVTYKEDKPFVQASIDQYPK

SEQ ID NO: 81 - DNA, 705 bp, Unknown
  Obtained from environmental sample
  misc_feature (1)..(705): n is a, c, g, or t
gtgtgcggagttattatcttttccgtgctggcggtaattgtttttacgctggtatacgaagttttatacctgagcaaagaaagagaaagagatacacaaatggtggtgcagttggacaatgaattaaccagagcagaaatgatggctttaagaaatgaattggacccgcactttattttcaattcattaactgctctttcctatctcatttcaaatgacagcaaaaaagcagaccagttcaaccaaaaactggcagaagtttataaatattttttgatcaataaagaaaaagaagttactactatagaaaatgaaattgaattcataaaaaactattgctttcttttatctatcaggcatgatgacaaactaaaattgcatattgattttgatgaaaaaaatatgaatcatgtttttattattccctgcgctttgcagattttggttgagaatgctataaaacataacatatttacccacgagcagcctttgaatattcatgtttctttagagggagaatacattattgtacagaacgaaggaaaacaaaaacaatcacttcccggtaccacaaaaatcggtttaaagaatctcggcgctcaatacaggctgctggctaaacaaaatattatcgtggaagaatcagtaaatagttttgtagtaaaactgcctcttatcccattaacccgaactcgggttaattaa

SEQ ID NO: 82 - protein, 234 aa, Unknown
  Obtained from environmental sample
  DOMAIN (46)...(129): Histidine kinase
  misc_feature (1)..(234): Xaa is any amino acid
MCGVIIFSVLAVIVFTLVYEVLYLSKERERDTQMVVQLDNELTRAEMMALRNELDPHFIFNSLTALSYLISNDSKKADQFNQKLAEVYKYFLINKEKEVTTIENEIEFIKNYCFLLSIRHDDKLKLHIDFDEKNMNHVFIIPCALQILVENAIKHNIFTHEQPLNIHVSLEGEYIIVQNEGKQKQSLPGTTKIGLKNLGAQYRLLAKQNIIVEESVNSFVVKLPLIPLTRTRVN

SEQ ID NO: 83 - DNA, 603 bp, Unknown
  Obtained from environmental sample
  misc_feature (1)..(603): n is a, c, g, or t
ttggtggtaaagtatttaaatactaaagtttttaaaatgaagaggatttttattttctgttgtatgcagttgattgttgcaacaacaatggcacaaaataataccgggtttcagcttgtagataaacctgcaagcaagcaggtggatgtattgtacaatggaaaattattaactgcatattgttattacgattccatcatgaagccatttttatatcctgtaaacacacttgatggtattacagtaacccgcggttatcctattgcaccaagggctggcgacagaaccgaccacccgcatcatgtaggtatatggatgaattatgaatctgtgaatggcctcgatttctggaataattcaacagctattcctgcagaaagaaaaaacaaatacggcactataaaacatgaccaggttgttgaaaaaaatgcagcaggcgataaagcatctattactgttactgctaattggataaggcctgacgggaaaacaataatgaaagaaaaaacagtctatcatttttctgtaaaagacaaaaatttcttattgacagaaactctgtgctcacagccgcagatgagccggttatttttaagatgtgag

SEQ ID NO: 84 - protein, 201 aa, Unknown
  Obtained from environmental sample
  misc_feature (1)..(201): Xaa is any amino acid
MVVKYLNTKVFKMKRIFIFCCMQLIVATTMAQNNTGFQLVDKPASKQVDVLYNGKLLTAYCYYDSIMKPFLYPVNTLDGITVTRGYPIAPRAGDRTDHPHHVGIWMNYESVNGLDFWNNSTAIPAERKNKYGTIKHDQVVEKNAAGDKASITVTANWIRPDGKTIMKEKTVYHFSVKDKNFLLTETLCSQPQMSRLFLRCE

SEQ ID NO: 85 - DNA, 717 bp, Unknown
  Obtained from environmental sample
  misc_feature (1)..(717): n is a, c, g, or t
atgggaatctcttntgatatctatccccgtacttctaatagagttcatcatgaaacatcagcagctttttttaaaaagatgtatgatgagggtttgtttgaagaaaaagaaatcgaacaatattatgatgagaaagcaaaggtttttttagcagatagatatattgttggcacttgccctgtttgtggaaatgaaaacgcatatggcgaccaatgtgaaagatgcggcagttctttatctcctgaacagttgatcaatccacgaagcacattgagtgatgcagtgcctgtaaaaaagaaaacgaaacactggtattttccattgcagaattatgaggcctggttgaaagaatggattttagaaggccataaagaatggaagaataatgtatacggccagtgcaaaagttggctggatagtggtttgcaaagccgggctatgacaagagatagtacgtggggaataaaagttcctttgccaaatgcggaaggaaaagttttgtacgtatggtttgatgcgcctattggttatataagtgctacaaaagaattaactccggactgggctgattattggtgcaagaaagatacgaggctgattcattttataggtaaggataatattgtttttcattgcataatttttccggcaatgcttcgggcacatggtgaatttgttttgcctgataatgtgcccgcaaatgaatttttaatatga

SEQ ID NO: 86 - protein, 238 aa, Unknown
  Obtained from environmental sample
  misc_feature (1)..(238): Xaa is any amino acid
MGISXDIYPRTSNRVHHETSAAFFKKMYDEGLFEEKEIEQYYDEKAKVFLADRYIVGTCPVCGNENAYGDQCERCGSSLSPEQLINPRSTLSDAVPVKKKTKHWYFPLQNYEAWLKEWILEGHKEWKNNVYGQCKSWLDSGLQSRAMTRDSTWGIKVPLPNAEGKVLYVWFDAPIGYISATKELTPDWADYWCKKDTRLIHFIGKDNIVFHCIIFPAMLRAHGEFVLPDNVPANEFLI

SEQ ID NO: 87 - DNA, 471 bp, Unknown
  Obtained from environmental sample
  misc_feature (1)..(471): n is a, c, g, or t
ttgtatatccacaactctataggaattatagatgaaagttcaattgatagactttatcttgtaaatgaactctcaaattatattcactttaaacaccaaaacaaacaagaaaatgagaaagaactatctaaaatagcacctcaactcttatggattcttcatgatttcactcatcaaatcaaatcagaagatacagatttgacaaatcatcaatttatccttgaaaaatcactcgaaatacaaaaagatggtaaaaactttcaagagagaaacaaaataagaaattccatcaaaactatctttccaaacagaagttgttttgctatttttaaatctcttgatgacaataaattaaaatctgaaaatcaaattaacaacatattaatagagatctcaaaaatcatcaaattaaaaacaatagatagtgttgctcttaatggtccaagtaattttttaatttttaatttttag

SEQ ID NO: 88 - protein, 156 aa, Unknown
  Obtained from environmental sample
  misc_feature (1)..(156): Xaa is any amino acid
MYIHNSIGIIDESSIDRLYLVNELSNYIHFKHQNKQENEKELSKIAPQLLWILHDFTHQIKSEDTDLTNHQFILEKSLEIQKDGKNFQERNKIRNSIKTIFPNRSCFAIFKSLDDNKLKSENQINNILIEISKIIKLKTIDSVALNGPSNFLIFNF

SEQ ID NO: 89 - DNA, 528 bp, Unknown
  Obtained from environmental sample
  misc_feature (1)..(528): n is a, c, g, or t
ttgatcagatgtcttgagaactccaataatttcattagactcgtcagagcaatagtcggacaacagctttcggtcaaggctgcatcaactatatttggaagatttgaaaagttatttaaaaagggtatttcagcttcagcaattctaaagctcaaagacgatgatatgcgtgcgtgtgggatatcttatccgaaaataaaatacataaaagatctttccgaaaaagtacacaataaagaacttcttcttgatacttttgaacatgcagatgaagagactatcatagaaaacctcacaaaagtaaagggtattggtatctggtcagctgagatgttcttgatgtttgcgcttgcccgcccggatgtcttttcagtaggcgacttggggttaaggaatgcaatgataaaactttacggacttgaaaaaccaacggatgaaaaaatattaaaattatctaaaaaatggagtccgtataggacatatgcatgccgcatcttgtggcaaagcctggataattctcctaagtag

SEQ ID NO: 90 - protein, 175 aa, Unknown
  Obtained from environmental sample
  DOMAIN (15)...(157): HhH-GPD superfamily base excision DNA repair protein
  misc_feature (1)..(175): Xaa is any amino acid
MIRCLENSNNFIRLVRAIVGQQLSVKAASTIFGRFEKLFKKGISASAILKLKDDDMRACGISYPKIKYIKDLSEKVHNKELLLDTFEHADEETIIENLTKVKGIGIWSAEMFLMFALARPDVFSVGDLGLRNAMIKLYGLEKPTDEKILKLSKKWSPYRTYACRILWQSLDNSPK

SEQ ID NO: 91 - DNA, 501 bp, Unknown
  Obtained from environmental sample
  misc_feature (1)..(501): n is a, c, g, or t
gtgatctttacgactgcttatccgcaatatgctctcgaaggctttgatttaaatgcactggattacctggtgaaacctatttcgtttgagcggtttttaaaagctgcaaacaaagcaaaagaatattatgagctgcgatttaagaaccagaaattatcaggtaaacaaagaaattccgatcatgttttcattaaagtagatggccggttggtaaaaatcttatttgagaatatcctctttattgaagcgcttcaaaattatattgctgttcatactaaagacaaaaaatacatcagctatttaaccctgcaatccctccttgaatttttaccaccctcaaactttgtcaaagcacacaaatcctttatagtttcggtagacaagatagatagcattgagggaaataatttacaattaggccaacatcatattccaataagccggagcttaaaagaagaagtgatggaaaaactattggggaaacattttgtaaaaagataa

SEQ ID NO: 92 - protein, 166 aa, Unknown
  Obtained from environmental sample
  DOMAIN (68)...(159): LytTr DNA-binding domain
  misc_feature (1)..(166): Xaa is any amino acid
MIFTTAYPQYALEGFDLNALDYLVKPISFERFLKAANKAKEYYELRFKNQKLSGKQRNSDHVFIKVDGRLVKILFENILFIEALQNYIAVHTKDKKYISYLTLQSLLEFLPPSNFVKAHKSFIVSVDKIDSIEGNNLQLGQHHIPISRSLKEEVMEKLLGKHFVKR

SEQ ID NO: 93 - DNA, 630 bp, Unknown
  Obtained from environmental sample
  misc_feature (1)..(630): n is a, c, g, or t
atgttagttaatctgtcttctgaatgtattagatcttatcccncaataattccagaaagaataggtcttggagctggtcatagaaaactaaatgatagacccaacgtccttaggatagtggtagggaagaacccagggagttctacgttaattcatgaaaagatgtttttgattgaaacaaatatagatgacgttaatggagagatagttggaaatttaatagacgttttaatgaaagaaggagcaagagatgtaacgatcattcctggaataaccaaaaaaaatcggcctgtaaatataataagagtcctttctgatttaacaaaaaatgactctatcgttgagagattatttaaagaaactggaacttcaggtataagaataaatgaaattaatagaatatctttaaagaggaacataataattattcaggtaaacataaatcattctaagtatgatgtcaaaataaaaataacaagagattcatcaaataatataatcaacatcaaaccagaatttacggatttgaaacatatatcagataatgaaaatcgttcattaaaatcaattcaagaaattgttatgtaccacatatttaaaaaatttaaggagaatagttatgagaagtga

SEQ ID NO: 94 - protein, 209 aa, Unknown
  Obtained from environmental sample
  DOMAIN (1)...(201): Protein of unknown function DUF111
  misc_feature (1)..(209): Xaa is any amino acid
MLVNLSSECIRSYPXIIPERIGLGAGHRKLNDRPNVLRIVVGKNPGSSTLIHEKMFLIETNIDDVNGEIVGNLIDVLMKEGARDVTIIPGITKKNRPVNIIRVLSDLTKNDSIVERLFKETGTSGIRINEINRISLKRNIIIIQVNINHSKYDVKIKITRDSSNNIINIKPEFTDLKHISDNENRSLKSIQEIVMYHIFKKFKENSYEK

SEQ ID NO: 95 - DNA, 618 bp, Unknown
  Obtained from environmental sample
  misc_feature (1)..(618): n is a, c, g, or t
atgttgtgcgtcggcaatatcccttcgctcattaagtactacgagatcttcaaacgcaaaaaggaaacaggcgagcacaagctgaagatcggaacgatcttttcatttggtgtgaacgaagacgacccggatgcggacggcagttatatgttcgaagcacctgaatctatcaccgcgcttgatcaggtcagcccgcacagtcgcgacaagcttgaagaatttatcggcgattacaacgcactgttcaataccaagttcactaccaaagacagccagtcgttttacgactattacaaggatattgggcggcgggcgaagaagaaagagttggacctgctgcttgtcgtaaacatgtttctgacaggctttgatagtcccgctctcaatacgctgtttgtcgataagaatcttcgctatcacggcctcatccaggcttattcccgaacaaaccgcatcctcaacgaaatgaagtcgcaagggaacatcgtggcgtttcgtaatctgaagaaggccacagatgaggcgatagctctctttgcaaataaagaggcgatcgaggaagtgatcgttgaaccgctcgaagtctcggtcgagaaattaataaaggtgagagagtaa

SEQ ID NO: 96 - protein, 205 aa, Unknown
  Obtained from environmental sample
  misc_feature (1)..(205): Xaa is any amino acid
MLCVGNIPSLIKYYEIFKRKKETGEHKLKIGTIFSFGVNEDDPDADGSYMFEAPESITALDQVSPHSRDKLEEFIGDYNALFNTKFTTKDSQSFYDYYKDIGRRAKKKELDLLLVVNMFLTGFDSPALNTLFVDKNLRYHGLIQAYSRTNRILNEMKSQGNIVAFRNLKKATDEAIALFANKEAIEEVIVEPLEVSVEKLIKVRE

SEQ ID NO: 97 - DNA, 411 bp, Unknown
  Obtained from environmental sample
  misc_feature (1)..(411): n is a, c, g, or t
atgaaaattgcactatttacagatgggatttttccttatgttatcggtgggatgcagaaacattccttcaacctggcaaaatattttgccaggaacaaagtgtacataaatctgtatcataccaatcaaagtggatatgatatttcccggctggagttcttttctgaagaagaaaaaaaatatataagatcgtttgttgttgattttccgtctctaggaaatttccccggacattacatcagggaatcttttgaatattccaatcggattttcaaacttttttcaaaaaatgctgatgtagattttatttatgcgaaagggtttacagcctggaagctcttggatganaggcgtaagggatataaatgtgccccctgttngtgttattnccatgctatgagatgttccaga

SEQ ID NO: 98 - protein, 137 aa, Unknown
  Obtained from environmental sample
  misc_feature (1)..(137): Xaa is any amino acid
MKIALFTDGIFPYVIGGMQKHSFNLAKYFARNKVYINLYHTNQSGYDISRLEFFSEEEKKYIRSFVVDFPSLGNFPGHYIRESFEYSNRIFKLFSKNADVDFIYAKGFTAWKLLDXRRKGYKCAPCXCYXHAMRCSR

SEQ ID NO: 99 - DNA, 765 bp, Unknown
  Obtained from environmental sample
  misc_feature (1)..(765): n is a, c, g, or t
ttggatgaaaggcgtaagggatataaatgtgcccctgttggtgttaatttccatggctatgagatgttccagaagcctgcttccctaagatccaggatagaacagttattattacgtaaacctgtaatatttagtattgcaaatgctgattacgtattttcatacggagggggtatcactgatattatattgaaattgaatatttcaaagaataagatcattgaatcacctgccggaatcgaaaaagactggatcgtaccggatattcattcttcagaaggaattagaagatttatttttgtaggtagatatgagaggagaaagggtgtagaagaactgacaaatgtcttaagcgaattggcggtgaataataattttgaatttacttttgttggggaaatgccggaaaagaaaaaaatatcacttcctggtattaaatattcaggaaggattaccgatagcgaagcgatgaaaagtgttttaaggaactccgatgtattggtgtgccccagttattcggagggtatgcctaacgttattctggaagcaatggcgtcagggttagtagtgattgcatcggatgtgggtgctgtaaatatgcttgtgtcaaaaaataatggctggttagtcaaggcaggaagcaagaaggaattaaagaccgctctttttgaggcacttcaaacttcggcaacgaagctctatggaatggggggtactcgaattttttgcgacagatttttatggaaaaatatcttatcaatctga

SEQ ID NO: 100 - protein, 254 aa, Unknown
  Obtained from environmental sample
  DOMAIN (82)...(242): Glycosyl transferases group 1
  misc_feature (1)..(254): Xaa is any amino acid
MDERRKGYKCAPVGVNFHGYEMFQKPASLRSRIEQLLLRKPVIFSIANADYVFSYGGGITDIILKLNISKNKIIESPAGIEKDWIVPDIHSSEGIRRFIFVGRYERRKGVEELTNVLSELAVNNNFEFTFVGEMPEKKKISLPGIKYSGRITDSEAMKSVLRNSDVLVCPSYSEGMPNVILEAMASGLVVIASDVGAVNMLVSKNNGWLVKAGSKKELKTALFEALQTSATKLYGMGGTRIFCDRFLWKNILSI

SEQ ID NO: 101 - DNA, 336 bp, Unknown
  Obtained from environmental sample
  misc_feature (1)..(336): n is a, c, g, or t
atgacccgctcctgccatgagaacggcatcaattccgcattctctatcaacgtcagtgcgagagcatcgcgcaaactgagaacgcccgtcggctctttcaaagtggtaatttctttttttgtggaaacaatgggaaaatcattcgtggcatttggagtgtgtgcgtccatgtgcttcggttgctctgggtgtggttttgtgacgcaaccgatcagtcccaacatcaaagttgtcgcaacacaaaccgagactctgcctagaaaatgtgacgtcataaaatcaatcaaacgaactacggacgaaggaaatgaattgggaaaaggaacggtgaaataa

SEQ ID NO: 102 - protein, 111 aa, Unknown
  Obtained from environmental sample
  misc_feature (1)..(111): Xaa is any amino acid
MTRSCHENGINSAFSINVSARASRKLRTPVGSFKVVISFFVETMGKSFVAFGVCASMCFGCSGCGFVTQPISPNIKVVATQTETLPRKCDVIKSIKRTTDEGNELGKGTVK

SEQ ID NO: 103 - DNA, 732 bp, Unknown
  Obtained from environmental sample
  misc_feature (1)..(732): n is a, c, g, or t
atggcgccaataaatatctcaggatcaaaccaagtatctcaaataataaacttttactacaatgaaaagaaacttaacaagaatgcaataatggtatttcgaatcatctcaattctttcagatccacagatcaaaaatctgaatataaaaatttcaggacacgtacttcttgcattggctaggatttatataagaaaattgaaatatgttttaaatgaatctaatgatctatattcagtatttttgccaaagcaaaaagaacatcataaaagaaatttgttgacaattcctaaaaacctttttgctttagaagtgccagaatcaaaattcgattttatggatgattatttatcaaaaaacgatataatcgatttgaatgaaaccactttagcagaaaatttcatgaatgaaaatgaattttttaatgaaattgaagtgggtagaaatgattcaataagcattaatattggtaatatcgaacctgaagaaagtattcaaaagagaaggaaaagggtaattgatgatgttattgaatatgatagtgagatttttaggaataaaataaggaataagaatctgcctaaacctaaaaaatataataccaattttttgtttgacgttaaattaccaagcgaaattattaacttttttaaaaatgttaaaagagaaagtatcgagtttgcaggaatgagacggcgattaaaacttgaaccaataataatatccaaataa

SEQ ID NO: 104 - protein, 243 aa, Unknown
  Obtained from environmental sample
  misc_feature (1)..(243): Xaa is any amino acid
MAPINISGSNQVSQIINFYYNEKKLNKNAIMVFRIISILSDPQIKNLNIKISGHVLLALARIYIRKLKYVLNESNDLYSVFLPKQKEHHKRNLLTIPKNLFALEVPESKFDFMDDYLSKNDIIDLNETTLAENFMNENEFFNEIEVGRNDSISINIGNIEPEESIQKRRKRVIDDVIEYDSEIFRNKIRNKNLPKPKKYNTNFLFDVKLPSEIINFFKNVKRESIEFAGMRRRLKLEPIIISK

SEQ ID NO: 105 - DNA, 372 bp, Unknown
  Obtained from environmental sample
  misc_feature (1)..(372): n is a, c, g, or t
atgagagatataaaagagctgaccaaggctgaggatcaggtcatgcaaatactatggaagctcgggaatgcattcgtgaaagacatcatcgaggtaatgcccgatccgaaacccgcatataatacggtgtcgaccatcattcgaattcttgaagcaaaaggatttgtggatcataaggcttatggtaaaacacatgaatactttccggtaatcagtaaggaaaagtataccaagttctatctcaataatctgttgaaagggtatttcaacggttccttccaaaatcttgtgtcctttttcgcgaaggaaaataagatggacatcaagtcgcttgagaagctgctggaggaaataaaaaatcagaagtcatga

SEQ ID NO: 106 - protein, 123 aa, Unknown
  Obtained from environmental sample
  DOMAIN (1)...(118): Penicillinase repressor
  misc_feature (1)..(123): Xaa is any amino acid
MRDIKELTKAEDQVMQILWKLGNAFVKDIIEVMPDPKPAYNTVSTIIRILEAKGFVDHKAYGKTHEYFPVISKEKYTKFYLNNLLKGYFNGSFQNLVSFFAKENKMDIKSLEKLLEEIKNQKS

SEQ ID NO: 107 - DNA, 339 bp, Unknown
  Obtained from environmental sample
  misc_feature (1)..(339): n is a, c, g, or t
atggaaagcgttagacagcaaaaggtgaataaactggttcaaaaagaacttgctgagatattcagaagcgaatcgaagaatctttttggaggagcatttattacagtgactcaaacaagagttagtccggatctcggccttgctaaagtgtatttaagtattatggctaccaaagaccgccaggctatttttaacctggtgcaggaagaaaaagcagctatccgtaagcgtttgggaaatttagtgggtaagcaattacgtgtagttcctgatctagtgtttttcattgatgattctttggattacgccatgaaaattgaagagcttctaaaaaaatag

SEQ ID NO: 108 - protein, 112 aa, Unknown
  Obtained from environmental sample
  DOMAIN (5)...(110): Ribosome-binding factor A
  misc_feature (1)..(112): Xaa is any amino acid
MESVRQQKVNKLVQKELAEIFRSESKNLFGGAFITVTQTRVSPDLGLAKVYLSIMATKDRQAIFNLVQEEKAAIRKRLGNLVGKQLRVVPDLVFFIDDSLDYAMKIEELLKK

SEQ ID NO: 109 - DNA, 630 bp, Unknown
  Obtained from environmental sample
  misc_feature (1)..(630): n is a, c, g, or t
gtggccaaacaggacgatattttttatacctgttcaatgcatccgcaagtaatatcggatatgcctggcaaatgtcctatttgcagtatgcctcttactctggttaaaaaaagcgctgttaagaatactgatgatattgagttaagcgaccagcaaattcaattagggaacattgtcgtggatactattcgaaaaggaagtatcggtaacgaaattgaattaacaggcactttaaatctcgacgcatcaaaaatcgcttcagtaagtgcaagagtaatgggaaggatcgaaaagttatttgtaaaaaccaccggggattacgtgacaaagggagcacctttatatgaaatctatagcgaagaattaaataataccaaacaggagtatatcgctgcactagaacggcgaatcttgttcaaggatcaatcacttattgattttgataatcttattgcaagtgcaagaacaaagcttcggttgtggggaatgacacaggcacaaatcaatgcattggaaaaactaaagcaagctccattaacaactactttttacagcacagaaactggctatgtcacttctcttggcgttattgaaggcngggtatgtaatggaaaggtggcacaattctga

SEQ ID NO: 110 - protein, 209 aa, Unknown
  Obtained from environmental sample
  misc_feature (1)..(209): Xaa is any amino acid
MAKQDDIFYTCSMHPQVISDMPGKCPICSMPLTLVKKSAVKNTDDIELSDQQIQLGNIVVDTIRKGSIGNEIELTGTLNLDASKIASVSARVMGRIEKLFVKTTGDYVTKGAPLYEIYSEELNNTKQEYIAALERRILFKDQSLIDFDNLIASARTKLRLWGMTQAQINALEKLKQAPLTTTFYSTETGYVTSLGVIEGXVCNGKVAQF

SEQ ID NO: 111 - DNA, 528 bp, Unknown
  Obtained from environmental sample
  misc_feature (1)..(528): n is a, c, g, or t
atgaacgtttaccctcacgataccgtagtgccttttaaaaattctacagaaagcaagaccaaacaggttgaaaatatgtttgataaaattgctttccgctatgattttttgaatcgttttttaagcgcaggtattgatgttggctggcgcaaaaaagccatcaaacaattactatcattacaaccccaaaaaatacttgatgtagctactggtacgggagattttgccatcaccggttatgaaatcctgaaacctgaaaaaattataggtatagatatcagtgatggaatgctcgacataggccggaaaaaaatattgaaagcaggcttgcaaaaccacattgagttgctgaatggcgatagcgaggcaattttatttgatgataattcgtttgatgcagttacagttgctttcggggtaagaaattttgagcatcttgaaaatggattatcagaaataaaaagagtattgaggcccggtggaaaattaattgtgctggaatgtacgaagccttcaatgccgggataa

SEQ ID NO: 112 - protein, 175 aa, Unknown
  Obtained from environmental sample
  DOMAIN (15)...(175): ubiE/COQ5 methyltransferase family
  misc_feature (1)..(175): Xaa is any amino acid
MNVYPHDTVVPFKNSTESKTKQVENMFDKIAFRYDFLNRFLSAGIDVGWRKKAIKQLLSLQPQKILDVATGTGDFAITGYEILKPEKIIGIDISDGMLDIGRKKILKAGLQNHIELLNGDSEAILFDDNSFDAVTVAFGVRNFEHLENGLSEIKRVLRPGGKLIVLECTKPSMPG

SEQ ID NO: 113 - DNA, 765 bp, Unknown
  Obtained from environmental sample
  misc_feature (1)..(765): n is a, c, g, or t
atggggaatatatgtatatgtaacgaaagattgattgtaggtgggttaaaaacctttgatgtagggtttgcgtctggccttgcgggaaagccgcatcctgatatttcactaatgagagtattattgttcatcagcggctcagcaaaacttatgccgtggaatagtagcaaatccgacataaatccctctcaggaagtatttcttgcaatccaaaactggctagtgcatgttgtcaaagattatgcatctctttcaaggagatttaacaaattagagggtggatggcccgaaaacgtatttaagtacaatagtggaagtattaaaaatgaaataatctctgacttccgtaccgccaatacatcttatctacctaaattgccagattctcaaccccgattgccagataaaataaaaaatgcgaataaagccgtggtacaaaccaaaccttgggcccgcggtctttacgagagcataatcgctgtagacttaatatccaagaaaaacctcgagcagaggaacagaatttgtctaattcttctcgatagcacactagaaatagcatttaaggaataccttgtgaatgaatcaggggtagcttacagcgatgatagattgcaaaaaatgttttctaacagaagtcttgttcaccaagaagttaagggacttgcattcaagaaaatttctacttcagattggatgactattgattattattataaaattaggtgtgatttgatccacagaaaagctaccacatcaatctga

SEQ ID NO: 114 - protein, 254 aa, Unknown
  Obtained from environmental sample
  misc_feature (1)..(254): Xaa is any amino acid
MGNICICNERLIVGGLKTFDVGFASGLAGKPHPDISLMRVLLFISGSAKLMPWNSSKSDINPSQEVFLAIQNWLVHVVKDYASLSRRFNKLEGGWPENVFKYNSGSIKNEIISDFRTANTSYLPKLPDSQPRLPDKIKNANKAVVQTKPWARGLYESIIAVDLISKKNLEQRNRICLILLDSTLEIAFKEYLVNESGVAYSDDRLQKMFSNRSLVHQEVKGLAFKKISTSDWMTIDYYYKIRCDLIHRKATTSI

SEQ ID NO: 115 - DNA, 351 bp, Unknown
  Obtained from environmental sample
  misc_feature (1)..(351): n is a, c, g, or t
ttgattgttttgattattatcaaaaaaattttaaaacaaaaattcaaaacatttcaacaggatttggttggaattgatgaagaacaaagaaaaagagaaataaaaggacaaaaccaatcaacacaacaacaactttattcattatcaaaagaaattggagaattaaatacacgttattcaaactttgaaaaatcaaaggaattatatcaacaatatgtgatagcaggtacaaaattattattatttattcattattttattttattattttattattttattattttattattttattattttattattttattattttattattttagtgaaaaaatttcaacaaattga

SEQ ID NO: 116 - protein, 116 aa, Unknown
  Obtained from environmental sample
  misc_feature (1)..(116): Xaa is any amino acid
MIVLIIIKKILKQKFKTFQQDLVGIDEEQRKREIKGQNQSTQQQLYSLSKEIGELNTRYSNFEKSKELYQQYVIAGTKLLLFIHYFILLFYYFIILLFYYFIILLFYYFSEKISTN

SEQ ID NO: 117 - DNA, 351 bp, Unknown; identical to SEQ ID NO: 115
  Obtained from environmental sample
  misc_feature (1)..(351): n is a, c, g, or t

SEQ ID NO: 118 - protein, 116 aa, Unknown; identical to SEQ ID NO: 116
  Obtained from environmental sample
  misc_feature (1)..(116): Xaa is any amino acid

SEQ ID NO: 119 - DNA, 429 bp, Unknown
  Obtained from environmental sample
  misc_feature (1)..(429): n is a, c, g, or t
atgataagagttggcctcctgagtgatacccatagttttattgacccaaaaatatttgaggtctttaaagaggttgatgaggtatggcatgccggtgatttaggaaccattgaattgtgtgatgaactcaaaaagtttaaacccttttatgccgtgcatggtaacattgatgggaaagatattcgcgcagattatcctctgaacctgtcgatagaaagagaagggtttagaattctaatgactcatataggtggttatcccggtagttatgagcctaaggcaagaagaaagattgaagagataaagccggatatctttatttgcggacactcgcatattcttaaagtgatgcgcgatcctaaatacaacaacatggtagtgatgaaccccggggctgctggcgttcagggttttcataaaataaaaacg

SEQ ID NO: 120 - protein, 143 aa, Unknown
  Obtained from environmental sample
  DOMAIN (2)...(114): Calcineurin-like phosphoesterase
  misc_feature (1)..(143): Xaa is any amino acid
MIRVGLLSDTHSFIDPKIFEVFKEVDEVWHAGDLGTIELCDELKKFKPFYAVHGNIDGKDIRADYPLNLSIEREGFRILMTHIGGYPGSYEPKARRKIEEIKPDIFICGHSHILKVMRDPKYNNMVVMNPGAAGVQGFHKIKT

SEQ ID NO: 121 - DNA, 690 bp, Unknown
  Obtained from environmental sample
  misc_feature (1)..(690): n is a, c, g, or t
gtgcgagctttttttcgggaaaagaaaggcatcagttttctcggtttttatattcaaggttcaagtaagcatcaaacaattataaggaggcaaaatgacacatgtgacgttgacctgggtacctatctagcgacgaaacccgagattatgccaacaacattgtttaaaaatgtagctgatcttttgactggacaaacgattgaaggcacagaaattaggaacaagtgtgttcgggttttttatgcaaataaatcacatattgacctaccactctattatcatgacaaggagcagagtaaattctttattgccgttgggtcaaacaatagctgggaggaagatgatccaaagctttttactgagtggctcaaaaaagagactgctgattcacagaaaataaggaccataaagtactttaaggcttggactgacaactataaaactgttcattctcgaaaaatgccgactgggctggcgttaactatttgggtattgggtcattttgagggcgatgcacgcgacgatctagcttttatcaagacagctcataaattgtatttagcgctcgcaaaacagtcattaaatgactgggagtgtaaaatgcccacaacgccctacgataaatgtattcgtaaattgaatgaggatcacagaaagaatttcctgatcgcggtaaaggaactattagta

SEQ ID NO: 122 - protein, 230 aa, Unknown
  Obtained from environmental sample
  misc_feature (1)..(230): Xaa is any amino acid
MRAFFREKKGISFLGFYIQGSSKHQTIIRRQNDTCDVDLGTYLATKPEIMPTTLFKNVADLLTGQTIEGTEIRNKCVRVFYANKSHIDLPLYYHDKEQSKFFIAVGSNNSWEEDDPKLFTEWLKKETADSQKIRTIKYFKAWTDNYKTVHSRKMPTGLALTIWVLGHFEGDARDDLAFIKTAHKLYLALAKQSLNDWECKMPTTPYDKCIRKLNEDHRKNFLIAVKELLV

SEQ ID NO: 123 - DNA, 624 bp, Unknown
  Obtained from environmental sample
  misc_feature (1)..(624): n is a, c, g, or t
ttgaatcctttcttttcgttcgacgattatttgactacaatgacattgtttctggagaaagagcaagaaaagcatacgcaatacattcatgatttattttggaaagtagaatcgggtcaaacagaaatgcagggtgaattggactatgcccgctatgaattagataaattccctgagtttgaaaatactttattcagttcttttttcgttatgatttactcttttatggaatcagaattactatggtattgccgagagttggccaatcgaagtccacaaagcatacttttgtcagatttaggtgccacaaatactattgagaaaactatgacttatttaattaaagttcaacacattgaattctcaaaaaaagataaccctgagtggggtaagatcagaatttttacctatttacgaaactgcattgttcataaccaaggtcgagtagataacttttttagtaaacaaaaagaattgctaaaattcattgaaaagaaggattccaaaataaaattggaaggtacaaaatgtatttttgataaggacttttgcttagatgcactaaacaccatcaaaagatttttggacatggtagcagctgcaaaaaagccaaatgtttcataa

SEQ ID NO: 124 - protein, 207 aa, Unknown
  Obtained from environmental sample
  misc_feature (1)..(207): Xaa is any amino acid
MNPFFSFDDYLTTMTLFLEKEQEKHTQYIHDLFWKVESGQTEMQGELDYARYELDKFPEFENTLFSSFFVMIYSFMESELLWYCRELANRSPQSILLSDLGATNTIEKTMTYLIKVQHIEFSKKDNPEWGKIRIFTYLRNCIVHNQGRVDNFFSKQKELLKFIEKKDSKIKLEGTKCIFDKDFCLDALNTIKRFLDMVAAAKKPNVS

SEQ ID NO: 125 - DNA, 525 bp, Unknown
  Obtained from environmental sample
  misc_feature (1)..(525): n is a, c, g, or t
ttgaaagtagaatcgggtcaaacagaaatgcagggtgaattggactatgcccgctatgaattagataaattccctgagtttgaaaatactttattcagttcttttttcgttatgatttactcttttatggaatcagaattactatggtattgccgagagttggccaatcgaagtccacaaagcatacttttgtcagatttaggtgccacaaatactattgagaaaactatgacttatttaattaaagttcaacacattgaattctcaaaaaaagataaccctgagtggggtaagatcagaatttttacctatttacgaaactgcattgttcataaccaaggtcgagtagataacttttttagtaaacaaaaagaattgctaaaattcattgaaaagaaggattccaaaataaaattggaaggtacaaaatgtatttttgataaggacttttgcttagatgcactaaacaccatcaaaagatttttggacatggtagcagctgcaaaaaagccaaatgtttcataa

SEQ ID NO: 126 - protein, 174 aa, Unknown
  Obtained from environmental sample
  misc_feature (1)..(174): Xaa is any amino acid
MKVESGQTEMQGELDYARYELDKFPEFENTLFSSFFVMIYSFMESELLWYCRELANRSPQSILLSDLGATNTIEKTMTYLIKVQHIEFSKKDNPEWGKIRIFTYLRNCIVHNQGRVDNFFSKQKELLKFIEKKDSKIKLEGTKCIFDKDFCLDALNTIKRFLDMVAAAKKPNVS

SEQ ID NO: 127 - DNA, 324 bp, Unknown
  Obtained from environmental sample
  misc_feature (1)..(324): n is a, c, g, or t
gtgcttattattgatatggtaactgttccggtgaagaagaaagagatcccccgttttctggttcacaaagtgaaacagttctcacaaaaattttcaaataaggagtttaacaacaatctgaagaatttggtaaatgatcccgactggaaatatatgcttcaatataatcccatcagggcagaacatgaaatgaaatggtatctggaaagtcgttttccgggtaagaaggtggataagatcaatataggctaccattcatgtatgctggcttttgattcgggcaatatcgaaaatatgaacgatatttatttaacttatccataa

SEQ ID NO: 128 - protein, 107 aa, Unknown
  Obtained from environmental sample
  misc_feature (1)..(107): Xaa is any amino acid
MLIIDMVTVPVKKKEIPRFLVHKVKQFSQKFSNKEFNNNLKNLVNDPDWKYMLQYNPIRAEHEMKWYLESRFPGKKVDKINIGYHSCMLAFDSGNIENMNDIYLTYP

SEQ ID NO: 129 - DNA, 411 bp, Unknown
  Obtained from environmental sample
  misc_feature (1)..(411): n is a, c, g, or t
atggaaaaatttctgatcgcaggtctgggaaacattggcgaagaataccaggatacccgacacaacattgggttcaatgttgccgatgcagttgctaaatctttgcagaaagaagatgacaaaactcctgtatcccggttatttacttccgaccgttatgccaatgttcaccaggcacgattcaaaggaaacaagcttaccatcatcaaacctacgacgtatatgaacctgagcggtaaagcagtgaacttctggcttcaggaagaaaaaattccttttaaaaatttattgatcattaccgatgaccttgcacttcctttcggcacactcaggcttaaaaagaagggaagtgacggaggacacaatggtctcacagatatcattgcaaccctgaacaccagtgaatttgca

SEQ ID NO: 130 - protein, 137 aa, Unknown
  Obtained from environmental sample
  DOMAIN (5)...(137): Peptidyl-tRNA hydrolase
  misc_feature (1)..(137): Xaa is any amino acid
MEKFLIAGLGNIGEEYQDTRHNIGFNVADAVAKSLQKEDDKTPVSRLFTSDRYANVHQARFKGNKLTIIKPTTYMNLSGKAVNFWLQEEKIPFKNLLIITDDLALPFGTLRLKKKGSDGGHNGLTDIIATLNTSEFA

SEQ ID NO: 131 - DNA, 441 bp, Unknown
  Obtained from environmental sample
  misc_feature (1)..(441): n is a, c, g, or t
ttgggcatagtggaaagggccaaagacattctcacagataaaaacactttccattctttatttggagaacctggaaaatatagcaaggatgagtatgtggcccaccttgatgaaaacgggaaggctcattatgtaaacacggttatgcaatctttgggggatattagtgatcctaatatcaggcgagaagcaatagcatctgatgtaaatgatatggtttgttccgcaaaacagaggcttgaatggtgtaagcatgttcagattattcaagaccttcggcatacgaaatcgctggaaactttttacaagcagataccgcaaaagaggatactctgcgcagaacttggatatcaatctcctgaagctggaaattcattcgaacagctatggccattttttaagggaatctattgtttaggttgtgtgaaaagaaagctgtga

SEQ ID NO: 132 - protein, 146 aa, Unknown
  Obtained from environmental sample
  misc_feature (1)..(146): Xaa is any amino acid
MGIVERAKDILTDKNTFHSLFGEPGKYSKDEYVAHLDENGKAHYVNTVMQSLGDISDPNIRREAIASDVNDMVCSAKQRLEWCKHVQIIQDLRHTKSLETFYKQIPQKRILCAELGYQSPEAGNSFEQLWPFFKGIYCLGCVKRKL

SEQ ID NO: 133 - DNA, 489 bp, Unknown
  Obtained from environmental sample
  misc_feature (1)..(489): n is a, c, g, or t
gtgaaaagtattagtggttgcaatagctcatacagaagaagtgatcttctgaaaattggaaattttaatccaaacctttcttttaatgaggatacggagttaaataaacgcttaactagtattggcaaaattttttatacttcagatgcaagggttcatcactatcaggatcgtggattaaaagatttctctaaaagaatttttttgtttggcaaaggtagggcgattaataagttaccagatttacagatcgtgcctccaattatcgctttattaagtttcctacttttgttcatatctttaaaagcatttttacttatgctaattctttatacttcacttttattaacatttgatatattgattttcttcaaacaccagaagctactttacttattttcaattcccgtcgtattcattttagaacatttatcttatacacttggtttttggagaggcattgcaaaaatatctggagtgtttaaatga

SEQ ID NO: 134 - protein, 162 aa, Unknown
  Obtained from environmental sample
  misc_feature (1)..(162): Xaa is any amino acid
MKSISGCNSSYRRSDLLKIGNFNPNLSFNEDTELNKRLTSIGKIFYTSDARVHHYQDRGLKDFSKRIFLFGKGRAINKLPDLQIVPPIIALLSFLLLFISLKAFLLMLILYTSLLLTFDILIFFKHQKLLYLFSIPVVFILEHLSYTLGFWRGIAKISGVFK

SEQ ID NO: 135 - DNA, 384 bp, Unknown
  Obtained from environmental sample
  misc_feature (1)..(384): n is a, c, g, or t
atggcaaaacaggtagaagactttgattcgaacctggcgggcgaagaaggaaaagaatcgacaaggacgagttggtttaaaaggattagaaaaggaattctaacgggtacccatgaaaaaaaggaaacgccggaaggactttggaccaaatgccctgaatgcaattttatctgtacatcaaatgagctaaaggaaaatctgtttgtttgccctaaatgcaactaccaccaccgtatcggcagcgaggaatattattcaattctctttgatgacaaccagtatacggagttgttcgataacattcgaagcaaggattatcttgaatttaccgatctgaaaccttataaanaaggcttgaagagacctggaataaaaccgatctga

SEQ ID NO: 136 - protein, 127 aa, Unknown
  Obtained from environmental sample
  misc_feature (1)..(127): Xaa is any amino acid
MAKQVEDFDSNLAGEEGKESTRTSWFKRIRKGILTGTHEKKETPEGLWTKCPECNFICTSNELKENLFVCPKCNYHHRIGSEEYYSILFDDNQYTELFDNIRSKDYLEFTDLKPYKXGLKRPGIKPI

SEQ ID NO: 137 - DNA, 717 bp, Unknown
  Obtained from environmental sample
  misc_feature (1)..(717): n is a, c, g, or t
atggagtttgggatgatattttggaacatttttagttcacttctttcagagcaaaatatttctcatcagggcattattgaagatgaatcgagaccaacaacagccaagacacgtgttatctcagacaatcagcacatagtaagaattgataaggaaagtaaagaaacaattaatcagaatattcagaataaaatatttgagtatataaaaagcatcataaaaaatattgatggaataattcttcaggattacaataaaggagttttatcttcttcacttatcgcgcaggttattgagttagcaaataaaaataaaaaacttgttacagtggatcctaaattcaataatttttacgagtacaaaaatgtaacagtatttaaaccgaacaggaaagaagcagaagatatacttggcatgaaaattagaaccgatgaagatatatcttttgcaggaaacactcttcttaaaaaacttaatgctaaaaatattttactaacacttggtgaaggcggaatagcagtttttgaaaaaggcaaacctgaaaaacgaatgcctactaaagcaagaaaagtggcagatgtttcaggggctggcgatacggtcatttctactttaactatggcgcttgcagcaggagcaaatatttatgaagcttcatttcttgccaattatgccggcggtttagtttgtgaggaagtaggaattgttccgatttga

SEQ ID NO: 138 - protein, 238 aa, Unknown
  Obtained from environmental sample
  misc_feature (1)..(238): Xaa is any amino acid
MEFGMIFWNIFSSLLSEQNISHQGIIEDESRPTTAKTRVISDNQHIVRIDKESKETINQNIQNKIFEYIKSIIKNIDGIILQDYNKGVLSSSLIAQVIELANKNKKLVTVDPKFNNFYEYKNVTVFKPNRKEAEDILGMKIRTDEDISFAGNTLLKKLNAKNILLTLGEGGIAVFEKGKPEKRMPTKARKVADVSGAGDTVISTLTMALAAGANIYEASFLANYAGGLVCEEVGIVPI

SEQ ID NO: 139 - DNA, 615 bp, Unknown
  Obtained from environmental sample
  misc_feature (1)..(615): n is a, c, g, or t
atggattcgaccataaataatacaaatgtaaaatcaaatccattagatgaaactggatttaaattattaagtttcgaaaacggtaaaacaaaatttgtagcgcaagggataaatgatgtagatagaacatatttttcatttcatgagttacaatattctagatggataaattttgtagaattaaccgaaaaaactatttcaaaattattagaaatccaaaatcaaatatttgttacaggaataagtttaacatatgttgacgagttccagtggaaagacaattctaaaattgattttgagaaaattataaatgctgagtcagaatatttaccaaaaaactttactgtaattagtgaggggcaattagttaatacacgtgaacttaaaaacgatattgataagcagtttgatagattagaaattactgttcgatcttcaattactaaaaatattacactaaatcataatcaaaccattttatttaaaaatcctttagaactaccaaacgatttagaattaataaaaaaagaattgactatgttacatgaatccaataaagagtttttacgtaaaacacttaaaaaagaggttttagaattaattgaattaaaataa

SEQ ID NO: 140 - protein, 204 aa, Unknown
  Obtained from environmental sample
  misc_feature (1)..(204): Xaa is any amino acid
MDSTINNTNVKSNPLDETGFKLLSFENGKTKFVAQGINDVDRTYFSFHELQYSRWINFVELTEKTISKLLEIQNQIFVTGISLTYVDEFQWKDNSKIDFEKIINAESEYLPKNFTVISEGQLVNTRELKNDIDKQFDRLEITVRSSITKNITLNHNQTILFKNPLELPNDLELIKKELTMLHESNKEFLRKTLKKEVLELIELK

SEQ ID NO: 141 - DNA, 399 bp, Unknown
  Obtained from environmental sample
  misc_feature (1)..(399): n is a, c, g, or t
atgtggaaactttatactaaaaacatgcccgaaggcatcgcaattcaaactacttataacaggctttacaaagcactcaaaagaaatccatcaattagcattggcagaataaattacatcgactacaataataggtttgcaggtgttaatgaatctttttggttcaaaagaaaatcctttgaacacgaaagggaaatcagagctatttataaggactttagtagtgatttggactatggtaaagcaattgaagtaaatgtaaatctactcattcaaaatatttttgtgtctccgacagcacaaggctggtttatagaccttgtaaagcagacattaaaaaaatatggcgtaaacaagaatgtaaaaagttcaagtatgctgaccgaaccatttcattga

SEQ ID NO: 142 - protein, 132 aa, Unknown
  Obtained from environmental sample
  misc_feature (1)..(132): Xaa is any amino acid
MWKLYTKNMPEGIAIQTTYNRLYKALKRNPSISIGRINYIDYNNRFAGVNESFWFKRKSFEHEREIRAIYKDFSSDLDYGKAIEVNVNLLIQNIFVSPTAQGWFIDLVKQTLKKYGVNKNVKSSSMLTEPFH

SEQ ID NO: 143 - DNA, 363 bp, Unknown
  Obtained from environmental sample
  misc_feature (1)..(363): n is a, c, g, or t
gtgtggagccatagcaagagcacgccttacgttccgactccgctatgnacagacggacttttatatttcgtcgcgagtaacaatgggattctttcctgttttgatgccaaaacaggcaagcctaactttagtgaagaacgcgttggagatattcgcggcatctacgcttcgccggtcgcgaccaaagatcgcgtttatgttttaggccgtgaaggtaaatgcgcggtgctgaaaaaaggctcaaagtttgaaattcttgccacaaacagcctagatgacaaaaccgatagctcgattgccattgtcggaaacgatctttttattcgcggtcaccagaatctttattgcattggtgaaaaataa

SEQ ID NO: 144 - protein, 120 aa, Unknown
  Obtained from environmental sample
  misc_feature (1)..(120): Xaa is any amino acid
MWSHSKSTPYVPTPLXTDGLLYFVASNNGILSCFDAKTGKPNFSEERVGDIRGIYASPVATKDRVYVLGREGKCAVLKKGSKFEILATNSLDDKTDSSIAIVGNDLFIRGHQNLYCIGEK

SEQ ID NO: 145 - DNA, 621 bp, Unknown
  Obtained from environmental sample
  misc_feature (1)..(621): n is a, c, g, or t
gtgattgagggtttctactcttgtctgaagtgtatgggtgggttatcttgcaggctcaacaaaaaacttttcattatggcaacactatcaaagatggtcattgaaagcattgcaagtaaaatgactgataaaagcaggattcattgtgagtctctgttaaaggaatataaagagatcgtgactaatctttatgagcagcaaatcccagacgaaataaaaaagagtttcaaaaacaacccggactacataaaaacaacatcaaccatttttttagatagccacgggttgagtagagaaagcgttaatctttcaaagcgattaccagctactgatggatacaatcatgaaatgaaacttacagctcagacagccgataagattatcaaggctaaacgaaaatatgagaaggctaaggatgattacaaaactcttgtgaatgaaactgagtcagccttatacgcgctcaaaaccgcaaagaacatcagagaaaacttacccgaagctatcccataccttccgccaccaatgtcaaatagcctcgttgtaaatttcgcatcgcttcaaagaaaattaaacaaacaacctactgcgaaaaagaagccgatcataatcggnccctaa

SEQ ID NO: 146 - protein, 206 aa, Unknown
  Obtained from environmental sample
  misc_feature (1)..(206): Xaa is any amino acid
MIEGFYSCLKCMGGLSCRLNKKLFIMATLSKMVIESIASKMTDKSRIHCESLLKEYKEIVTNLYEQQIPDEIKKSFKNNPDYIKTTSTIFLDSHGLSRESVNLSKRLPATDGYNHEMKLTAQTADKIIKAKRKYEKAKDDYKTLVNETESALYALKTAKNIRENLPEAIPYLPPPMSNSLVVNFASLQRKLNKQPTAKKKPIIIGP

SEQ ID NO: 147 - DNA, 534 bp, Unknown
  Obtained from environmental sample
  misc_feature (1)..(534): n is a, c, g, or t
gtgaaaccaatatattctaatgataggaaggctccgaggatgagaaagggaaagttctctaaaatgataataactagagagttatggaagaaatttattgcagaatttccagagtataaggaaatgagctggaaggatttctataataattggttagatatagcacagactattagacaagagacagtgaataatcctctaggtgttaaattgggtagctatacaggagaattaaagcttcagtatttacctcacaagtttaaggcagaagatgcagtaacatctggagagttaggagagaaaataaatttcttgaatatacctatgaagggtaaagttgctaaagtaaagtgggaaagaagatgggctgtcaagttcaataaaatactacagttctatgcctttgatgagacgagagagattaatcagatggcaaaggagtatattgataaatattctgataaattgagaatctctaggaatacattaggaggcccttctatttggagacaaaaaatgaaaaagaatgactaa

SEQ ID NO: 148 - protein, 177 aa, Unknown
  Obtained from environmental sample
  misc_feature (1)..(177): Xaa is any amino acid
MKPIYSNDRKAPRMRKGKFSKMIITRELWKKFIAEFPEYKEMSWKDFYNNWLDIAQTIRQETVNNPLGVKLGSYTGELKLQYLPHKFKAEDAVTSGELGEKINFLNIPMKGKVAKVKWERRWAVKFNKILQFYAFDETREINQMAKEYIDKYSDKLRISRNTLGGPSIWRQKMKKND

SEQ ID NO: 149 - DNA, 378 bp, Unknown
  Obtained from environmental sample
  misc_feature (1)..(378): n is a, c, g, or t
ttgataagaatcacaataccatcgaagtcaatttttgatgccaccattgaatttggatctaagacgacccaatacgtgaacctgctgaagtttgcagtccgcaggaaatacgggaacgaggccacgcaaagcatactgatcggcgcaggcggtgagatcaacaaccagacctatctcagccggatcatcgacaacatgaacgaaatcctgaaggtggaggctgaccaaaagctcgacaggaaggaccttttcaccttcatcggtcagggaaagtaccggctcaggattattccggagaatatcaaaattgacgaagcactgctgaaggaatttgtgtcttcgcctggaaatcaagagtataagtcaattgtaacttag

SEQ ID NO: 150 - protein, 125 aa, Unknown
  Obtained from environmental sample
  misc_feature (1)..(125): Xaa is any amino acid
MIRITIPSKSIFDATIEFGSKTTQYVNLLKFAVRRKYGNEATQSILIGAGGEINNQTYLSRIIDNMNEILKVEADQKLDRKDLFTFIGQGKYRLRIIPENIKIDEALLKEFVSSPGNQEYKSIVT

SEQ ID NO: 151 - DNA, 621 bp, Unknown
  Obtained from environmental sample
  misc_feature (1)..(621): n is a, c, g, or t
atgcctaccttcattacgggtgagcaggagctggattcattcatgcaggataatattgtacttcctatggatcttagtggcttacaatatgaaatcgaaatgtcgttcgacgttgacacaagtggaactgttaagaatgcaaaaattgaagattatcaactgtcaggagttagtattgcagaaaaaaaatctgattttgtaaaaggaatgcaaatgatgctgaacagggaagcaatgcgtgttatatatttttccagcggtttatggatccccgtaatacaagagaatacaaaagttgcaggcagaagaaaaataaaagtaaaatttgatacgaatcagtttggcaaaaacaacatatcaacttttaaagtacgcaatcatgaagacccaagtcgatattataataacggagttaaaaagctgcaacaaaagaaacccattttagcagttaagtatcttgaagaatcgatccgcttaaaagaagatgttgattcatactttaatcttgggattgcctatatgaaaatccagaattcattattagcatgtaaaaactgggaaaaggctcaaaaaatgggcgatacagaagtgcaatcattaattagtaaatactgtaaataa

SEQ ID NO: 152 - protein, 206 aa, Unknown
  Obtained from environmental sample
  misc_feature (1)..(206): Xaa is any amino acid
MPTFITGEQELDSFMQDNIVLPMDLSGLQYEIEMSFDVDTSGTVKNAKIEDYQLSGVSIAEKKSDFVKGMQMMLNREAMRVIYFSSGLWIPVIQENTKVAGRRKIKVKFDTNQFGKNNISTFKVRNHEDPSRYYNNGVKKLQQKKPILAVKYLEESIRLKEDVDSYFNLGIAYMKIQNSLLACKNWEKAQKMGDTEVQSLISKYCK

SEQ ID NO: 153 - DNA, 804 bp, Unknown
  Obtained from environmental sample
  misc_feature (1)..(804): n is a, c, g, or t
atgataaagacaatanagagtttagccagatgtataatcgctttcggcatcctgaatgcgtatatagggttacgctatgctaataagcataatattccttttgtgtattatcttttagatcatctacactgtcttttacctggcaaattggctcaaaaaatcgcaaaaagatttgaaaaaagtaatatccgatgtgccgataaaattttcgtacttaatcagggactgaaagattacgttggagaaatgggagggaacctgagtaaagtatatgttcttccttctggagttgatcttgacaagttcaatttacagatagatggttcaataatccgaaaaagatacggtataaaaaaggacgatacactactatttttcatgggctggatttacgaattttcaggcatgaaagaagtaactgaaagtcttgctaattttgaaagcgggtctataaagctaatgattgttggcgatggcgatctctatgatactctatgcaaaatgagtactgaagaaaatcttaagaataaattaatcctcaccgggaaagtgccttttgagcagattccatcatttattgctgctgctgatatatgccttttgccagcttataagaatgaaatcatgatgaatattgtaccaattaagttatatgaatatatggctatgggaaaaccagtaatagccacaaatcttcctggaatnaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 154 - protein, 268 aa, Unknown
  Obtained from environmental sample
  SIGNAL (1)...(20)
  DOMAIN (108)...(262): Glycosyl transferases group 1
  misc_feature (1)..(268): Xaa is any amino acid
MIKTIXSLARCIIAFGILNAYIGLRYANKHNIPFVYYLLDHLHCLLPGKLAQKIAKRFEKSNIRCADKIFVLNQGLKDYVGEMGGNLSKVYVLPSGVDLDKFNLQIDGSIIRKRYGIKKDDTLLFFMGWIYEFSGMKEVTESLANFESGSIKLMIVGDGDLYDTLCKMSTEENLKNKLILTGKVPFEQIPSFIAAADICLLPAYKNEIMMNIVPIKLYEYMAMGKPVIATNLPGXKXXXXXXXXXXXXXXXXXXXXXXXXXXXXXXXX

SEQ ID NO: 155 - DNA, 633 bp, Unknown
  Obtained from environmental sample
  misc_feature (1)..(633): n is a, c, g, or t
ttgcgctatgctaataagcataatattccttttgtgtattatcttttagatcatctacactgtcttttacctggcaaattggctcaaaaaatcgcaaaaagatttgaaaaaagtaatatccgatgtgccgataaaattttcgtacttaatcagggactgaaagattacgttggagaaatgggagggaacctgagtaaagtatatgttcttccttctggagttgatcttgacaagttcaatttacagatagatggttcaataatccgaaaaagatacggtataaaaaaggacgatacactactatttttcatgggctggatttacgaattttcaggcatgaaagaagtaactgaaagtcttgctaattttgaaagcgggtctataaagctaatgattgttggcgatggcgatctctatgatactctatgcaaaatgagtactgaagaaaatcttaagaataaattaatcctcaccgggaaagtgccttttgagcagattccatcatttattgctgctgctgatatatgccttttgccagcttataagaatgaaatcatgatgaatattgtaccaattaagttatatgaatatatggctatgggaaaaccgagtaatagccacaaatcttcctga

SEQ ID NO: 156 - protein, 210 aa, Unknown
  Obtained from environmental sample
  misc_feature (1)..(210): Xaa is any amino acid
MRYANKHNIPFVYYLLDHLHCLLPGKLAQKIAKRFEKSNIRCADKIFVLNQGLKDYVGEMGGNLSKVYVLPSGVDLDKFNLQIDGSIIRKRYGIKKDDTLLFFMGWIYEFSGMKEVTESLANFESGSIKLMIVGDGDLYDTLCKMSTEENLKNKLILTGKVPFEQIPSFIAAADICLLPAYKNEIMMNIVPIKLYEYMAMGKPSNSHKSS

SEQ ID NO: 157 - DNA, 558 bp, Unknown
  Obtained from environmental sample
  misc_feature (1)..(558): n is a, c, g, or t
atgggacaaactgcattctntaaaaaattctttgagagaattacaaaaggtgttttagcaaatgtgctaagagaaataccaatgacatacaagaagcacagacgagaactattagctaataaaaacagtaattggaatttgcagattttggatgaattggttaagaaggataaaaacagcagaattcaccctgatgaacaggcattgcttctatactttacaaatagtgtctgtttcagtttatcaaaaggttttcaaaaacaattcaacagcctgaatcacccatatttaacagcatataaaaatcattgtaagccagttattggaattgatgaagcaactgacttttcaattattgaccttttggcaattaatagctttagacatcctgaattatcatctgtaacgctttctggtgacattatgcaaaggatgaccaatgacggcttaacttcttgggaagacttttcaagtgttgtttcaggaacagaaagaaaagatttagaagtgtcatatcgccaaagtcctactctactttccttagcacaatctatatag

SEQ ID NO: 158 - protein, 185 aa, Unknown
  Obtained from environmental sample
  misc_feature (1)..(185): Xaa is any amino acid
MGQTAFXKKFFERITKGVLANVLREIPMTYKKHRRELLANKNSNWNLQILDELVKKDKNSRIHPDEQALLLYFTNSVCFSLSKGFQKQFNSLNHPYLTAYKNHCKPVIGIDEATDFSIIDLLAINSFRHPELSSVTLSGDIMQRMTNDGLTSWEDFSSVVSGTERKDLEVSYRQSPTLLSLAQSI

SEQ ID NO: 159 - DNA, 780 bp, Unknown
  Obtained from environmental sample
  misc_feature (1)..(780): n is a, c, g, or t
ttgatatcggcatttatgggagtacataaaggcatcctgaaaattaagggaaacaccctggtgctgcaattaagtaaagaagacggtttacaggaaaatgaattcaataccaattcttttgcccggtcggttgatggcgaattattttttggtggagtaaatggcatcagtagcttttatcccgtctcgatcagcacaaacccggagaaactaaagttattgtttactggcatccgcgcaaatggtgaagatgctgttcctggtacagcagcctgggaagttcaatcgatcaacctcccttattttaaaaactctctgtcgtttgattttattgccatgggaaattacaatgttgaccaatacatttatcaatataaaatggaaggggtagataatgaatggatacagcaaaatggcttgcagacggtcaggtacagtttacctccggggaaatacacgttcaaaatatatgcatcacgatcttacgatgacgatgcaaacccaataaaagaaatcaggataactatccgcaatcctttctggaaaagcgggtggttccttttcctcgttttactggcatttatatcattgcttgcttattttatcaaccagaagatcaaaaaaaaatacgcaaaaaaattacagcaactggaaaatgaacgtncacttnnaacagagcgcgaacgtatctccaaagaccttcacgacagtttagggggttacgccaatgcggtcatttataaatctgaactcctggaaaagaaaccngtgaagaaaaaa

SEQ ID NO: 160 - protein, 260 aa, Unknown
  Obtained from environmental sample
  DOMAIN (123)...(160): Two component regulator three Y motif
  misc_feature (1)..(260): Xaa is any amino acid
MISAFMGVHKGILKIKGNTLVLQLSKEDGLQENEFNTNSFARSVDGELFFGGVNGISSFYPVSISTNPEKLKLLFTGIRANGEDAVPGTAAWEVQSINLPYFKNSLSFDFIAMGNYNVDQYIYQYKMEGVDNEWIQQNGLQTVRYSLPPGKYTFKIYASRSYDDDANPIKEIRITIRNPFWKSGWFLFLVLLAFISLLAYFINQKIKKKYAKKLQQLENERXLXTERERISKDLHDSLGGYANAVIYKSELLEKKPVKKK

SEQ ID NO: 161 - DNA, 417 bp, Unknown
  Obtained from environmental sample
  misc_feature (1)..(417): n is a, c, g, or t
ttggaaaatacaacgaatgtcaaatcaggacattcaaaaatgaatcgagaagaatttttgagattaattgaaattaaaaataatgactttcgaaataattttgaacgtttattaattgcaacgttagctattgtaactgcaattattttaagcgatgcgtttgtggtaacatttgcatacgtatttgcagattctgtgttacatacaatatatgtgattgtaattacattgattgggttttggattgtgatcatcttaggatatatcgaagataaatatgaagaagatacatattattttttaaaacaaaatgcaaaaaattatccattgacaaaaaaaaagctattttgttttgctcgaaagttaaattatatttatttttttttttggagtaaaagaagaagaaaaataaaataa

SEQ ID NO: 162 - protein, 138 aa, Unknown
  Obtained from environmental sample
  misc_feature (1)..(138): Xaa is any amino acid
MENTTNVKSGHSKMNREEFLRLIEIKNNDFRNNFERLLIATLAIVTAIILSDAFVVTFAYVFADSVLHTIYVIVITLIGFWIVIILGYIEDKYEEDTYYFLKQNAKNYPLTKKKLFCFARKLNYIYFFFWSKRRRKIK

SEQ ID NO: 163 - DNA, 450 bp, Unknown
  Obtained from environmental sample
  misc_feature (1)..(450): n is a, c, g, or t
gtgcaaataaatagattaattgttttacttctgattatgatttcacataaaaatttcgctgaaaacaaactgctctatttgcagccaatgcaagatgcaaagtatgtgaatttaaaagacaacatcattattggatttgagaaaccgcttaatgctgataaacaggatgttcaaaaatgcattgaggttattggaacaaaaagcggaattcatactggcgaaataaagtttgcagtcagcagcattattatttttaatccgcatacttcctttgcttatgatgaagaaatatatataanaatttcgggaattgtatgcagagaaaatcgaacgaagtcatttcagtatagattcactacttcaaagagaaaagttaactatgattaccggaagaatggagaagcagaatttccaggcttacccgatcaaccgtttctccccctgtactga

SEQ ID NO: 164 - protein, 149 aa, Unknown
  Obtained from environmental sample
  SIGNAL (1)...(20)
  misc_feature (1)..(149): Xaa is any amino acid
MQINRLIVLLLIMISHKNFAENKLLYLQPMQDAKYVNLKDNIIIGFEKPLNADKQDVQKCIEVIGTKSGIHTGEIKFAVSSIIIFNPHTSFAYDEEIYIXISGIVCRENRTKSFQYRFTTSKRKVNYDYRKNGEAEFPGLPDQPFLPLY

SEQ ID NO: 165 - DNA, 333 bp, Unknown
  Obtained from environmental sample
  misc_feature (1)..(333): n is a, c, g, or t
atggaatccaataacaggaaagaaaaaactaaggcgtatcacctgaaacgattgcttaattataaagcgatcgttaaacaaattcccttctttttgtttttggcatttctggcagtgatctacatctataacggacacatggcggataaaaccatccgcagcattactaaaaccagcaacgagttaaaagaattacagttcgaatataaggatgtacagggggatgtattgaaaagaagcaagcaaagtgaattgatccaggcggtagagccactgggattgaaagaattaacgacaccgccggttgtattgattgatagcacaaagtattga

SEQ ID NO: 166 - protein, 110 aa, Unknown
  Obtained from environmental sample
  misc_feature (1)..(110): Xaa is any amino acid
MESNNRKEKTKAYHLKRLLNYKAIVKQIPFFLFLAFLAVIYIYNGHMADKTIRSITKTSNELKELQFEYKDVQGDVLKRSKQSELIQAVEPLGLKELTTPPVVLIDSTKY

SEQ ID NO: 167 - DNA, 756 bp, Unknown
  Obtained from environmental sample
  misc_feature (1)..(756): n is a, c, g, or t
ttggttattcttacaagggacttccgcatcaaaagtgccaacaagtctttttacgaaaaatgcaatgagtcagaaggtggaatagcagggaaaatgttttttgaattaggaaatggcaaatgggatgtttcaggcctgcgtcaaaacctgcaaaaaattctgccggaccaatcattttttgaaaagcttgaaatgaaagttgtgcttccctctgttggagagcgggtatttgaattaaatgcgcggcagttactcaatgagaatagtaatgagcaattaatcctactcgctatccaggacgttactgaccgtaaaatatttgaacaggaattggagcgtcaggtgatagaacgaacaaaagaattaaaagaagcgaacctcagccttcagcattccaatgaaaacctccagcaatttgcatctattgcgtctcacgacctacaggaacccctccgtaagatcaaaacgtttaccgcgatgttaaatcgtcaatttgctactcatatagaagacgagggcaaagagatcatcaataaaataaagttgtctgctgaccgtatgtctgaattgatcaaagctgttttgagatattcaaaaattgttcatgctgaaaaagaatacctggtcaccaacctggatgaggttttaaaaaatgtggtggatgatcttgatctgctcatatcagaaaacgaaagcgaactggtttataaggaaccgctgcctcaaatagatgcaattcctctgcagatgaacaaa

SEQ ID NO: 168 - protein, 252 aa, Unknown
  Obtained from environmental sample
  DOMAIN (135)...(203): His Kinase A (phosphoacceptor) domain
  misc_feature (1)..(252): Xaa is any amino acid
MVILTRDFRIKSANKSFYEKCNESEGGIAGKMFFELGNGKWDVSGLRQNLQKILPDQSFFEKLEMKVVLPSVGERVFELNARQLLNENSNEQLILLAIQDVTDRKIFEQELERQVIERTKELKEANLSLQHSNENLQQFASIASHDLQEPLRKIKTFTAMLNRQFATHIEDEGKEIINKIKLSADRMSELIKAVLRYSKIVHAEKEYLVTNLDEVLKNVVDDLDLLISENESELVYKEPLPQIDAIPLQMNK

SEQ ID NO: 169 - DNA, 465 bp, Unknown
  Obtained from environmental sample
  misc_feature (1)..(465): n is a, c, g, or t
atgatgatcttttttttatatcgtaaaccacataaggctttctttggtcagaaagacgctcagcaggcttcggtaattaccaggatggttaaggatttaaaatatgatcttgatattgaaatttgtcctattataagggaacctgatggtttagcaatgagcagcagaaatatttttctgaatcctttacaaagagagaaagcagcgataatatacaggtctttgttgacagccaaggaacttattaattctggagaacgtgattcttatactgttataaaagctgtgaacaatcattttcttaaggagacctcagttcatctgaattatataagaattgttgagaaggaaagttttattgagcctaaaactctcgaagatggtaaacagtattatataattattgcctgtaagattggtacaactcgtttattagacaacctattggtgatacctgccatttaa

SEQ ID NO: 170 - protein, 154 aa, Unknown
  Obtained from environmental sample
  DOMAIN (1)...(150): Pantoate-beta-alanine ligase
  misc_feature (1)..(154): Xaa is any amino acid
MMIFFLYRKPHKAFFGQKDAQQASVITRMVKDLKYDLDIEICPIIREPDGLAMSSRNIFLNPLQREKAAIIYRSLLTAKELINSGERDSYTVIKAVNNHFLKETSVHLNYIRIVEKESFIEPKTLEDGKQYYIIIACKIGTTRLLDNLLVIPAI

SEQ ID NO: 171 - DNA, 564 bp, Unknown
  Obtained from environmental sample
  misc_feature (1)..(564): n is a, c, g, or t
atgaaaagaataatttatataatactgttattttctgtcgcagtgatcctcagttcctgtacaaaaacagaatctaaaagagaataccgggctggtagtgacggattattctatgaacagggaagcgataaactctataccggttatgtaatcgatacttcggatgttattgtaacttttgaagttgtaaacggcgtaaagaacggtgcctttataacattctacacaaacggagaatatgaaaaatacgggttgattgtaaatgataagaataccggcacctggagatatttttattctgacggacagcttgaaagcatcggatcatttcaggataataaacctgagggaaagtgggtttcatactacccgaacggcagaatgaaaacagaaggcgaatatattgagggggaacagcatgngtggtggaagtactataatgaggaaggtgaactaataatgtttatatctttggaaatggtatgctgctcgaagatcaataaaatcctgatttatancatccctangaaaataattcaccatatcagttttgttaaaagataa

SEQ ID NO: 172 - protein, 187 aa, Unknown
  Obtained from environmental sample
  SIGNAL (1)...(21)
  misc_feature (1)..(187): Xaa is any amino acid
MKRIIYIILLFSVAVILSSCTKTESKREYRAGSDGLFYEQGSDKLYTGYVIDTSDVIVTFEVVNGVKNGAFITFYTNGEYEKYGLIVNDKNTGTWRYFYSDGQLESIGSFQDNKPEGKWVSYYPNGRMKTEGEYIEGEQHXWWKYYNEEGELIMFISLEMVCCSKINKILIYXIPXKIIHHISFVKR

SEQ ID NO: 173 - DNA, 447 bp, Unknown
  Obtained from environmental sample
  misc_feature (1)..(447): n is a, c, g, or t
atggagagaatggaaaaaaaactgcaggaccaggaagcgcaggacaaatttcgggaactggcaactggagtaaatatttgcatgtttaccaccatagacaacgaacaaaatattatgagccgtcccatgtggacagctgatattgataaagaaggcaatgcctggttttttacgaatgagttttctgaaaaaattcatgaagtgtcaaaagacaatattgtaaacctgatttatgcgcatccgggaaaaaatatttatgtaaatgtaaaaggcacgtgcactgtaattatcgataggaaaaaaatggaagaattgtggaaaccatctatgaaaacctggtttcccgaagggctggatgatacaaagatctgcctggtgaaagtaactacagaaaatgcatactatggaacacaagctcgagtaaaatgtcgctttttccaaagataa

SEQ ID NO: 174 - protein, 148 aa, Unknown
  Obtained from environmental sample
  DOMAIN (13)...(100): Pyridoxamine 5'-phosphate oxidase
  misc_feature (1)..(148): Xaa is any amino acid
MERMEKKLQDQEAQDKFRELATGVNICMFTTIDNEQNIMSRPMWTADIDKEGNAWFFTNEFSEKIHEVSKDNIVNLIYAHPGKNIYVNVKGTCTVIIDRKKMEELWKPSMKTWFPEGLDDTKICLVKVTTENAYYGTQARVKCRFFQR

SEQ ID NO: 175 - DNA, 345 bp, Unknown
  Obtained from environmental sample
  misc_feature (1)..(345): n is a, c, g, or t
atgatagttaatgaaaataattcccaaccatatatgaaaagcttatcaacttgcttgaataaaatgataagcgatggatatgacgaagattataaactaacggaccgggggctggaatctttgcatagtggaaaaacatacaaccccgaacaggtacagatcgttaattttttccgctttgaaggaatgtcagacccggatgataatgccatactatacgttattaaaacagatgatggagctaaaggaactttaatagacggatatggaatttatacggagccgaaaattgcttcatttatgaaagaagtggaaaacattcaaaagaaaactgtaaaaagttag

SEQ ID NO: 176 - protein, 114 aa, Unknown
  Obtained from environmental sample
  misc_feature (1)..(114): Xaa is any amino acid
MIVNENNSQPYMKSLSTCLNKMISDGYDEDYKLTDRGLESLHSGKTYNPEQVQIVNFFRFEGMSDPDDNAILYVIKTDDGAKGTLIDGYGIYTEPKIASFMKEVENIQKKTVKS

SEQ ID NO: 177 - DNA, 543 bp, Unknown
  Obtained from environmental sample
  misc_feature (1)..(543): n is a, c, g, or t
atgacggttttgatcgacgatgacggcaaatcaatcgcggcgatcgacgatttcagcgaacaggatttcgaaaaaaatcccgaagttttaatcttttatcgaaacggagagaaaattaaatcgtataaactcagtgacttactcgacgattcgaaattcatttccgtatccgtcagtcatttccattggctttacagaaacgaaaattccttttccttaaaagattcgaagctcgaattgacgactttcgagctgaacagatacatttttgacgccgaaagcggcggcgttttgaaaaaggaaaaggacgaaatattatccggcgacgcggtttacgtttacggcgaagtgaaaagtttaagcggagacaaatacgaaatcgacgtggaatgcgcgatttacggttcagtttccaaaggcgctaaactgcagtttgcttcgaaagaacacagatggaaaggcaaaggatttcacgaaactttgattataaaagacggcaaacttgcggctataaaaggcgttatttttaatgtctgcaattaa

SEQ ID NO: 178 - protein, 180 aa, Unknown
  Obtained from environmental sample
  misc_feature (1)..(180): Xaa is any amino acid
MTVLIDDDGKSIAAIDDFSEQDFEKNPEVLIFYRNGEKIKSYKLSDLLDDSKFISVSVSHFHWLYRNENSFSLKDSKLELTTFELNRYIFDAESGGVLKKEKDEILSGDAVYVYGEVKSLSGDKYEIDVECAIYGSVSKGAKLQFASKEHRWKGKGFHETLIIKDGKLAAIKGVIFNVCN

SEQ ID NO: 179 - DNA, 309 bp, Unknown
  Obtained from environmental sample
  misc_feature (1)..(309): n is a, c, g, or t
atggtaaaacatgtaaaaacgctaaatctgccctccggtcataaacagattgcctatgatacaaggcagtacagcagttatgatcagataatcacccagtattttatcattgaggaaatcgatgaaaaaggacttgttgtttccaaacattatcacccgttaaccctgcgctgggtaacaaagtttgaaatgcagcacctttttgacctctgtggttttaaagtgactaacctgttcggctggtttgataaaagcgaatttaccaataacagtgaggaaatgatctgggttgcccagaaggtcggttag

SEQ ID NO: 180 - protein, 102 aa, Unknown
  Obtained from environmental sample
  misc_feature (1)..(102): Xaa is any amino acid
MVKHVKTLNLPSGHKQIAYDTRQYSSYDQIITQYFIIEEIDEKGLVVSKHYHPLTLRWVTKFEMQHLFDLCGFKVTNLFGWFDKSEFTNNSEEMIWVAQKVG

SEQ ID NO: 181 - DNA, 474 bp, Unknown
  Obtained from environmental sample
  misc_feature (1)..(474): n is a, c, g, or t
ttgaattcaagtttattatcttatcaataccaaaaactaaatcctgagctagggcgtgtttttgctcaggtcaaaatagattatgtaaatgagctgcccataattttaatcgataacaacagacaagtttacttcatccaaaaagctgaccaaatgctctccctcaacaaagcttttcacgaaaaaatccaaaaattcctcaagcttattcaggctgaattcggaattgaaaaattgagcaagaaaatagagaaattctacgaactcacttttgaggaatttgttaagcagctcaaagtaaaatccctggggctggaaaagaaggcagatttgctggatttttttgagaagaataaaaaggagcttgtggagttgaaggctcaaatcgattcaacggatagagagattgatgagatggtgtttgatttgtatgggttgacggaggaggagaggaaggtggtgctggccagctga

SEQ ID NO: 182 - protein, 157 aa, Unknown
  Obtained from environmental sample
  misc_feature (1)..(157): Xaa is any amino acid
MNSSLLSYQYQKLNPELGRVFAQVKIDYVNELPIILIDNNRQVYFIQKADQMLSLNKAFHEKIQKFLKLIQAEFGIEKLSKKIEKFYELTFEEFVKQLKVKSLGLEKKADLLDFFEKNKKELVELKAQIDSTDREIDEMVFDLYGLTEEERKVVLAS

SEQ ID NO: 183 - DNA, 831 bp, Unknown
  Obtained from environmental sample
  misc_feature (1)..(831): n is a, c, g, or t
atgccaacagcggaaatctactttttttataaagttttggaagttaaaaaagccctcacttatcctgtcgcaggtactacccgcgaccgcgcttacggacttactgcctggaacggactccagttttttttggttgacaccgcaggcatagacctgaatccaaattccgaattagaaaagaatatccagaagcagacgaatatcgccttagaagaggcggacttgattctgttggttgcagacgggcaaaccgaacttgcagacaaagacttggtaattgcgcagcagcttagccggagcaagaagccggtaatcctggcagtcaataaaatcgaggtccgcaaccaaaaaaccgaaacgcaatattccaagttcatccgcatgggtttgggtgaaccgtttccaatgtcctctatcaacggatcaggcgtcggtgatgtgctggatgaaattgtaaaaaaattaaaagaaaaatttaaccaggaaactgttgaagagtccacagatgtaaaattggcttttgttggtaaaccaaacgtcggaaaatcctctttaatcaacgctttactaaaagaagagcgcttaatcgtacacaaccagtccggaaccacccgctcaaccgttgaaattccattcgaatataaaggcgagaaattcattctgctcgataccgcgggaatcaagagaaaatggaaacaggatgtggatgtggaagcggncgcagccttccaatccatccgcaccatctcgcgcacagacattgccctngtcgtaatagatgcgtcggatgaaaataccgtacaggacccaggctgtatggaagaaatctag

SEQ ID NO: 184 - protein, 276 aa, Unknown
  Obtained from environmental sample
  DOMAIN (24)...(226): Ferrous iron transport protein B
  misc_feature (1)..(276): Xaa is any amino acid
MPTAEIYFFYKVLEVKKALTYPVAGTTRDRAYGLTAWNGLQFFLVDTAGIDLNPNSELEKNIQKQTNIALEEADLILLVADGQTELADKDLVIAQQLSRSKKPVILAVNKIEVRNQKTETQYSKFIRMGLGEPFPMSSINGSGVGDVLDEIVKKLKEKFNQETVEESTDVKLAFVGKPNVGKSSLINALLKEERLIVHNQSGTTRSTVEIPFEYKGEKFILLDTAGIKRKWKQDVDVEAXAAFQSIRTISRTDIALVVIDASDENTVQDPGCMEEI

SEQ ID NO: 185 - DNA, 621 bp, Unknown
  Obtained from environmental sample
  misc_feature (1)..(621): n is a, c, g, or t
atgaaaagcttagattcactaaaaaatctgatttttaaactaacatcagatgagttaaaatctttggttcgatatcttgaatactatagtgagaaagattctattaaatcagtcgaattacttcaactaattttaaagaagccttctgctaaatccggagaaattgaaaaaatgttatatagtattccaaataaaacagcatttaataaacttattggtaggttaaatgacaaaattctcgaaatcctattatttaactctaatttaaataaagatcattattcgtctagattaaaagtcctcattgatcttaagaaaaaattaatacaatcagacatattaagtctaaaagggttaagagaggaagctgataaaatatgtaggaaggtaatctcgaaagctgaaaaatatgaagtgtacgatttagttcttcaaggattacttgtaagacaaaaatttgtaaatgttagaaagcaaaggtcactataccagagactaaaaaatcaaattgaatatgctgaaattaagcaaaagtccaacattgaaagcgaaatcctatataacgatattacgaatcaaatcactaattcctcagatacctctaaatattttatccgctag

SEQ ID NO: 186 - protein, 206 aa, Unknown
  Obtained from environmental sample
  misc_feature (1)..(206): Xaa is any amino acid
MKSLDSLKNLIFKLTSDELKSLVRYLEYYSEKDSIKSVELLQLILKKPSAKSGEIEKMLYSIPNKTAFNKLIGRLNDKILEILLFNSNLNKDHYSSRLKVLIDLKKKLIQSDILSLKGLREEADKICRKVISKAEKYEVYDLVLQGLLVRQKFVNVRKQRSLYQRLKNQIEYAEIKQKSNIESEILYNDITNQITNSSDTSKYFIR

SEQ ID NO: 187 - DNA, 318 bp, Unknown
  Obtained from environmental sample
  misc_feature (1)..(318): n is a, c, g, or t
gtgantgcgaatgatcttcctgtgcactctgggcggttttgcnatattctgnatccaaaacgtgattatactttggtgcaaaggccatcaaaaattgatgcatcaaaaacatttgcctgcatgggtctcgacggaactatcaaaacaaaagagttcgataatttccaaagagactggccgaacatcattgtatcggataatgaaacaattaagtcggttgatgaaaaatgggagaaactaggtttgggggaatttattccatcaccgtcattgaaatacaaaggccagatgtatggagaagaagccgttgtgaagtaa

SEQ ID NO: 188 - protein, 105 aa, Unknown
  Obtained from environmental sample
  misc_feature (1)..(105): Xaa is any amino acid
MXANDLPVHSGRFCXILXPKRDYTLVQRPSKIDASKTFACMGLDGTIKTKEFDNFQRDWPNIIVSDNETIKSVDEKWEKLGLGEFIPSPSLKYKGQMYGEEAVVK

SEQ ID NO: 189 - DNA, 441 bp, Unknown
  Obtained from environmental sample
  misc_feature (1)..(441): n is a, c, g, or t
atgaccgcagggcgaggcagtctgctgggcagtgacggttcaggttattttacattaagtgaagaagagaatggaattgaagctcacctttatttttatccaagacttgtttcagcttctgacgaaaaaaacaatgaaatagttattaattttaaattagaacagaactatccaaatccttttaacccaactacaaaaattaaatattcaatcccaacccctctccttactaaggagaggggcaggggtgaggttgtaactctaaaggtttacgatatccctggtaatgaaatagcttctcttgtaaatgaagaaaaatccccgggtgaatatgaaataattttcgacgccggtaaatatggattatcaagcggaatatatttttataaactaaccgcaggtgatttttctgagagcaaaaaattaattctgcttaaataa

SEQ ID NO: 190 - protein, 146 aa, Unknown
  Obtained from environmental sample
  misc_feature (1)..(146): Xaa is any amino acid
MTAGRGSLLGSDGSGYFTLSEEENGIEAHLYFYPRLVSASDEKNNEIVINFKLEQNYPNPFNPTTKIKYSIPTPLLTKERGRGEVVTLKVYDIPGNEIASLVNEEKSPGEYEIIFDAGKYGLSSGIYFYKLTAGDFSESKKLILLK

SEQ ID NO: 191 - DNA, 345 bp, Unknown
  Obtained from environmental sample
  misc_feature (1)..(345): n is a, c, g, or t
atgagaaggcattgcaaacatgttttgcataaagaagtcagttatggtcattcaaatggatggattcaaaacaagaatgacatcttaaatgactttacaagtggcaaactgatctataataaaattgacaataacagctcggcgatagttgtgataagtaagaaatatgccactgtgaaaacgaatacaaatgcggaggggatggtgaatggggccccatttaatttaaaactgcatatcatgcagttttggataaaaaccaaaaggggttggcaattgctgcgtattttctcatcgaacttgagtttttgggcgggcggcagcacctgggagaggttccggtga

SEQ ID NO: 192 - protein, 114 aa, Unknown
  Obtained from environmental sample
  misc_feature (1)..(114): Xaa is any amino acid
MRRHCKHVLHKEVSYGHSNGWIQNKNDILNDFTSGKLIYNKIDNNSSAIVVISKKYATVKTNTNAEGMVNGAPFNLKLHIMQFWIKTKRGWQLLRIFSSNLSFWAGGSTWERFR

SEQ ID NO: 193 - DNA, 636 bp, Unknown
  Obtained from environmental sample
  misc_feature (1)..(636): n is a, c, g, or t
gtgcttaataataacctggtttcagatcagaagttgggaatcgaattctctgaaaaggacaaattccaatccttgcttaatacccttaagggatgtgaggagtttgttttggattcatcaggggtaattgtaagcagtaacctggaagctgttaccattactggttatgaagaatgggaagtaattggtaaacatatctcatttctgtactcaatagaagaccaacaaattaataaagcagaggccgacttgcttaagaccgctaaacttggcaagtatatcagtagtggatttagaattaaaaaaagaggcgaccggttttgggctaagatgaaattttttgcccttgcaaacaacggtgaagtggccgcgtatcgggtaacactcaccgactctacacatcgtgccatgtataccatgagcacgaaacgaattaaagatgaatatctaagtctgttcaataattcattcattggcatatataaatttaaacttaagggatattctttcttaatgctnaatgaaaaggcaacacagatttttggaaaaggtcgggaaatcgtgacattaaatgatgttttcttcttncanngagaaactcatgagttnactanaaaactaggaacgcacaaacat

SEQ ID NO: 194 - protein, 212 aa, Unknown
  Obtained from environmental sample
  misc_feature (1)..(212): Xaa is any amino acid
MLNNNLVSDQKLGIEFSEKDKFQSLLNTLKGCEEFVLDSSGVIVSSNLEAVTITGYEEWEVIGKHISFLYSIEDQQINKAEADLLKTAKLGKYISSGFRIKKRGDRFWAKMKFFALANNGEVAAYRVTLTDSTHRAMYTMSTKRIKDEYLSLFNNSFIGIYKFKLKGYSFLMLNEKATQIFGKGREIVTLNDVFFXXXETHEXTXKLGTHKH

SEQ ID NO: 195 - DNA, 594 bp, Unknown
  Obtained from environmental sample
  misc_feature (1)..(594): n is a, c, g, or t
gtgatgcgcgaatttaccattaaagaagttttacggaaattaaacgattcaaacgtagagggggttttatacctctgtgcaagccccgaccaggcgtggaatgacttccttgataactattcgctgatagaagctgcaggtggtgttgtgaaaaatgagaatgatgaattgcttataattttcagaaagaaaaaatgggatttaccaaaaggtaaattggactatgatgaaacacccgaatctgctgcgcttcgtgaagtgaaagaagaatgtggcatcattgaattagagttagaaaagtttcttcttaaaacgtaccatacttatacagaaaagaataaaagtatcttaaaaaaaactcactggtattcgatgtattctcccgatgatcataagctcatcccccagaaagaagaagatatcgaaaaagctttgtggatgagtaaggataaaatctactcggatgtttttgctaatacatatgcttctataaaagaagtactattaaattattacgaagtgaattctgtaaaaacaattaatattttcgttgcgaaactntgcgaaccgttgccctctttgcntttannatga

SEQ ID NO: 196 - protein, 197 aa, Unknown
  Obtained from environmental sample
  DOMAIN (42)...(171): NUDIX domain
  misc_feature (1)..(197): Xaa is any amino acid
MMREFTIKEVLRKLNDSNVEGVLYLCASPDQAWNDFLDNYSLIEAAGGVVKNENDELLIIFRKKKWDLPKGKLDYDETPESAALREVKEECGIIELELEKFLLKTYHTYTEKNKSILKKTHWYSMYSPDDHKLIPQKEEDIEKALWMSKDKIYSDVFANTYASIKEVLLNYYEVNSVKTINIFVAKLCEPLPSLXLX

SEQ ID NO: 197 - DNA, 333 bp, Unknown
  Obtained from environmental sample
  misc_feature (1)..(333): n is a, c, g, or t
ttgaacgtacaaatatccttgagcatactaaatactccctacgcaaaagctctggaacaaaccaggggagaagtagtttgggcatgctgggaaaacgatagttcggcatactttaaaaaaaacaatggaatactttatccttattcaggaaaggatagcccggagaaaatccaggccgtggggtttaaacctcttacctgcatttccaaggacgaaaaacacctgtattatattaaccgccagatgaaccttgtgccgcgcgagctcataacaaggaaatcgcagataattttacttccggaaaaattaaagagccatgagttttccttttaa

SEQ ID NO: 198 - protein, 110 aa, Unknown
  Obtained from environmental sample
  misc_feature (1)..(110): Xaa is any amino acid
MNVQISLSILNTPYAKALEQTRGEVVWACWENDSSAYFKKNNGILYPYSGKDSPEKIQAVGFKPLTCISKDEKHLYYINRQMNLVPRELITRKSQIILLPEKLKSHEFSF

SEQ ID NO: 199 - DNA, 579 bp, Unknown
  Obtained from environmental sample
  misc_feature (1)..(579): n is a, c, g, or t
gtggaagctataacaagaaacaatctttatacaccgaaggaaagcggccacgcctttttattttacctggtaaatggtaaagtaaaaacgtttaaaacacacgaagatggaaaagaatacataacagatcttttcagccccggagattttattggttatatagcgttgatagaagataaaaattatgatgataatgccactgttttagaagatgctgaaatcatgcaaataccaaaagaagattttctgcagatgatttatagcgatattaatattgccaataaattcattcatatagttacacaaaatgtgaagcaaaaagaagaacgtttaataaacctggcctatagttctttgcgtaaaagggtggcaaaggctttggttgaagtaagctccaaattcaaagttcaaaatagcccactggaaatttcccgtgatgatgtggctcaatatattggtacagctacggagtcactcatccgtacattaagcgattttaaagatgaaaaattaatagaaataaaaagcggcaaaataatagttaccaatattgagaaattgaaaaacctgctttattaa

SEQ ID NO: 200 - protein, 192 aa, Unknown
  Obtained from environmental sample
  DOMAIN (3)...(91): Cyclic nucleotide-binding domain
  misc_feature (1)..(192): Xaa is any amino acid
MEAITRNNLYTPKESGHAFLFYLVNGKVKTFKTHEDGKEYITDLFSPGDFIGYIALIEDKNYDDNATVLEDAEIMQIPKEDFLQMIYSDINIANKFIHIVTQNVKQKEERLINLAYSSLRKRVAKALVEVSSKFKVQNSPLEISRDDVAQYIGTATESLIRTLSDFKDEKLIEIKSGKIIVTNIEKLKNLLY

SEQ ID NO: 201 - DNA, 582 bp, Unknown
  Obtained from environmental sample
  misc_feature (1)..(582): n is a, c, g, or t
ttgatgaaacattcttccttttctgctttttcctgttctgttccgcaaaaggttagttgggacagaaccaaagagggcaacgttcgtcatatagggtcgaaagcacttgaaacgaaaattgacaatgcaacatataggttcaacctgacagtattctcaggacaaaaatcaaaatactattgcttattgataagctcgttatggagaatagaaaataacggtatagtattaattaagcttggcaatgacgagaccgtaaaattagtatctgacaattctaacgtaggtgaagttgattggccaacatattcaccaataattggcgggacttcaacttctggagtgatgactacaaaaaaagttgactactatacatcaatttatttgttgcaggaggacgttttaagcaaaatcgaacagtatggaattcacaaaattagaattcagtttggaaactcatacaaagaacaaaattgggaaagggataaactaggaaaatatattagaaactctcacgaaattctggaattgcagttacaaaaaccagttgcaccatctaaatctattgaacaggacttttaa

SEQ ID NO: 202 - protein, 193 aa, Unknown
  Obtained from environmental sample
  misc_feature (1)..(193): Xaa is any amino acid
MMKHSSFSAFSCSVPQKVSWDRTKEGNVRHIGSKALETKIDNATYRFNLTVFSGQKSKYYCLLISSLWRIENNGIVLIKLGNDETVKLVSDNSNVGEVDWPTYSPIIGGTSTSGVMTTKKVDYYTSIYLLQEDVLSKIEQYGIHKIRIQFGNSYKEQNWERDKLGKYIRNSHEILELQLQKPVAPSKSIEQDF

SEQ ID NO: 203 - DNA, 528 bp, Unknown
  Obtained from environmental sample
  misc_feature (1)..(528): n is a, c, g, or t
ttggagaataaaatgaaacgactcttaactatttttgtttttttaattgttttttcctgtacggcttttgtccagaccgcttttgcgcaaaatcgcggcggcggcggcgttatcttcaaaattcccgaagacgtttttccgatggattggaacaagagcgggtttaagggaattttgatgcttcgcaaagcgagcccgtcgggaattttcgtcggttatccgaacgaaggcgaaacgatcgaggcgcttaaggcgcgcaccgccaaatttatcgtgccgatgtttaccgggcaggataagaaaaaaacggacgaggaaataaaatttcagatcacctcgattccgaatcataaaggcgattccggcaattcgggacaatattattcctacaaggacgaanaagccgaggtgcagatcctgttttatgagcgcgaggcanacggctcagtttttctttacggttattttgcccgtanaaatgactcgatgaaagacatctgggcggacgataaggggaagggcgtgaaa

SEQ ID NO: 204 - protein, 176 aa, Unknown
  Obtained from environmental sample
  SIGNAL (1)...(19)
  misc_feature (1)..(176): Xaa is any amino acid
MENKMKRLLTIFVFLIVFSCTAFVQTAFAQNRGGGGVIFKIPEDVFPMDWNKSGFKGILMLRKASPSGIFVGYPNEGETIEALKARTAKFIVPMFTGQDKKKTDEEIKFQITSIPNHKGDSGNSGQYYSYKDEXAEVQILFYEREAXGSVFLYGYFARXNDSMKDIWADDKGKGVK

SEQ ID NO: 205 - DNA, 675 bp, Unknown
  Obtained from environmental sample
  misc_feature (1)..(675): n is a, c, g, or t
ttgacaaaagaagaaagagaagttgttgataaattagcatcttcatttttaaacagtgagaagcttcaaaaacacataaggtttcttttgtcaaacggtagtatgtatttaaaggttaattcgaatcttctttaccatggatgtattcctgtaaatgaagacggaacatttaaaaaagttaaaataggttcatccggtaaagaatacagtggcaaatcatattttgatagacttgaaatattagttagagaaggatatttccataaaaacaatcctgaaggaaagctgtatggaatggatttgacttggtatttgtggactggtcctgattcgcctttatttggcaagaataaaatgaccacattcgaaagatattttatagatgataatgaaactcacaaggaaaagaaaaatccgtattttaaattagaagacaatgagttaatgtgtggcataatatttgaagaatttggcttgaagcctgaaaattctcacattattaacggtcatgtgcctgttaaaagtaaaaatggagaaagtccaattaaggctaatggtaagcttatagttattgatggtggattttcaaaagcttatcaaggaactactggtattgctggatacactctcatatataattcctatggactcatattggtatctcagatcctttaa

SEQ ID NO: 206 - protein, 224 aa, Unknown
  Obtained from environmental sample
  DOMAIN (1)...(224): Firmicute fructose-1,6-bisphosphatase
  misc_feature (1)..(224): Xaa is any amino acid
MTKEEREVVDKLASSFLNSEKLQKHIRFLLSNGSMYLKVNSNLLYHGCIPVNEDGTFKKVKIGSSGKEYSGKSYFDRLEILVREGYFHKNNPEGKLYGMDLTWYLWTGPDSPLFGKNKMTTFERYFIDDNETHKEKKNPYFKLEDNELMCGIIFEEFGLKPENSHIINGHVPVKSKNGESPIKANGKLIVIDGGFSKAYQGTTGIAGYTLIYNSYGLILVSQIL

SEQ ID NO: 207 - DNA, 717 bp, Unknown
  Obtained from environmental sample
  misc_feature (1)..(717): n is a, c, g, or t
ttgcgttatttaaagcttttaactaaacaatttcctaccatagcctcatgctgtactgaaattataaatttgcaggcaatattaaatcttccaaagggtacagagcatttcttgtctgatattcatggagaatatgaaccatttaatcatgtgcttaagaatggctcaggcaatattaaaaggaagataactgaagtttttggtgatattatgactgagaaggatattaaaagtcttgcaacgcttatttattatcctgagcaaaagctagaaatcattcataagttggaagaaaatattgatgaatggtataagataacaattcatagacttattgaggtgagcagaaaggcagcttttaaatatacacgtatgaaggtaaggaaagcactgcctgtggaatttgcttacataatagaagaattgatgcacaaaggtcacgaagagtatgataaggaagagtattacagcgaaataatcaactccattatcagagtgggaagggctgatgaatttattgtttcaatgtcaaagcttattcaaagactggttattgacaggcttcacattgttggagatatttttgacagaggtcccggtgctgacaaggtaatggatacacttattaattatcattctgttgatattcaatggggaaatcatgatgtgttgtggatgggcgctgctgctggcagcgaagcatgtattgcaacagtt

SEQ ID NO: 208 - protein, 239 aa, Unknown
  Obtained from environmental sample
  DOMAIN (1)...(239): Firmicute fructose-1,6-bisphosphatase
  misc_feature (1)..(239): Xaa is any amino acid
MRYLKLLTKQFPTIASCCTEIINLQAILNLPKGTEHFLSDIHGEYEPFNHVLKNGSGNIKRKITEVFGDIMTEKDIKSLATLIYYPEQKLEIIHKLEENIDEWYKITIHRLIEVSRKAAFKYTRMKVRKALPVEFAYIIEELMHKGHEEYDKEEYYSEIINSIIRVGRADEFIVSMSKLIQRLVIDRLHIVGDIFDRGPGADKVMDTLINYHSVDIQWGNHDVLWMGAAAGSEACIATV

SEQ ID NO: 209 - DNA, 597 bp, Unknown
  Obtained from environmental sample
  misc_feature (1)..(597): n is a, c, g, or t
ttgatggcagacttcgttcaccttcacaaccatagtgagtactcgctcttagacggtttatcaaaaatcgagctaatggtagagcaagcaaaaaaacttggcatgacttccctagccataacagaccatggaagcttgtatggcgcaattaaattttacaaagcttgcaaagaagcggggataaaaccaattattggttgtgagatatacgtttccaaaagaagtagacacgacaaggaggccggaattgattctgattcaaaccatcttattcttcttgcaaaaaacgaagagggatataaaaacctaatgagaataatctcagttgcaaacctagaaggctactactacaaaccaagatcagacatggaacttttaaagcaacactcagagggcctaatttgtctatcggcctgcattaacgggtatgtttcagaaccacttttgcaaaaccaacaagaaactgcagaaaaaagagcactggaactatccgaaatctttggagagggaaacttctatttagaattacaaaaacatctaaacgttaaggatcaggacgaactgaatgaaaaactactcaagctttctgaaaaatag

SEQ ID NO: 210 - protein, 198 aa, Unknown
  Obtained from environmental sample
  DOMAIN (86)...(198): PHP domain C-terminal region
  misc_feature (1)..(198): Xaa is any amino acid
MMADFVHLHNHSEYSLLDGLSKIELMVEQAKKLGMTSLAITDHGSLYGAIKFYKACKEAGIKPIIGCEIYVSKRSRHDKEAGIDSDSNHLILLAKNEEGYKNLMRIISVANLEGYYYKPRSDMELLKQHSEGLICLSACINGYVSEPLLQNQQETAEKRALELSEIFGEGNFYLELQKHLNVKDQDELNEKLLKLSEK

SEQ ID NO: 211 - DNA, 660 bp, Unknown
  Obtained from environmental sample
  misc_feature (1)..(660): n is a, c, g, or t
atgttccgcgacaccgcgcacatggagaaggtgatcgacgggccgatcggcgacgaggtcctgaagaagctgtcggatcaccccaccgccaacctggtcgggctgtgctggatgaacgccggcacacgcaacgtctacaacaacaagaaaccgatccggagcgtggaggatctcaaggggctgaagatccgcatgatgggcaacccggtgttcgtcgacaccatgaatgcgctcggcggcaacggcatctcgatggggatggaccagctcatcagcgcgatgcagaccggcgtcgtcgacggggcggaaaacaacgagccgacctacgcgaccggccagcattatcgctatgccaagtactattccatgaccgggcacctgatgatcccggaggtgctggtgttctccaagcggatcttccagtcgctcggcaaggaggaccaggacctgatccgtcggctggccaaggaggcgcagatcgaggagcgcaccctgtggtacgagatggagaagaagtcactcgagcagatgaagcaggccggcgccgagatcgtcgaagtgtccgacaagaagtcgttccaggcccgcgtgaagccggtgtgggacaagtacggcgcccagctctcggggctgatcgagcggatccagaatgtgaagtga

SEQ ID NO: 212 - protein, 219 aa, Unknown
  Obtained from environmental sample
  DOMAIN (1)...(208): Bacterial extracellular solute-binding protein, family 7
  misc_feature (1)..(219): Xaa is any amino acid
MFRDTAHMEKVIDGPIGDEVLKKLSDHPTANLVGLCWMNAGTRNVYNNKKPIRSVEDLKGLKIRMMGNPVFVDTMNALGGNGISMGMDQLISAMQTGVVDGAENNEPTYATGQHYRYAKYYSMTGHLMIPEVLVFSKRIFQSLGKEDQDLIRRLAKEAQIEERTLWYEMEKKSLEQMKQAGAEIVEVSDKKSFQARVKPVWDKYGAQLSGLIERIQNVK

SEQ ID NO: 213 - DNA, 480 bp, Unknown
  Obtained from environmental sample
  misc_feature (1)..(480): n is a, c, g, or t
atgaaaggagattttgatgcggagtcatggaagttgcaattaataaaaaataatggagatacttcgttctattcattagacgatatcaaaggacttcccaaaaccgagattgtttatgattttaaatgtattgaaggttggacccaaaaaacctggtggggcggtgtaaagttctctgactttatcagacattatcatttggaaaacgaaagcaattcaaattatgttgcattaattactcctgataaaaaatattacgtaggcattgatatggccagcgctcttcatcagcaaactatgctttgttatgaaatgaatggggctccattgccaatgaaccaggggtttcctttacggttgatagtaccagttaaatatggcataaaaagcattaaaagaataggaaccatttacttcagcgatcaaagaccaccagactattgggcagaaagaggatacgattattattcaggtcattaa

SEQ ID NO: 214 - protein, 159 aa, Unknown
  Obtained from environmental sample
  misc_feature (1)..(159): Xaa is any amino acid
MKGDFDAESWKLQLIKNNGDTSFYSLDDIKGLPKTEIVYDFKCIEGWTQKTWWGGVKFSDFIRHYHLENESNSNYVALITPDKKYYVGIDMASALHQQTMLCYEMNGAPLPMNQGFPLRLIVPVKYGIKSIKRIGTIYFSDQRPPDYWAERGYDYYSGH

SEQ ID NO: 215 - DNA, 468 bp, Unknown
  Obtained from environmental sample
  misc_feature (1)..(468): n is a, c, g, or t
ttgatattcctaaaggctataagcccaaaaattaaaagtaaagttatgaatacaatgtttttttcatttttaagttttttgacagtttctatttttgttttgtcctttaatgctgaagcgcagaataaaaagagaacagtaatcaaaaatggaagcctaacagttgttgttaacaaatctggagtttacatttcttttgagcggtttggaagaagagagcccttgagagaggatgaaaatggcgaaggtgtttggttacggttgcacaataatatgcgctattcaattagtctttgcgcgtttggcatttcagagaaaggtgaacagctccttatgtatggaaaaagcacccaaataggcgtaaagtatgacattgtacctaatccgatatctgaaaccgacaatgacccacagccagtagttcctttaggttacaatacaggaagtacttgtcacctgtcgaagtaa

SEQ ID NO: 216 - protein, 155 aa, Unknown
  Obtained from environmental sample
  misc_feature (1)..(155): Xaa is any amino acid
MIFLKAISPKIKSKVMNTMFFSFLSFLTVSIFVLSFNAEAQNKKRTVIKNGSLTVVVNKSGVYISFERFGRREPLREDENGEGVWLRLHNNMRYSISLCAFGISEKGEQLLMYGKSTQIGVKYDIVPNPISETDNDPQPVVPLGYNTGSTCHLSK

SEQ ID NO: 217 - DNA, 426 bp, Unknown
  Obtained from environmental sample
  misc_feature (1)..(426): n is a, c, g, or t
ttgcagatatcgccgtccattgacatcgatccggtcaacaaatcggcgaaaaaagccaaatgcgccgaacggattcaaagaatggtcgatttcttcgggcgtttctgctggacggaagccgaccgcaatttaattttcgacggcatccaaaaagaaggaccgtggctgatcgaatcctacaaagagttgtccggcaatcaaaccacttccgcgccggaaaataccgaatcgtttaacgtttcctacaaatgcgctgcgtgcggaagttccggcaaaaaggaaatcgaatctgaaatcgggcgcgatatgtcgtcgcagagttcgcaaaaggttccgtgtccgtcgtgcggggagaatacgcccggactaatcgaatcgctcaccaattacggctttacggacacggacatcaaacctacgacatag

SEQ ID NO: 218 - protein, 141 aa, Unknown
  Obtained from environmental sample
  misc_feature (1)..(141): Xaa is any amino acid
MQISPSIDIDPVNKSAKKAKCAERIQRMVDFFGRFCWTEADRNLIFDGIQKEGPWLIESYKELSGNQTTSAPENTESFNVSYKCAACGSSGKKEIESEIGRDMSSQSSQKVPCPSCGENTPGLIESLTNYGFTDTDIKPTT

SEQ ID NO: 219 - DNA, 363 bp, Unknown
  Obtained from environmental sample
  misc_feature (1)..(363): n is a, c, g, or t
atggaatactgcgttccattctggtcgtgccttggtaaaacccgggacatcttcaaaatcaaggaggggaatattaaactgtcgcaaaaccgttcaaacctgccgccttttgtggaagagtgtatgtcggagcacacccgcaagcaccgcgggctggttggctactatgccaatgcttctgccggccaggcgcgcgatacccaccacgatgttctcggcgaaaagcttgtgaacttcaaaaaacgtatcactgtcaagtactttttcaatcacttccctgatgtcgtatggctgattggcattgccgggaatgatcgaattcaggtcaggccttttttcattaccgggctcatagggtactga

SEQ ID NO: 220 - protein, 120 aa, Unknown
  Obtained from environmental sample
  misc_feature (1)..(120): Xaa is any amino acid
MEYCVPFWSCLGKTRDIFKIKEGNIKLSQNRSNLPPFVEECMSEHTRKHRGLVGYYANASAGQARDTHHDVLGEKLVNFKKRITVKYFFNHFPDVVWLIGIAGNDRIQVRPFFITGLIGY

SEQ ID NO: 221 - DNA, 471 bp, Unknown
  Obtained from environmental sample
  misc_feature (1)..(471): n is a, c, g, or t
atgattttggcagtcaaaagaaacgttagggagagaaatcatccggagtatacgatcacttttgaagtcgtcaatcttccggaacaggagcaaaagctctatgttcaggcaaatgagcaactccttaaaaccgcccttgtcaatctgatggacaacggttgtaagtttagccccgataaaagtgtaaaggttagtctggcttttccgcccgatagtggtgcaatagttgagatcatagataaaggcccgggtattccggaagaagaacaacccatggtatttgaagcattttatcgaagccctaaaacttcaactgtgaaaggaacgggaatcgggcttgcacttgttgacagcatagtaaaaattcatcggatcgaactcaggataatcagcaaactggaaggaggtacaacgttaatttcgaaattccccgactatcacggttatgatgaaaaacttaaactcggctaa

SEQ ID NO: 222 - protein, 156 aa, Unknown
  Obtained from environmental sample
  DOMAIN (37)...(146): Histidine kinase-, DNA gyrase B-, and HSP90-like ATPase
  misc_feature (1)..(156): Xaa is any amino acid
MILAVKRNVRERNHPEYTITFEVVNLPEQEQKLYVQANEQLLKTALVNLMDNGCKFSPDKSVKVSLAFPPDSGAIVEIIDKGPGIPEEEQPMVFEAFYRSPKTSTVKGTGIGLALVDSIVKIHRIELRIISKLEGGTTLISKFPDYHGYDEKLKLG

SEQ ID NO: 223 - DNA, 369 bp, Unknown
  Obtained from environmental sample
  misc_feature (1)..(369): n is a, c, g, or t
ttgctctacttttttccttttttacatatttcttttttctccccagactggcttccaacttccatatgctctgcttaccggacgatcacattctattgtgtttcagcgatcttcacgaatctggtttcctcctacgatctccagtttcttcctatccattatcgcggccctctgccgatgcttcgcgattcctggtttcactgcttacctgtactcgacactctttcgttttcgatgggaaaccaggggattcctatcgattctgtttctttttcgcaaggggggatgctctattctacaggtataattcaccaaatccaacgtagggtttatcaaaatcttcattgcgagcaaggatatgaaaattaa

SEQ ID NO: 224 - protein, 122 aa, Unknown
  Obtained from environmental sample
  misc_feature (1)..(122): Xaa is any amino acid
MLYFFPFLHISFFSPDWLPTSICSAYRTITFYCVSAIFTNLVSSYDLQFLPIHYRGPLPMLRDSWFHCLPVLDTLSFSMGNQGIPIDSVSFSQGGMLYSTGIIHQIQRRVYQNLHCEQGYEN

SEQ ID NO: 225 - DNA, 366 bp, Unknown
  Obtained from environmental sample
  misc_feature (1)..(366): n is a, c, g, or t
ttgatcacagatccccggcattcaataataaaaatcatgaccaataaaattatctccgtcaagaatcttgttaagcattacgggaacttcaaagcggtgaaggatatatcttttgatgttttcgaaggggagattttcggcttactcggccctaatggtgcaggtaaatcaaccacgctcgagatcatggaaacgcttcgaaaaaaaacaagcggtgaagtgatcatcgcgggcctaaaccttgacaaacaaccggacgacattaagaagatcatcggggtgccagttgcaacatcaggcttttaccccggtcttgacctggttgagctgatcccatcttttcggcgggttaacaaccgggcgtaa

SEQ ID NO: 226 - protein, 121 aa, Unknown
  Obtained from environmental sample
  misc_feature (1)..(121): Xaa is any amino acid
MITDPRHSIIKIMTNKIISVKNLVKHYGNFKAVKDISFDVFEGEIFGLLGPNGAGKSTTLEIMETLRKKTSGEVIIAGLNLDKQPDDIKKIIGVPVATSGFYPGLDLVELIPSFRRVNNRA

SEQ ID NO: 227 - DNA, 306 bp, Unknown
  Obtained from environmental sample
  misc_feature (1)..(306): n is a, c, g, or t
atgaggattcaggtaataccaaagtattcatccgtgattggtaacattgagaacgatgttgtggagctatcttataattttcaaggaagtgatccggaagatgatagcttctattctctaatatttaaacgtaaggattacgaaatgggaattgataacctggccaaaaccaatcattgtttaattataggggaaagggggagtattgaaataaaattaaatgataataaatcatttcgaattattattaaaacaagtagtagaactgaaattttagatgacgtcgattataaattctatgaataa

SEQ ID NO: 228 - protein, 101 aa, Unknown
  Obtained from environmental sample
  misc_feature (1)..(101): Xaa is any amino acid
MRIQVIPKYSSVIGNIENDVVELSYNFQGSDPEDDSFYSLIFKRKDYEMGIDNLAKTNHCLIIGERGSIEIKLNDNKSFRIIIKTSSRTEILDDVDYKFYE

SEQ ID NO: 229 - DNA, 420 bp, Unknown
  Obtained from environmental sample
  misc_feature (1)..(420): n is a, c, g, or t
atgggctcaggcttaagctcgttcatattgagactctatgcacaagagacagcaggggtaaaagtttattctgtagacgatgacgcagcgtggttagaaaagaccatgcattatttgaaagagcaggggcttgaaacgggaaacatgtacaccttagaggagtttataaagttggaggagtttgggtttgattgcattttacatgatctgaactttgtggaggtgcgcattaattatgttgaattagtcatcaatgcagccaagccaaatggactcatcattatggatgatgtgcataagcccgactacccatacgctttgttggaaaaactggatggcatgcctgttcataaatttaatttaaagcccattactcttgatatatatggccgttacgcgttcgcggttctgaaaaaatag

SEQ ID NO: 230 - protein, 139 aa, Unknown
  Obtained from environmental sample
  misc_feature (1)..(139): Xaa is any amino acid
MGSGLSSFILRLYAQETAGVKVYSVDDDAAWLEKTMHYLKEQGLETGNMYTLEEFIKLEEFGFDCILHDLNFVEVRINYVELVINAAKPNGLIIMDDVHKPDYPYALLEKLDGMPVHKFNLKPITLDIYGRYAFAVLKK

SEQ ID NO: 231 - DNA, 684 bp, Unknown
  Obtained from environmental sample
  misc_feature (1)..(684): n is a, c, g, or t
atgaataaggtgatcaagaagataagtcgagtattagagtatgtactcttgcggtttaaggttagatgctttcgtgagttcaataaaaaggttttattggatcattttgatttaggtattctcgagataaataaaaaaaaaatagaaccatattatactcaatatgtaaaacacgtctcctcaccggaaatggctgcatcacttgagttagcaggaagtatttatactatatgtaggacaaaccagtatactaaattgttagatatgggctcaggcttaagctcgttcatattgagactctatgcacaagaaacagcaggggtaaaagtttattctgtagacgatgacgcagcgtggttagaaaagacaatgcattatttgaaagagcaggggcttgaaacggaaaacatgtacaccttagaggagtttataaagttggaggagtgtgggtttgattgcattttacatgatctgaactttgtggaggtgcgcattaattatgttgaattagtcatcaatgcagcaaagcaaaatggactcatcattatggatgatgtgcataagcccgactaccaatacgctttgttgaaaaaactggatggcatgcctgttcataaatttaatctaaaggccattactcttgatatatatggccgttacgcgtccgcggttctgaaaaaatag

SEQ ID NO: 232 - protein, 227 aa, Unknown
  Obtained from environmental sample
  misc_feature (1)..(227): Xaa is any amino acid
MNKVIKKISRVLEYVLLRFKVRCFREFNKKVLLDHFDLGILEINKKKIEPYYTQYVKHVSSPEMAASLELAGSIYTICRTNQYTKLLDMGSGLSSFILRLYAQETAGVKVYSVDDDAAWLEKTMHYLKEQGLETENMYTLEEFIKLEECGFDCILHDLNFVEVRINYVELVINAAKQNGLIIMDDVHKPDYQYALLKKLDGMPVHKFNLKAITLDIYGRYASAVLKK

SEQ ID NO: 233 - DNA, 591 bp, Unknown
  Obtained from environmental sample
  misc_feature (1)..(591): n is a, c, g, or t
atgcgaatcgataagtacaataaagagttagttgaatgggaaagacttaaaaaaatagcaaatggaattataagtaaggaaattactgcttaccaagaagcgattcattatttcaacccatttgccgatattaacgagttgggatcaaaattaacactggaagtaacacagtgcaatgccactatatgcctttatgtaaataacaaacaaataattccagactatattctttccacaacaaaaacgggaaggctttctaagagaaatatgtccgctacaaagtttaatgaactgtaccaagactatgtttgcagttgtgtgctgcgtgtggccagagaaatatttgcataccttccagtaaatttagttgtggtaaatgcgatgggagagttatataataattccacaggaattaagaaagaggaagtgatagtatccgtagccatatctcctgatatactttgccggctaaacttcaattttgttgacccttccgattcgatgaaaaactttccgcacaatatgaaatttggtaaaaccacaggattcatcgcagtggagagcatcaaggcagaaaacctgattaaataa

SEQ ID NO: 234 - protein, 196 aa, Unknown
  Obtained from environmental sample
  misc_feature (1)..(196): Xaa is any amino acid
MRIDKYNKELVEWERLKKIANGIISKEITAYQEAIHYFNPFADINELGSKLTLEVTQCNATICLYVNNKQIIPDYILSTTKTGRLSKRNMSATKFNELYQDYVCSCVLRVAREIFAYLPVNLVVVNAMGELYNNSTGIKKEEVIVSVAISPDILCRLNFNFVDPSDSMKNFPHNMKFGKTTGFIAVESIKAENLIK

SEQ ID NO: 235 - DNA, 660 bp, Unknown
  Obtained from environmental sample
  misc_feature (1)..(660): n is a, c, g, or t
gtgcggagggaaatggttgacgttgcgccggtcgaaatagacaaagagatcgccaaacgacatcaacaaattatcgaaaatgccgtggctgtctttcacaacccggagcttcgaaattatatcacggatgttcgtaaaaaatatgaccaggtaatcgacagcatcaatatagatgaggtaacgaacattggctgggttaaagaccaggaagcggccgccgaactcaccatcagtaatttcaccacctggattgaaacgcataaagatgagattactgccctgcagattttctatagccaaccttatcggcgtcgggaacttacatattcaatgatcaaagacctgtatgagaagattaaaatggaacaacctttaatagctccttcacacgtttggcgtgcgtatgaacaactgggacaagcgaacggctcagctaaaaacgaattaatcgctttagtaagttggatacgaaaggttagtggaattgatgaaatcttgacggggtatgataaaacggttgataaaaatctccaggcatgggtatttaaaaagcaggctggtactactacgaaatttagtgaggaacaaatggtgtggctgcggatgatcaaagattatgtagccagcagttttcatgtggaaaaggatgattttgagttg

SEQ ID NO: 236 - protein, 220 aa, Unknown
  Obtained from environmental sample
  misc_feature (1)..(220): Xaa is any amino acid
MRREMVDVAPVEIDKEIAKRHQQIIENAVAVFHNPELRNYITDVRKKYDQVIDSINIDEVTNIGWVKDQEAAAELTISNFTTWIETHKDEITALQIFYSQPYRRRELTYSMIKDLYEKIKMEQPLIAPSHVWRAYEQLGQANGSAKNELIALVSWIRKVSGIDEILTGYDKTVDKNLQAWVFKKQAGTTTKFSEEQMVWLRMIKDYVASSFHVEKDDFEL

SEQ ID NO: 237 - DNA, 360 bp, Unknown
  Obtained from environmental sample
  misc_feature (1)..(360): n is a, c, g, or t
atgggaccattgaagattaaaatattattggttgatgacaaagagaacaatctgctttcgatggaaagtatttttgaaagcgacggttatcaattaataagggcaagttctgggaaggaagcgttgaagatacttttaactgagtttgattttacgcttatccttatggatgttgaaatgccggaagtgaacggctttgaagctgctactttgatttaccagcgcgaaaaacttcagcatatcccgatcattttcataacggcgcatagttatggcgacgagaatgtgtttaaaggttataaggccggcgcggtggattatatttataagcccattcagtcggaattactccgcggttaa

SEQ ID NO: 238 - protein, 119 aa, Unknown
  Obtained from environmental sample
  DOMAIN (6)...(118): Response regulator receiver domain
  misc_feature (1)..(119): Xaa is any amino acid
MGPLKIKILLVDDKENNLLSMESIFESDGYQLIRASSGKEALKILLTEFDFTLILMDVEMPEVNGFEAATLIYQREKLQHIPIIFITAHSYGDENVFKGYKAGAVDYIYKPIQSELLRG

SEQ ID NO: 239 - DNA, 555 bp, Unknown
  Obtained from environmental sample
  misc_feature (1)..(555): n is a, c, g, or t
gtggggctacgtgcgagccgaaagtannnnnnnnnnnnnnnnnnnnnnnnnnnnnnnnnnnnnnnnnnnnnnnnnnnnnnnnnnnnnnnnnnnnnnnnntcgggcttttcagaaatgttgaaacacgggttgattgccgatgctgcttactggagacaactggttgcgctcaatcttgaagatacggcatcattactgccgctgatagaacggtcagttcagataaaacagcacattgtagaacaggattatcatgaaaccggcatacgaaaaaatctgaatttcggacataccattggacacgccatcgaaggctatttcctggaaaaaggaaaacccatgttgcatggatacgccgttggtttgggcatgatcgctgaatcatacatctcgtcgaaaaagaatttgctctcagatgtggaattcaaggaaattgaagctgtttgtaaaaaatatttcggcgaagcattgaatgaaaaacctgattttgatttgcttttgtcactcatgctcaatgataaaaaaaataccggtggaaaaatcaatttctcatag

SEQ ID NO: 240 - protein, 184 aa, Unknown
  Obtained from environmental sample
  DOMAIN (2)...(183): 3-dehydroquinate synthase
  misc_feature (1)..(184): Xaa is any amino acid
MGLRASRKXXXXXXXXXXXXXXXXXXXXXXXXXSGFSEMLKHGLIADAAYWRQLVALNLEDTASLLPLIERSVQIKQHIVEQDYHETGIRKNLNFGHTIGHAIEGYFLEKGKPMLHGYAVGLGMIAESYISSKKNLLSDVEFKEIEAVCKKYFGEALNEKPDFDLLLSLMLNDKKNTGGKINFS

SEQ ID NO: 241 - DNA, 375 bp, Unknown
  Obtained from environmental sample
  misc_feature (1)..(375): n is a, c, g, or t
ttggacaaagaaaatcttctttccaaaaacagttcgcttgcaaaaaaatacaagggcttccgtcagtatatcgatcaaaaagaattaacgaataaggcgccatataaaataaaaacgcctgcaggttaccgtaaccttgctaacaatacaatgccttgcggcatacgttctgctttttatattacgtggaataacaactcttatgtttcgcttcaaagaaatattcacaaactaaatcttgtaatcccggaatggatattcattgacccgaaggctgataccttaatcacaagaattgataccaagggttatgcggtgatgaagaatgccaggagtgaatgttattccgatgctatcgaacttttatcatgctga

SEQ ID NO: 242 - protein, 124 aa, Unknown
  Obtained from environmental sample
  misc_feature (1)..(124): Xaa is any amino acid
MDKENLLSKNSSLAKKYKGFRQYIDQKELTNKAPYKIKTPAGYRNLANNTMPCGIRSAFYITWNNNSYVSLQRNIHKLNLVIPEWIFIDPKADTLITRIDTKGYAVMKNARSECYSDAIELLSC

SEQ ID NO: 243 - DNA, 513 bp, Unknown
  Obtained from environmental sample
  misc_feature (1)..(513): n is a, c, g, or t
atgaagcaacttccttacgttaaacatatcagagattctattaaggctaagacatacaaatgggccaaagaatctggtatgttaaaggcaacagatgatcaaatgccatccactctgtcagaagatgagaagaggtggaaagaatattttagagatcattccttcggatcaacggaggcggcgaagaatttcgccgatgccatggagatcgtcactggcataaaaatgggaagattcatatctaagaaaggctggagtgggaactttcctccgtttgtttgtatcattcctatcggcaactccaatagtcactattatccacttggacttcctgctatgtctttctccactggaagaattttcattaccaaagatggagagcagggaaacaatatgacaaatgatttaggtgaattgcagatacctgatgatgatcaactccttgattatgtagctaatctcatgtacagaagcaaggctcattgtgacaagcttattctaaactttacatag

SEQ ID NO: 244 - protein, 170 aa, Unknown
  Obtained from environmental sample
  misc_feature (1)..(170): Xaa is any amino acid
MKQLPYVKHIRDSIKAKTYKWAKESGMLKATDDQMPSTLSEDEKRWKEYFRDHSFGSTEAAKNFADAMEIVTGIKMGRFISKKGWSGNFPPFVCIIPIGNSNSHYYPLGLPAMSFSTGRIFITKDGEQGNNMTNDLGELQIPDDDQLLDYVANLMYRSKAHCDKLILNFT

SEQ ID NO: 245 - DNA, 636 bp, Unknown
  Obtained from environmental sample
  misc_feature (1)..(636): n is a, c, g, or t
atggannnnnnnnnnnnnnnnnnnnnnnnnnnnnnnnnnnnnnnnnnnnnnngtaatactacaggaatacctcggacatatatgatattaccaatctatgcatacggacagcccgtcttacgaaagaaatcaagcccgatttcaaaggactatcctaatctcaaggaattgatagcggatatgtatgagactatgtatgccgcgaagggtgttggcctggcagcaccgcagatagggaaggatatccggctttttgtagtcgatactattcagcttgacaagaaaaatgataccgacacgggaataaaaaaagttttcataaatgctcaaatcctggatgaatctggagaattatggtcctatgaggaaggttgtcttagcatcccggatattcatagtgaaattaagcgaaccccaactatacggatcaattattttgatgaagaatggaatgaatatactgaaatgtttgaaaaaataaatgcccgggtaattcagcatgaacatgatcacattgagggaatatcatttattgataagatgaagcctctgaggaagcgtctgatcaacggtaaattggaaaaaattaaaaaaggcgacgttgatgtcgtttatccaatgaggtttatccgttaa

SEQ ID NO: 246 - protein, 211 aa, Unknown
  Obtained from environmental sample
  DOMAIN (29)...(187): Polypeptide deformylase
  misc_feature (1)..(211): Xaa is any amino acid
MXXXXXXXXXXXXXXXXXNTTGIPRTYMILPIYAYGQPVLRKKSSPISKDYPNLKELIADMYETMYAAKGVGLAAPQIGKDIRLFVVDTIQLDKKNDTDTGIKKVFINAQILDESGELWSYEEGCLSIPDIHSEIKRTPTIRINYFDEEWNEYTEMFEKINARVIQHEHDHIEGISFIDKMKPLRKRLINGKLEKIKKGDVDVVYPMRFIR

SEQ ID NO: 247 - DNA, 339 bp, Unknown
  Obtained from environmental sample
  misc_feature (1)..(339): n is a, c, g, or t
ttgagcaaacgcgtctctcagatattccaaagtacgatagcgtcggaaaagagcacgggcgtcgtaatttgcaagaaaaataatctatccggggaactggaaagcgtcatgaacatatcgtatatctttagacgaagtccgaaacgaacgggagtcgactgtaggaaaccggacaaccgctctttaggagctttaccccggataggaaatcaggacagttgtaaccattccacgtacaagtccaagattaatacggggtacgaaaacgaagaaacttttcccaaaaatcaatcaggtatgaaaccctttgtgtttgggaaaactatgaaaacgagctag

SEQ ID NO: 248 - protein, 112 aa, Unknown
  Obtained from environmental sample
  misc_feature (1)..(112): Xaa is any amino acid
MSKRVSQIFQSTIASEKSTGVVICKKNNLSGELESVMNISYIFRRSPKRTGVDCRKPDNRSLGALPRIGNQDSCNHSTYKSKINTGYENEETFPKNQSGMKPFVFGKTMKTS

SEQ ID NO: 249 - DNA, 429 bp, Unknown
  Obtained from environmental sample
  misc_feature (1)..(429): n is a, c, g, or t
ttggacagtacgtatacggaggagtatagaaaacgaaatggtgcaaacagtgagccgtctaaaattactgcttcaaaaataggtaccgatgtagctttccttaaaggtgaaattttatatcaggatagcgacgttattcttattcttcaccagccggatgcccgtgagttatctccaaaaatgctaacgcttgctgataaagataagggcgtagtctggaccgcaaatgaagataaacttttaccgcaaatgcgcactaatcctaatgatacgtttactcaaatgttctttataaaggatgattttagtgctgaacgcgtcaaagacactatcatggtgaagtttaagcagggtgggatgattgcctttgatattgctactggaaacgttatttggacatttaatcctaataagggttggttccaataa

SEQ ID NO: 250 - protein, 142 aa, Unknown
  Obtained from environmental sample
  misc_feature (1)..(142): Xaa is any amino acid
MDSTYTEEYRKRNGANSEPSKITASKIGTDVAFLKGEILYQDSDVILILHQPDARELSPKMLTLADKDKGVVWTANEDKLLPQMRTNPNDTFTQMFFIKDDFSAERVKDTIMVKFKQGGMIAFDIATGNVIWTFNPNKGWFQ

SEQ ID NO: 251 - DNA, 354 bp, Unknown
  Obtained from environmental sample
  misc_feature (1)..(354): n is a, c, g, or t
atgccacaaattattgtaaataatatcactgaactttctgcggcagcaaaaaaaatagtacactcatttcatggaaaagtagttctgttttatggtgagatgggggctgggaagactaccctaattaaagctatttgtgaggaactgcgcattaaagatatagtaagcagccctacattttctatcgttaatgaatatcatacaatagaaggacaaaaagtatatcacttcgatttttatcgtattaattctattgaagaagcgtatgatctggggtatgaggaatatttttattctaaatcgtattgcttaattgaatggcccgaaaaagttccgcgagctgcttcctcttga

SEQ ID NO: 252 - protein, 117 aa, Unknown
  Obtained from environmental sample
  DOMAIN (9)...(116): Uncharacterised P-loop hydrolase UPF0079
  misc_feature (1)..(117): Xaa is any amino acid
MPQIIVNNITELSAAAKKIVHSFHGKVVLFYGEMGAGKTTLIKAICEELRIKDIVSSPTFSIVNEYHTIEGQKVYHFDFYRINSIEEAYDLGYEEYFYSKSYCLIEWPEKVPRAASS

SEQ ID NO: 253 - DNA, 357 bp, Unknown
  Obtained from environmental sample
  misc_feature (1)..(357): n is a, c, g, or t
ttgccaatcatgctaaactggaagaattcgaatctggttttttcgagggcattacaaaagaatactcacacttggaacttctatttggaaggatgttatgacaatagacaattcgatcgattggtgaaagaattccaaaagatggaccaacaaaatatccaaccgaatgaaaaaacgttcaaatttctattggaatcgctcggatcgattggtgattttgatacaggtgataaaatcatcgagaaaacaaaacgtatgggaattagaaaagaactcgaccattcaatttttctttattacatccacagagacaaatcatccactgtaatctcgcaaaaaagttcttttttgaactga

SEQ ID NO: 254 - protein, 118 aa, Unknown
  Obtained from environmental sample
  misc_feature (1)..(118): Xaa is any amino acid
MPIMLNWKNSNLVFSRALQKNTHTWNFYLEGCYDNRQFDRLVKEFQKMDQQNIQPNEKTFKFLLESLGSIGDFDTGDKIIEKTKRMGIRKELDHSIFLYYIHRDKSSTVISQKSSFLN

SEQ ID NO: 255 - DNA, 354 bp, Unknown
  Obtained from environmental sample
  misc_feature (1)..(354): n is a, c, g, or t
ttgaaaatcagcaagcaaaaaattaagaaagaaaataaatctaagattaatattgagtgcggattatctgtggatatcttaaaatatctcggagagcaaaaaaagaattataagctcgttggttttgcagttgaaacgaataatgaagtttcaaatgcaaagaacaaactaaagagaaaaaatttagattttatagtattaaataatcccaatgtaaaaggagccggattcggtactgacacaaacgttgcctcgataatagatagtaagagtgtgaacaagtataaaaaaatgtctaagcttgagcttgcaaatattatattagataaattgtttacaaaagaagatgaataa

SEQ ID NO: 256 - protein, 117 aa, Unknown
  Obtained from environmental sample
  misc_feature (1)..(117): Xaa is any amino acid
MKISKQKIKKENKSKINIECGLSVDILKYLGEQKKNYKLVGFAVETNNEVSNAKNKLKRKNLDFIVLNNPNVKGAGFGTDTNVASIIDSKSVNKYKKMSKLELANIILDKLFTKEDE

SEQ ID NO: 257 - DNA, 558 bp, Unknown
  Obtained from environmental sample
  misc_feature (1)..(558): n is a, c, g, or t
gtgaaaagaaaaggaatccactacaaaatgggagaaaaatatacattctccattccagataaaaaaggaggcgcatttaaatttaaacacagattgattgatagaaaaacatcaaatttgcaaattttaaagttcagacacaaaatgttgactcatttggttgaaaagaaaaaaatgatattgcaaaatcaaaacgaaacaaaagaaaccaacgaaaaaacatactctttaggaagtgatgatatgaacattgaaaagaataatattgaaatgcaaaataaaacaaacaaaaataatgaaaagaacattgaaataatcaggcagagagaagaaaaaatgaaggaaaatgaattatatgtgaatgaacacactttagaagaacttttatatgaacaagaagttttttgtaaacgagtagaattcgaaagagagaaaaataattcaaaaaatttaaagaaattaacattagcaccagaagaaaaaatancaaaaaatgacaaaaacaantttcttttattcatatcatattggaaacatgtncatagattggagatttaa

SEQ ID NO: 258 - protein, 185 aa, Unknown
  Obtained from environmental sample
  misc_feature (1)..(185): Xaa is any amino acid
MKRKGIHYKMGEKYTFSIPDKKGGAFKFKHRLIDRKTSNLQILKFRHKMLTHLVEKKKMILQNQNETKETNEKTYSLGSDDMNIEKNNIEMQNKTNKNNEKNIEIIRQREEKMKENELYVNEHTLEELLYEQEVFCKRVEFEREKNNSKNLKKLTLAPEEKIXKNDKNXFLLFISYWKHVHRLEI

SEQ ID NO: 259 - DNA, 378 bp, Unknown
  Obtained from environmental sample
  misc_feature (1)..(378): n is a, c, g, or t
atgactgagcccggttcaaacggtggcatttatttccacactaaattccaggacagcgattggcncaaggctggctttgaatgccaggtcaatgtcacccagggagactggatcaaaaccggcagcctgtatggtctggcaagcatcggcgtcactcccgctcaggacaagaaatggtggacccagcacatcatcgtcaagggcaaccaggtgaccgtcaaaattgatgataaaacggtattacaatataccgaaccagctggtgccgaagcagggaagcaattcgctcgcaagttggacgaaggcaccttcgccctgcaagcgcatgatcccaagagcattgtgcgctacaaaaacatccgggtgaagcgactctaa

SEQ ID NO: 260 - protein, 125 aa, Unknown
  Obtained from environmental sample
  misc_feature (1)..(125): Xaa is any amino acid
MTEPGSNGGIYFHTKFQDSDWXKAGFECQVNVTQGDWIKTGSLYGLASIGVTPAQDKKWWTQHIIVKGNQVTVKIDDKTVLQYTEPAGAEAGKQFARKLDEGTFALQAHDPKSIVRYKNIRVKRL

SEQ ID NO: 261 - DNA, 681 bp, Unknown
  Obtained from environmental sample
  misc_feature (1)..(681): n is a, c, g, or t
atgacattgtctgcaattagtgtaaaaaaagaaagtatgaagaagccgttatatgtaacaaaatctttcttaccagaattggcagaatttataccttatctagaaaaggtatggagttcacacatccttacaaacggcggaccttttcatgaacaactggaaatagaactagccaagtaccttggtgtaaaacacgtatcccttttcacaaatggaacgctggcgttaatgactgccttccaaactttacgtctatctggtgaggtaataacaactcccttcagttttcctgctacctcacattcactactttggaatggtattaaaccaatattttgtgacgttgaaccagatacctttaaccttgatccgagtaaaatacaaaattgcatcacggcagataccaaagcaattttacccgttcatgtttttgggaatccatgcaagttgatccagatccaggagatagcaacacttcatggcttgaaagttatttatgatgcttgtcacagttttggtgtaaaacaagaaggaacatccattctaaatgcaggagatctctctatcctgagttttcatgctaccaaaatctttaatacgtttgagggcggggctatcataagtcacgatcacgtaacaaagcaacggattgattttttaaaaacttcggtatcacgatga

SEQ ID NO: 262 - protein, 226 aa, Unknown
  Obtained from environmental sample
  DOMAIN (25)...(226): DegT/DnrJ/EryC1/StrS aminotransferase family
  misc_feature (1)..(226): Xaa is any amino acid
MTLSAISVKKESMKKPLYVTKSFLPELAEFIPYLEKVWSSHILTNGGPFHEQLEIELAKYLGVKHVSLFTNGTLALMTAFQTLRLSGEVITTPFSFPATSHSLLWNGIKPIFCDVEPDTFNLDPSKIQNCITADTKAILPVHVFGNPCKLIQIQEIATLHGLKVIYDACHSFGVKQEGTSILNAGDLSILSFHATKIFNTFEGGAIISHDHVTKQRIDFLKTSVSR

SEQ ID NO: 263 - DNA, 399 bp, Unknown
  Obtained from environmental sample
  misc_feature (1)..(399): n is a, c, g, or t
ttggaggtgattaatttgatgctaaaactaaactctatattactcttctcagaaaatccggaagccctatcaaaattttacacaaaggtttatggtaaggaaccggattgggttgacggaggatactacggattttcatctgataaattttttctgacaataggacctcatgacaaagtacatggtcaaaattcacaacctgaaaggattatgataaattttgagacaacagacgttaagggtgaattcgaaaggataaaaggacttggagcaaaggtcattaaagaaccttattccatgggtgaaggtgattacgaaggtcaaattgctacgtttgaagatcctgacggaaactactttcaattaatgtcaccatttgacatggaattgacaaattaa

SEQ ID NO: 264 - protein, 132 aa, Unknown
  Obtained from environmental sample
  DOMAIN (9)...(122): Glyoxalase/Bleomycin resistance protein/Dioxygenase superfamily
  misc_feature (1)..(132): Xaa is any amino acid
MEVINLMLKLNSILLFSENPEALSKFYTKVYGKEPDWVDGGYYGFSSDKFFLTIGPHDKVHGQNSQPERIMINFETTDVKGEFERIKGLGAKVIKEPYSMGEGDYEGQIATFEDPDGNYFQLMSPFDMELTN

SEQ ID NO: 265 - DNA, 678 bp, Unknown
  Obtained from environmental sample
  misc_feature (1)..(678): n is a, c, g, or t
gtggaaatgattaccgggattagcctttcattgacgaatacagtttcttcttcaagaaattttatcattatcggtactattgataaatcccatttcatccgtcaactcatccaaagcaacaaacttgaagtaaaaaaaataaaaactacatgggaaggttatcttatccaggttgtaaaaaatccatttccaggtgtaagtgaggcattggtaataaccggcagtgacaggcggggcacagctttcggtgtttttgaattaagcaggcaaatgggcatatcaccatggtattggtgggcagatgttcccgtaatgaaaaaaaacagcctttattttaagaaaggcattatactttctgatgcgccaaaagtacaatatcggggcatttttatcaacgatgaggcgcctgcattgagtaactggagcaaggaaaaattcggtggcttcaatcatcttttttatgaaaaggtttttgagctaatgctgcgtctcaaatcaaattatatctggccagccatgtggggaaatgcattttatgatgatgattcattgaatataaaaaccggagataagtatggcatcataatcggtacatcgaatcatgagccgctgatgcgggcacatgacgaatgtagaagatatggcagcggaaagtggaactttgaagtaatgacgtga

SEQ ID NO: 266 - protein, 225 aa, Unknown
  Obtained from environmental sample
  misc_feature (1)..(225): Xaa is any amino acid
MEMITGISLSLTNTVSSSRNFIIIGTIDKSHFIRQLIQSNKLEVKKIKTTWEGYLIQVVKNPFPGVSEALVITGSDRRGTAFGVFELSRQMGISPWYWWADVPVMKKNSLYFKKGIILSDAPKVQYRGIFINDEAPALSNWSKEKFGGFNHLFYEKVFELMLRLKSNYIWPAMWGNAFYDDDSLNIKTGDKYGIIIGTSNHEPLMRAHDECRRYGSGKWNFEVMT

SEQ ID NO: 267 - DNA, 531 bp, Unknown
  Obtained from environmental sample
  misc_feature (1)..(531): n is a, c, g, or t
ttggtggtgaatactgattcattgatttttgaaaccgatagacttattgtaaaacgctttacagaaaataacaaggaagaattttacaaagttaacggtgatgcgcaggtgatgaagtatataagaccagccaaatcacggtctgaaacagatgcatttttacttgaagtgattgaatactataatcagactaagatatttggaagatggggggtatggaataaatcttcaaatgagtttgtcggttcctttgctttaataccggttgagaaatcggaaaaaatgcagttaggttatgcattgttaccatctcattggggtttaggatatgcatcagaactaaccagggcagggattgaatatacatttcaccgaactccgcttctggaagtatacggctatacagaaaaagaaaacctgggttctataaaagttctggaaaaatgcggctttaagtataatgatcaaaaaagtgaaggaagtaaaatcatacttgaatacattctagaaaaaacgtacaatggattttaa

SEQ ID NO: 268 - protein, 176 aa, Unknown
  Obtained from environmental sample
  DOMAIN (72)...(152): Acetyltransferase (GNAT) family
  misc_feature (1)..(176): Xaa is any amino acid
MVVNTDSLIFETDRLIVKRFTENNKEEFYKVNGDAQVMKYIRPAKSRSETDAFLLEVIEYYNQTKIFGRWGVWNKSSNEFVGSFALIPVEKSEKMQLGYALLPSHWGLGYASELTRAGIEYTFHRTPLLEVYGYTEKENLGSIKVLEKCGFKYNDQKSEGSKIILEYILEKTYNGF

SEQ ID NO: 269 - DNA, 354 bp, Unknown; identical to SEQ ID NO: 255
  Obtained from environmental sample
  misc_feature (1)..(354): n is a, c, g, or t

SEQ ID NO: 270 - protein, 117 aa, Unknown; identical to SEQ ID NO: 256
  Obtained from environmental sample
  misc_feature (1)..(117): Xaa is any amino acid

SEQ ID NO: 271 - DNA, 687 bp, Unknown
  Obtained from environmental sample
  misc_feature (1)..(687): n is a, c, g, or t
ttgaatgaatacgccaagggcaagttcgagggcgacgacgttcgcgagtgcatggtcgggccgattgcgattcgcttgaaggatccgatgttcgagtcgcaaaccagaaacaaactcggcaacaccgaaattcgctccgagttgatgaaccaggttcgcgaagagctgctgcacttctttaatcgcaataaagacatcgccgaaaaaattgtcgcgaaagctcaagacacccagcaactccgcaaagaactccaggaagttaaaaagctcgcccgcgagcgttccaaagccatttctctgcacatccctcagctcaaggattgcaaaaatcatttaaacaaagagaaaggcaaaggcgccgggacaatgatttttctcaccgaaggtcaatccgcggccggttccatcgtcagcacgcgcgacgtgaacaaccaggcgatcttcgtcctcaaggggaagccgctgaacgtttgggacctcaagcgcgacatcgtttacaagaacgacgaaatgtacaacctcatgcgagctctcgacatcgaggacaacatttcaaatctccgttacgccaaagtcattctcgccaccgacgccgacgtcgacggtctccacatccgcaatttgctnnnnnnnnnnnnnnnnnnnnnnnnnnnnnnnnnnnnnnnnnnnnnnnnnnnnnnnnnntaa

SEQ ID NO: 272 - protein, 228 aa, Unknown
  Obtained from environmental sample
  DOMAIN (1)...(90): DNA gyrase B
  misc_feature (1)..(228): Xaa is any amino acid
MNEYAKGKFEGDDVRECMVGPIAIRLKDPMFESQTRNKLGNTEIRSELMNQVREELLHFFNRNKDIAEKIVAKAQDTQQLRKELQEVKKLARERSKAISLHIPQLKDCKNHLNKEKGKGAGTMIFLTEGQSAAGSIVSTRDVNNQAIFVLKGKPLNVWDLKRDIVYKNDEMYNLMRALDIEDNISNLRYAKVILATDADVDGLHIRNLLXXXXXXXXXXXXXXXXXXX

SEQ ID NO: 273 - DNA, 741 bp, Unknown
  Obtained from environmental sample
  misc_feature (1)..(741): n is a, c, g, or t
atgaacaggagaaattcgatggcgaacttgggggtgttatatcgtcgtattccacaggaaaaagtcctatatctaattgccccaatcaagttagatcagcaaagtgatactttgaagttaaaagagcgatacatgaaggaattaggagaacctgtagatcgggaacatctcttaagaaagagcaaacgtgcgtatcctagctttattgtttatgaggaaaagctttggattcatgatattcaggagaaagacgaaaaagccaacctggctttatctaaagaggaggcggagatccttgattcccgagaaaaaggatatccacttttcatcaacgggaggccaggaagtggtaaatcgactgttttgcaatatttatttgctgaacatctttatcatcaccttacatatagcaaactaacgggtcttcctctgtatctgacttacaacaaagaattactggatattgccagagataatgtgtttcatattttgaccagcaatgctaagaagcttgattctggtgtgattaccgaagaagaggcaagagagacagttggtcatggatttgtggactttcgtgagtattcatcctctctattgacccagataaacgtttcaaagaacatagtatattggatttcccgaatttcggattctgttggaagcaaatttcaagtatcggattgcatattagaagatactgctgactgcatgaatgtattcaaaattataaaggacaan

SEQ ID NO: 274 - protein, 247 aa, Unknown
  Obtained from environmental sample
  misc_feature (1)..(247): Xaa is any amino acid
MNRRNSMANLGVLYRRIPQEKVLYLIAPIKLDQQSDTLKLKERYMKELGEPVDREHLLRKSKRAYPSFIVYEEKLWIHDIQEKDEKANLALSKEEAEILDSREKGYPLFINGRPGSGKSTVLQYLFAEHLYHHLTYSKLTGLPLYLTYNKELLDIARDNVFHILTSNAKKLDSGVITEEEARETVGHGFVDFREYSSSLLTQINVSKNIVYWISRISDSVGSKFQVSDCILEDTADCMNVFKIIKDX

SEQ ID NO: 275 - DNA, 471 bp, Unknown
  Obtained from environmental sample
  misc_feature (1)..(471): n is a, c, g, or t
atgttaaaaaatatttcaatcttttcaattttatttattctattaataaatgcttcaaatgcccagttaattagtaaaaaagagttccgtttaaaggaatccagaatacacagcatagagctgattaaagattacaaacatacttcaaaaagttctgtttcaaaaaataaaagtcctttactggctgggaccctatcgttcatagtgccgggtgctgcattaggtcagttttacaaagaagaatacattaatggtggtatcagggttgggatttcggcaatatgtatagtttggtttttcgtctcacctacatttgattttggtggtggtggcgatgcttcgcaaaaatttttggcaacattgctatatactgctaactggttagtttccgtaattgatgncattataccggctaagtatttcaataacaatataggaaaaacttcactcgttttgactttaatatgttaa

SEQ ID NO: 276 - protein, 156 aa, Unknown
  Obtained from environmental sample
  SIGNAL (1)...(21)
  misc_feature (1)..(156): Xaa is any amino acid
MLKNISIFSILFILLINASNAQLISKKEFRLKESRIHSIELIKDYKHTSKSSVSKNKSPLLAGTLSFIVPGAALGQFYKEEYINGGIRVGISAICIVWFFVSPTFDFGGGGDASQKFLATLLYTANWLVSVIDXIIPAKYFNNNIGKTSLVLTLIC

SEQ ID NO: 277 - DNA, 429 bp, Unknown
  Obtained from environmental sample
  misc_feature (1)..(429): n is a, c, g, or t
gtgttaaaccatagatttattgaaatggaaatgaaaaaggaattattcccattaagcgaaagggaagaagaaattggtaaaatagttgttaatgcagcatataaagtacattctgctttgggtccgggtttgttggaaaaaatctatgaaatttgttttgttcatgaattgaagaaagcaggtttaaatgccttaagacaaattgatctgcccattcaatatgatggaattatttttgatgagggcttaagaattgatgtttttgtagaggattcagttatatgtgaaataaaagcagtagaacatgtaaatcctttatggaatgcacaagtgttaagtcaccttaagctgacagataaacgcctaggttacttaattaattttaatgtagaaaagataaaagacgggattaagcgaataataagatag

SEQ ID NO: 278 - protein, 142 aa, Unknown
  Obtained from environmental sample
  misc_feature (1)..(142): Xaa is any amino acid
MLNHRFIEMEMKKELFPLSEREEEIGKIVVNAAYKVHSALGPGLLEKIYEICFVHELKKAGLNALRQIDLPIQYDGIIFDEGLRIDVFVEDSVICEIKAVEHVNPLWNAQVLSHLKLTDKRLGYLINFNVEKIKDGIKRIIR

SEQ ID NO: 279 - DNA, 417 bp, Unknown
  Obtained from environmental sample
  misc_feature (1)..(417): n is a, c, g, or t
atgcctatagatttttttgcaagcggagaaaccatacaggaattgcaggaccagcaaaagagccaaaagcaagaggggaaaatgaacttttatgagttcagtaattgggatgattttttgatcttcagccgagaagtaagaaaaaatgatctgctgattattttatcatcaagaaaaggacatgtttcttaccaaacccagttagaaaaattaccctattatctttctaactatttcaaagaaaatagtttcattatgctatatccacagcaaattgaaagaggcataaaaatggacgatgttcaatacgttgacagttctttaggggaaacgatttctgaaaaagtaggatcggtgggtaagtcgggcggactttttaaaagattgtttaagaaaaataaagcccctgatacataa

SEQ ID NO: 280 - protein, 138 aa, Unknown
  Obtained from environmental sample
  misc_feature (1)..(138): Xaa is any amino acid
MPIDFFASGETIQELQDQQKSQKQEGKMNFYEFSNWDDFLIFSREVRKNDLLIILSSRKGHVSYQTQLEKLPYYLSNYFKENSFIMLYPQQIERGIKMDDVQYVDSSLGETISEKVGSVGKSGGLFKRLFKKNKAPDT

SEQ ID NO: 281 - DNA, 426 bp, Unknown
  Obtained from environmental sample
  misc_feature (1)..(426): n is a, c, g, or t
ttgcctggcttgaaatgcgcagaaagcaactatgtatccaaagaagaaataaaatacgaaacctccattccttccaaagacaaattccagatcgttctaattgaagcattgtatgaagacgacaaaggatatatcaacgtaactaccaaccaacaggtggccgaccaggctatagaaaaattgattgcagtagagcctgctatggacatacgagtggaaacgcatgaatcaggattctacgtgagaggaggattccaggctggcaattcttatcgtgttataatcaacaaacaactgaaaggaatctttggcggaacaattaaagaccattatcagcaggatcttgtttttggcgcacaagagccgagcatcagtttcgtaaataaaaaaggaatctaccttacttcaaaaggcgaaaaaaatgtn

SEQ ID NO: 282 - protein, 142 aa, Unknown
  Obtained from environmental sample
  misc_feature (1)..(142): Xaa is any amino acid
MPGLKCAESNYVSKEEIKYETSIPSKDKFQIVLIEALYEDDKGYINVTTNQQVADQAIEKLIAVEPAMDIRVETHESGFYVRGGFQAGNSYRVIINKQLKGIFGGTIKDHYQQDLVFGAQEPSISFVNKKGIYLTSKGEKNV

SEQ ID NO: 283 - DNA, 744 bp, Unknown
  Obtained from environmental sample
  misc_feature (1)..(744): n is a, c, g, or t
ttgaatttctttaaagccatctgggaccaaactggtacaccccaaaatccggttgactggagcaatccagatcaatggattgaagagcgcctcgacggcaaggaaaaaatactaggcaagcgcatttgggaagagagtaacaagacagtaaacccaaggcatgtctatggttcctatttatttattaatacctacaaacttctcgcgattgaccaaagcgggatttaccgcattagtgataaaggcaaagactttttaaataatgagcctgccgttatgagcgaattggataaagcagaagggctacctaaactgcttgcaatattaacagctcattcaccggcaaaacgcggcgacctcatcgatgaatggggcgagttcctcctagcccattccaagtatggcaccccttcaacaattaaagatactcttcagcgccgcattctgaacctcgtggagcgagggtatatccaccgccaaggtaatacctacactattactgacaaaggcattgcatacgcagccgacacttcagtgccagagacacagcaaccttaccagcaggtgctcagcgcaattaagcaatacaacgacgcccagactcaagcccttcgtaaacagctaggcaagatgaatccttacagcttcgagttactgatcanggacttattggaggctatggactatgaggatgtagttgtgaccaagcagagcggagacaaagggattgacgttgtcgccact

SEQ ID NO: 284 - protein, 248 aa, Unknown
  Obtained from environmental sample
  misc_feature (1)..(248): Xaa is any amino acid
MNFFKAIWDQTGTPQNPVDWSNPDQWIEERLDGKEKILGKRIWEESNKTVNPRHVYGSYLFINTYKLLAIDQSGIYRISDKGKDFLNNEPAVMSELDKAEGLPKLLAILTAHSPAKRGDLIDEWGEFLLAHSKYGTPSTIKDTLQRRILNLVERGYIHRQGNTYTITDKGIAYAADTSVPETQQPYQQVLSAIKQYNDAQTQALRKQLGKMNPYSFELLIXDLLEAMDYEDVVVTKQSGDKGIDVVAT

SEQ ID NO: 285 - DNA, 351 bp, Unknown
  Obtained from environmental sample
  misc_feature (1)..(351): n is a, c, g, or t
ttgattgttttgattattatcaaaaaaattttaaaaccaaaattcgaaacatttcaacaggatttggttggaattgatgaagaacaaagaaaaagagaaataaaaggacaaaaccaatctacacaacaacaactttattcattatcaaaagaaattggagaattaaatacacgttattcaaactttgaaaaatcaaaggaattatatcaaccatatgtgatagcaggtacaaaattattattatttattcattattttattttattattttattattttattattttattattttattattttattattttattattttattattttagtgaaaaaatttcaacaaattga

SEQ ID NO: 286 - protein, 116 aa, Unknown
  Obtained from environmental sample
  misc_feature (1)..(116): Xaa is any amino acid
MIVLIIIKKILKPKFETFQQDLVGIDEEQRKREIKGQNQSTQQQLYSLSKEIGELNTRYSNFEKSKELYQPYVIAGTKLLLFIHYFILLFYYFIILLFYYFIILLFYYFSEKISTN

SEQ ID NO: 287 - DNA, 351 bp, Unknown
  Obtained from environmental sample
  misc_feature (1)..(351): n is a, c, g, or t
ttgattgttttgattattatcaaaaaaattttaaaacaaaaattcaaaacatttcaacaggatttggttggaattgatgaagaacaaagaaaaagagaaataaaaggacaaaaccaatcaacacaacaacaactttattcattatcaaaagaaattggagaatcaaatacacgttattcaaactttgaaaaatcaaaggaattatatcaacaatatgtgatagcaggtacaaaattattattatttattcattatttaattttattattttattattttattattttattattttattattttattattttattatttaattattccagtgaaaaaatttcaacaaattga

SEQ ID NO: 288 - protein, 116 aa, Unknown
  Obtained from environmental sample
  misc_feature (1)..(116): Xaa is any amino acid
MIVLIIIKKILKQKFKTFQQDLVGIDEEQRKREIKGQNQSTQQQLYSLSKEIGESNTRYSNFEKSKELYQQYVIAGTKLLLFIHYLILLFYYFIILLFYYFIILLFNYSSEKISTN

SEQ ID NO: 289 - DNA, 420 bp, Unknown
  Obtained from environmental sample
  misc_feature (1)..(420): n is a, c, g, or t
gtgcgaaaattttctttaccagaaaaaataaaaataaaatttcaaaagtctcgaaattatcctaatttgttagggaaaagtcaaaatactttaaaaaattatcttaatcgcaaccatcaaaattggactttgataaaccagctaaaaaaagaaaaatcttcaaagttgaaatcaaaaaatttaattatctatggttattccatatcaaataattttcttaaagaagttttatcaaaaatgggggtaaaatttggtctcacaaatgatattacaaaagcaagcttaattcttggcttaaaaaaacatttaaaaaaaaatcttaaattaaaaaatttagcaaaacaaaaaaaaattccgatttattccttaaatcaaatcagtatttatcaattaacaaaatttattaaaatgattcaataa

SEQ ID NO: 290 - protein, 139 aa, Unknown
  Obtained from environmental sample
  misc_feature (1)..(139): Xaa is any amino acid
MRKFSLPEKIKIKFQKSRNYPNLLGKSQNTLKNYLNRNHQNWTLINQLKKEKSSKLKSKNLIIYGYSISNNFLKEVLSKMGVKFGLTNDITKASLILGLKKHLKKNLKLKNLAKQKKIPIYSLNQISIYQLTKFIKMIQ

SEQ ID NO: 291 - DNA, 444 bp, Unknown
  Obtained from environmental sample
  misc_feature (1)..(444): n is a, c, g, or t
atggaatataaaaataaggttgctgattttacgataaggctaagagaacctcttgaggagttaatgttccttagggaataccttaaaacatatctgaaatcagttgatacgcggactagaaaatattttcagattgttacaaataataaagttttaaattaccttcttcttactaatatcgaaatggctctcagcgaaaaggtagcagaaattaatcaatacagatcctcgccaaacgcaaaaaattacaaaattttagattatcttttgcgttctgatattatagtaaacgacggaatgggtctggaaacagggctgctccatcatattcccctttcaaaaatagcagagacaattgacgtactagctacaaaccttgaagagggaataaagattcttgaagaagaaagagaaataataccaagcaggattatcgagcactaa

SEQ ID NO: 292 - protein, 147 aa, Unknown
  Obtained from environmental sample
  misc_feature (1)..(147): Xaa is any amino acid
MEYKNKVADFTIRLREPLEELMFLREYLKTYLKSVDTRTRKYFQIVTNNKVLNYLLLTNIEMALSEKVAEINQYRSSPNAKNYKILDYLLRSDIIVNDGMGLETGLLHHIPLSKIAETIDVLATNLEEGIKILEEEREIIPSRIIEH

SEQ ID NO: 293 - DNA, 462 bp, Unknown
  Obtained from environmental sample
  misc_feature (1)..(462): n is a, c, g, or t
atgtgcttatctataaaaaatacaggtttgaagattgaaattgatgtatatgacaaacaaatgacctttaagagaagaaaagagatctcattaaaaaatattgattatgaaacggtagaagtttataaagccggtgagcacatttatcatttttataccgttaaagaaaataaaatgaattacctcacggtacaacaatacaacctcgatattgaaaaaaagggtgatgccctggtgctggattccacctcattgaaactcggcgtcaattattcggaatttaagatcgcccgggcaaaaaccggagcctatattctcatttataaatacgaattcagcggtggaaggatagataaattatttacaatggtgatggacggcgaatcgaagatcattcagaaaaatgagatcaatctttcagatgataatttcagtcccgttcttataaaacgaacttattag

SEQ ID NO: 294 - protein, 153 aa, Unknown
  Obtained from environmental sample
  misc_feature (1)..(153): Xaa is any amino acid
MCLSIKNTGLKIEIDVYDKQMTFKRRKEISLKNIDYETVEVYKAGEHIYHFYTVKENKMNYLTVQQYNLDIEKKGDALVLDSTSLKLGVNYSEFKIARAKTGAYILIYKYEFSGGRIDKLFTMVMDGESKIIQKNEINLSDDNFSPVLIKRTY

SEQ ID NO: 295 - DNA, 708 bp, Unknown
  Obtained from environmental sample
  misc_feature (1)..(708): n is a, c, g, or t
atgcacaaggaaaatccaacagatgaattacctcgatacctgatgactctcgcaaggacttggaaaaggcaaagcctgcttgcagaaatgaaaataggaaactggcaaccagatgtaattacctacaatacgcttctagaaaaagttaaaaaagaaaaagatgctatattttggattactgaattttgttcaactaaccttataccagatgctcatattaccaacagtcttaaaaaaatatttgcacttgtgtgcgagagttcaagattaatggaaatgtttattctaatactgcgctttaatccaatgatgttctttatctggttaaaaaactttgaagatgttgtcattgtagataaatttacttccgaatacccgaatgaatgcaatggcaccgactttaacaaactcggatttgcaactcattacctccttctaggagaacttgtcagaggcaaggaatggttagattctgtagcagttcacaacttttattatttcaaatattcaggagattattattgtcagattagaaatgaacagcaagcggaaaataattataaaagagcgttcgaactttcagaagataataataatcgtcaagacatgcttgataaaatatcttcgatgattaaacttttcaaacaggatcaaaaaattgagcgaagcaatagaatattgcaagcaatcaatatcactatttcctga

SEQ ID NO: 296 - protein, 235 aa, Unknown
  Obtained from environmental sample
  misc_feature (1)..(235): Xaa is any amino acid
MHKENPTDELPRYLMTLARTWKRQSLLAEMKIGNWQPDVITYNTLLEKVKKEKDAIFWITEFCSTNLIPDAHITNSLKKIFALVCESSRLMEMFILILRFNPMMFFIWLKNFEDVVIVDKFTSEYPNECNGTDFNKLGFATHYLLLGELVRGKEWLDSVAVHNFYYFKYSGDYYCQIRNEQQAENNYKRAFELSEDNNNRQDMLDKISSMIKLFKQDQKIERSNRILQAINITIS

SEQ ID NO: 297 - DNA, 351 bp, Unknown
  Obtained from environmental sample
  misc_feature (1)..(351): n is a, c, g, or t
ttggaacaatttgcttccgttgcaagtcatgatttaaaagaacctctgcgaaagatcatcacttttactgatttgctattaaatgatgaaaacagcaaattatcagagctgggagaaaaaaacttctcaaaagttatcgactcagcacgcagaatgtcgcggatgatagaagacattttagccttttcttttttggctcaaaagcaggaatttcaacccatttcccttcaagcggttttagaggaaacattggaattgctggaccagccaattaaagaaaaaaatgccatcatctcctccgataatttgcctgaaataaaaggtatacctttctcaantgaggcattctga

SEQ ID NO: 298 - protein, 116 aa, Unknown
  Obtained from environmental sample
  DOMAIN (1)...(68): His Kinase A (phosphoacceptor) domain
  misc_feature (1)..(116): Xaa is any amino acid
MEQFASVASHDLKEPLRKIITFTDLLLNDENSKLSELGEKNFSKVIDSARRMSRMIEDILAFSFLAQKQEFQPISLQAVLEETLELLDQPIKEKNAIISSDNLPEIKGIPFSXEAF

SEQ ID NO: 299 - DNA, 594 bp, Unknown
  Obtained from environmental sample
  misc_feature (1)..(594): n is a, c, g, or t
gtgtcatgtgacagagattataaatccgactttccacttgggattactaaaattgaaaatggtgttgaaattccttcaaccatcgccagtttaaaaaagaatgaccacattattgtccgcaatcaggaaatgattcctgctgattctgttttaattaaaggagaagcgagcatcgattacagttttgtttcaggagaaaatactcctgtcatgaaaaaaaagggtgaattgatttacgccggcgcaaaacagttgggaggcagcattgagctcatggtgattaaaactgtgaaccaaagttacatcacccagttatggaacaacaacgatttttatgccgatcagaaaaacagggacaaatctttcattcatccctggagccgctattttactattgttctttttagtttaaccacaatcgggggcatatattgggcctttgttaatccaggtaatatattgccttccatatcggctgcattaattgttgcctgcccctgctccctcctgctgtcgtcaacgtttacgtttggaaacatgcttcgttacttcgggaaaaataagcttgtatctaaaaaacgcttccgtcattga

SEQ ID NO: 300 - protein, 197 aa, Unknown
  Obtained from environmental sample
  DOMAIN (16)...(194): E1-E2 ATPase
  misc_feature (1)..(197): Xaa is any amino acid
MSCDRDYKSDFPLGITKIENGVEIPSTIASLKKNDHIIVRNQEMIPADSVLIKGEASIDYSFVSGENTPVMKKKGELIYAGAKQLGGSIELMVIKTVNQSYITQLWNNNDFYADQKNRDKSFIHPWSRYFTIVLFSLTTIGGIYWAFVNPGNILPSISAALIVACPCSLLLSSTFTFGNMLRYFGKNKLVSKKRFRH

SEQ ID NO: 301 - DNA, 432 bp, Unknown
  Obtained from environmental sample
  misc_feature (1)..(432): n is a, c, g, or t
ttggacttcaagaaaaccattattcccaatgccagtcaactcaatgcatgggacctacgttttctctcttatcaacttaaaaagaaggactatcaactcgatgatgaaaagatcagagaatatttcccaattcacactgtcatcgaaggactttttaaagtttattccaatcttctgggtgttgaatttaccccagtcctagatgcaaaaacttgggctgacggagttcaactctatcaaattcgagatcaggatgatcactccctttggggatacttttttaccgactttatcccgagaaaaggaaaatatggacatgccgcagccttcactctccattcaggtaaaatattaaacgatggaaagtattcccacccaatttcagctattgtggctaactttacgccacctgaagcagggaagcctgtttaa

SEQ ID NO: 302 - protein, 143 aa, Unknown
  Obtained from environmental sample
  misc_feature (1)..(143): Xaa is any amino acid
MDFKKTIIPNASQLNAWDLRFLSYQLKKKDYQLDDEKIREYFPIHTVIEGLFKVYSNLLGVEFTPVLDAKTWADGVQLYQIRDQDDHSLWGYFFTDFIPRKGKYGHAAAFTLHSGKILNDGKYSHPISAIVANFTPPEAGKPV

SEQ ID NO: 303 - DNA, 738 bp, Unknown
  Obtained from environmental sample
  misc_feature (1)..(738): n is a, c, g, or t
atgtccaaaatattcctggccgtattgacagtatttaccggcatcggggtacaagcacaacagcctaaatgggacagcacttttcggcccgcgaactatgcgcgtcaactggaaaattttcgcaactatcccaatgcgccttccgatatcattatgctgggcaatagcattacggattatgcggactggaacgaactactcggtatttgcgaagtgaaaaaccgcgggatttcgggcgatatcacttttggcattttggaaagactggacgaaataaccgaaggaaaacccgccaaagtttttatcctgatcggcatcaacgatatcgcgcgtaatatcccggatagtattatcctggataattataaacgcatcatacatcgtataagatctgcctcaccggccacgaagatctatttcaatacgctccttccggtaaataaaaccttcccggagaaaaatcatttcaacaaggatgtgaacattcttcatataaacgaggaactaaaaaaaattggaaaatcggaaggaatcgtggtcattgatactcatccccatttcctcgacacggaacaaatgcttaacaaatcgctcacctacgatggtctccatctcaatgctgccgggtacaaggtatgggcatcgatacttaaaccctatattaaaaacccagtgacaaaatgctatttacccgtgttgttgctggcgttcaatagctgccgcaaatcgcgcatctga

SEQ ID NO: 304 - protein, 245 aa, Unknown
  Obtained from environmental sample
  SIGNAL (1)...(19)
  DOMAIN (50)...(217): GDSL-like Lipase/Acylhydrolase
  misc_feature (1)..(245): Xaa is any amino acid
MSKIFLAVLTVFTGIGVQAQQPKWDSTFRPANYARQLENFRNYPNAPSDIIMLGNSITDYADWNELLGICEVKNRGISGDITFGILERLDEITEGKPAKVFILIGINDIARNIPDSIILDNYKRIIHRIRSASPATKIYFNTLLPVNKTFPEKNHFNKDVNILHINEELKKIGKSEGIVVIDTHPHFLDTEQMLNKSLTYDGLHLNAAGYKVWASILKPYIKNPVTKCYLPVLLLAFNSCRKSRI

SEQ ID NO: 305 - DNA, 360 bp, Unknown
  Obtained from environmental sample
  misc_feature (1)..(360): n is a, c, g, or t
atgaacccatgtaaagattattttcttggcaataaaattccttcgtacaaaagagtggcagacactctaaaatgtttacgggttaacggcaagcataatgaccttgaagaagttggtgtagatacttaccatcatactatgtttgaaatgcttggtaactggagctttggggattattttaaagaagaagctataaagtggagttgggaattactcactcaggtttataaaatttcacgagaccgtttgtatgttacagtttttgaaggtgacacgagggaaaatttgccacgtgatgatgaatcaataaatatttggaaagaaataattggagaagaaagaataataatgggaaattaa

SEQ ID NO: 306 - protein, 119 aa, Unknown
  Obtained from environmental sample
  misc_feature (1)..(119): Xaa is any amino acid
MNPCKDYFLGNKIPSYKRVADTLKCLRVNGKHNDLEEVGVDTYHHTMFEMLGNWSFGDYFKEEAIKWSWELLTQVYKISRDRLYVTVFEGDTRENLPRDDESINIWKEIIGEERIIMGN

SEQ ID NO: 307 - DNA, 618 bp, Unknown
  Obtained from environmental sample
  misc_feature (1)..(618): n is a, c, g, or t
ttggaatctcttggcgctatgtttagccaatataatattgatgaagtagcaaattggtataaggttaattcagcccttgatttatattacaaaattgccataaaagcgattgacctgaaggacctcaaagattttagggtaattggcgatcgcatagaaccgccaaaacctgacaaattattggtggatgcaaagcctgagtatcaccctggcatacaaaaaaaggatgcggagctgactatttttggtgaaagcagtgacaggattgtttataatctcgctaattgctgcaaacctattcccggcgatgatgtatttggttttgtaactactggaaaaggcctaacaatccatagaacaaattgccccaatgctgctaagttattagccaattatggccatcgggtggtaaaaacaaagtgggcaaaaaacaaagagatatccttccttacaggtttaaaaattgtaggtatggatgatgtgggcattatcaataagattaccaatatcatcagcggtgatctgcgtatcaacattgctgctcttacnnnnnnnnnnnnnnnnnnnnnnnnnnnnnnnnnnnnnnnnnnnnnnnnnaaactcccgttagtgaggtaa

SEQ ID NO: 308 - protein, 205 aa, Unknown
  Obtained from environmental sample
  misc_feature (1)..(205): Xaa is any amino acid
MESLGAMFSQYNIDEVANWYKVNSALDLYYKIAIKAIDLKDLKDFRVIGDRIEPPKPDKLLVDAKPEYHPGIQKKDAELTIFGESSDRIVYNLANCCKPIPGDDVFGFVTTGKGLTIHRTNCPNAAKLLANYGHRVVKTKWAKNKEISFLTGLKIVGMDDVGIINKITNIISGDLRINIAALTXXXXXXXXXXXXXXXXKLPLVR

SEQ ID NO: 309 - DNA, 354 bp, Unknown
  Obtained from environmental sample
  misc_feature (1)..(354): n is a, c, g, or t
ttgaagagccgttcggatccgattcaaacgatctgcccaccgatgaaatatcggtacgcattaaaaacaatatcagggaaattttactgccggatggaaattaactacgattatacacgcaaaggcgatttcgaaatgaaggtgacgacctttttcggtctggaagaaatccttgcgaaggagcttcagcagctgggaggcagggatgtcaccgtatttaaaagaggcgcgtcggttaccggcgatcttggatttttatacaaggccaacctttgccttcacaccgcattaaaggtgatcatccccatcacaaaattttccgcgaacaatgaagaagactctacacgcatataa

SEQ ID NO: 310 - protein, 117 aa, Unknown
  Obtained from environmental sample
  misc_feature (1)..(117): Xaa is any amino acid
MKSRSDPIQTICPPMKYRYALKTISGKFYCRMEINYDYTRKGDFEMKVTTFFGLEEILAKELQQLGGRDVTVFKRGASVTGDLGFLYKANLCLHTALKVIIPITKFSANNEEDSTRI

SEQ ID NO: 311 - DNA, 783 bp, Unknown
  Obtained from environmental sample
  misc_feature (1)..(783): n is a, c, g, or t
ttgatggcagctgaaataacctcactaacaggggattnnnnnnnnnnnnnnnnnnnnnnnnnnnnnnnnnnnnnnnnnnnnnnnnnngccgttacatatgaagcgaaattaaaagattcgtatggaaggttcagttcggtaacgatcaaggttcaaaggcctgggttgggagagatcttaaatttcaatcgccgctttaatcattttattctcaaagccgtggcagtgggggtgcctgaaaactattctccgctttttgattttatcgccggacaagtcttgggactagaagatgcgtttgaaagggaactcgacttccgattagaagttacgaaattaaagagattcaagcgattgtttcgatttgattcaagaattgcgatcccaaccgtgatcgacgaatattccaccaaaaacataatcacaatggaaaagctagatggttccaatcttgagacttcgattaagagtggaactccgatcaaagtaaaaaatttgaacaagtatcaccctgattatggcaagcccgtaattttgacagaggagcaagcgaggaggcaggaggaaatcgaaaggttattctcgacgttgtatgagggcacgctctatatgttgtttgtagcaggtgagctccacgccgatttacatccaggcaatgttctcgcgagaaagttggaagaggcagagagagaggctaaagaaagcaaggttggaattctcgattttggtaatactgtaaaaaccaagggtttcatctggaatcctatcaaggctggttattat

SEQ ID NO: 312 - protein, 261 aa, Unknown
  Obtained from environmental sample
  DOMAIN (31)...(132): ABC1 family
  misc_feature (1)..(261): Xaa is any amino acid
MMAAEITSLTGDXXXXXXXXXXXXXXXXXAVTYEAKLKDSYGRFSSVTIKVQRPGLGEILNFNRRFNHFILKAVAVGVPENYSPLFDFIAGQVLGLEDAFERELDFRLEVTKLKRFKRLFRFDSRIAIPTVIDEYSTKNIITMEKLDGSNLETSIKSGTPIKVKNLNKYHPDYGKPVILTEEQARRQEEIERLFSTLYEGTLYMLFVAGELHADLHPGNVLARKLEEAEREAKESKVGILDFGNTVKTKGFIWNPIKAGYY

SEQ ID NO: 313 - DNA, 585 bp, Unknown
  Obtained from environmental sample
  misc_feature (1)..(585): n is a, c, g, or t
ttgccaagtatagatgataatagcgacaacaagaataattccgaaaatatgattggcttggagtttatactggaacttttaagaaaagaaacgcagattcctaagatccaagccatatcacctgacatttatagaaaaattgcacaaataatcaggggcctttcgatccaaaaatatgaagacttggaattggatgtacatcatgaactcattaaattactaacaatatctacaaaatcattgtttgaattaagaatccgaaagctcttagaaagttctaacgttcaacatttgtcatatccttcattattgtctagcgatgactattcaaaattaactgatgaagagaagtttatttttgaagaagaaagaaaagtttcacaaagaaaggaacttatcatacagtctttaattggcggaaatgtgaacaatttagatacaatatcaagaatcataagatccaaaatgattataatcagatttttagagtctactgatcagttcatgggggttgatatggcaaaatatggtccgttcattaaagaggatattgcgatattaccctttgaaatgcaagatctttaa

SEQ ID NO: 314 - protein, 194 aa, Unknown
  Obtained from environmental sample
  misc_feature (1)..(194): Xaa is any amino acid
MPSIDDNSDNKNNSENMIGLEFILELLRKETQIPKIQAISPDIYRKIAQIIRGLSIQKYEDLELDVHHELIKLLTISTKSLFELRIRKLLESSNVQHLSYPSLLSSDDYSKLTDEEKFIFEEERKVSQRKELIIQSLIGGNVNNLDTISRIIRSKMIIIRFLESTDQFMGVDMAKYGPFIKEDIAILPFEMQDL

SEQ ID NO: 315 - DNA, 456 bp, Unknown
  Obtained from environmental sample
  misc_feature (1)..(456): n is a, c, g, or t
gtgaagaattatacaaacaaatacataaataaatacttccattgtaactttcaaatatttatttatattatttttatgttaatagtacaagaagcagaacaacaagcaagaaaagtagaacgtgatctatttcatactctagaaaaaatatacaaatacagaatcagaagagatccagattatccattatattctagctcaattcattctaaatattatccaatggttttagcagcaataagaaaagcaatagaaacagtacacaaagaaggaattgaatatgttggatctaaactcaaacaagaagtttattttacagatacagatattgatactattaaagttcaagcagaatttaccactaatctattttttaaagcattaagcaaggaagcagaaataacaagtatgcggtcaatgaccgnatcacaacaacaaaaaaaagcaacgcattaa

SEQ ID NO: 316 - protein, 151 aa, Unknown
  Obtained from environmental sample
  misc_feature (1)..(151): Xaa is any amino acid
MKNYTNKYINKYFHCNFQIFIYIIFMLIVQEAEQQARKVERDLFHTLEKIYKYRIRRDPDYPLYSSSIHSKYYPMVLAAIRKAIETVHKEGIEYVGSKLKQEVYFTDTDIDTIKVQAEFTTNLFFKALSKEAEITSMRSMTXSQQQKKATH

SEQ ID NO: 317 - DNA, 489 bp, Unknown
  Obtained from environmental sample
  misc_feature (1)..(489): n is a, c, g, or t
atgttatttgaaacccaaaggctgtttgtaacgaaatggaaggaagatgacctggattccttataccagttatttaatgatcctgctataaaagaatgtatccttccccggcttaccattgaggaaaccactcatatttttgaaacgcagttaacggagtatgatacttcttttccttttggaaggtattttattgtagaaaaagaaagtctggaaaagattggtctttttttgttgaaagcaatgaaagacggaattgagattggctattccttaaaaaaagaacattggaataaaggcttcgcaaccgagatcgtacgggaaagtattacctggatacagcaactgaaaaaattcgataaagtgtatgcaataacgggcaccgataataccaattctcaaaatgtcctgctaaaatccgggttcaccccaaaggaagacttcttagaaaatggaaaagacattgagtttatttcaaaaagattctga

SEQ ID NO: 318 - protein, 162 aa, Unknown
  Obtained from environmental sample
  DOMAIN (65)...(143): Acetyltransferase (GNAT) family
  misc_feature (1)..(162): Xaa is any amino acid
MLFETQRLFVTKWKEDDLDSLYQLFNDPAIKECILPRLTIEETTHIFETQLTEYDTSFPFGRYFIVEKESLEKIGLFLLKAMKDGIEIGYSLKKEHWNKGFATEIVRESITWIQQLKKFDKVYAITGTDNTNSQNVLLKSGFTPKEDFLENGKDIEFISKRF

SEQ ID NO: 319 - DNA, 492 bp, Unknown
  Obtained from environmental sample
  misc_feature (1)..(492): n is a, c, g, or t
ttgcaggaattggtacatgagtcgatatatgcggatgtcctcattattgaccaaaaaggaacatttagcattttcggacaaccaacgcctgccaattttttacgcgaattgcttgtagatgtacaatgcccagtgctggtagcgccagacaaattcaggaaaataggaaacatagtatttctctatgatggcgaaccctcttcagtttttgctattaaaatgttcagccatacgtttccttcactgagcggaaaaaatgtggaagtggtcatagtaaaaaataaatttgaaacactccatgttcccaatggaaaattaatgagggaatttatgaaacgccgctatcctgaagcagaatttattattgaaaagggcgatgcagaagacaatattgtgagttatctgaagaataagaaacagcccttacctggcggtgttaggtgcatacaggagaagcagggtttcgagatggttcaggccaagtatggctga

SEQ ID NO: 320 - protein, 163 aa, Unknown
  Obtained from environmental sample
  misc_feature (1)..(163): Xaa is any amino acid
MQELVHESIYADVLIIDQKGTFSIFGQPTPANFLRELLVDVQCPVLVAPDKFRKIGNIVFLYDGEPSSVFAIKMFSHTFPSLSGKNVEVVIVKNKFETLHVPNGKLMREFMKRRYPEAEFIIEKGDAEDNIVSYLKNKKQPLPGGVRCIQEKQGFEMVQAKYG

SEQ ID NO: 321 - DNA, 672 bp, Unknown
  Obtained from environmental sample
  misc_feature (1)..(672): n is a, c, g, or t
atggcaggccccacttatattcccatgttggagacagatgacagcgactcaatagaaaaaaacatcagccgcttcgaaaaattgtgcacggaacattcaattaaatacaaaattcataaggacttttttgattttgcgcttcctgaattgaaaaaagaaacacgcttcgcagatttgctgattatcagcagcgaaacgttttataaagacctgggaagacaaaatcccagtgagtatttaaaagatgcacttcactcttccgaatgtcctgtaattgttgttcccgaaaatttcaaatttcccaaagtaaatgtcctggcttatgacgggagtgaatcatccgtttttgcaattaagcagtttgcttacatctttcctgaactaaccagccaggaaaccttgctgttttacatttctccaggtgaagagaaaaaattacctgacaatgaaaacgcagaagaactgataaaacaacacttttctaatgtttcgtttttgaaactttcacttaatccgagaaaggattttaccgactgggttaataataatcctgatgctatcctggtaagtggttcttttggcaggtcttcgctttcagaaatgttcaggaaaagttttgtggctaatataattgcagaacacaagttcccggtatttatagcacataagtag

SEQ ID NO: 322 - protein, 223 aa, Unknown
  Obtained from environmental sample
  misc_feature (1)..(223): Xaa is any amino acid
MAGPTYIPMLETDDSDSIEKNISRFEKLCTEHSIKYKIHKDFFDFALPELKKETRFADLLIISSETFYKDLGRQNPSEYLKDALHSSECPVIVVPENFKFPKVNVLAYDGSESSVFAIKQFAYIFPELTSQETLLFYISPGEEKKLPDNENAEELIKQHFSNVSFLKLSLNPRKDFTDWVNNNPDAILVSGSFGRSSLSEMFRKSFVANIIAEHKFPVFIAHK

SEQ ID NO: 323 - DNA, 744 bp, Unknown
  Obtained from environmental sample
  misc_feature (1)..(744): n is a, c, g, or t
ttggaaagtaaatgggaaatatgtatctttcgtcttcgaacccgcccggacgccaacttacggaagcgttatgcgtcatttcaaggaaagtatatgaacgacttcaaagaatacttaaaatttcaagatattgaaactgctatggagtataccacagtacttgaaagacatagtattccttttgcactggatgatgcttcgatgcgtttcgaattagtaaaatcaagtgactcattagaaaatttattcatcttaagaataaaagatgaggacaaagaaaaggcagagcgattatttgatgcagaaattgataaggagataaaaaatctttcgcctgaacattatttattttcctttaatgacaacgaaatacttgatgtaatcgcaaatcagaatgaatggacaaagacagaaattaaacttgctttaaaaattgcaaatgagcgaaaaatagatttatcagctgtctctataaagagtgcaaagaaaaaaccagaggatcagaaaataaatattttaaatattgagaatgcctctggttggtatggggtttccggaatattctctttaattaattatgtcttagtgacagcacaagtagattttcatttgcctggtttagcaatgacagaatatattgaccagttatctaataattcctatggtattgggtatcgatttggattgcttgcttgcttagtgattgccgtatttttcactgtttgcaaaatgggaagagcataa

SEQ ID NO: 324 - protein, 247 aa, Unknown
  Obtained from environmental sample
  misc_feature (1)..(247): Xaa is any amino acid
MESKWEICIFRLRTRPDANLRKRYASFQGKYMNDFKEYLKFQDIETAMEYTTVLERHSIPFALDDASMRFELVKSSDSLENLFILRIKDEDKEKAERLFDAEIDKEIKNLSPEHYLFSFNDNEILDVIANQNEWTKTEIKLALKIANERKIDLSAVSIKSAKKKPEDQKINILNIENASGWYGVSGIFSLINYVLVTAQVDFHLPGLAMTEYIDQLSNNSYGIGYRFGLLACLVIAVFFTVCKMGRA

SEQ ID NO: 325 - DNA, 459 bp, Unknown
  Obtained from environmental sample
  misc_feature (1)..(459): n is a, c, g, or t
gtgaaactaaacttgaattatcggagcactcaaaatattgttggcgcaagcaacgaggttatcaaacataacaaattcaaggttgagaaagatattcatgcatccaagaaatcggaacataagattgtggtctatactggcggcagtgaggaggaaaacattcaattctgtttgaataaggtaaaagaattacaaaacacagggttgacaggagaagatatcctatttctctatcgcaggacccatatgtataatcccggtgcgtattcaggcaggccttcatactcacgaacattttccgacgagggaataaaagtgcaagcaaaaacaattcatgctgcgaaagggcttgaagcgaaagttgttttcataattggattaaccgagggcaacggaggtttccctgatatttggctcgaagaccagaatttttcaagtgatacaaaaagcaaatcatga

SEQ ID NO: 326 - protein, 152 aa, Unknown
  Obtained from environmental sample
  misc_feature (1)..(152): Xaa is any amino acid
MKLNLNYRSTQNIVGASNEVIKHNKFKVEKDIHASKKSEHKIVVYTGGSEEENIQFCLNKVKELQNTGLTGEDILFLYRRTHMYNPGAYSGRPSYSRTFSDEGIKVQAKTIHAAKGLEAKVVFIIGLTEGNGGFPDIWLEDQNFSSDTKSKS

SEQ ID NO: 327 - DNA, 414 bp, Unknown
  Obtained from environmental sample
  misc_feature (1)..(414): n is a, c, g, or t
ttgacttttaaagaaagaattaagtataaagatagagtactccttatagaaataataagctctttccttagccttttcaaatccaatcaatatactattgagcaaattattggaaaggcgaatcaagaattaaatacgattctatttctatcgttcattaaaataattgaacccataatcaatgaatacgaaaaatacttaattgataacaaagttattgattttgatgatatgatagctaaagctactaattatttaatagaaagtaaatatttatcatcttttaaatatgtattggttgatgaatttcaggatatttcnnnnnnnnnnnnnnnnnnnnnnnnnnnnnnnnnnnnnnnnnnnnnnnnnnnnnnnnnnnnntgtgtaccagtaagttaccaatcgcctatatga

SEQ ID NO: 328 - protein, 137 aa, Unknown
  Obtained from environmental sample
  misc_feature (1)..(137): Xaa is any amino acid
MTFKERIKYKDRVLLIEIISSFLSLFKSNQYTIEQIIGKANQELNTILFLSFIKIIEPIINEYEKYLIDNKVIDFDDMIAKATNYLIESKYLSSFKYVLVDEFQDISXXXXXXXXXXXXXXXXXXXXCVPVSYQSPI

SEQ ID NO: 329 - DNA, 378 bp, Unknown
  Obtained from environmental sample
  misc_feature (1)..(378): n is a, c, g, or t
atggccgtattgaattacccctccatacaaccctttctcaattttctgaagtttgaaaaaagatattccccgcatacgctgacatcttacgaaactgatttggtttcattcattgattacctggaaatacaatacggggagacgcagctttctgaaatttcacatatttatataaggagctggctcgccttactaaaagaaaaaggccttacagccaaatcgtttaaccggaagatctccaagctcaaatctttttccaaatgtgaattgacggaaggcaggatacaatcaagaccgatgctacaggtgattagtcccaaatcaggtaaagcttaccttatttttaagaaaaataaccaggacatggtagaattctga

SEQ ID NO: 330 - protein, 125 aa, Unknown
  Obtained from environmental sample
  DOMAIN (9)...(94): Phage integrase, N-terminal SAM-like domain
  misc_feature (1)..(125): Xaa is any amino acid
MAVLNYPSIQPFLNFLKFEKRYSPHTLTSYETDLVSFIDYLEIQYGETQLSEISHIYIRSWLALLKEKGLTAKSFNRKISKLKSFSKCELTEGRIQSRPMLQVISPKSGKAYLIFKKNNQDMVEF

SEQ ID NO: 331 - DNA, 351 bp, Unknown
  Obtained from environmental sample
  misc_feature (1)..(351): n is a, c, g, or t
atgaaagtatcaggcttcacaataattaaaaacgggattaaatatttttacccgtttattgaggcaataacatcaatacttcctctctgtgatgaatttgttgttaatgtcggagattcggatgatgatactttgcaggctgtgagcgctctgcagagcaggaagataaggatacttgaaagtaagtgggatatgagcctccgtgagggagggaaattactttctgttgaaaccaataaagccctgaaattatgcagcggcgactggtgtttctatatccaggctgacgaggttctgcatgaaaagttatatccccgttgtaagaactactatggaaaaatacctggataa

SEQ ID NO: 332 - protein, 116 aa, Unknown
  Obtained from environmental sample
  misc_feature (1)..(116): Xaa is any amino acid
MKVSGFTIIKNGIKYFYPFIEAITSILPLCDEFVVNVGDSDDDTLQAVSALQSRKIRILESKWDMSLREGGKLLSVETNKALKLCSGDWCFYIQADEVLHEKLYPRCKNYYGKIPG

SEQ ID NO: 333 - DNA, 540 bp, Unknown
  Obtained from environmental sample
  misc_feature (1)..(540): n is a, c, g, or t
gtggaaggagtcgatgaaaatattatcgatttgacccccggatttaatgatcgcgccaatcgagatacggaagctgcgatcgctcaactacgatccaggtgggaaaccgagaaagatccggctgtgaagcaggatcttgaaatcctgatcaaaaccgcctctgatgcaatcaaatccaacgaattaaacagaaagtatcttgttccttactatgatgtatcacagacattctttctgggacttcgcgctcttctggacgatcaggtcgcacctggccggcgtcaagcggcgctcgtccgcctgaaaaaatattccggaatgcaggaaggctataaacccgttaccgttctggcgatggaacgaattcgcgagcaaatgcagcagcccggtttgttattcccatccaaacccgaactggacaagatgttgattaacgggccccacctgatccatggaatcgggaaattgtttcaaaagtattccatttcaggatatgaacgaggcttagggaaactgaaagaacaaacgctagatatgtaa

SEQ ID NO: 334 - protein, 179 aa, Unknown
  Obtained from environmental sample
  misc_feature (1)..(179): Xaa is any amino acid
MEGVDENIIDLTPGFNDRANRDTEAAIAQLRSRWETEKDPAVKQDLEILIKTASDAIKSNELNRKYLVPYYDVSQTFFLGLRALLDDQVAPGRRQAALVRLKKYSGMQEGYKPVTVLAMERIREQMQQPGLLFPSKPELDKMLINGPHLIHGIGKLFQKYSISGYERGLGKLKEQTLDM

SEQ ID NO: 335 - DNA, 426 bp, Unknown
  Obtained from environmental sample
  misc_feature (1)..(426): n is a, c, g, or t
ttgagacacgcaaaagtcgaaaaactcatcaatggaaatgtcacccggtgtgatgtgacacaacctcaaattctaccggatatgcccggaaaaacattcggtgttgtcgaggtcggtatggtgatggagtcaattacagaaaaaaaagctgaatggcaacaatatttgagtaatgtaatccgtgttattaaacccggtggaagactcatcatgactgttatccgggaggcagcagactaccgtgtagggaattatcgcttccctgcattgtcattaaaagaatcagaagtcctagcagagctgaaaaaattgggattgactgatatttccgtagacaagacacttaaagaaacagaagagacaaataaaaaagaaagactcggatacaagggtattatgttttttaccgcaagaatgcctgagtaa

SEQ ID NO: 336 - protein, 141 aa, Unknown
  Obtained from environmental sample
  misc_feature (1)..(141): Xaa is any amino acid
MRHAKVEKLINGNVTRCDVTQPQILPDMPGKTFGVVEVGMVMESITEKKAEWQQYLSNVIRVIKPGGRLIMTVIREAADYRVGNYRFPALSLKESEVLAELKKLGLTDISVDKTLKETEETNKKERLGYKGIMFFTARMPE

SEQ ID NO: 337 - DNA, 315 bp, Unknown
  Obtained from environmental sample
  misc_feature (1)..(315): n is a, c, g, or t
atggtaaagattgcaattaatggcttaggaagaattggtcgctgtgtgttaagagcggcatttgaatattctcgtaaggatattgaaattgtagcgctcaatggccccgcacctacagatacacatgtgcaccttttaaaatatgactccacgcacggcgcgtttccaaatgtcaaaaaaatcaatgaagatttaattgaaataaatggcaaacaaatacctattttccatgagcgcgatgccagcaaattgccatggggcaagcgttggtgtgagagtatagattcttggaatgatactgggcaagatgaatag

SEQ ID NO: 338 - protein, 104 aa, Unknown
  Obtained from environmental sample
  DOMAIN (2)...(104): Glyceraldehyde 3-phosphate dehydrogenase, NAD binding domain
  misc_feature (1)..(104): Xaa is any amino acid
MVKIAINGLGRIGRCVLRAAFEYSRKDIEIVALNGPAPTDTHVHLLKYDSTHGAFPNVKKINEDLIEINGKQIPIFHERDASKLPWGKRWCESIDSWNDTGQDE

SEQ ID NO: 339 - DNA, 468 bp, Unknown
  Obtained from environmental sample
  misc_feature (1)..(468): n is a, c, g, or t
ttgattgatgatgaagaacactgtttaggtaaaggtgggcaagccaaagtctattcactaaaagaaataaacgcgcctattttgcatgttaaatcagaacatttagtagcaaaagtgtataaaatgttgggaacttttgacgataataaaataacacaagatcaaatagaaaaagaacgtcacatattaaaaatcacgcataattatcgtggatcctgtgactatacatacaaagaacaggacggaaatatatatactgcttttgttacgttaatgccatttattgagggacataatttaacggaaattttttcttcaaaaaagaataatcattcacaacgtaaaaaatttgtcagaacatatcttccctttgatatactttatgaagttattcttcnnnnnnnnnnnnnnnnnnnnnnnnnnnnnnnnnnnnnnnnnnnnnnnnnnnnnnnnnnnnnnnnnnnntaa

SEQ ID NO: 340 - protein, 155 aa, Unknown
  Obtained from environmental sample
  misc_feature (1)..(155): Xaa is any amino acid
MIDDEEHCLGKGGQAKVYSLKEINAPILHVKSEHLVAKVYKMLGTFDDNKITQDQIEKERHILKITHNYRGSCDYTYKEQDGNIYTAFVTLMPFIEGHNLTEIFSSKKNNHSQRKKFVRTYLPFDILYEVILXXXXXXXXXXXXXXXXXXXXXXX

SEQ ID NO: 341 - DNA, 426 bp, Unknown
  Obtained from environmental sample
  misc_feature (1)..(426): n is a, c, g, or t
atggataaaataaaaattagaatagttgtattggcttttgccttatttggctttcaaaaaacagaatttttaaaagagaaaactcaaaaagctatagtttcggatacattaagttggaagaaactaggacaaattaaatttgttaaaaaacaacataaagattacgggaacattgattttcctgtaattagtcctgaagttaaaaagtatcataataaacgaatttttatgtcgggcttcattgtacctatagataatgttaattatgcattgagtaaaaatgtgtttgcatcttgtttctttggtgggaaagcaggacccgagactattatgggaattaaatttaaagcaggtaaacttaagttgcgtacagatcaatatgtaaccttggaaggaatactgacagtcactggacataaatcctga

SEQ ID NO: 342 - protein, 141 aa, Unknown
  Obtained from environmental sample
  misc_feature (1)..(141): Xaa is any amino acid
MDKIKIRIVVLAFALFGFQKTEFLKEKTQKAIVSDTLSWKKLGQIKFVKKQHKDYGNIDFPVISPEVKKYHNKRIFMSGFIVPIDNVNYALSKNVFASCFFGGKAGPETIMGIKFKAGKLKLRTDQYVTLEGILTVTGHKS

SEQ ID NO: 343 - DNA, 357 bp, Unknown
  Obtained from environmental sample
  misc_feature (1)..(357): n is a, c, g, or t
atgggaactcttggatatctccacgcgaaatataactgtcacattataacgaatggttttgccgaagtacaatttaaaaagcttagcaattcaggaattgatcatttttttgaaacagtgactaattctgaaatgcctggagtaaaagaaccacattcgggaatttttgaacatgctttgtcaaaagcttctgctgaaaaagaagaaagcgtgatgattggagattgtttagatgctgatgtatctggggcaataaattttggaatgcaatctattttttttaattcagaaaaaattgatgtttcaaaagatgttaatcaaatcactaacttagtcgaacttaaaaacctgttttaa

SEQ ID NO: 344 - protein, 118 aa, Unknown
  Obtained from environmental sample
  misc_feature (1)..(118): Xaa is any amino acid
MGTLGYLHAKYNCHIITNGFAEVQFKKLSNSGIDHFFETVTNSEMPGVKEPHSGIFEHALSKASAEKEESVMIGDCLDADVSGAINFGMQSIFFNSEKIDVSKDVNQITNLVELKNLF

SEQ ID NO: 345 - DNA, 612 bp, Unknown
  Obtained from environmental sample
  misc_feature (1)..(612): n is a, c, g, or t
ttgcttgcattaaccataggcacttttatggcacagcctgctttactgtttatgtttgataaagaaattaaacttcaatcctcgctcgataatgaaaaaaagaaaatacaaaagcgggatgagctcgatgcattgtataaaaacaggaaagaagaattaacggttcaaataactcaattaaaaagtgagctcagtaaaaaatatgacgatgtagacaaagcaagagaaaattatattgctgaaagtgatggaaccggcggaaccggaaaaattggaattaaagacatagcgttggccaagaaaaaagagtatgaaaaattagagtcagaatatcgggatatttccaatatccaacaaccaaaaataaatagatttgaaaaagaactgcaagacattactgacacagtaaaaaaagaagaacaacaatttactacctactttaataatggatttttaacaagaattgaggctctgaataatcttataaaaaacaatgctgcactgcagtttaggtatcatttacttgtaataattgcattatggatagaacttatgccggtactgcaaacacattgcttacttctggtacctatgatgaaacggtcagtttaa

SEQ ID NO: 346 - protein, 203 aa, Unknown
  Obtained from environmental sample
  misc_feature (1)..(203): Xaa is any amino acid
MLALTIGTFMAQPALLFMFDKEIKLQSSLDNEKKKIQKRDELDALYKNRKEELTVQITQLKSELSKKYDDVDKARENYIAESDGTGGTGKIGIKDIALAKKKEYEKLESEYRDISNIQQPKINRFEKELQDITDTVKKEEQQFTTYFNNGFLTRIEALNNLIKNNAALQFRYHLLVIIALWIELMPVLQTHCLLLVPMMKRSV

SEQ ID NO: 347 - DNA, 444 bp, Unknown
  Obtained from environmental sample
  misc_feature (1)..(444): n is a, c, g, or t
gtgaaggcagccgaaatacctcactacaggggctgcnnnnnnnnnnnnnnnnnnnnnnnnnnnnnnnnnnnnnnnnnnttgatgaatgagatcaaaagagtgcttaaaccgggtggaaaagtgcttattattgatatggtaactgttccggtgaagaagaaagagatcccccgttttctggttcacaaagtgaaacagttctcacaaaaattttcaaataaggagtttaacaacaatctgaagaatttggtaaatgatcccgactggaaatatatgcttcaatataatcccatcagggcagaacatgaaatgaaatggtatctggaaagtcgttttccgggtaagaaggtggataagatcaatataggctaccattcatgtatgctggcttttgattcgggcaatatcgaaaatatgaacgatatttatttaacttatccataa

SEQ ID NO: 348 - protein, 147 aa, Unknown
  Obtained from environmental sample
  misc_feature (1)..(147): Xaa is any amino acid
MKAAEIPHYRGCXXXXXXXXXXXXXXLMNEIKRVLKPGGKVLIIDMVTVPVKKKEIPRFLVHKVKQFSQKFSNKEFNNNLKNLVNDPDWKYMLQYNPIRAEHEMKWYLESRFPGKKVDKINIGYHSCMLAFDSGNIENMNDIYLTYP

SEQ ID NO: 349 - DNA, 696 bp, Unknown
  Obtained from environmental sample
  misc_feature (1)..(696): n is a, c, g, or t
atggatgcccgcgaccgctctattggtattattttatcaggaacaggtagcgatggaacgaaaggagccacaaccataaagaaccagggtggcgtagtagtaatccaggatcctgttacggcagcgtttgacggtatgccaaataatgcactatctgcgggccttggaaacctggtcattccaccggaaatgatggcgcaggagctggtagaatggttgaatgaatcaccgcaaatgaaagcgtttcaaaccgaaagctcgaaagaagaaacgctggtgagggaattattgcaacaggtcaaggacgattcgggtctcgatttcagccattacaaaagaccaacaatattgcggcgactggcaaaacgcttattggaaatcgggatcaattcgattaaaaaatatctcgactactttgccctccatccggatgagctatctgttataagcaaagaattcctgatcaatgtcagcggtttttttcgcgacaaagaagctttggatgtgctctctgataaagtgattcccgcgctgatgacagataaaaaccaggtgatgggattaaagcctggtgtgtcgcctgcagtaccggcgaagaagcttactcgatctccatcatttgagggaatggctggattaaaacaccggaaggacaccctattaaaattctgctacgatattgacgggatgcgctga

SEQ ID NO: 350 - protein, 231 aa, Unknown
  Obtained from environmental sample
  misc_feature (1)..(231): Xaa is any amino acid
MDARDRSIGIILSGTGSDGTKGATTIKNQGGVVVIQDPVTAAFDGMPNNALSAGLGNLVIPPEMMAQELVEWLNESPQMKAFQTESSKEETLVRELLQQVKDDSGLDFSHYKRPTILRRLAKRLLEIGINSIKKYLDYFALHPDELSVISKEFLINVSGFFRDKEALDVLSDKVIPALMTDKNQVMGLKPGVSPAVPAKKLTRSPSFEGMAGLKHRKDTLLKFCYDIDGMR

SEQ ID NO: 351 - DNA, 351 bp, Unknown
  Obtained from environmental sample
  misc_feature (1)..(351): n is a, c, g, or t
atgcaccagttgttccaaaacctaatcagcaatgcgttgaagtttaatgataaggttacaccggttatatccatccaggaaaaaaagatctccccaaaaattgcaacggaatataagatcaatccccacaggtacgcgtgcatcagtatcaaagacaacggtattggtatcgaagaacagtttaaagaaaaaatatttgggatatttcaacgcctccatggcaaccgttatgacggtacaggtattggcctggctatctgtaaaaaaatcgtggagaataacaggggacatcttttactcgaaagcacgccgggtaagggatctgagtttatgattttattacctttataa

SEQ ID NO: 352 - protein, 116 aa, Unknown
  Obtained from environmental sample
  DOMAIN (1)...(116): Histidine kinase-, DNA gyrase B-, and HSP90-like ATPase
  misc_feature (1)..(116): Xaa is any amino acid
MHQLFQNLISNALKFNDKVTPVISIQEKKISPKIATEYKINPHRYACISIKDNGIGIEEQFKEKIFGIFQRLHGNRYDGTGIGLAICKKIVENNRGHLLLESTPGKGSEFMILLPL

SEQ ID NO: 353 - DNA, 525 bp, Unknown
  Obtained from environmental sample
  misc_feature (1)..(525): n is a, c, g, or t
gtgtatttcgacattctgtacgccaaaattccaaaatttgaaaaagggtttaacaaacaaaccaaagaacaatggttacgggataatttatattatgcttttaaaacaacagataaatatgtttggttttataatgaaagaatagactggtggaaaaacaaagtagattccggggtggcagatattattaacgaagtaaaaaataaaataaatactgacctaaataacaattcttcaagagctgctggctacacttcagcattaaattttaaaaataaaaagcctgatgattaccgggcactatcttatacgtatcaaaaagataaaaaccagctggaaataaagctactgaagaatgacgttaggcatcttttaatatataacaattcgcatttaatttataatatcgacaaccctccatcaagcctgaccatcaatttaaaaaataagtatgcttacaaaggcaacttgataataatggcaaaagatagcaagggtaaatcttcggtttctttggttaattga

SEQ ID NO: 354 - protein, 174 aa, Unknown
  Obtained from environmental sample
  misc_feature (1)..(174): Xaa is any amino acid
MYFDILYAKIPKFEKGFNKQTKEQWLRDNLYYAFKTTDKYVWFYNERIDWWKNKVDSGVADIINEVKNKINTDLNNNSSRAAGYTSALNFKNKKPDDYRALSYTYQKDKNQLEIKLLKNDVRHLLIYNNSHLIYNIDNPPSSLTINLKNKYAYKGNLIIMAKDSKGKSSVSLVN

SEQ ID NO: 355 - DNA, 339 bp, Unknown
  Obtained from environmental sample
  misc_feature (1)..(339): n is a, c, g, or t
ttgatgacagtggacaaattaatggagcaaattttccccaagaaacaagaagtaaaacctgtcaagaaaaaagagtcaaaacctgtcagcgatgtaagtgtcgaagacttactcaagaagaatgaggagaacgaggatgaagaagagaaacagggagaggaagaagatgagtatgaattttcttggaattttactatttgtttactcgatctttcaagtttcttaaacctttctggaaagggaattggaaaactgaatggcttgattcagtacaatcacgtgacaagaattgatctttcaaataatagtattcgtaagattttctacaagtacatttga

SEQ ID NO: 356 - protein, 112 aa, Unknown
  Obtained from environmental sample
  misc_feature (1)..(112): Xaa is any amino acid
MMTVDKLMEQIFPKKQEVKPVKKKESKPVSDVSVEDLLKKNEENEDEEEKQGEEEDEYEFSWNFTICLLDLSSFLNLSGKGIGKLNGLIQYNHVTRIDLSNNSIRKIFYKYI

SEQ ID NO: 357 - DNA, 603 bp, Unknown
  Obtained from environmental sample
  misc_feature (1)..(603): n is a, c, g, or t
atggtcaagactttagtgtgttctgaacaaaagattgcagaggcacaaaaatttctaacaaaattatggaatattggaagatgtgtttcctcatttgaattcgttcgaacagtcgaagttgatttattgccttcggataagtggattttaggaaagttgtctaatttggtagctgaatgcttcaaggggtacagagaatataatttctttattccagcttcacaaataaaagattttacttggaatatttccgcttcccactacctaaaattagtaaaatcacgcgcgtacaacgatcaaaaccaaaacaacagatattccgcattatatgcgctccataaatgtttttcagtaatatggttactattagctcctatttgcccatttattacagaaaaattatggactacgatatattctaaagaaagtattcatttacaaaagtttccagttcagagtaatgactatgaagagatgtgtaaatttacaaaagccattacagatttcaattcattactgtggacaacaaaaagagaatcagaatttgaaaatggtaaggcgatattcattgagagatcctataaaggcgaaatttccagatga

SEQ ID NO: 358 - protein, 200 aa, Unknown
  Obtained from environmental sample
  misc_feature (1)..(200): Xaa is any amino acid
MVKTLVCSEQKIAEAQKFLTKLWNIGRCVSSFEFVRTVEVDLLPSDKWILGKLSNLVAECFKGYREYNFFIPASQIKDFTWNISASHYLKLVKSRAYNDQNQNNRYSALYALHKCFSVIWLLLAPICPFITEKLWTTIYSKESIHLQKFPVQSNDYEEMCKFTKAITDFNSLLWTTKRESEFENGKAIFIERSYKGEISR

SEQ ID NO: 359 - DNA, 576 bp, Unknown
  Obtained from environmental sample
  misc_feature (1)..(576): n is a, c, g, or t
atgatgttagttagtattgttttactgttagttgttattttctcttattatttattttcccgattacaacttattcgcagtcaaaaaaatgtaattgaaaaacaaaaacatttggtagacgaaaaacaaaaagagatcattgatagcattacttacgctaaacgcttgcagcaagctattcttccaccattgagtttaattgaaaaacatgtaaagaataattttgttctatataaacccaaagatatcgttgccggagatttttattggatgcattacgatgagcataatacatcaacgatatatttagcagcagcagactgtacaggtcatggtgtgcctggtgccatggtaagtgtagtatgtagcaatgcgttaaacagaaccgttaaagaatttaaaattactgagccaggaaaaattttagataaggttcgcgacttggttattgaaaccttcgagaaaagcgacagcgaagtacaagatggtatggatatcaggttgtgtactattaattttgaaactaaagaagtgaactgggctggtgataataatcctttgtggatgatagccann

SEQ ID NO: 360 - protein, 192 aa, Unknown
  Obtained from environmental sample
  misc_feature (1)..(192): Xaa is any amino acid
MMLVSIVLLLVVIFSYYLFSRLQLIRSQKNVIEKQKHLVDEKQKEIIDSITYAKRLQQAILPPLSLIEKHVKNNFVLYKPKDIVAGDFYWMHYDEHNTSTIYLAAADCTGHGVPGAMVSVVCSNALNRTVKEFKITEPGKILDKVRDLVIETFEKSDSEVQDGMDIRLCTINFETKEVNWAGDNNPLWMIAX

SEQ ID NO: 361 - DNA, 639 bp, Unknown
  Obtained from environmental sample
  misc_feature (1)..(639): n is a, c, g, or t
atgagtgatggaacaaatggatttgaacgtattcttcccggtgctgatagaatgtatcccgatacagatcttcctcctaaaaaaattacaagtgaaagattaaataaaataaaattatggttgcctgaacagatttggaaaaggattgaatggtacaacaaactttccattcctaaagacactattgaggaactctctgtctctaaatatgcggagctttttaagaaagcagtaaatgattggaaaataaatccaacgactgcagcagttttattaattcaatatcccaaaagattgataaagtatggctgtatgattgaatggctgcaagaaggaatgtttgaaaatattttaaaatcctatgccgatggaaaaattccaaatgatgcattgcttacaacactaagaacagttgcagaacttggtgcatttactgaggaagtaattaaaaatcctgcaggcaaaaaagaagttgatgaagtcattaaatcagcacaaacagaatgtgataaaatgaagattataaatccagaaaagaaaaatgaaatattgttaggaatgattatgaaaaaactccggggcagaatcccagcaaaaactattgcagataaaataggttttgtgaaaggagctaaataa

SEQ ID NO: 362 - protein, 212 aa, Unknown
  Obtained from environmental sample
  misc_feature (1)..(212): Xaa is any amino acid
MSDGTNGFERILPGADRMYPDTDLPPKKITSERLNKIKLWLPEQIWKRIEWYNKLSIPKDTIEELSVSKYAELFKKAVNDWKINPTTAAVLLIQYPKRLIKYGCMIEWLQEGMFENILKSYADGKIPNDALLTTLRTVAELGAFTEEVIKNPAGKKEVDEVIKSAQTECDKMKIINPEKKNEILLGMIMKKLRGRIPAKTIADKIGFVKGAK

SEQ ID NO: 363 - DNA, 660 bp, Unknown
  Obtained from environmental sample
  misc_feature (1)..(660): n is a, c, g, or t
gtgccattaaacagcatcaaaaaaatatttactcattatcaggcggcaagacaatgcagtaaatttttaaaatctattcccaatgccgaagttgaattgttacctgatacagcaaaatctgtagaatttataaaagaaaaaggggataaaacttttgcagcaatagcaagtagagaagccgcagagatatttgatgttgttgtaataaaagaagatattgcaaatcagcaaggcaactttacaagatttttaatttgttcacgcgattcaataaaagttgatgaaagaattcccgctaaaacctccttaattcttgctacttcacataaaccgggatcactggttgaaactttatctgtttttagagattaccagatcaatatgacaaaacttgaatcacgtccgattataggaaatccctgggaagaaatgttttatcttgattttcaaggaaacattcagaatcaaaaagttaaagaattattagacgaagttggaaagcatacccgctatttaaaagtgttgggatgttatccggctaaagacgttgaaaaaactaaagttgaaaaagtaacaacagatcaacagagattaaaagaaaaaattgttgctcctcaaattatctctcagaaaaaatcaacttcaaaagtttctttataa

SEQ ID NO: 364 - protein, 219 aa, Unknown
  Obtained from environmental sample
  DOMAIN (1)...(91): Prephenate dehydratase
  misc_feature (1)..(219): Xaa is any amino acid
MPLNSIKKIFTHYQAARQCSKFLKSIPNAEVELLPDTAKSVEFIKEKGDKTFAAIASREAAEIFDVVVIKEDIANQQGNFTRFLICSRDSIKVDERIPAKTSLILATSHKPGSLVETLSVFRDYQINMTKLESRPIIGNPWEEMFYLDFQGNIQNQKVKELLDEVGKHTRYLKVLGCYPAKDVEKTKVEKVTTDQQRLKEKIVAPQIISQKKSTSKVSL

SEQ ID NO: 365 - DNA, 609 bp, Unknown
  Obtained from environmental sample
  misc_feature (1)..(609): n is a, c, g, or t
gtgcataactcttcaccaatgaaaaatcttttaattctttttgcctcttttattttgagttctgtttcttttgctcaaacaagtgtgaacaaacttcctactattgacaaatcgccaatggacatggcgtactaccctatcaattacccggttttaaaaattcaggataaggccactggacctttgattgcacgggttatatatagccggccgcaaaaaaacaaccgtgtagtatttggcgagctggtagaatataatactgtttggcgcatgggagcaaacgaggccactgaaatagagttttatcgggatgtaaaaattggcggtaaaaaaattttaaaaggaaagtataccttatatgcccttgtaaccccaaatgagtggacagtaattttgaataaagaaagggatacctggggcgcattcaaatacgatcagaaaaaagatgttgttcgaacaaccgttcctgtgcaaaaaaatatggagcctgcggaagtatttacggtattttttgacaagataaccaacggcattaattttaaatattgcatgggacacggtaattgtttcattgccaatactattgaaatacagtattttccggcttga

SEQ ID NO: 366 - protein, 202 aa, Unknown
  Obtained from environmental sample
  SIGNAL (1)...(21)
  misc_feature (1)..(202): Xaa is any amino acid
MHNSSPMKNLLILFASFILSSVSFAQTSVNKLPTIDKSPMDMAYYPINYPVLKIQDKATGPLIARVIYSRPQKNNRVVFGELVEYNTVWRMGANEATEIEFYRDVKIGGKKILKGKYTLYALVTPNEWTVILNKERDTWGAFKYDQKKDVVRTTVPVQKNMEPAEVFTVFFDKITNGINFKYCMGHGNCFIANTIEIQYFPA

SEQ ID NO: 367 - DNA, 363 bp, Unknown
  Obtained from environmental sample
  misc_feature (1)..(363): n is a, c, g, or t
gtgggcatgcaagtgctatgcagtcattcggaagaatatgacacggtatgccttggaattattccgctggaggttaaaaagtttgaaagccatcgacaggctattgaagtgccgcagataggatggtacaatatcgataatctcaaatcagaattgtttaaagacattaaagacaaaagttggatttacaatgttcatagctactatgcagaagatagccaatacactattgccacctgcaattatggaattgaatatgcagccgctgtaaaaaaagataatttttatggtgtgcagtttcacacggaaaaaagtgctgtcaccggagataaaattctaaaaaactttatcgaaaatacttaa

SEQ ID NO: 368 - protein, 120 aa, Unknown
  Obtained from environmental sample
  misc_feature (1)..(120): Xaa is any amino acid
MGMQVLCSHSEEYDTVCLGIIPLEVKKFESHRQAIEVPQIGWYNIDNLKSELFKDIKDKSWIYNVHSYYAEDSQYTIATCNYGIEYAAAVKKDNFYGVQFHTEKSAVTGDKILKNFIENT

SEQ ID NO: 369 - DNA, 828 bp, Unknown
  Obtained from environmental sample
  misc_feature (1)..(828): n is a, c, g, or t
ttgttttcgttgccagctcaaataannnnnnnnnnnnnnnnnnnnnnnnnnnnnnnnnnnnnnnnnnnnnnnnnnnnnnnnnnnnnnnnnnnngcaatacacggtgacaaatatgattactcaaaggttaattacgtaaatgttaaacaaactgtgacaattatttgtagagaacacggtgaatttttacaaatcccaaattctcatttggcaaaaaaaggctgcacgaaatgtggaatacaaaaattatcaaaattatttcgaacagatgctgcagtgtttatagaaaacgcaatttccaaacacggaaataaatttgattattctgaaatgcaatatgttaatacggatacaaaaattactattatatgcaataaacatggtagatttgagagaacaccgtctcttcatcttatcacaataaatggtggctgtgttgaatgtcgctcggaaacaatttcaaaaaagagaggaaacaccgaaaattttattgaaaaatcaatggtaattcacggcgataaatatgactattcaaaagtttgttatgaaagcagcacgaaaaatgtgacaattatttgtggtgaacacggggaattttatcaatatccaaccaaacatttaagtggaattggctgcaaaaaatgcgatcgtcaaatacaggatgcacagttatcgaaaattaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 370 - protein, 276 aa, Unknown
  Obtained from environmental sample
  misc_feature (1)..(276): Xaa is any amino acid
MFSLPAQIXXXXXXXXXXXXXXXXXXXXXXXAIHGDKYDYSKVNYVNVKQTVTIICREHGEFLQIPNSHLAKKGCTKCGIQKLSKLFRTDAAVFIENAISKHGNKFDYSEMQYVNTDTKITIICNKHGRFERTPSLHLITINGGCVECRSETISKKRGNTENFIEKSMVIHGDKYDYSKVCYESSTKNVTIICGEHGEFYQYPTKHLSGIGCKKCDRQIQDAQLSKINTXXXXXXXXXXXXXXXXXXXXXXXXXXXXXXXXXXXXXXXXXXXXXXX

SEQ ID NO: 371 - DNA, 387 bp, Unknown
  Obtained from environmental sample
  misc_feature (1)..(387): n is a, c, g, or t
atgagctccctcaatttaaaggttctcattggagaaatgagcatagtaggaccaagaccgcatatgcatattgactgcgacgatttttcaaaagtgatagctaattataaattcagaagcatctcaaaaccgggtattaccggcctggctcaggttaaaggttgccggggccctgtaaaagatgaagaatctattttccgcagatttcaatgggattgttttaatgttcgcaaccaggattataaattagaatgtcgcattattggactcaccatcatatgcactctaaaatcccttaattcagtaatctttaatagcaagaaaaaacttgacaagaaagagatgctcatcaactaccagttaaacgcaggtgaatacctgaattaa

SEQ ID NO: 372 - protein, 128 aa, Unknown
  Obtained from environmental sample
  misc_feature (1)..(128): Xaa is any amino acid
MSSLNLKVLIGEMSIVGPRPHMHIDCDDFSKVIANYKFRSISKPGITGLAQVKGCRGPVKDEESIFRRFQWDCFNVRNQDYKLECRIIGLTIICTLKSLNSVIFNSKKKLDKKEMLINYQLNAGEYLN

SEQ ID NO: 373 - DNA, 456 bp, Unknown
  Obtained from environmental sample
  misc_feature (1)..(456): n is a, c, g, or t
atgaataaaaggatcataattctgatttccgcaacggtggtatccatttctctccaggtttataacaggatgagaggcaataaaaccattgtgggagatcttattgaacagatactcaaaaaagaggttgagttcaaaaaaggagaatatggttatgatcttgaatttctgaagaagcacctgaaatgtatagagctgttcaggggtgatcaaaggctgattattgtcccgcaataccaggacagagtgatgaccagcacttcaaatggtctgaaaggatatccttacggatggataaatcatgaactgatagcctccaaaaagattctggaacattttaatccttatggaggtgaagaacgcttatggctaggcccgaaggcagggcaaatctctcttaactcccaaagattttcaattcccgggaaaactggttgtgcaaagcgtggcactgag

SEQ ID NO: 374 - protein, 152 aa, Unknown
  Obtained from environmental sample
  SIGNAL (1)...(20)
  misc_feature (1)..(152): Xaa is any amino acid
MNKRIIILISATVVSISLQVYNRMRGNKTIVGDLIEQILKKEVEFKKGEYGYDLEFLKKHLKCIELFRGDQRLIIVPQYQDRVMTSTSNGLKGYPYGWINHELIASKKILEHFNPYGGEERLWLGPKAGQISLNSQRFSIPGKTGCAKRGTE

SEQ ID NO: 375 - DNA, 621 bp, Unknown
  Obtained from environmental sample
  misc_feature (1)..(621): n is a, c, g, or t
gtgnnnnncgctgtcactgctntcgagcaacgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaacaccttggcaataaagttaaacttgaaagtgaagtaacatcaattcaaaaaacagaaaagggattccaggttaattttatacagaatggaactcagcataatattgattgcaataaaattatttcaactatcccggcttatattgccgtaaatctgttttcacattttgatgatggtttaataaaacattttaatgagatatattatccgcctgtccttgtcctattccttgtttataaaaaagaaaacattaaacgtccattagatggatttggtttccttataccttctaaagaaagaaaatctttccttggtgcaatctggagttcagtaatattcccaaacagatctgatgatgacacggcttcatttacttggtttgtcggcggtgcaagaaaccccgaaataggaagtattgataaagaaatattaatcggcaaagttaaaaaaagagtttga

SEQ ID NO: 376 - protein, 206 aa, Unknown
  Obtained from environmental sample
  misc_feature (1)..(206): Xaa is any amino acid
MXXAVTAXEQRXXXXXXXXXXXXXXXXXXXXXXXXXXXXXXXXXXXXXXXXXVKHLGNKVKLESEVTSIQKTEKGFQVNFIQNGTQHNIDCNKIISTIPAYIAVNLFSHFDDGLIKHFNEIYYPPVLVLFLVYKKENIKRPLDGFGFLIPSKERKSFLGAIWSSVIFPNRSDDDTASFTWFVGGARNPEIGSIDKEILIGKVKKRV

SEQ ID NO: 377 - DNA, 450 bp, Unknown
  Obtained from environmental sample
  misc_feature (1)..(450): n is a, c, g, or t
ttgatcggggtcagtgctgatctgtactgtttcgctcctgctctgaaacagttcttttgcgcgattgacggcgcccaggattcgggccagcgtcacaggctttacaatatagtcggccacgttcaactcaaatgcctcaacggcgtaatgttctttggcggtgataagaataatgataggccggcggtcaaggttttttaccaactcaattcccgtcattcctggcatttcaacgtccagaaagaccaggtctaccgtttcggatttgaggtaattgaaagctgcaagcggatcttcaaattcctctttcagattaagacttccaacctgggcgacaagttttttaagcgcaatccgcgccatcttattgtcatcaacaataatacagttcataaaacggccattttagtacctttaaatttacagaaaactaaattaaaccgccactaa

SEQ ID NO: 378 - protein, 149 aa, Unknown
  Obtained from environmental sample
  misc_feature (1)..(149): Xaa is any amino acid
MIGVSADLYCFAPALKQFFCAIDGAQDSGQRHRLYNIVGHVQLKCLNGVMFFGGDKNNDRPAVKVFYQLNSRHSWHFNVQKDQVYRFGFEVIESCKRIFKFLFQIKTSNLGDKFFKRNPRHLIVINNNTVHKTAILVPLNLQKTKLNRH

SEQ ID NO: 379 - DNA, 531 bp, Unknown
  Obtained from environmental sample
  misc_feature (1)..(531): n is a, c, g, or t
atgtccataactgtaaaaaaccttacaaagatctacggtgagcaaaaagcagtgaacgacatttcctttttcattcaacagggtgagatcgtcggtttcctggggccaaatggagccggcaagtctacaactatgaagatgatcacgggatacctggaaccaagtgctggtgatattgatgttagtggagtagatgtaaaaagaattcctcttgatgccaaaaagaaaattggctacctgcccgaatcgaatgctttgtactacgatatgtacgtaagggagtatttgggctttattgcagatgtgcatagaatagacaataagcagcaagcaataaacaaagtgattgagcaagtgggactaactcctgaggccaaacacagagtgggacaactttcaaaaggatacaagcaaagagtaggattagctgacgacttattacatgatcccgaaggttcgatattagatgaaccacaagtggatgggtcccaatcgaattttgaatccgaaagtattaacgacagggcaann

SEQ ID NO: 380 - protein, 177 aa, Unknown
  Obtained from environmental sample
  DOMAIN (28)...(175): ABC transporter
  misc_feature (1)..(177): Xaa is any amino acid
MSITVKNLTKIYGEQKAVNDISFFIQQGEIVGFLGPNGAGKSTTMKMITGYLEPSAGDIDVSGVDVKRIPLDAKKKIGYLPESNALYYDMYVREYLGFIADVHRIDNKQQAINKVIEQVGLTPEAKHRVGQLSKGYKQRVGLADDLLHDPEGSILDEPQVDGSQSNFESESINDRAX

SEQ ID NO: 381 - DNA, 687 bp, Unknown
  Obtained from environmental sample
  misc_feature (1)..(687): n is a, c, g, or t
ttggacagcactgaatttttatttggacacagagcagtctatttcggagagtatgatatgggggttatgaccagggaccaaaaagtaaagattgccccggagtacagcgacatttcaaagttgaagggattatacacagtaacaaagcaggaatacagtatacttgacaaaagtccgacaggtgatgttcgttcgcttacattcttttacggtctgctggacaacaatggaaaacttttgatcccctgcaaataccattacctggaacgaaggaatgacagtctcatagtgttaacaataaataacaatgagaaaagtcattccgccctatttaataccagtggtgaacaattaactggctttgattacatggtcttcgggaagttcactgaaggagttgcaaaggcgagaattgatgacaaattcggcttcatttatccaacagggaaaattgccatcccggtgatcttcgattattgcgaagactttaataaaggctacgcaataattaagcaaaaagataaatggggagctattgacaggcaggctacaattgtcattgagccgaatttggaataccaggctgttaagtccctgctgaaagagaacgttgacgcggagctgattacgggacaggctggacggtcacccagcctcatgtcccaggatagttaccaaaggccttag

SEQ ID NO: 382 - protein, 228 aa, Unknown
  Obtained from environmental sample
  misc_feature (1)..(228): Xaa is any amino acid
MDSTEFLFGHRAVYFGEYDMGVMTRDQKVKIAPEYSDISKLKGLYTVTKQEYSILDKSPTGDVRSLTFFYGLLDNNGKLLIPCKYHYLERRNDSLIVLTINNNEKSHSALFNTSGEQLTGFDYMVFGKFTEGVAKARIDDKFGFIYPTGKIAIPVIFDYCEDFNKGYAIIKQKDKWGAIDRQATIVIEPNLEYQAVKSLLKENVDAELITGQAGRSPSLMSQDSYQRP

SEQ ID NO: 383 - DNA, 342 bp, Unknown
  Obtained from environmental sample
  misc_feature (1)..(342): n is a, c, g, or t
gtgaccatggcgaataaagcttgggcactgcccgaagaggacatggtttcagatgaccgctatgcctcgatgattaattggattcgcaaattcaaattgggtcacaaggtcgaaatcaaacaattcgattcacaaggggaggcaagtctgaatgtttttcctaaattcctttataagcagttcacggtctccataatgggaatctggtactaccaggaatctggggggtttacattggcgaattcgaaaacaattccaaaaggtcccgaatcctcacagtggaaatattcccggaaagctccaaaaatcggggggacagggaaagttcaatggtccgattga

SEQ ID NO: 384 - protein, 113 aa, Unknown
  Obtained from environmental sample
  misc_feature (1)..(113): Xaa is any amino acid
MTMANKAWALPEEDMVSDDRYASMINWIRKFKLGHKVEIKQFDSQGEASLNVFPKFLYKQFTVSIMGIWYYQESGGFTLANSKTIPKGPESSQWKYSRKAPKIGGTGKVQWSD

SEQ ID NO: 385 - DNA, 609 bp, Unknown
  Obtained from environmental sample
  misc_feature (1)..(609): n is a, c, g, or t
gtgtggacagtattctactttacttatcactattttgatcagtataacaaatcgctcaagtatgaagcgtccatgattgaaatcgagttgaacaatctgaagtcgcagcttaatccgcattttatctttaacgcgttgaatagcatccgggcgttggtggatgaaaatcccaggaagtcgaagcaagccatcaatcagttgagcaatattctccggaagtctttggcatctgacaagcaggggctcaccaacttcgatgatgaactcaagatcgtgaaagactaccttgggctggaaagcatacgctttgaagagcgcctgagaacggagttcgatattcatccggaatcacagcgatttcttgtccctccactcatgattcaaacgctggtggagaacggcatcaaacatggtatttcaagactcacgcccggcgggctgatccaggtgaaaaccaccattgatggcgacaaactgaagatccagatccggaacagtggccacatggtgaatggggtgaagcggggtaaatccggattaggcatcaagaataccgttcaaaggctcaaactgttgtatggtgatgatgcatctttcaaattgccatga

SEQ ID NO: 386 - protein, 202 aa, Unknown
  Obtained from environmental sample
  DOMAIN (29)...(112): Histidine kinase
  misc_feature (1)..(202): Xaa is any amino acid
MWTVFYFTYHYFDQYNKSLKYEASMIEIELNNLKSQLNPHFIFNALNSIRALVDENPRKSKQAINQLSNILRKSLASDKQGLTNFDDELKIVKDYLGLESIRFEERLRTEFDIHPESQRFLVPPLMIQTLVENGIKHGISRLTPGGLIQVKTTIDGDKLKIQIRNSGHMVNGVKRGKSGLGIKNTVQRLKLLYGDDASFKLP

SEQ ID NO: 387 - DNA, 513 bp, Unknown
  Obtained from environmental sample
  misc_feature (1)..(513): n is a, c, g, or t
atgataatgaccatcatgttgactcaggagaaagtattgaatgcaagattactaaatatgctgattggtgattgggacaggcttgccgatcaatggaaatggggaacatcggatactggaaaaggtacattatattttcccataccgaaagacagggaccaggcattctttaattccaatgggatactgttaaaactggtttcgaaaaaatatatgcctttcttacagggctttaaaactaagatcagagatatcaatgggtttactacttctgcaagggatttcgaccgtttctttatgaataacctgaacgaagaaacctggaaacggattactgcggagtttcaacttaaaatgaccaatgaggtcattgatcatgctgtaaacaaaatttccgtgcaccgatcgctgtacttgatgcaaagatggtgtccagataaactgaaagacaggagagataatctctccaaatatgtttaccctattataggtcatccaagcaaagtactgtag

SEQ ID NO: 388 - protein, 170 aa, Unknown
  Obtained from environmental sample
  misc_feature (1)..(170): Xaa is any amino acid
MIMTIMLTQEKVLNARLLNMLIGDWDRLADQWKWGTSDTGKGTLYFPIPKDRDQAFFNSNGILLKLVSKKYMPFLQGFKTKIRDINGFTTSARDFDRFFMNNLNEETWKRITAEFQLKMTNEVIDHAVNKISVHRSLYLMQRWCPDKLKDRRDNLSKYVYPIIGHPSKVL

SEQ ID NO: 389 - DNA, 738 bp, Unknown
  Obtained from environmental sample
  misc_feature (1)..(738): n is a, c, g, or t
gtgggggnccgtgatcgcggtatgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattttttgaagaattgctacagttacttcatccatttatgccttttgttacggaagaaatttaccaccagttaaaagacagaagcgaaggcgatgatatttgtatcaaacaatttaaaccaatcaccgatagcaacgggctgattttaaaacatgcttctttgttaaaagagatgataaccgcaatcagggaactgcgggttaaaaataatattaaacaaagggaaggcattgtgctcaatattgaaacagatgatggacctgctttttcatcgtttgaaggaattttgaaaaaacaaacgaatgccacagcaatcaaccttgtatcaaaacctgttggtgatagtttaaatattgttgtcggcaaatcaagagtatatattcaatcagaaaagcctgtagatacatcagggcaaaaggaagaattaaaaaaagaacttgattatttgcttggctttttaaattcagtggaaaaaaaattgagtaacgaacgttttgtgcataatgcaaagccagaagttgtagatattgaacgaagaaaaaaagcagatgcggaacaaaagatcaaagcaatagaggagagtttggccacgctctcgcaatag

SEQ ID NO: 390 - protein, 245 aa, Unknown
  Obtained from environmental sample
  misc_feature (1)..(245): Xaa is any amino acid
MGXRDRGMYXXXXXXXXXXXXXXXXXXXXXXXXXXXXXXXXXXXEFFEELLQLLHPFMPFVTEEIYHQLKDRSEGDDICIKQFKPITDSNGLILKHASLLKEMITAIRELRVKNNIKQREGIVLNIETDDGPAFSSFEGILKKQTNATAINLVSKPVGDSLNIVVGKSRVYIQSEKPVDTSGQKEELKKELDYLLGFLNSVEKKLSNERFVHNAKPEVVDIERRKKADAEQKIKAIEESLATLSQ

SEQ ID NO: 391 - DNA, 381 bp, Unknown
  Obtained from environmental sample
  misc_feature (1)..(381): n is a, c, g, or t
gtgtctaaattggttacgaaaaatattgtctccaaaattatttatccacattctcctgaactattgagaatttggtctcgtcatgtccctgacacaataaaatatgaaggcaagaatttcaaattagaatatgaggtacttaaatcagaaacaatttttaaaatttcatattcaaagataattccgcttgaattggaactctctaatgattttttgaatgaacagggtttattaatatacaatgttctaaactatattttaaccacactaaggactttcgaccacccagatttacagtttaagagaattgaatccagtggtttgactgaaatcaaaattgatatttgctcgagataccgaagttttagaaaaaacttttga

SEQ ID NO: 392 - protein, 126 aa, Unknown
  Obtained from environmental sample
  misc_feature (1)..(126): Xaa is any amino acid
MSKLVTKNIVSKIIYPHSPELLRIWSRHVPDTIKYEGKNFKLEYEVLKSETIFKISYSKIIPLELELSNDFLNEQGLLIYNVLNYILTTLRTFDHPDLQFKRIESSGLTEIKIDICSRYRSFRKNF

SEQ ID NO: 393 - DNA, 654 bp, Unknown
  Obtained from environmental sample
  misc_feature (1)..(654): n is a, c, g, or t
gtgattgcggtatgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaacgatatccgccgtggccgataaaattgctgccgacttacgtagtaaaaatatctctgtcaaatacgataacagcgataccaataaacctggatggaaattcgccgagtacgaattaaaaggtgtccctgtcagaattgcgatcggtccgcgcgacatagaaaacggaaccgtagaagttgcaagaagggatactaaggaaaaaactgtaatgcagttaaccgaccttactcttaaagtagaaaatcttcttacacagattcaggataatatttacagaaaggcactcaatcacagggaaactcatacattcatggctgacagctacgatgagttcaagaaattggtagaggaaggcggatttatttatgctcactgggacggaactcctgagactgaacagaaaatcaaggaagagacaaaggcaacgatccgttgtattccactaaataataaattggaagaaggtaaatgcattttaaccggtaatccttccagacaacgtgtaattttcgcgaaagcatattga

SEQ ID NO: 394 - protein, 217 aa, Unknown
  Obtained from environmental sample
  DOMAIN (42)...(132): Anticodon binding domain
  misc_feature (1)..(217): Xaa is any amino acid
MIAVCXXXXXXXXXXXXXXXXXXXXXXXXXXXXXXXXXXXXKTISAVADKIAADLRSKNISVKYDNSDTNKPGWKFAEYELKGVPVRIAIGPRDIENGTVEVARRDTKEKTVMQLTDLTLKVENLLTQIQDNIYRKALNHRETHTFMADSYDEFKKLVEEGGFIYAHWDGTPETEQKIKEETKATIRCIPLNNKLEEGKCILTGNPSRQRVIFAKAY

SEQ ID NO: 395 - DNA, 375 bp, Unknown
  Obtained from environmental sample
  misc_feature (1)..(375): n is a, c, g, or t
atgtcagaagaggcaaatactaaaatcctgaaattattagaagaaaaaattcttcttaagaaggaagtatttgaaaagacgcagacagcattcaaagagatcaaggaaagtctgtccgaactcgttactgatttaaagaccgatctgaaagagatcagtaaggaagaatcaatttcattcagagataccggtgactatgaagcccagtttgatctctctgatgaaacacttttttttgtaatgcataccaacatttttacgtttcgaaataatcatcagatctggcgaaacaaatactttcaacaggattccaaacgtgcttactgcggaaaaattttatttaaaatttcccgggcccgaagttttaaaatttaa

SEQ ID NO: 396 - protein, 124 aa, Unknown
  Obtained from environmental sample
  misc_feature (1)..(124): Xaa is any amino acid
MSEEANTKILKLLEEKILLKKEVFEKTQTAFKEIKESLSELVTDLKTDLKEISKEESISFRDTGDYEAQFDLSDETLFFVMHTNIFTFRNNHQIWRNKYFQQDSKRAYCGKILFKISRARSFKI

SEQ ID NO: 397 - DNA, 789 bp, Unknown
  Obtained from environmental sample
  misc_feature (1)..(789): n is a, c, g, or t
atgatccgttttgtcatacctgttttctttttattaccttttttcagcaatgcccaaaaagacagttccgaaatcgaggctcttggcaaagaaacggttttaagcgaagtggttatccgcaatgggtttgatgtcaatagatttttgcagcgaataaaaaacgacaccacattttataaagcttttcgcaccttacgcattctcggatttacttcattgaatgatataagaatgctggacagcgacgggggaataaaagcatcccttcatagcaagacaagacaaaaccggactaatggctgccgtactatggatgtactggaagaaaaaacaaccggcaacatgtacaaaggaaggaagttaaattactatacggctgaattgtatgcgggtcttttttttactgacggaaaagtttgcggcgaaaataatattgttgcaggtacccaacgaaacgttcgcaataagagcggtattgaaaagcataaagaacaattaaaaatgttgttctttaatcccggacaaaaaattccgggtattccttttattggcgataaggttgacatttttgatccatccgtttccaaatactatgatttttctattgacatggatgaaatgagcgggcagcagtggtatgttttcaaaattgttccaggggcagatattgaccgtgataaaattgtttttgataacatcaccaccgggttccattcaaaaaccatggaaaattgttgcccccccaattatgaatttaagccctacgaaacccccgggtataacgaattc

SEQ ID NO: 398 - protein, 263 aa, Unknown
  Obtained from environmental sample
  SIGNAL (1)...(18)
  misc_feature (1)..(263): Xaa is any amino acid
MIRFVIPVFFLLPFFSNAQKDSSEIEALGKETVLSEVVIRNGFDVNRFLQRIKNDTTFYKAFRTLRILGFTSLNDIRMLDSDGGIKASLHSKTRQNRTNGCRTMDVLEEKTTGNMYKGRKLNYYTAELYAGLFFTDGKVCGENNIVAGTQRNVRNKSGIEKHKEQLKMLFFNPGQKIPGIPFIGDKVDIFDPSVSKYYDFSIDMDEMSGQQWYVFKIVPGADIDRDKIVFDNITTGFHSKTMENCCPPNYEFKPYETPGYNEF

SEQ ID NO: 399 - DNA, 783 bp, Unknown
  Obtained from environmental sample
  misc_feature (1)..(783): n is a, c, g, or t
atggcaagagatctttcgaagtacctgtataatgagatgaacaaagaggcaggtattgaacatagcactcaccggacaaaaatcgttgcaactgttggccccgcctgtgatacgtatgataaactactggaactggtaagagcgggtgtaaatattttccgcctcaacttttctcatggcacgcatgaaaataaagcagagatcattaagcatatcagggatattaatgtaaaagagccatacaatatctctatcctggccgatctgcagggaccaaagctgcgcgttggtgaaatagagaacggcgctttactgattgaacccggagatattctcacattcacctccaaagaaaaagtggtaggcaccaaagaaaagatctacgtttcttatcctaacctgcacgaagatgttgtggtgggcaataagatactgatcgatgatggaaaactggaagtggtggtgacggaagtaactaaagccggtgacgtaaaagtaaaagttacctatggcggcatgttactgcctaaaaaaggagttaacctgcctgatacagctatatcactgccatcactcactgaaaaagacctggtcgatcttgaatttattatcggccagcangtagactgggtagcattgtcctttgtgcgtaaagtagacgacattattgatctgaaaaaaaggctggcagaaaagaagagcaaatcgaaagtgatcgctaaaatgaaatgccttcagcccgggccgatctgcgccatatcatttgtgaatctgatggcgtaa

SEQ ID NO: 400 - protein, 260 aa, Unknown
  Obtained from environmental sample
  DOMAIN (23)...(259): Pyruvate kinase, barrel domain
  misc_feature (1)..(260): Xaa is any amino acid
MARDLSKYLYNEMNKEAGIEHSTHRTKIVATVGPACDTYDKLLELVRAGVNIFRLNFSHGTHENKAEIIKHIRDINVKEPYNISILADLQGPKLRVGEIENGALLIEPGDILTFTSKEKVVGTKEKIYVSYPNLHEDVVVGNKILIDDGKLEVVVTEVTKAGDVKVKVTYGGMLLPKKGVNLPDTAISLPSLTEKDLVDLEFIIGQXVDWVALSFVRKVDDIIDLKKRLAEKKSKSKVIAKMKCLQPGPICAISFVNLMA

SEQ ID NO: 401 - DNA, 738 bp, Unknown
  Obtained from environmental sample
  misc_feature (1)..(738): n is a, c, g, or t
ttgttctttctcaataaaaactttttcatgataaaaattgctttttgtattcttctattatgtatcaataaaagttttgctcaacttgtcccacatcagcatgacagcacaagatttttgataaaggcagatcaatatatttccgaagttttaactcctgaaagaatttataagtatcccggtttttcaaagggtaaaatcttttttaaggataatacaataacagaggctaacctgaattataattatttaaatggcgagattgaatttattaatccggcaaacgacacactcgctattgccaaacaccagatgctgaatattcaacacatcattttgaataaggataccttttattatgatgacggatatatgcaacaggtattaagaacgccggcgggaagaattgcaaaaaggcagatgcttgtaatactaaaaagggagaaactaggagcatatgaccagccgacttccaccaccaatgcggaatcaatgattgtttttagagactattatggatctaccagcacacatggcctgaaggttcgtgaaaatattacaatgaccgtagtgaaccaggtttttttaggagatcattattccttccttcctgccagcaaaaaaaatttactaaaacttttcccttcaaaaaaatcagttattaataattacctcaatcaaaaccatgttgattttaaaaatacagaagacattcaaaaattgtttcttcttctctaa

SEQ ID NO: 402 - protein, 245 aa, Unknown
  Obtained from environmental sample
  misc_feature (1)..(245): Xaa is any amino acid
MFFLNKNFFMIKIAFCILLLCINKSFAQLVPHQHDSTRFLIKADQYISEVLTPERIYKYPGFSKGKIFFKDNTITEANLNYNYLNGEIEFINPANDTLAIAKHQMLNIQHIILNKDTFYYDDGYMQQVLRTPAGRIAKRQMLVILKREKLGAYDQPTSTTNAESMIVFRDYYGSTSTHGLKVRENITMTVVNQVFLGDHYSFLPASKKNLLKLFPSKKSVINNYLNQNHVDFKNTEDIQKLFLLL

SEQ ID NO: 403 - DNA, 375 bp, Unknown
  Obtained from environmental sample
  misc_feature (1)..(375): n is a, c, g, or t
gtgatggtttttggaaaagagcttgcagatactaaggatacgcgggtcttctatatgtcatcggagactttgcctaaagtagttgagaaactaactgctaatcatatccatgaaagccaactattagccatcattgaacaagctactacgccatttcaaaatgtacacatcaccaatttgtacgactttgaaaagaggtaccatcagcaatcatttatttctccctcgctggtcattatcgggcgcgtggtatcacttcacgaaaagtttaaatggcttgaaaataacgatactaatgaatactattttaaaccaataaccagccctataatttctataacccaacccgaaaaattgcataaaaatgttagttga

SEQ ID NO: 404 - protein, 124 aa, Unknown
  Obtained from environmental sample
  misc_feature (1)..(124): Xaa is any amino acid
MMVFGKELADTKDTRVFYMSSETLPKVVEKLTANHIHESQLLAIIEQATTPFQNVHITNLYDFEKRYHQQSFISPSLVIIGRVVSLHEKFKWLENNDTNEYYFKPITSPIISITQPEKLHKNVS

SEQ ID NO: 405 - DNA, 360 bp, Unknown
  Obtained from environmental sample
  misc_feature (1)..(360): n is a, c, g, or t
ttgtacagaatattaaaaccaaatggaattatagttgtttatgctccgtttttcctaaatacaaaatattttggggatcctgatcataaaattccattttcaatcaggacttttgataattacgagtacatcggtaaccgaaaactaaagttttatgaaaagtggaaattgaatcatcgcactaattatgaaaccggcgcgcagtttgaggtgttggaaaagagatttataacatcacactttgctgtgcttaagtggatggacttttttgttaatatcgaaccggttatttatgaaagatttttttccggtatcttttcaccggaagaagtttatttcagactaagagcaattaagtaa

SEQ ID NO: 406 - protein, 119 aa, Unknown
  Obtained from environmental sample
  misc_feature (1)..(119): Xaa is any amino acid
MYRILKPNGIIVVYAPFFLNTKYFGDPDHKIPFSIRTFDNYEYIGNRKLKFYEKWKLNHRTNYETGAQFEVLEKRFITSHFAVLKWMDFFVNIEPVIYERFFSGIFSPEEVYFRLRAIK

SEQ ID NO: 407 - DNA, 540 bp, Unknown
  Obtained from environmental sample
  misc_feature (1)..(540): n is a, c, g, or t
ttgatggttctttatatgttaccgatgatgcaaaaggatatgtttggaaaatcaattttacaggaaaataaaatgatgatgagagtttttgtatttgtgttgctgctaattcctggtcttgtgaaagctcaaacgaaaaagccggtaacaaagaagcctgcaatttccacttcaaaaacaacaagtggttccggaaacactttaaagagttcaataagccgtgggcagattgtgtacactaaattttgtcttacctgccaccaggtagatggatcaggcgtgcctaatctgaatccgccgttgatcaggacacaatggactttgggttccaaaaccgttttgatagagcaggtgttgaaaggttcaaatggcaagattgaaatcgacggcgaaacttttcacaacaccatgcccccattggccacattgaccgatcagcaaattgcagatgtactaacttatgtaagaaacaattttggaaacaaagcaagcatagtaacgccggcagaagtgaaagcggtaagagtgaagacaaaatga

SEQ ID NO: 408 - protein, 179 aa, Unknown
  Obtained from environmental sample
  misc_feature (1)..(179): Xaa is any amino acid
MMVLYMLPMMQKDMFGKSILQENKMMMRVFVFVLLLIPGLVKAQTKKPVTKKPAISTSKTTSGSGNTLKSSISRGQIVYTKFCLTCHQVDGSGVPNLNPPLIRTQWTLGSKTVLIEQVLKGSNGKIEIDGETFHNTMPPLATLTDQQIADVLTYVRNNFGNKASIVTPAEVKAVRVKTK

SEQ ID NO: 409 - DNA, 396 bp, Unknown
  Obtained from environmental sample
  misc_feature (1)..(396): n is a, c, g, or t
ttgaaattcaaagatttgaacggcaatgaaattcaggtggacaaactaaaacaaggtgttgaatttatagccgaagtcacgattaaaaaccccggaaaaaaagggtattacaaggaaatggctttaaaccagatttttccttccggctgggaaatccacaatacacggatggacggtacttctcaaaacgcagtagcacgttatcaggatattcgtgacgacagggtttatacctattacgatttgggtccaaacgaaaccaaaacctttagcgtacaactgaatgcctgctaccttggtcgcttctacctgccgaccacctattccgaggccatgtatgacaacctgatcaatgcccgcacaccgggtaaatgggtggaagtcattaaaggctaa

SEQ ID NO: 410 - protein, 131 aa, Unknown
  Obtained from environmental sample
  misc_feature (1)..(131): Xaa is any amino acid
MKFKDLNGNEIQVDKLKQGVEFIAEVTIKNPGKKGYYKEMALNQIFPSGWEIHNTRMDGTSQNAVARYQDIRDDRVYTYYDLGPNETKTFSVQLNACYLGRFYLPTTYSEAMYDNLINARTPGKWVEVIKG

SEQ ID NO: 411 - DNA, 627 bp, Unknown
  Obtained from environmental sample
  misc_feature (1)..(627): n is a, c, g, or t
atgatggctaaggctgcggatcttgcttctgcaacggatgataccctgatccctttaacccgttttgatatgagtatcagcaatgggatcatttacaccattaaggaacataatatttccgatgttgtaataggtctgcatcatgctgctaaagattcaggttatcaactgttaggtccggttgttgacaaaattgttaaacgaacttctgaaactattttcatttataaggcagcgcagccactgaatactttaaaaagaatcctggttgctattcctcccaaagcagaatatgaaccgggcttttatcattggtttgataaattatatacattggcaaaaggcaccgggttatcaatacatttttatggtaatggtgattcgttaaaaagaataagccaattaaatgaacaacgatcagcaaaactcaaaattggtcttaatcccttttcggactggggagagtttttaattttaagcagggaaatcaggaaggatgatctatttgttttaatcacttcccgcaaaggctatccctcttataataatgatcttgagaaagttccttatcaattattaaatattttaaggacaacagttttatcatattatatccacgggcattaa

SEQ ID NO: 412 - protein, 208 aa, Unknown
  Obtained from environmental sample
  misc_feature (1)..(208): Xaa is any amino acid
MMAKAADLASATDDTLIPLTRFDMSISNGIIYTIKEHNISDVVIGLHHAAKDSGYQLLGPVVDKIVKRTSETIFIYKAAQPLNTLKRILVAIPPKAEYEPGFYHWFDKLYTLAKGTGLSIHFYGNGDSLKRISQLNEQRSAKLKIGLNPFSDWGEFLILSREIRKDDLFVLITSRKGYPSYNNDLEKVPYQLLNILRTTVLSYYIHGH

SEQ ID NO: 413 - DNA, 582 bp, Unknown
  Obtained from environmental sample
  misc_feature (1)..(582): n is a, c, g, or t
ttgtttgaaatgctgaaggaggttcgtcagcaagaggctaagaagaaggggctgcctccgtttgtattgttcttagagaattcgttacaggacatggcaacgatgtatcctactacgctgaaggaactggagaaatgccagggagtaagtgtgggcaaggctatgaagtacgggaagccattcgttgacctgattgctcagtacgtagaggagaacgatatagagaagccggatgacttcgtgatgaagagcgttgccaacaggagtaataataagatattcattattcagaacgtagataagaaaatccctttagaaacgatagcgaagatcaaggatctacgccttgatgtcttattggaggagatggagacgattgtggcaagtggtaccaggctaaatctcaactatgccattgatgacatgttggatgaagatgagcaggaagagatcatagattattttaggggatgccagacaagttctctggatgtcgcccttgatgagctgtcagatgggggatatgagtatgagcagttgaagcttatgcgggataaattcctccgtgagtgtggggactaa

SEQ ID NO: 414 - protein, 193 aa, Unknown
  Obtained from environmental sample
  DOMAIN (1)...(75): HRDC domain
  misc_feature (1)..(193): Xaa is any amino acid
MFEMLKEVRQQEAKKKGLPPFVLFLENSLQDMATMYPTTLKELEKCQGVSVGKAMKYGKPFVDLIAQYVEENDIEKPDDFVMKSVANRSNNKIFIIQNVDKKIPLETIAKIKDLRLDVLLEEMETIVASGTRLNLNYAIDDMLDEDEQEEIIDYFRGCQTSSLDVALDELSDGGYEYEQLKLMRDKFLRECGD

SEQ ID NO: 415 - DNA, 882 bp, Unknown
  Obtained from environmental sample
  misc_feature (1)..(882): n is a, c, g, or t
ttgcgtgatgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactcctgtccttaagcggagttactatgaaattaaatgcattaaaagaaataattaagaccggggaaaataccgagaaaatgcccgtattgtttgttggccatggcaaccccatgaatgccatagaagacaatcaattctccagggaaatgaaagccattggaaaaaagataactaaacccaaggccatcctcatggtatctgcccattgggaaactaagggtacttttgtaaccgggcaagaaaaaccgcctacgattcacgattttggaggttttcccaaggaattatttgccgttgaatatccggcaccgggcagtaagtggctggctgaagaaaccacccgggcaattaccaatgaaaaagtggatctaagcaacacctggggatttgaccatggatgctggagcgtgaccaaaaacatgtttccagaggcagatatacctattatacagctcagtttagattataccaagagcgcccggcaacattacgatctggccaaacaactttcggccttaaggaaaaagggggttttgatcataggaagcggacacatggtgcacaattttggctatgtgcaaataaagggaaacgactttaacgccccttttgggcacgactggacccttgaggcanacgaaaaatttaaaaaatatattagtaatgacgagcattcttcattggtaattancaagatcagggcagcgccattaacctggcggtacctacccccggagcatatttacctttatatataa

SEQ ID NO: 416 - protein, 293 aa, Unknown
  Obtained from environmental sample
  DOMAIN (69)...(293): Catalytic LigB subunit of aromatic ring-opening dioxygenase
  misc_feature (1)..(293): Xaa is any amino acid
MRDVXXXXXXXXXXXXXXXXXXXXXXXXXXXXXXXXXXXXGLLSLSGVTMKLNALKEIIKTGENTEKMPVLFVGHGNPMNAIEDNQFSREMKAIGKKITKPKAILMVSAHWETKGTFVTGQEKPPTIHDFGGFPKELFAVEYPAPGSKWLAEETTRAITNEKVDLSNTWGFDHGCWSVTKNMFPEADIPIIQLSLDYTKSARQHYDLAKQLSALRKKGVLIIGSGHMVHNFGYVQIKGNDFNAPFGHDWTLEAXEKFKKYISNDEHSSLVIXKIRAAPLTWRYLPPEHIYLYI

SEQ ID NO: 417 - DNA, 372 bp, Unknown
  Obtained from environmental sample
  misc_feature (1)..(372): n is a, c, g, or t
gtgccaataatctcccggatgaaaaacaaaaagtggctcttactccttatcattggcctaccatcatttttatggataatactcgaaacaagtactattaattcatatcgtttaaattattacggaccaaagatcgcggaggaacaaaaggatactgtgttttataaagtatctgatcagttttcgatctcgcctgtaaaaaattctgattccttacaaccttttttaattgatgtggaaaatcatcctttttatgcccttatgtttatcagtaaaaagtaccaaaaagacgcttaccgattaggtgggttgtgggagtatttaaactatgaaaaagaaaaagttgggcaccattgctttttacccgggtaa

SEQ ID NO: 418 - protein, 123 aa, Unknown
  Obtained from environmental sample
  misc_feature (1)..(123): Xaa is any amino acid
MPIISRMKNKKWLLLLIIGLPSFLWIILETSTINSYRLNYYGPKIAEEQKDTVFYKVSDQFSISPVKNSDSLQPFLIDVENHPFYALMFISKKYQKDAYRLGGLWEYLNYEKEKVGHHCFLPG

SEQ ID NO: 419 - DNA, 444 bp, Unknown
  Obtained from environmental sample
  misc_feature (1)..(444): n is a, c, g, or t
atgaaatctttaatcataatcttttcactcattttgttttttactgcctgtaaaaatcaaaagggaggagtgcaaactacaggtcaggtgattgaaaattccattacactcaccgacgcacaaatgaggaatgcaaaaattgaaaccgggaaaatagagcagaaggaaatttcatctgtgctaaaggtcaatggacggatagatgtgccaccacaaaatttagtatcggtaagtgtacctcttggaggttatctcagatcaactaaactcctcccgggtatgcacataaataaaaatcaggtgattgctataattgaagatcatcaatatattcagcttcagcaggattatctaacggctaaagcgctattcggttatcatgaaagtgaataccaaaggcagaaggtattgaacgaaagcaacgccacagcgataaatgtatga

SEQ ID NO: 420 - protein, 147 aa, Unknown
  Obtained from environmental sample
  SIGNAL (1)...(18)
  misc_feature (1)..(147): Xaa is any amino acid
MKSLIIIFSLILFFTACKNQKGGVQTTGQVIENSITLTDAQMRNAKIETGKIEQKEISSVLKVNGRIDVPPQNLVSVSVPLGGYLRSTKLLPGMHINKNQVIAIIEDHQYIQLQQDYLTAKALFGYHESEYQRQKVLNESNATAINV

SEQ ID NO: 421 - DNA, 573 bp, Unknown
  Obtained from environmental sample
  misc_feature (1)..(573): n is a, c, g, or t
ttgcagaaaataactccccgatcaaggaagaaaaaggtggataaagaagaagttttaattgtaccgggagatacgttaatttttgttcccctcgtgctcagcggtgtgcttcggattattagagaagaggaagaagggcgtgaagtgtttctatatcatctgtacccttcgcaaacctgcgccatggctgtaaattgttgccagtcggggaaaaaaagtatggtaaaagcggtagcggaagacgaaacggaagtgttattgatacccgtcaacctaatagaccagttatttaaatatgatgaatggaaaatgtttatcaaccaaacctatagcagccgtttcgcagaactgattgaggtgatagacctgattgcctttaacaacctggataaaaaaattctcaattatttagaaaagaaaaaagaagcgcttaacaccgctagtttatccatcactcaccaacaaattgcagcagaattaaacacacaccgcgaagctgtcagtcgcctgttgcgaaccatggagcataaaggcatcgtaaagcttggtagaaataccattgagttattataa

SEQ ID NO: 422 - protein, 190 aa, Unknown
  Obtained from environmental sample
  misc_feature (1)..(190): Xaa is any amino acid
MQKITPRSRKKKVDKEEVLIVPGDTLIFVPLVLSGVLRIIREEEEGREVFLYHLYPSQTCAMAVNCCQSGKKSMVKAVAEDETEVLLIPVNLIDQLFKYDEWKMFINQTYSSRFAELIEVIDLIAFNNLDKKILNYLEKKKEALNTASLSITHQQIAAELNTHREAVSRLLRTMEHKGIVKLGRNTIELL

SEQ ID NO: 423 - DNA, 570 bp, Unknown
  Obtained from environmental sample
  misc_feature (1)..(570): n is a, c, g, or t
gtggaggtgatggctcaaaatacccgcgtttcaggtgttgtgctgcaggctgaagatagcattcctgcattcgtatctgtggtattcaaggaagattcaaccaatggtgaccaggtagatgccaaggacggaagtttctccatttcatctaaaaaacctgttacggccattatagtttccggaaccggttataaaaggatcacctatccgataaagccaggaatcaataacaaggaccttgtaatctatgtagaagaagccattaatgacatcccccccatcaccgttacatggcaaggcaatccggccgaacgactcattgatagtgtagttgctcatcgtaaatataccgactttagaagggccaacagtttttatgttactacgtacgaaaagacaagtttaagtctgtataacctccgcgaaaaatttaagaagtcatttttgctccggcccatcaaagaaattttcagcaatccggatacggttgacaggaattgtaatgtatccggccatgttatccgaaagctttgcgaatggttacaaaaacagggaacagctggaaagtaa

SEQ ID NO: 424 - protein, 189 aa, Unknown
  Obtained from environmental sample
  misc_feature (1)..(189): Xaa is any amino acid
MEVMAQNTRVSGVVLQAEDSIPAFVSVVFKEDSTNGDQVDAKDGSFSISSKKPVTAIIVSGTGYKRITYPIKPGINNKDLVIYVEEAINDIPPITVTWQGNPAERLIDSVVAHRKYTDFRRANSFYVTTYEKTSLSLYNLREKFKKSFLLRPIKEIFSNPDTVDRNCNVSGHVIRKLCEWLQKQGTAGK

SEQ ID NO: 425 - DNA, 408 bp, Unknown
  Obtained from environmental sample
  misc_feature (1)..(408): n is a, c, g, or t
atgaaacaattcgaccttaacattgaaaaaatccttgagaactgggaaacgtaccatgcaataagagaaataattgctaatgctctcgacgagcaacttttaactgacacaaaagatgttgaaatcactaaagaaaactatacttggcatataagagattatggacgaggtttaaaatatacaaatctaacccaaaatgaaaatcaagagaaactcaccaatccttctgtcattggaaaatttggaattgggcttaaagatgctttggctacatttgacaggaaaggtattagggttctaattaaatcaaaatttggtgatattactctctctaaaactgcaaaagaagggtttgcagatataattacattacacgctaatatttctgacgcactgacgataaattat

SEQ ID NO: 426 - protein, 136 aa, Unknown
  Obtained from environmental sample
  misc_feature (1)..(136): Xaa is any amino acid
MKQFDLNIEKILENWETYHAIREIIANALDEQLLTDTKDVEITKENYTWHIRDYGRGLKYTNLTQNENQEKLTNPSVIGKFGIGLKDALATFDRKGIRVLIKSKFGDITLSKTAKEGFADIITLHANISDALTINY

SEQ ID NO: 427 - DNA, 513 bp, Unknown
  Obtained from environmental sample
  misc_feature (1)..(513): n is a, c, g, or t
gtgaaatcgaaatttggttatcacattattcaaatggtacagcgaaatggtgatgaagctattgttcgtcatattttacggatacctcccgttaccgagaaagaaataaatgaatctatatcacgacttgattcagtgcggtctaaggtcattgcaggtactatgagcttccctatcgctgccggcaggtatagtgacgatgaggctgcaaaatatactggtccttttattcaaagtcgagacggtgatacttataacactattgatgaattggacaaggagatagtaaccgcattggataaattgaaagttggagaaatttcgcagcccctgacatttaccgatcagcgtaataaaaaaggcgttcggatcttatatcttaaatcccgttccgagccacaccgtatgaatctgaaagatgattatgacaagatagctaactatgctttagagcaaaaaaatcaaccgcactggaaaagtggctcctggcacatattccacatactatattag

SEQ ID NO: 428 - protein, 170 aa, Unknown
  Obtained from environmental sample
  DOMAIN (24)...(129): PPIC-type PPIASE domain
  misc_feature (1)..(170): Xaa is any amino acid
MKSKFGYHIIQMVQRNGDEAIVRHILRIPPVTEKEINESISRLDSVRSKVIAGTMSFPIAAGRYSDDEAAKYTGPFIQSRDGDTYNTIDELDKEIVTALDKLKVGEISQPLTFTDQRNKKGVRILYLKSRSEPHRMNLKDDYDKIANYALEQKNQPHWKSGSWHIFHILY

SEQ ID NO: 429 - DNA, 471 bp, Unknown
  Obtained from environmental sample
  misc_feature (1)..(471): n is a, c, g, or t
gtggtcatcaccgacggtgagaatcacgaagaagatgcagtcgaggccgccaaggtggcgaacagcaaaggcatcatcattcatacgattggcatgggttcctatgaaggcgcgccgataccggtttacaggaatggcatgcaggttgatttcatgaaggatcacaatggaaatacagttctcaccaaactcgaaccgctaacattagagcgtatcgccggagaagggaaaggcgttttcatccaggcttcgaacaatgacgacggtctaaattccatactcgcacagatcaataagatggagaaaaaatctttcggaacgaaacaattctccggctacgaggatcgtttccagtatttcctggcagcaggattatttctactgttgctggaattcacaatcacaaaccgaaagagccggttcatacagaagcttaatctcttcaacgaaaaaacgaacaagggcatctaa

SEQ ID NO: 430 - protein, 156 aa, Unknown
  Obtained from environmental sample
  misc_feature (1)..(156): Xaa is any amino acid
MVITDGENHEEDAVEAAKVANSKGIIIHTIGMGSYEGAPIPVYRNGMQVDFMKDHNGNTVLTKLEPLTLERIAGEGKGVFIQASNNDDGLNSILAQINKMEKKSFGTKQFSGYEDRFQYFLAAGLFLLLLEFTITNRKSRFIQKLNLFNEKTNKGI

SEQ ID NO: 431 - DNA, 321 bp, Unknown
  Obtained from environmental sample
  misc_feature (1)..(321): n is a, c, g, or t
gtgtcgcaagtgagcagccaatatcacgaagatcaaatcatcgccgagttctttggcgacaccgttggaagcttcattgattgcggcgcccatgatggcgtgattaacagcaatacgcagacactggcatcgcgagggtggggtgggatctgcattgaaccttcgccacttgtgttcccatacctgatgcgacggtacgccgaatcaccgcaggttctttgccttacgcagcgatcgaccccactgcagcatagtgcgattttggaaaataatggcgaccagatgagcacgaccgaacaggaccatcgtgatatctggatg

SEQ ID NO: 432 - protein, 107 aa, Unknown
  Obtained from environmental sample
  misc_feature (1)..(107): Xaa is any amino acid
MSQVSSQYHEDQIIAEFFGDTVGSFIDCGAHDGVINSNTQTLASRGWGGICIEPSPLVFPYLMRRYAESPQVLCLTQRSTPLQHSAILENNGDQMSTTEQDHRDIWM

SEQ ID NO: 433 - DNA, 438 bp, Unknown
  Obtained from environmental sample
  misc_feature (1)..(438): n is a, c, g, or t
gtgaagggaatcaaaatgattcgcctgctcaattatgttccgtacgttaaaaaagatgcgatgaaaatcctgcagaacgaactcggatgggtatattatgggggcaagcattatgaaagtgtgttcacgcgatttttccaggcttatattctgcctgttaaattcaatatcgataagagacgcgcgcatctttcaacattggtggcagcgggtgaaatcaacaggaatgaagcactcgaagaaatgaacaaggaggcatatccgcccgacatgctgaggcatgataaggagtacgtgatgaaaaaattattactgaagcccgaggaattcgaagcgattatgaaagcaccaccgaagtcttataaggaatatcccaatgatgaaaagcgactgcaatttatttacaaaatttataataaactttttggcagaaaatga

SEQ ID NO: 434 - protein, 145 aa, Unknown
  Obtained from environmental sample
  misc_feature (1)..(145): Xaa is any amino acid
MKGIKMIRLLNYVPYVKKDAMKILQNELGWVYYGGKHYESVFTRFFQAYILPVKFNIDKRRAHLSTLVAAGEINRNEALEEMNKEAYPPDMLRHDKEYVMKKLLLKPEEFEAIMKAPPKSYKEYPNDEKRLQFIYKIYNKLFGRK

SEQ ID NO: 435 - DNA, 669 bp, Unknown
  Obtained from environmental sample
  misc_feature (1)..(669): n is a, c, g, or t
atgaccaagctgaccttgtaccctaccgaagagcaaagcccttatggttcaaacccgcgaccttcctttaaagagtacctgagccagactggctttttatctgttacccgcaccaaagaattccttgatccttatttccgctttaagttattcagctctgccaagttcaacaccaagaagtacgaagaggataaagagaaagtgcttgaattttataactcgctgggttaccgcgatgccgctattgtggccgatacccaatactataatcaaaaaggaaatctgaaaatagaccttaaagtagatgagggccatcgctattattttggtgacgttacctggaaaggaaataccaaatacacagattctattcttaccatattattaggtattgccaaaggagatgtttataacctggagatccttaataagaaactgggtaaacaaatgtcacaggaaggtggcgatatcagtagcctgtacatggatgatggttatcttttcttccgaattgaaccagtggaaactgctgtgtataacgataccatcgatttcgagatccgtatacaggaggngccgcaggctaccattaagaacgttaccatttcaggtaacgaaaaaacaaaagagcacgttattcgccgtgagttgcgtacgcttccccggtga

SEQ ID NO: 436 - protein, 222 aa, Unknown
  Obtained from environmental sample
  DOMAIN (50)...(109): Surface antigen variable number repeat
  misc_feature (1)..(222): Xaa is any amino acid
MTKLTLYPTEEQSPYGSNPRPSFKEYLSQTGFLSVTRTKEFLDPYFRFKLFSSAKFNTKKYEEDKEKVLEFYNSLGYRDAAIVADTQYYNQKGNLKIDLKVDEGHRYYFGDVTWKGNTKYTDSILTILLGIAKGDVYNLEILNKKLGKQMSQEGGDISSLYMDDGYLFFRIEPVETAVYNDTIDFEIRIQEXPQATIKNVTISGNEKTKEHVIRRELRTLPR

SEQ ID NO: 437 - DNA, 324 bp, Unknown
  Obtained from environmental sample
  misc_feature (1)..(324): n is a, c, g, or t
gtgaatcaatcggacaaagtaatctgttttgaccatgaagttgacacaattctagacgtgccttcaattaacaaaaaggaattctttattaacgaaagaatagaacctggggacacagccaatgttgttctatctgggagttcgacaaaatggattatgaaggtcagcagcggtaaggacagcacgttaagtatttttgtgtttgactataaccaagttttaactaatgactggaacactttgagaatgaataagaaatacaaacgtcttgactataaattggacgacttaaatagaaacaactggacggtgattgtagaataa

SEQ ID NO: 438 - protein, 107 aa, Unknown
  Obtained from environmental sample
  misc_feature (1)..(107): Xaa is any amino acid
MNQSDKVICFDHEVDTILDVPSINKKEFFINERIEPGDTANVVLSGSSTKWIMKVSSGKDSTLSIFVFDYNQVLTNDWNTLRMNKKYKRLDYKLDDLNRNNWTVIVE

SEQ ID NO: 439 - DNA, 696 bp, Unknown
  Obtained from environmental sample
  misc_feature (1)..(696): n is a, c, g, or t
atgatgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcaaccggattgaaaacctattcatccggtacggaatcaagagcatcaccatggacgatgtgtctgccgagctgggtatttccaagaagacgctttaccagtggtttgaatcaaaagatgacctggtaatcaaggttttggagcaccatatctcaagagaaaaaacaaactgcctgcaacttgcctccaatgctaaaaacgctatagacgagatcctggtactgatggattccaattcgcaggagctggcccagatgaaggccaacatcgtcaacgatctgcagaagtatcatcgcgatgcctgggagatcatgcgcaaattccactacgactttatcctcaaggtgatcaaagagaacctggagcggggccgaaaagagggactctaccgtgatgatttcgatatcgatgtgatcgccaagttgcacctggcttccgcattcagcatattcgatccgcagctatttgctgatggacagggaaataaagcagttctctttaatgaacacatgatgcactatctccacggcatcgtttcacccaaaggccttacatatctcaaaaagaaattgaactga

SEQ ID NO: 440 - protein, 231 aa, Unknown
  Obtained from environmental sample
  DOMAIN (39)...(85): Bacterial regulatory proteins, tetR family
  misc_feature (1)..(231): Xaa is any amino acid
MMYXXXXXXXXXXXXXXXXXXXXXXXXXXXXXXXXXXXXLNRIENLFIRYGIKSITMDDVSAELGISKKTLYQWFESKDDLVIKVLEHHISREKTNCLQLASNAKNAIDEILVLMDSNSQELAQMKANIVNDLQKYHRDAWEIMRKFHYDFILKVIKENLERGRKEGLYRDDFDIDVIAKLHLASAFSIFDPQLFADGQGNKAVLFNEHMMHYLHGIVSPKGLTYLKKKLN

SEQ ID NO: 441 - DNA, 585 bp, Unknown
  Obtained from environmental sample
  misc_feature (1)..(585): n is a, c, g, or t
atgaattttgacgaagaagacaggcaggatagccttgcaaaactttctgtaaaatggctgcatggtgctattgcaaaaaatttatatgcttcggtaaatgtcatagtcaatcaaacaaaaacaatatttggaaagtttaaagcttacgagttcgattctccaatacgcagttattattcagatgaaatggaagtatggggcggcaatcttaatgataagggtgaagccattatcaatactgatctggcagtaggacaaactgcacccggcatgttacgtgccacctatattacaaaagtatttgaagaaggcggggattttagcattgatcgctataatatgttatattctccttacaaaacttatgtgggtattcatacgccagaaatcaaaggatacgataacaatttagaaacgggaaaagaatacatatacgatattgcaactgtaaacgaacagggaaaagctgtaactgccagtaagctgcaggtgaagatttataaacttcagtggcgctggtggtatgaaaaagaaaaagaagatatttgccagtttatttccgaaaacgggtaccctcatttttaa

SEQ ID NO: 442 - protein, 194 aa, Unknown
  Obtained from environmental sample
  misc_feature (1)..(194): Xaa is any amino acid
MNFDEEDRQDSLAKLSVKWLHGAIAKNLYASVNVIVNQTKTIFGKFKAYEFDSPIRSYYSDEMEVWGGNLNDKGEAIINTDLAVGQTAPGMLRATYITKVFEEGGDFSIDRYNMLYSPYKTYVGIHTPEIKGYDNNLETGKEYIYDIATVNEQGKAVTASKLQVKIYKLQWRWWYEKEKEDICQFISENGYPHF

SEQ ID NO: 443 - DNA, 624 bp, Unknown
  Obtained from environmental sample
  misc_feature (1)..(624): n is a, c, g, or t
atgcgacaggtgtcgcattttgatacaattcacgagaatatggctggtaaatctgataaatctaaatcattggtaagtttcgaatctgctagagatatttacaattttctccagcaacccacagttgctattgcggaatttcttacagggttgctcgcctctgatgaatcggcatacaaattgtcagccggtaggttagttcaaggagcagtgaaaggtagacttctaactcaactggggagggagattaaagattatcgggaaaaaggagaaataaaagaagactattttgccacaaacaaaaatcaggcttctttacttgagttacttcaatttatcgatagcgatattccagacgaagaagtcttcaatgcaatgaagtcaatttttttctcaagtattgcaaaaggtgccaattcaaaagaagaagaggtcggatatcagttgcttcaactatgcaaaanactaaattctatcgatattctgatacttaaagtttgttacaaaatttacaaaggcgaggatctgacaaatgttaatactggtattaatgcgtttggagactgggtgaacaccgtctctgaaaaaattgggtatgacttacctgaactagntagtgccgaa

SEQ ID NO: 444 - protein, 208 aa, Unknown
  Obtained from environmental sample
  misc_feature (1)..(208): Xaa is any amino acid
MRQVSHFDTIHENMAGKSDKSKSLVSFESARDIYNFLQQPTVAIAEFLTGLLASDESAYKLSAGRLVQGAVKGRLLTQLGREIKDYREKGEIKEDYFATNKNQASLLELLQFIDSDIPDEEVFNAMKSIFFSSIAKGANSKEEEVGYQLLQLCKXLNSIDILILKVCYKIYKGEDLTNVNTGINAFGDWVNTVSEKIGYDLPELXSAE

SEQ ID NO: 445 - DNA, 351 bp, Unknown
  Obtained from environmental sample
  misc_feature (1)..(351): n is a, c, g, or t
atgcaacctgacctcgcctacaaattcttctcagacaaactcatgcaacatgagccgctgaccgtaaaaagcggaaatggtggattgagttattacaagaatggcgtgtttgtctgtcatttcaatgccaagccacagaaaagtcgcgacgacctgggttttgtggatattcgttatgatgcacttcgtctatatcttgatatcgaaaagaccatttctcagcaggaagctttgccagaggtgcagatcaaaagccataaactgtggtgcactctgcatttcccgttgtcgctgatggaacacatcgcaggattgtttttgaagcatatcatttctaaagttaatacctaa

SEQ ID NO: 446 - protein, 116 aa, Unknown
  Obtained from environmental sample
  misc_feature (1)..(116): Xaa is any amino acid
MQPDLAYKFFSDKLMQHEPLTVKSGNGGLSYYKNGVFVCHFNAKPQKSRDDLGFVDIRYDALRLYLDIEKTISQQEALPEVQIKSHKLWCTLHFPLSLMEHIAGLFLKHIISKVNT

SEQ ID NO: 447 - DNA, 405 bp, Unknown
  Obtained from environmental sample
  misc_feature (1)..(405): n is a, c, g, or t
atgcctatagatttttttgcaagcggagaaactatacgggaattgcaggaccagcaaaagagccaaaagcaagagggaaaaatgaacttttatgagttcagtaattgggatgattttttgatcttcagccgagaagtgagaaaaaatgatctgctcattattttatcatcaagaaaaggacatgtttcttaccaaagccagttagaaaaattaccttattatctttctaactatttcaaagaaaatagtttcattatgctgtatccacagcaaattgaaagaggcataaaaatggacgatgttcaatacgttgacagttctttaggagaaacgatttctcagaaagtaggatcgggcggaatttttaaaagattgttcaagaaaaataaaccccctgatacataa

SEQ ID NO: 448 - protein, 134 aa, Unknown
  Obtained from environmental sample
  misc_feature (1)..(134): Xaa is any amino acid
MPIDFFASGETIRELQDQQKSQKQEGKMNFYEFSNWDDFLIFSREVRKNDLLIILSSRKGHVSYQSQLEKLPYYLSNYFKENSFIMLYPQQIERGIKMDDVQYVDSSLGETISQKVGSGGIFKRLFKKNKPPDT

SEQ ID NO: 449 - DNA, 558 bp, Unknown
  Obtained from environmental sample
  misc_feature (1)..(558): n is a, c, g, or t
atgcgcggacttttttattatctaatcaataataactggttttatcgattctatgaaagaaaattggaatcacagattagaaaagatccgcttccaaatcatgttgcaattatactggatggtaataggcgatgggctaaatatcatttcttggcaagcagaggcgcgcataaaatgggcgctgacaaggccgaacagttactaacttggatttatgaccttaagataaaaataactactctttatgtattgtctatcgaaaacctcgaacgcgacaagaaggaattggaagacatctataatcttcttggaataaaacttgaaaaattatacaatgattcacgaatacacgaaagggaaatgaaaataaaggccattggaaatatagacgctctcccacaatcaataaaggatattttgtttaaacttgaaaaagagacaaatcattatgatctgacttttctaaacatcgctatagcttatggggggcagcaagaattagttgatgcgattagaaaaattgctcatgatgtagaaaaaagagaactaataatttag

SEQ ID NO: 450 - protein, 185 aa, Unknown
  Obtained from environmental sample
  DOMAIN (38)...(185): Putative undecaprenyl diphosphate synthase
  misc_feature (1)..(185): Xaa is any amino acid
MRGLFYYLINNNWFYRFYERKLESQIRKDPLPNHVAIILDGNRRWAKYHFLASRGAHKMGADKAEQLLTWIYDLKIKITTLYVLSIENLERDKKELEDIYNLLGIKLEKLYNDSRIHEREMKIKAIGNIDALPQSIKDILFKLEKETNHYDLTFLNIAIAYGGQQELVDAIRKIAHDVEKRELII

SEQ ID NO: 451 - DNA, 579 bp, Unknown
  Obtained from environmental sample
  misc_feature (1)..(579): n is a, c, g, or t
gtgagaccaatcatgagtaacacatttttacaattatcccagtatgttgaaaaaaaatttggaattgcattacaagaacatcaaacaaatagagtaatgcatgcgctcgataatactaaaaaaacattacaactgaatgatgaaaaattaataaatggattgcagcaaaacgatatgtcaattatgaatgccgttattagtgcaattaccgttcaagaaagttattttttccgcgatcaatctttgtttaattatctaaaagaatatgggttacctaaaataattcagaaaaaaataaaaaccaatgatttaaatattaagatttggagtgctggatgtgctcgtggtgaggaaatttatagcgttgcaatattgttaaacgaattacttccgtttgatgcgcgatggcaaatacacttgattggcagtgacattaatcaagccgcaattcgtgatgctgaaaatggcgaatattcagcatccagtttgagacgctttaccgaagaacaaattcagcaatattttgaaaaaaaagaaaacaaattctttttaaaatcccagtttcaaaaaaaatgttaa

SEQ ID NO: 452 - protein, 192 aa, Unknown
  Obtained from environmental sample
  DOMAIN (72)...(192): CheR methyltransferase, SAM binding domain
  misc_feature (1)..(192): Xaa is any amino acid
MRPIMSNTFLQLSQYVEKKFGIALQEHQTNRVMHALDNTKKTLQLNDEKLINGLQQNDMSIMNAVISAITVQESYFFRDQSLFNYLKEYGLPKIIQKKIKTNDLNIKIWSAGCARGEEIYSVAILLNELLPFDARWQIHLIGSDINQAAIRDAENGEYSASSLRRFTEEQIQQYFEKKENKFFLKSQFQKKC

SEQ ID NO: 453 - DNA, 501 bp, Unknown
  Obtained from environmental sample
  misc_feature (1)..(501): n is a, c, g, or t
atgaaaaagaaacaaatcaaaaaaatcaaagcggaagaaaacaacagtaaaaaattgctggccagaaccatatctaaaaagttccaacgcagaatgaaaatttaccttggaattctcattgctgtttttgccttcattctttattccggaagcattggacatgattttgccttggatgacaattcggtggtacaggaaaacagtgtaaccaagcaaggcctctccgctatccctaccatactgaaaactgattactggtatggctccggtcataatacatcgagagggcctatttaccgtcctacctcattgattgtctatgccatcgtctggcaattttctcccggtgatccgcatgcctaccatttaatcaatgtgttgttctatgcttttagctgcctgcttttattcatggtgctttgcaaatttttcgaagatcagacctgctctcccctttatctgcgcactgctgtatacgctcacccatctaccggagtgtaa

SEQ ID NO: 454 - protein, 166 aa, Unknown
  Obtained from environmental sample
  misc_feature (1)..(166): Xaa is any amino acid
MKKKQIKKIKAEENNSKKLLARTISKKFQRRMKIYLGILIAVFAFILYSGSIGHDFALDDNSVVQENSVTKQGLSAIPTILKTDYWYGSGHNTSRGPIYRPTSLIVYAIVWQFSPGDPHAYHLINVLFYAFSCLLLFMVLCKFFEDQTCSPLYLRTAVYAHPSTGV

SEQ ID NO: 455 - DNA, 486 bp, Unknown
  Obtained from environmental sample
  misc_feature (1)..(486): n is a, c, g, or t
atgagtacaaaagccggttatgctgctattattggtttgccaaatgtcggtaaatcaactttgatgaatgctttgctcgggcaaaaaatttctatcactacttccaaacctcaaactaccagaaaaagaattttagggattttatcggaagaaaattatcaaatagtttttctcgatacaccgggtatattaaaacccgcttatctgctgcaggaaaaaatgatggaagagatagatctttcagtaaaagatgctgatgtgtttgtcattatttatgatgtcagttccgagcaatcatttaaaggatctgaggaaaacgaatatattcagaagataataagtgaacaaacaaaacctaaaattcttgttcttaacaagattgatacgattactcaggaggaggctgttgctcttattgagcgatttgaaaaattaaataagtttaaatctgtaattccggtttctgcaaatcttaaatttatctga

SEQ ID NO: 456 - protein, 161 aa, Unknown
  Obtained from environmental sample
  DOMAIN (9)...(157): Ras family
  misc_feature (1)..(161): Xaa is any amino acid
MSTKAGYAAIIGLPNVGKSTLMNALLGQKISITTSKPQTTRKRILGILSEENYQIVFLDTPGILKPAYLLQEKMMEEIDLSVKDADVFVIIYDVSSEQSFKGSEENEYIQKIISEQTKPKILVLNKIDTITQEEAVALIERFEKLNKFKSVIPVSANLKFI

SEQ ID NO: 457 - DNA, 321 bp, Unknown
  Obtained from environmental sample
  misc_feature (1)..(321): n is a, c, g, or t
atggaaatattttacgaagaacatatagaaaaggtatataaattcttctacgtaaagtctctcgacagggctactgctgaggatttaacttcggagaccttcgtaaattttgttacccagaaccaaagccgaaagatcgaaagtcccactaaatatttgtatggcatcatgcggacagtttggattgaatttctgaaaaacaaatacaaaataaagttagtggatctggaaaacattgaagactttgaagattactctactgacatagtttataagtttgaggaaagcgagnactcctatagcaggcttcagccctacatc

SEQ ID NO: 458 - protein, 107 aa, Unknown
  Obtained from environmental sample
  misc_feature (1)..(107): Xaa is any amino acid
MEIFYEEHIEKVYKFFYVKSLDRATAEDLTSETFVNFVTQNQSRKIESPTKYLYGIMRTVWIEFLKNKYKIKLVDLENIEDFEDYSTDIVYKFEESEXSYSRLQPYI

SEQ ID NO: 459 - DNA, 351 bp, Unknown
  Obtained from environmental sample
  misc_feature (1)..(351): n is a, c, g, or t
ttgaggttcctgtttgggaagtttaaattctacctgcccgggcgtggtaatttctatacctgctatggcgtttattgcgataaaggaaaaactgttttctgctccgtgaaagtctgtactctccagcaaaatggtatctctaaacctgtctcgcaggcggagatacacccccacgggagtgtacacatcagccagcatgggctttatagtggtagtaaaattgatctttttcatgttcttaaaatcaaaaagccccgactgtgtcggggcttgaatatttttaaacaaatacaaataagcaatgacacatcaatgattgaatgtgtaccaccaccaaaatttgttatttga

SEQ ID NO: 460 - protein, 116 aa, Unknown
  Obtained from environmental sample
  misc_feature (1)..(116): Xaa is any amino acid
MRFLFGKFKFYLPGRGNFYTCYGVYCDKGKTVFCSVKVCTLQQNGISKPVSQAEIHPHGSVHISQHGLYSGSKIDLFHVLKIKKPRLCRGLNIFKQIQISNDTSMIECVPPPKFVI

SEQ ID NO: 461 - DNA, 438 bp, Unknown
  Obtained from environmental sample
  misc_feature (1)..(438): n is a, c, g, or t
atgcccgtacaggaacaaatcgaaaagtacatcgcgagccagcctgaaccaaaacgcagcgacatgcaggcgttgcacgacatcattcagcaagtaagtccgggatgtaaattatggttcctcgacggaaagaacgacgaaggcaaaactgtttcgaatcctaatatcggatacgggtctcgcgaccataagtacgccgatggctcggtcagcgagttctatcagatcggcgtgagtgcaaacaagaccgggatctctatctatatcctcggtatcgaagataagaaatacttaaccgggacatatggaaaagaactcggcaaggctagggtgaccgggtattgcataaggttcaaaagtttaaaagacatagacactgatgtgctgaagacggcaatacgatttgggtttgagaatcagaatcagggtgtcacgtag

SEQ ID NO: 462 - protein, 145 aa, Unknown
  Obtained from environmental sample
  misc_feature (1)..(145): Xaa is any amino acid
MPVQEQIEKYIASQPEPKRSDMQALHDIIQQVSPGCKLWFLDGKNDEGKTVSNPNIGYGSRDHKYADGSVSEFYQIGVSANKTGISIYILGIEDKKYLTGTYGKELGKARVTGYCIRFKSLKDIDTDVLKTAIRFGFENQNQGVT

SEQ ID NO: 463 - DNA, 636 bp, Unknown
  Obtained from environmental sample
  misc_feature (1)..(636): n is a, c, g, or t
gtgatacgtactaagggacnnnnnnnnnnnnnnnnnnnnnnnnnnnnnnnnnnnnnnnnnnnnnnnnnnnnggaatctgatattaaattcacgaatagcaaggctatttatctttctaaaaaaggtggtggcaatattgaagtgcgaatcacaaataccccaaaggttaaactcgttatctcgaaaatttatgagaacaatttgctgatggccgaccgctatggttatgatccacaggataacgatgatgaaaactcagatgctgaatatgcttcttatagtgaagaaggagattatgagtatagaagttacagcaatgacctggcgggtgatattatttacacaaaagaaatcgacacccgttctttaccaaagtcagggtcgggaagactgctgaacatttcccagtttgaagaccggttgccagatgtaaaaggcatttaccatgtaatgattcgctccaccaatgattactggatacgcgatagccgtttcatttctttctccgatattggtttgattgcaaagcagggagaggataaactctttgtattcgcgaactcattgaaaaccgcaaaacggaatccaaaggtgtttaccataaaaggtttccgggggaaataccccgcttggtag

SEQ ID NO: 464 - protein, 211 aa, Unknown
  Obtained from environmental sample
  SIGNAL (1)...(21)
  misc_feature (1)..(211): Xaa is any amino acid
MIRTKGXXXXXXXXXXXXXXXXXXESDIKFTNSKAIYLSKKGGGNIEVRITNTPKVKLVISKIYENNLLMADRYGYDPQDNDDENSDAEYASYSEEGDYEYRSYSNDLAGDIIYTKEIDTRSLPKSGSGRLLNISQFEDRLPDVKGIYHVMIRSTNDYWIRDSRFISFSDIGLIAKQGEDKLFVFANSLKTAKRNPKVFTIKGFRGKYPAW

SEQ ID NO: 465 - DNA, 408 bp, Unknown
  Obtained from environmental sample
  misc_feature (1)..(408): n is a, c, g, or t
gtgtggaacatcggccacttcgacagcgagattcagatcggcgccctgtcgaacatgaagtggaccgagatcaagccgcaggtcgacgaggtcgaattcccggacggcaagaagatcatcgtcctgtcgaagggccgcctggtgaatctcggcaatgccacgggtcacccgagcttcgtcatgtcctcgtccttcaccaaccaggtgctcgcgcagatcgagctctggacgaagagcgaccagtacacgaatgaggtttatgtccttccgaagcacctcgacgagaaggtcgcccgccttcacctcggcaagctcggcgtccacctgaccgagctcagcgagaagcaggccaattacatcggcgtgccgcagcagggcccgttcaagccggaccactaccgctactaa

SEQ ID NO: 466 - protein, 135 aa, Unknown
  Obtained from environmental sample
  misc_feature (1)..(135): Xaa is any amino acid
MWNIGHFDSEIQIGALSNMKWTEIKPQVDEVEFPDGKKIIVLSKGRLVNLGNATGHPSFVMSSSFTNQVLAQIELWTKSDQYTNEVYVLPKHLDEKVARLHLGKLGVHLTELSEKQANYIGVPQQGPFKPDHYRY

SEQ ID NO: 467 - DNA, 447 bp, Unknown
  Obtained from environmental sample
  misc_feature (1)..(447): n is a, c, g, or t
atgtttaacgattgctttttagcagagcacctggagtcgatgcacacttatgtgcgaaaaacgcgattcgacctcattgagaagatcaatgtgacccttcaaaaactgaaagagctgaacgaagacaaattatttttgttcaggccagcgtcaaacaggatgctgatcatcaaatacatctccgagaagcagggcggagccgccaacctgaagggcaagaagatcggtttcatcttcctggaaagcggctatggccgcgagccgatcccgctgctcgaggcgctcgccaaggacatgggcttcgaggtgaagctctatccggtggccggcaaggacatgcaggaccagtcggagcagtggctggcggtgcggcgtgaccgcccggactggataatannnnnnnnnnnnnnnnnnnnnnnnnnnnnnnnnnnnnnnnnnnnnnagtga

SEQ ID NO: 468 - protein, 148 aa, Unknown
  Obtained from environmental sample
  misc_feature (1)..(148): Xaa is any amino acid
MFNDCFLAEHLESMHTYVRKTRFDLIEKINVTLQKLKELNEDKLFLFRPASNRMLIIKYISEKQGGAANLKGKKIGFIFLESGYGREPIPLLEALAKDMGFEVKLYPVAGKDMQDQSEQWLAVRRDRPDWIIXXXXXXXXXXXXXXXX

SEQ ID NO: 469 - DNA, 414 bp, Unknown
  Obtained from environmental sample
  misc_feature (1)..(414): n is a, c, g, or t
atgttacatgcattttttgaaccggttagcaagcaattattaaagggtattgcaaaaaaggaatccttgcttggcaaccgtctctatattaattcaaataaattcccggatacgtcaaaggtagatgtagcaattattggattgggtccaaacgccaatcttataaggaaatatttatacagttacagctttaagctgaatggtattgaagttgccgatttcggcaaccttaaacatacaggaactgaaaaaaatatgaatgcaggactggctgaatgtctgatcgcaatgaaagaggagaatattattccaatcatcattggtgaacaattcnnnnnnnnnnnnnnnnnnnnnnnnnnnnnnnnnnnnnnnnnnnnnnnnnnnnnnnnnnnnagtanggtatccacctcctaa

SEQ ID NO: 470 - protein, 137 aa, Unknown
  Obtained from environmental sample
  misc_feature (1)..(137): Xaa is any amino acid
MLHAFFEPVSKQLLKGIAKKESLLGNRLYINSNKFPDTSKVDVAIIGLGPNANLIRKYLYSYSFKLNGIEVADFGNLKHTGTEKNMNAGLAECLIAMKEENIIPIIIGEQFXXXXXXXXXXXXXXXXXXXXSXVSTS

SEQ ID NO: 471 - DNA, 693 bp, Unknown
  Obtained from environmental sample
  misc_feature (1)..(693): n is a, c, g, or t
atggatttcatcaaaaaccaggacctcggattcgggaaagagaacattttcaccttcgtgattaacggggacatggagtcgcacattgaaacgattaaaaaggagctggaaaaccatcccgggatcgtgcgcgtagccgtcgccaatcaaaaaatatggcaactggaaaacacgactggtgacacggattgggaaggaaaagaccccaaggagtctatgatgataaaacccgtcaatgtcgacaatgatttcaaagatgtcctgggattggacctcgttgaaggaaggtggttttccgaaggcagaaacgattcgctctcgtttattctcaatgaaaccgccgtcgcggcgacgggattgaccgatccggtaggaaaatcattttcactctgggacgaaaagggaaccataatcggagtggtgaaagactttcaccacgcgtcaatacatcaaaagattgaaccggttattctatttcactggccgcattggtactggttggtctatgtgaaagtggatggccatgacccccccggagcgataaagcttctgaaaaaatgtgaagcatttaatccggaatatccttttcagtattctttatcgatgcttcgaatgacgcgttggaacgcttcggacaagcggacagggaaaaatatttggagggccttttcccttcttggcatcgcccatctt

SEQ ID NO: 472 - protein, 231 aa, Unknown
  Obtained from environmental sample
  misc_feature (1)..(231): Xaa is any amino acid
MDFIKNQDLGFGKENIFTFVINGDMESHIETIKKELENHPGIVRVAVANQKIWQLENTTGDTDWEGKDPKESMMIKPVNVDNDFKDVLGLDLVEGRWFSEGRNDSLSFILNETAVAATGLTDPVGKSFSLWDEKGTIIGVVKDFHHASIHQKIEPVILFHWPHWYWLVYVKVDGHDPPGAIKLLKKCEAFNPEYPFQYSLSMLRMTRWNASDKRTGKNIWRAFSLLGIAHL

SEQ ID NO: 473 - DNA, 555 bp, Unknown
  Obtained from environmental sample
  misc_feature (1)..(555): n is a, c, g, or t
ttgaatcccatctgcttgcggcctatgtatattttgcaacgtgttcttaattttttagtgtcggttgttgtttctattggtgattttgttattctttttgttacttcgcctatagcaataatgcaagggaaaagacttcaaggcggtacgtttaaaattaagaaaaagattaatattcctctttcggccagaataaggaccgtcccctctcaaattggatcaggaattgccggatcagcaaattttatatttaaagttttaaaattcccattcgtccttatctctgttgtggtcagttttgtatttaatttattcggtaaggttttttcacgctcaaagccgtctgctgaggcgcaagcgagaaaacaaataaaccaaaaacgaaaccaagtaaaaataaaaacttatcatcggccaagcattttttataaattaaaatacgtttttatcggatttatattttcttctatttttgtttttttacctcttctctccttccttttcgtttctgatttacaaatccggacagtctttctgccactacattctaagacc

SEQ ID NO: 474 - protein, 185 aa, Unknown
  Obtained from environmental sample
  misc_feature (1)..(185): Xaa is any amino acid
MNPICLRPMYILQRVLNFLVSVVVSIGDFVILFVTSPIAIMQGKRLQGGTFKIKKKINIPLSARIRTVPSQIGSGIAGSANFIFKVLKFPFVLISVVVSFVFNLFGKVFSRSKPSAEAQARKQINQKRNQVKIKTYHRPSIFYKLKYVFIGFIFSSIFVFLPLLSFLFVSDLQIRTVFLPLHSKT

SEQ ID NO: 475 - DNA, 363 bp, Unknown
  Obtained from environmental sample
  misc_feature (1)..(363): n is a, c, g, or t
atgggtaattgtgcgagcaagcaaaaaagatcatatatgaaattgtggaatggacttcacgctgtgccaaaacaaattatttttaaatgttcaacggctgtaaatcagccgttgaatgatttgtccgatggatatatttatggacgggacattgtgcatacgttgaatgtgctgttgatacgcgtgcttttgggaaaagccgacattcgtggaaaatgcgaaagagtagttgttttgtgtgtaaaagattcccgatataaaatcaacaaaaataattacattgtccatgtggttcgttcgcaaaatgcagactggtttggcaccacggaagaaaatgtgtattatatacaactcttttcattt

SEQ ID NO: 476 - protein, 121 aa, Unknown
  Obtained from environmental sample
  misc_feature (1)..(121): Xaa is any amino acid
MGNCASKQKRSYMKLWNGLHAVPKQIIFKCSTAVNQPLNDLSDGYIYGRDIVHTLNVLLIRVLLGKADIRGKCERVVVLCVKDSRYKINKNNYIVHVVRSQNADWFGTTEENVYYIQLFSF

SEQ ID NO: 477 - DNA, 405 bp, Unknown
  Obtained from environmental sample
  misc_feature (1)..(405): n is a, c, g, or t
atgaacacacttaaccttttaaaacaactcgtctctattaattcgacttttccaaatgaggaggaaattagtaaatttttggttaattatttagaaaaactaggatttaaagtggagattgttaagacagaaaaaaatagaccaaatattgtggccacttttggaaccgccaaaaaatatatcggtttttatgggcatatggacactgtacctattgataaaaattacatatttaatcccctttctataggtgttaaagataacttagtttatgggttaggagtcagcgatatgaaaggtggtattacggctattttaaaaactgcagaatttgctagtcaagagaacctacctattcaaataatatgtggggttgaagaagaaatattccccaagtgctcatga

SEQ ID NO: 478 - protein, 134 aa, Unknown
  Obtained from environmental sample
  DOMAIN (59)...(134): Peptidase family M20/M25/M40
  misc_feature (1)..(134): Xaa is any amino acid
MNTLNLLKQLVSINSTFPNEEEISKFLVNYLEKLGFKVEIVKTEKNRPNIVATFGTAKKYIGFYGHMDTVPIDKNYIFNPLSIGVKDNLVYGLGVSDMKGGITAILKTAEFASQENLPIQIICGVEEEIFPKCS

SEQ ID NO: 479 - DNA, 567 bp, Unknown
  Obtained from environmental sample
  misc_feature (1)..(567): n is a, c, g, or t
atgaagttatcaaaaataaaccggcgcaggtttctttggtcacttttccttggaacgcccgccactgtttttgcagattccttttgggtggagccgaattggctgaagattcggaaaatgcgcctgaacgaaaatccaacccaccgcttcgtccacttcacggatattcattacaaaggcgacaaaaagtatctcgattcggtggtctcggaaattaacaagctctcccctgattttgtttgcatgacgggcgacatcatcgaagaaagctcgtttctctccgaagcgctgcaaattctgggcggaatcaaatctccaatctatggcgtgccgggaaaccacgattattgggcacatgcggattttgacgaaattgcccgggcgttcgcaaaaagcggcggaggatggcttgtggaccagcaagcgactacacgcgatggcaaaattactttgcatggagcgggagaatatcggccgaccaaactccagccggatccgaaaaccaaaaatattttgctcatccattatccagagtggatcgagcgtttgactccaaatcgggtttga

SEQ ID NO: 480 - protein, 188 aa, Unknown
  Obtained from environmental sample
  misc_feature (1)..(188): Xaa is any amino acid
MKLSKINRRRFLWSLFLGTPATVFADSFWVEPNWLKIRKMRLNENPTHRFVHFTDIHYKGDKKYLDSVVSEINKLSPDFVCMTGDIIEESSFLSEALQILGGIKSPIYGVPGNHDYWAHADFDEIARAFAKSGGGWLVDQQATTRDGKITLHGAGEYRPTKLQPDPKTKNILLIHYPEWIERLTPNRV

SEQ ID NO: 481 - DNA, 396 bp, Unknown
  Obtained from environmental sample
  misc_feature (1)..(396): n is a, c, g, or t
atgtttggcgaaaaagtggccaaaatcattgatggattaacaaaaatttcaggagtatttgaccagacttcttcgctgcaggcagaaaatttcaggaaaatgctgcttactctttctgaagatgtgcgtgttattcttattaaactggccgaccgcctgcacaatatgcgtacccttgattcaatggcaagggacaaacaattaaaaattgcatcggaaacactgtatttatatgcccctctggcgcaccggcttggcctgaatgccataaaaacagagatggaagacctgggcttaaaatataccgagccccaggtgtttgaagacattacccaaaaattaagggaaacagaaccggaaaaaaaaaattcgtccataaatttatcgtgcccctaa

SEQ ID NO: 482 - protein, 131 aa, Unknown
  Obtained from environmental sample
  misc_feature (1)..(131): Xaa is any amino acid
MFGEKVAKIIDGLTKISGVFDQTSSLQAENFRKMLLTLSEDVRVILIKLADRLHNMRTLDSMARDKQLKIASETLYLYAPLAHRLGLNAIKTEMEDLGLKYTEPQVFEDITQKLRETEPEKKNSSINLSCP

SEQ ID NO: 483 - DNA, 801 bp, Unknown
  Obtained from environmental sample
  misc_feature (1)..(801): n is a, c, g, or t
atgccacgacattctgacagtctcattatgagcagcatatattttttgccgtggccggtgatactcaggattctaattgctgataaactattgcgttttgtagtttccttactaatactcggtgtgcgatttatttccaaactttattattggtggcaagtgagaaaagctcaaaaaaaactcgaattacatccacgtcttattaaaatcggtattaccggaagttttggaaaaagttcaactaaagaatttctggcaactatactttctcaaaaatattctgtggttaaaacacctaaaaatctcaatacagatattgggatagctcaaacaatcttaaaagaagttagctcccaaactgacatctttatcgctgaaatgggcgcatataaaagaggtgaaatacgacatatgtgtacgtttttcaaaccgagtatgggcattgtaacgggaattaatgagcagcatattgagctttttggttcgctttcaaatacacgcttagccaagtatgagctgattgagagtctacctaacaatggagttgccatttttaatggtgacaatgagtataccaggcttatggccaaaagaaccaaacataaaaaagtgattttgtatggagtacacaaaaactgggctgtttgggcagatcagatagaacaaacaaaagatggactgaggtttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtga

SEQ ID NO: 484 - protein, 266 aa, Unknown
  Obtained from environmental sample
  DOMAIN (17)...(253): Mur ligase family, catalytic domain
  misc_feature (1)..(266): Xaa is any amino acid
MPRHSDSLIMSSIYFLPWPVILRILIADKLLRFVVSLLILGVRFISKLYYWWQVRKAQKKLELHPRLIKIGITGSFGKSSTKEFLATILSQKYSVVKTPKNLNTDIGIAQTILKEVSSQTDIFIAEMGAYKRGEIRHMCTFFKPSMGIVTGINEQHIELFGSLSNTRLAKYELIESLPNNGVAIFNGDNEYTRLMAKRTKHKKVILYGVHKNWAVWADQIEQTKDGLRFXXXXXXXXXXXXXXXXXXXXXXXXXXXXXXXXXXXXX

SEQ ID NO: 485 - DNA, 618 bp, Unknown
  Obtained from environmental sample
  misc_feature (1)..(618): n is a, c, g, or t
atgagcagcatatattttttgccgtggccggtgatactcaggattctaattgctgataaactattgccttttgtagtttccttactaatactcggtttgcgatttatttccaaactttattattggtggcaagtgagaaaagctcaaaaaaaactcgaattacatccacgtcttattaaaatcggtattaccggaagttttggaaaaagttcaactaaagaatttctggcaactatactttctcaaaaatattctgtggttaaaacacctaaaaatctcaatacagatattgggatagctcaaacaatcttaaaagaagttagctcccaaactgacatctttatcgctgaaatgggcgcatataaaagaggtgaaatacgacatatgtgtacgtttttcgaaccgagtatgggcattgtaacgggaattaatgagcagcatattgagctttttggatcgctttcaaatacacgcttagccaagtatgagctgattgagaatctacccaacaatggagttgccatttttaatggggacaatgagataccacgcttatgggcgaaaacatccagcttaagaaagtgttttgtatggggacccaaaaactggggctgttga

SEQ ID NO: 486 - protein, 205 aa, Unknown
  Obtained from environmental sample
  DOMAIN (8)...(205): Mur ligase family, catalytic domain
  misc_feature (1)..(205): Xaa is any amino acid
MSSIYFLPWPVILRILIADKLLPFVVSLLILGLRFISKLYYWWQVRKAQKKLELHPRLIKIGITGSFGKSSTKEFLATILSQKYSVVKTPKNLNTDIGIAQTILKEVSSQTDIFIAEMGAYKRGEIRHMCTFFEPSMGIVTGINEQHIELFGSLSNTRLAKYELIENLPNNGVAIFNGDNEIPRLWAKTSSLRKCFVWGPKNWGC

SEQ ID NO: 487 - DNA, 702 bp, Unknown
  Obtained from environmental sample
  misc_feature (1)..(702): n is a, c, g, or t
atggctgataattctggattttctttaaaagttcttgaaaacgaaatacaagacaaagatagagacatcgtaagaattgatccggaaataatgcatatgctaaacatagctgagggcgcccttgttaatatcattggtcctaaaaatagcgccagtattatttgtctttcattgcaccctactgatgagatcgaagataatatgaataataataataataaaaatagcaacaaaaatacgaacgataaaataattcgaatcgatgccaaatcaagagattttataggaacccgtataggggataatgtcactgtcaagaaaattgttctagctgaaaatgataatagatctgggaagatgaacattgaattaactgacgatattgcaaattccataataataaatgggtcttgtattaattttgataaagaacgtccaaagataatggaatacctgggatctcttcaaaaagaagtacatatggacagtatctattacaagtgttacgctaatggcaaaaaaactctaggatgggatttttttgatgttgtcgtagacttgagactggtacaaagattgattgaaatacaccctgaaataacaagcaagaagcagcaagtattaagaacgattcgtgctctggtacatgccaatttagaaaaaggaaacttgatatcccatgaaattagcgaaatccctatg

SEQ ID NO: 488 - protein, 234 aa, Unknown
  Obtained from environmental sample
  DOMAIN (8)...(109): Cell division protein 48 (CDC48), N-terminal domain
  misc_feature (1)..(234): Xaa is any amino acid
MADNSGFSLKVLENEIQDKDRDIVRIDPEIMHMLNIAEGALVNIIGPKNSASIICLSLHPTDEIEDNMNNNNNKNSNKNTNDKIIRIDAKSRDFIGTRIGDNVTVKKIVLAENDNRSGKMNIELTDDIANSIIINGSCINFDKERPKIMEYLGSLQKEVHMDSIYYKCYANGKKTLGWDFFDVVVDLRLVQRLIEIHPEITSKKQQVLRTIRALVHANLEKGNLISHEISEIPM

SEQ ID NO: 489 - DNA, 714 bp, Unknown
  Obtained from environmental sample
  misc_feature (1)..(714): n is a, c, g, or t
gtgcatctcgcattaaatcggcttgctgaaaaaggagatgtactagggttaatttcagaaattgagataaataccatccaggatggtaaaagaaagtacccattattcaaaaaaattcctttttctaataatgatagtttggaagattacattaaatcttctcccgaaggattagtaatagattataaagacgaaacctctttgaagatacttcagaattttaggaaaaagtttgatgggccaatattggtggatgtcagtgaaatttttccgttccatattaaaactatactaggagaggaagcagatggtattatagtagatacagaaaaggttataaaaaatgaaagatacaaaggaaaacatgcaatagccgtgattcatgatgcaaagaacgctatagatgatttttacaaaggaagagaagcaaataatgatgattacgataacgaagataacgcgatattggtaatagcaggagacgtaaacagtgcaggaaagattgtaaaagcagcggcattaggagctaatgtcataggatattctacaagtatgctgatagcacattctcacatttattctgaaaaaacctctaacgctagttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntag

SEQ ID NO: 490 - protein, 237 aa, Unknown
  Obtained from environmental sample
  misc_feature (1)..(237): Xaa is any amino acid
MHLALNRLAEKGDVLGLISEIEINTIQDGKRKYPLFKKIPFSNNDSLEDYIKSSPEGLVIDYKDETSLKILQNFRKKFDGPILVDVSEIFPFHIKTILGEEADGIIVDTEKVIKNERYKGKHAIAVIHDAKNAIDDFYKGREANNDDYDNEDNAILVIAGDVNSAGKIVKAAALGANVIGYSTSMLIAHSHIYSEKTSNASSXXXXXXXXXXXXXXXXXXXXXXXXXXXXXXXXXXX

SEQ ID NO: 491 - DNA, 459 bp, Unknown
  Obtained from environmental sample
  misc_feature (1)..(459): n is a, c, g, or t
atggatgttaaaagaaaattcagttttactgaagctctcacttatatgaaaaatatgcctaacactgtcatggcgtgcaaagaaagtggtttttctcctaaattgtataaacatgataaagaaaaattcctttgttggaatgatttttctagggaatgggaagaatgtattttccctacttttgttcaaaaaaatgactggtttttttctgaaaaaaaatcgatagatttaagtaatttaaataaacatgtcaattacgacacctctattgcatttacaatcaacaaaataggagatgatttttttatgcaaacgattatgataccacgccaaactttttttaaagatccggtatctattgttaaaatgataaatttgaatagtattgaaggatttatttcacaggcctcatcagaatttaaagatgtatttacagaaactaatcaagggatagtttga

SEQ ID NO: 492 - protein, 152 aa, Unknown
  Obtained from environmental sample
  misc_feature (1)..(152): Xaa is any amino acid
MDVKRKFSFTEALTYMKNMPNTVMACKESGFSPKLYKHDKEKFLCWNDFSREWEECIFPTFVQKNDWFFSEKKSIDLSNLNKHVNYDTSIAFTINKIGDDFFMQTIMIPRQTFFKDPVSIVKMINLNSIEGFISQASSEFKDVFTETNQGIV

SEQ ID NO: 493 - DNA, 618 bp, Unknown
  Obtained from environmental sample
  misc_feature (1)..(618): n is a, c, g, or t
ttgaatccggcttttaacggggtggaacaggttttgtaccgggagaaaaaattgccgctgacccaaatgatcccctggagaaagggcatcctaggcatcatcaaaaatttgaaacccaagaatgttttagagattggtgtaggctcaggattgttaatgtttccactgcttccagagggtcaaaaatttgtagggattgacatctccagcactgtaatagacaggcataaaaaatctctcgaaggccgtggttatgactcggagctatttcatttaaaagcggatcaagtagatcaattatctgatctttatgacactattattatgaattccgtttgtcaatattttccaaccatccattattttcaagacgttcttcataaagcttttctaaaactctcgtccaatggatcgatttttatcggtgacgtccgaaactacgataggcacaaagatctcataaaagaaaaatttgatttcagaaaacaactctatacgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntag

SEQ ID NO: 494 - protein, 205 aa, Unknown
  Obtained from environmental sample
  misc_feature (1)..(205): Xaa is any amino acid
MNPAFNGVEQVLYREKKLPLTQMIPWRKGILGIIKNLKPKNVLEIGVGSGLLMFPLLPEGQKFVGIDISSTVIDRHKKSLEGRGYDSELFHLKADQVDQLSDLYDTIIMNSVCQYFPTIHYFQDVLHKAFLKLSSNGSIFIGDVRNYDRHKDLIKEKFDFRKQLYTPXXXXXXXXXXXXXXXXXXXXXXXXXXXXXXXXXXXXXX

SEQ ID NO: 495 - DNA, 771 bp, Unknown
  Obtained from environmental sample
  misc_feature (1)..(771): n is a, c, g, or t
atgggcaggcatgcagtatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatcaaagaagtaaatgacgaagaaagaatataccaagttgatgaccaaacatacatcttcgatcagattaaacaaatcaaatggcagcagaattcagacataacagaaattcaagcaactcaagctgagaaattgttagaaaaatacacagacatctttgcagggaataccagacaaccaaggctgacaaccaaggtcaaacatgtgatcgatactggaacagccagacctatcaaattacggacatacagaacgagcccacatgaagatgaaatagctgaaaaagaagtaaatgagatgctcaaaaacggcacaataagaccttcaaagagcccttggagttcaccaattgtgttggtcacaaagaaagacggagctataagattctgtgtggattacagaaaactcaacgagatcacaaagaaggatgtatatccaataccaagagtagatganatcttggataaaatggctcgaatgaagtactacacaaccttggatctagcaagtggctattggcaagtagaaatcatggaaacagacaaggaaaagactgctttcaccaccaagaaaggattcttcgaatttaacaatatgccatttggtctctgcaatgcaccagcaacatccaacggatga

SEQ ID NO: 496 - protein, 256 aa, Unknown
  Obtained from environmental sample
  SIGNAL (1)...(20)
  misc_feature (1)..(256): Xaa is any amino acid
MGRHAVCXXXXXXXXXXXXXXXXXXXXXXXXXXXXXXXXXXXXEIKEVNDEERIYQVDDQTYIFDQIKQIKWQQNSDITEIQATQAEKLLEKYTDIFAGNTRQPRLTTKVKHVIDTGTARPIKLRTYRTSPHEDEIAEKEVNEMLKNGTIRPSKSPWSSPIVLVTKKDGAIRFCVDYRKLNEITKKDVYPIPRVDXILDKMARMKYYTTLDLASGYWQVEIMETDKEKTAFTTKKGFFEFNNMPFGLCNAPATSNG

SEQ ID NO: 497 - DNA, 471 bp, Unknown
  Obtained from environmental sample
  misc_feature (1)..(471): n is a, c, g, or t
ttggtcttcgtgtattttcttgatttgattgtcaacatacttcttttcttctttcgctttttctacgaaatcttccggagactccccgttttccatgcttcaaaaaaaaatatttcagtttattttttcaagatggcgcaatgcccggacggtgtgaaaaagtttcttcaagaaaaaacggcggagtattcaacggatgcatggaatgaagaaatcgttgggaaaaaactgatgacgcagtttgctcttattcaaatcgttcctgccatcccaaaacatttattaattcgatacgaaacattccaatatcgacttcattgtgatcataaacgcggtcgctgcatgaatttttcttcgcaggaaattcttcaggcattgcggaccgaattccccggatttgagttttccggttggtctagtaacgaatattataattgttacatagacatcaaaattataccgccaaaataa

SEQ ID NO: 498 - protein, 156 aa, Unknown
  Obtained from environmental sample
  misc_feature (1)..(156): Xaa is any amino acid
MVFVYFLDLIVNILLFFFRFFYEIFRRLPVFHASKKNISVYFFKMAQCPDGVKKFLQEKTAEYSTDAWNEEIVGKKLMTQFALIQIVPAIPKHLLIRYETFQYRLHCDHKRGRCMNFSSQEILQALRTEFPGFEFSGWSSNEYYNCYIDIKIIPPK

SEQ ID NO: 499 - DNA, 399 bp, Unknown
  Obtained from environmental sample
  misc_feature (1)..(399): n is a, c, g, or t
ttgttagttattccaaagataaatattgtcgagcctatttttcaaaaaggcaaatcttctctaaacaaaggtatctggcataaattttcagacaggtcagatccccaaaaaggaggaaacttcgtgctcacaggccatcgttttacttttggtatgactccagacgaaactctgagaaaatcacccttatacaatgtcgataaattagttgtcggagacaagataaaggttaaatggaatggtcaatcctatgactataacatttattcaattaaggaagttccaaagactgaagtaaagattgaagatcaaacaaaggatgatattttaactctttacacctgtacttttattggagaggatggacctaggtttgttattagagcgaggcctatataa

SEQ ID NO: 500 - protein, 132 aa, Unknown
  Obtained from environmental sample
  DOMAIN (2)...(132): Sortase family
  misc_feature (1)..(132): Xaa is any amino acid
MLVIPKINIVEPIFQKGKSSLNKGIWHKFSDRSDPQKGGNFVLTGHRFTFGMTPDETLRKSPLYNVDKLVVGDKIKVKWNGQSYDYNIYSIKEVPKTEVKIEDQTKDDILTLYTCTFIGEDGPRFVIRARPI

SEQ ID NO: 501 - DNA, 585 bp, Unknown
  Obtained from environmental sample
  misc_feature (1)..(585): n is a, c, g, or t
ttgcaaaaggaaatcgaaatcacactcgccgcgaaagaaaatcgcgtgacggttttgcatcggctcaccaacaaaaatttgtggactgttgaagctgcgccgtgggctttgtctgtgatggaaggaccggggcgtgcgatttttccgcaggaaccggtcgtgaaacaatttttgccggttcgtccacttgcgctttggggttataccgacatgcgcgacgaccgttacatttggggcacaaaatatattcaggtcaaatgcgatccaaaagccgataacccacaaaaaatcggcataatgaacacgctcggttgggccgcgtacgttcgcgacgaagatattttcatcaagcgattcggtttcgatgcgaaagcaacttaccccgacttcaactgcaatttggaatgttacacgcgcggcgacatgatcgagatcgaaagcctcggcccgcttcacaaaattgaagctggagcaaaagtggaacacatcgaaacctggtatcttttcaaagagaaaatcggcgaagacgaagtttcgattgataaaaaacttctgccactcgtgaagcaaacgagtcttccgtaa

SEQ ID NO: 502 - protein, 194 aa, Unknown
  Obtained from environmental sample
  misc_feature (1)..(194): Xaa is any amino acid
MQKEIEITLAAKENRVTVLHRLTNKNLWTVEAAPWALSVMEGPGRAIFPQEPVVKQFLPVRPLALWGYTDMRDDRYIWGTKYIQVKCDPKADNPQKIGIMNTLGWAAYVRDEDIFIKRFGFDAKATYPDFNCNLECYTRGDMIEIESLGPLHKIEAGAKVEHIETWYLFKEKIGEDEVSIDKKLLPLVKQTSLP

SEQ ID NO: 503 - DNA, 603 bp, Unknown
  Obtained from environmental sample
  misc_feature (1)..(603): n is a, c, g, or t
ttggccgaagaagcaaaacatatttcaataccctttagctattatggcaagatgcaacagcaaaaaccaaaacctgaaccacttcctcctcatagcaagccaccagaaagcgatgaagaagctgccattgctttagcttatgattttttacaaaaaagagagcaaaaagaacaggcattagtgtatgcagaaatcggaaaatcgtttttggataaacagttagttacagtaaacgaaaacagcacggaagccatacaacaattagcccgccgcatgatggggtacaatattgtagccatggtgtatgtatggaacaatgaaatcaacaaggttgctgaagtggatacgctttatattcatcatcctcccatgtgggactatcttgaagatcacattcgaccacatttggaactgttaatggcaaaaaagcaagtggactatgtaaaacatttgttcactgataaagaattccgtaaccgttttttagctcattacgaaacttttgtttcgctgttcattgatgatacatatccattaactatgaaaggttatgtgattgacatagttaacagggtgaataatatgcgagatacttatttgtga

SEQ ID NO: 504 - protein, 200 aa, Unknown
  Obtained from environmental sample
  misc_feature (1)..(200): Xaa is any amino acid
MAEEAKHISIPFSYYGKMQQQKPKPEPLPPHSKPPESDEEAAIALAYDFLQKREQKEQALVYAEIGKSFLDKQLVTVNENSTEAIQQLARRMMGYNIVAMVYVWNNEINKVAEVDTLYIHHPPMWDYLEDHIRPHLELLMAKKQVDYVKHLFTDKEFRNRFLAHYETFVSLFIDDTYPLTMKGYVIDIVNRVNNMRDTYL

SEQ ID NO: 505 - DNA, 534 bp, Unknown
  Obtained from environmental sample
  misc_feature (1)..(534): n is a, c, g, or t
ttgcaggaatatactttacttgccatggaaagaatgaaagggaatgatgatgtgatcctggtaaaaaatagcgtttctgtaaacgatcgatctgaagagcccgaagctgctaccgaggaggctgggatcaatgtctccagttttccgcagggtgtatttaagatcaatgacacgaaagtcaccattattaaaaaatctacatcatacctgaaggtagctgaggagaataatattacccttgcacgcctgtttgaatttaatgatatgaagccttcagatattgcagaaaaagatcacctgctttacctgcaacgtaaaaggaaaacaggtgccagtgatgtacatgtagttgcaaatggtgaaacactgcaccaggtttcacaactccagggcatacgtctgcagaatcttctggaatacaattcactcaaaggcaccgaggaaattccttccggaaccaccttatcactaaagggcccgggacctgctataaaattatttgggatcaaagaaaccaaagctgaaataagatag

SEQ ID NO: 506 - protein, 177 aa, Unknown
  Obtained from environmental sample
  DOMAIN (115)...(158): LysM domain
  misc_feature (1)..(177): Xaa is any amino acid
MQEYTLLAMERMKGNDDVILVKNSVSVNDRSEEPEAATEEAGINVSSFPQGVFKINDTKVTIIKKSTSYLKVAEENNITLARLFEFNDMKPSDIAEKDHLLYLQRKRKTGASDVHVVANGETLHQVSQLQGIRLQNLLEYNSLKGTEEIPSGTTLSLKGPGPAIKLFGIKETKAEIR

SEQ ID NO: 507 - DNA, 603 bp, Unknown
  Obtained from environmental sample
  misc_feature (1)..(603): n is a, c, g, or t
gtgttaagtgtgtttaatggttttgaagacctggtgaaatctttatactcttctttttatccagatctgaaaatctcgcctgtttccggtaaacaaataacccttacacaggaacagctgaataaattaagagctgttaaaggagtgaggagcgtttcggtaattgcggaagaaaaagctttattgcagaacggggaataccaatccattatttatttaaaaggggttgatgagaattatacatctgttaccacggttgcagatcatataattaaaggatccttcaacacaggagaaactgaaaatccccggctggttttaggagcgggtattgaaaatgcggtgggagttcaggcagacaggaatttatctcctttaactgtttatctcccaaaaaaaacggaggtaaatctttctaatccattgcaatcaataagcgccgataccatcaacaccgcaggtacgttcgttattcagcaggactttgataataaatacgctataaccaacctgggctttgtaaaaaaatgctggatatgcctgcagatgcatatagtgctgccgaaaacagtattaagccagatgctgatgaaaaagatgtaa

SEQ ID NO: 508 - protein, 200 aa, Unknown
  Obtained from environmental sample
  misc_feature (1)..(200): Xaa is any amino acid
MLSVFNGFEDLVKSLYSSFYPDLKISPVSGKQITLTQEQLNKLRAVKGVRSVSVIAEEKALLQNGEYQSIIYLKGVDENYTSVTTVADHIIKGSFNTGETENPRLVLGAGIENAVGVQADRNLSPLTVYLPKKTEVNLSNPLQSISADTINTAGTFVIQQDFDNKYAITNLGFVKKCWICLQMHIVLPKTVLSQMLMKKM

SEQ ID NO: 509 - DNA, 636 bp, Unknown
  Obtained from environmental sample
  misc_feature (1)..(636): n is a, c, g, or t
gtgaaagttcttctatcaacagcactccccatagctttatgctgcctgctgttacaacccgcaacaaataaaattccggcagaaaataaaatttatacagcccccccgatcagggaaactggaaatgatctttttgacagcgaagaaatcctgaatataaaattgtcgggaaagatccgtcaactatttgcagaccgctccgatgatggagcctatcatccactggtgcttacttataaaggcgctgatggtaacgacgtaaccattaatttaagaggcaaaacaagaggaaattttcgccgtaaaaaagaaaattgtacttacccgcccattctgctgaattttacaaggaaagaacaccagccctcactctttgatcaacaggataaattaaaactggttactccatgcgcaggtgataactatgttatccgcgaataccttgtttataaattatacaacttggttactcccaaaagctacagggccagattggtgaaagtaacttttgacgatatagaaaagaaaaaagaaacctcattttacagcatgttactggaagaagatgagcagatggccctacgcaacaaatcgaagttaatggctataaaaaacctgaatggagaaatacagaaa

SEQ ID NO: 510 - protein, 212 aa, Unknown
  Obtained from environmental sample
  SIGNAL (1)...(18)
  misc_feature (1)..(212): Xaa is any amino acid
MKVLLSTALPIALCCLLLQPATNKIPAENKIYTAPPIRETGNDLFDSEEILNIKLSGKIRQLFADRSDDGAYHPLVLTYKGADGNDVTINLRGKTRGNFRRKKENCTYPPILLNFTRKEHQPSLFDQQDKLKLVTPCAGDNYVIREYLVYKLYNLVTPKSYRARLVKVTFDDIEKKKETSFYSMLLEEDEQMALRNKSKLMAIKNLNGEIQK

SEQ ID NO: 511 - DNA, 567 bp, Unknown
  Obtained from environmental sample
  misc_feature (1)..(567): n is a, c, g, or t
atgtcagatgaaagtggaaacgttggaacatatactgaaattgatatagttaaggatactattaaaaaagccaattcagttaatttattagaagtattaaaaaaatataatctaaatttagatagttataatcgcaaaatatgctgtcctttttctttccataaaatgggtagagaaacgacagcatctttttattattatccagatagtaatagtttttattgttttggatgcaaatcttctggatctactgtagattttgtttctttatatgaaaatataacgaaatataaagccgcattagctttaatagaaggatatgaggctgatgttaatttacaaaattcagaatcctctggaattgaagatcaacgattacatcttgaattttcacaccttattagagagtttattactcttaacaaggataattatgaggctttagagtactctgaaaaattgtcagctgcttttgatgaaattaactctaaatataatttagatcctggtgggttgaaattattaattaagaaacttaagcttaaaattgaactatttagtaagtag

SEQ ID NO: 512 - protein, 188 aa, Unknown
  Obtained from environmental sample
  DOMAIN (16)...(116): CHC2 zinc finger
  misc_feature (1)..(188): Xaa is any amino acid
MSDESGNVGTYTEIDIVKDTIKKANSVNLLEVLKKYNLNLDSYNRKICCPFSFHKMGRETTASFYYYPDSNSFYCFGCKSSGSTVDFVSLYENITKYKAALALIEGYEADVNLQNSESSGIEDQRLHLEFSHLIREFITLNKDNYEALEYSEKLSAAFDEINSKYNLDPGGLKLLIKKLKLKIELFSK

SEQ ID NO: 513 - DNA, 615 bp, Unknown
  Obtained from environmental sample
  misc_feature (1)..(615): n is a, c, g, or t
atgtcaggaaaagcgggtggtggtaaaaacactgccgcagaaattattattaaagacattcttaagttaaatgataatgagttttatttggctgcctttgcagatccaataaaagaaataattcaaaaaatgttcccaagttgtgatcctgaaagtctctatggcgattctaaattgcgccaaaacaggattgcttctgatttagatgaattttccaataaaagtattggaacttctttcaggcaggcttctatcgatattggtaaattaggtaggtcttatgacaataatttttgggtttggcacgctcaaaataagtttaataaaatgaaagaaactaacataaaagcttatcttatttctgatcagagatttcctgaagaattacgatggcttaaatcagagggttttaccctttgtcgtattaagagagaggataatagtaatattaatgatatttctgaatatgttcaggatcaattatcagatgatcaatttgatatcgtcattaataataattattcattagataacttaaaaaaacaacttcaacaggcacttgataaacaatttcataataatatgacatatttacaagtgagaaatgcagtctga

SEQ ID NO: 514 - protein, 204 aa, Unknown
  Obtained from environmental sample
  misc_feature (1)..(204): Xaa is any amino acid
MSGKAGGGKNTAAEIIIKDILKLNDNEFYLAAFADPIKEIIQKMFPSCDPESLYGDSKLRQNRIASDLDEFSNKSIGTSFRQASIDIGKLGRSYDNNFWVWHAQNKFNKMKETNIKAYLISDQRFPEELRWLKSEGFTLCRIKREDNSNINDISEYVQDQLSDDQFDIVINNNYSLDNLKKQLQQALDKQFHNNMTYLQVRNAV

SEQ ID NO: 515 - DNA, 330 bp, Unknown
  Obtained from environmental sample
  misc_feature (1)..(330): n is a, c, g, or t
atgcatgagaaaaaacaggaaaaagattttcatgattatagaaaagatattgatatcgcaaagaaatcaatgctagattacagtcaagaatgccaggagaatgcagaaaaagagacagaacctttcaaaaaggaagtcttaatgacatttagccgcatgggtgtccaaatggaagacctttatagcaatattgaagttttattggttgccaatcatatcagaactaagagattcgaagatctagttgagttaattttggggttaaaagaagttaaaaataatcatgaattacgcaaacatatctcagaaattttatctgaggactattga

SEQ ID NO: 516 - protein, 109 aa, Unknown
  Obtained from environmental sample
  misc_feature (1)..(109): Xaa is any amino acid
MHEKKQEKDFHDYRKDIDIAKKSMLDYSQECQENAEKETEPFKKEVLMTFSRMGVQMEDLYSNIEVLLVANHIRTKRFEDLVELILGLKEVKNNHELRKHISEILSEDY

SEQ ID NO: 517 - DNA, 450 bp, Unknown
  Obtained from environmental sample
  misc_feature (1)..(450): n is a, c, g, or t
atggtaaacaaactagttttagtttctccagctgggaccatgaaaaattcgacgagaacactggaggagtatattctcgcgtctctttatccaacacatgataatgcttggagagccttcatcaatatggcatttgacccccgaacagttacggaacaaactgtagaagattttatcgatagaatgaaacttccgaatgcaaaatacgcatttatgtctaccatgcttggaatcaggaatactctaaacttgtcttctcgactcgacaagatactttcacctacgataatagtatggggagaacaggacgaaatgataccggtcaaatatgcagacgattataagaaaattctcaaatctaatttgatagtaataccaaaatgtggtcatacaccctttactgaaaaaccagaaatattttctaaaatagcaatcgatttcttgagatga

SEQ ID NO: 518 - protein, 149 aa, Unknown
  Obtained from environmental sample
  misc_feature (1)..(149): Xaa is any amino acid
MVNKLVLVSPAGTMKNSTRTLEEYILASLYPTHDNAWRAFINMAFDPRTVTEQTVEDFIDRMKLPNAKYAFMSTMLGIRNTLNLSSRLDKILSPTIIVWGEQDEMIPVKYADDYKKILKSNLIVIPKCGHTPFTEKPEIFSKIAIDFLR

SEQ ID NO: 519 - DNA, 357 bp, Unknown
  Obtained from environmental sample
  misc_feature (1)..(357): n is a, c, g, or t
atgatatcaaatatgcttaactatcctaatccatttacaacatcaaccgcttttgtctttacaattacaggttcagaagtgccacaaaatatcaaaatacaaatactgacaattacaggtaaagttgttagggaagttacaaaagatgaacttgggccattaagagttggaaggaatattacagagtataaatgggatggtacagatcaatatggtcaaaagcttgccaatggtgtctatttgtatagagtagttaccaacctgaatggtaaagcgttggaaaagttcagggatgatggcgacgacaccgataaatattttaataaaggttatgggaaaatgtacctgatgcggtaa

SEQ ID NO: 520 - protein, 118 aa, Unknown
  Obtained from environmental sample
  misc_feature (1)..(118): Xaa is any amino acid
MISNMLNYPNPFTTSTAFVFTITGSEVPQNIKIQILTITGKVVREVTKDELGPLRVGRNITEYKWDGTDQYGQKLANGVYLYRVVTNLNGKALEKFRDDGDDTDKYFNKGYGKMYLMR

SEQ ID NO: 521 - DNA, 705 bp, Unknown
  Obtained from environmental sample
  misc_feature (1)..(705): n is a, c, g, or t
ttggaaggactccgtatgcgcgaagaaaagaaaattattccaccaaagtttgtaattgagaaagttttaaccgagatgcgtaacttcacaaatcaaaagccgaaagaaaacattttgtatacatcgtttgatgaaaaaattaagaagctttcagacataagtgaaaccgacagatccaaactttatggagatgtggggcatgaaattacgagcactgtatatcccgcgtacaaaaaattgattgcatactttgagcagctggaaccaaaagcaacgactgatgatggagtgtggaagcttccggacggcgatgcttactatcgctggatgctgaaatccaacaccacttcagacatgactccagaacaggtgcatgaattaggcttgaaggaagtggatcgcattcatactgagatgcgatcgatcttggatagcgttggattaactggtgaaacaatttcccagcgcatgaatgaattgcggaacgatccgcgttttcaatatccacctactaacgaaggacgtcagcaatgtgtcaacgattatcaaaatatcatcaatgaagtggatcgaggaattacaaaggtctttgatatcagacctaaaatcggagttaaagtggaacgcgtaccggcatttaaagaagcaggatcttccggcgcctactacgaacctgcttccatggatggngtgcgccccgnagtg

SEQ ID NO: 522 - protein, 235 aa, Unknown
  Obtained from environmental sample
  DOMAIN (1)...(235): Bacterial protein of unknown function (DUF885)
  misc_feature (1)..(235): Xaa is any amino acid
MEGLRMREEKKIIPPKFVIEKVLTEMRNFTNQKPKENILYTSFDEKIKKLSDISETDRSKLYGDVGHEITSTVYPAYKKLIAYFEQLEPKATTDDGVWKLPDGDAYYRWMLKSNTTSDMTPEQVHELGLKEVDRIHTEMRSILDSVGLTGETISQRMNELRNDPRFQYPPTNEGRQQCVNDYQNIINEVDRGITKVFDIRPKIGVKVERVPAFKEAGSSGAYYEPASMDGVRPXV

SEQ ID NO: 523 - DNA, 681 bp, Unknown
  Obtained from environmental sample
  misc_feature (1)..(681): n is a, c, g, or t
ttgaaatgctctgcccaagtagttgaaaaaataaaacacttcgtatccagaaatgcttttaatatagaaggcttaggtgaaaaacaagtggaagaattttttcatatagggttaataaaaaatcctgtcgatatttttacattgcaagataaaaaccaaacagaaaatattaatatagagcaattcgatggatggggcgcaaaatcagtacaaaatctatgggattctatagaaaaatccaaagatgtctctttagatagttttatttattcgttaggcattcgttatataggtgaagccacagctaaactacttagcaaaaattttatgactttggagaaaataattgagatttctaattcagagcaagcgtatgaagttttaattgccattgatggtataggtactaaggtggcatcagaaataataaaattttttaccgatacttactatttagaattagtaagaagactaactaattatgttaaaattagaccaaccctggtacaaggaattgttggaggacctctccattctaagcgcttagtatttaccggcactttagaaaaaatgagtcgtagtgaagctaaagctactgctgaaagacttggtgcaattatctcctcttctatttccaataagacagactatttaaatgctgggacagatgcgggctcttag

SEQ ID NO: 524 - protein, 226 aa, Unknown
  Obtained from environmental sample
  misc_feature (1)..(226): Xaa is any amino acid
MKCSAQVVEKIKHFVSRNAFNIEGLGEKQVEEFFHIGLIKNPVDIFTLQDKNQTENINIEQFDGWGAKSVQNLWDSIEKSKDVSLDSFIYSLGIRYIGEATAKLLSKNFMTLEKIIEISNSEQAYEVLIAIDGIGTKVASEIIKFFTDTYYLELVRRLTNYVKIRPTLVQGIVGGPLHSKRLVFTGTLEKMSRSEAKATAERLGAIISSSISNKTDYLNAGTDAGS

SEQ ID NO: 525 - DNA, 795 bp, Unknown
  Obtained from environmental sample
  misc_feature (1)..(795): n is a, c, g, or t
atgatgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaccatacgtggacctatggattgctgtttctaaaaggtcagaagaatatttagaacttctaggcttgagaaatgtatatattccctatgaatatgatcagtcaaagttttttgaactagaaaaacaaatctcacgaacagaattgagaaaaaaatatgcattacctttcgataaatatctaataggaagctttcaaagagatactgaaggcagagatttaaaaactccaaaatatataaagggtcctgatatatttcttgcaatcacaaaaaagctttacgaaaaaaacaagaatatacatgtagttttagctggacctagaagatattggcttagggaaaaactaaaagaaaataacattccgtttagttttattggtaaagaaccagtagatggtgacgatctcgaaattaatacattaggttcggaagctataaacgaattgtataacgcattggatctatatatagtatctagtaggatggaaggtggtccgagggcgatattagaatgtattgcgactcagacaaaggtaatatctacagatgttggtattgctccagattttctgaataaagatcagatttatactgattttcttaatgctgttgaaataattgaaggtgatatagctacagatagtttaaaaagttttcaacaagaatcagcttctaaataa

SEQ ID NO: 526 - protein, 264 aa, Unknown
  Obtained from environmental sample
  DOMAIN (84)...(261): Glycosyl transferases group 1
  misc_feature (1)..(264): Xaa is any amino acid
MMYXXXXXXXXXXXXXXXXXXXXXXXXXXXXXXXXXXXAPYVDLWIAVSKRSEEYLELLGLRNVYIPYEYDQSKFFELEKQISRTELRKKYALPFDKYLIGSFQRDTEGRDLKTPKYIKGPDIFLAITKKLYEKNKNIHVVLAGPRRYWLREKLKENNIPFSFIGKEPVDGDDLEINTLGSEAINELYNALDLYIVSSRMEGGPRAILECIATQTKVISTDVGIAPDFLNKDQIYTDFLNAVEIIEGDIATDSLKSFQQESASK

SEQ ID NO: 527 - DNA, 570 bp, Unknown
  Obtained from environmental sample
  misc_feature (1)..(570): n is a, c, g, or t
gtgatgcaatataacaaaactaaaggaggttctcaactccaacatgaggatatttccgtgcaacccagtaaagttggagacaaacttgttgaagcaaccacactgaagctgatctttattgtcattatcattgtatttgtaggaattgttgtggaaattgttgctgaagataaattgcttccatcacaaattggaggtgggcttactatcctatccagtattggagcaagttatggaaccaatagcgaatttttcgccacttcgacatctttatatatctctaactacaaagaggtggtttatttaaaagcatatggccaagaactattagtgaaccaagaaagaatggatgagattccaaaggttgatattgtaaaattcaaatcggaggataagaacgtggaggccaagtttgacaacacagaaacagcaaagttagtcgctggaatgaacatcttgttcttagggaccattatatgtacgaatttattcaaagaatcaggttctaatatggagcaggtatgcttgttgttggaaatgtcttcatggttcgagatgcaaacaagatag

SEQ ID NO: 528 - protein, 189 aa, Unknown
  Obtained from environmental sample
  misc_feature (1)..(189): Xaa is any amino acid
MMQYNKTKGGSQLQHEDISVQPSKVGDKLVEATTLKLIFIVIIIVFVGIVVEIVAEDKLLPSQIGGGLTILSSIGASYGTNSEFFATSTSLYISNYKEVVYLKAYGQELLVNQERMDEIPKVDIVKFKSEDKNVEAKFDNTETAKLVAGMNILFLGTIICTNLFKESGSNMEQVCLLLEMSSWFEMQTR

SEQ ID NO: 529 - DNA, 642 bp, Unknown
  Obtained from environmental sample
  misc_feature (1)..(642): n is a, c, g, or t
atgtactatatacttacacccaatccaatgcctggtgttaaaacaacgatgaaaaaacatntacgtcagaatatagaccctgtatggtctgaaggagatggtgaatgtttagcagatatttataatgttttcggtaaaagtagaaaaggggatgttatgaatgtggctgatacgataagtagttggagtgaatgggagaaatcaacagtctccataggttttaatccaaaaacagaaaaattaatggaaaaatgtaatccgatatttttcgaattaaaagaaggtatcttatccattccaaagttaaaaattagtcttgattcgtatgttccgaatgatgcagggataattcagaaaacttttataaaaaatactaagattcctatctttatatttgccggtttaggaaccttagggacaagtgctgcgggttattattttaaaaaagaatatattaatctgggtaaactctatggttcaaaacctttttgtgtactttttggtgttaaatcggatgaaggtagatcatccgtttatcctagtgcaatttatccaacaccaaatttgattagtaagttatttcatcctatttcatatcttaaaatgaaaaatttatttatatctaaaactgaaaaagcatag

SEQ ID NO: 530 - protein, 213 aa, Unknown
  Obtained from environmental sample
  misc_feature (1)..(213): Xaa is any amino acid
MYYILTPNPMPGVKTTMKKHXRQNIDPVWSEGDGECLADIYNVFGKSRKGDVMNVADTISSWSEWEKSTVSIGFNPKTEKLMEKCNPIFFELKEGILSIPKLKISLDSYVPNDAGIIQKTFIKNTKIPIFIFAGLGTLGTSAAGYYFKKEYINLGKLYGSKPFCVLFGVKSDEGRSSVYPSAIYPTPNLISKLFHPISYLKMKNLFISKTEKA

SEQ ID NO: 531 - DNA, 525 bp, Unknown
  Obtained from environmental sample
  misc_feature (1)..(525): n is a, c, g, or t
atgaacagatctgagatactaacgaaaattgacaatcccagggagcttgaaaaattgtaccatgacaataagacggcctttaaaacagagtttaatttactttaccctgaactaacggacaataaacttgcagagtattggaatgaaagactgaattacgaaagctccgaaatatcctgggggagcaaaaaagaactaatttttgtaataattgcttcgttattagcgggtgttattgcaaagcttcctgaattatttaatatcaatcctgaatctttttaccagaggaatataggatttatcattttcccaattttgacaacttactttatttggaaaaataacctttcaccaaagaaaattgtatttgcagcggtcgcatttttgatttctttaatcttcatcaatctgttgcctgccgataacaaaagtgacacaatgattttgtcttgcattacttgccgctattttgtgggagtcttaggtttcatatgtggcgacacctccaagcaccacaaaaactta

SEQ ID NO: 532 - protein, 175 aa, Unknown
  Obtained from environmental sample
  misc_feature (1)..(175): Xaa is any amino acid
MNRSEILTKIDNPRELEKLYHDNKTAFKTEFNLLYPELTDNKLAEYWNERLNYESSEISWGSKKELIFVIIASLLAGVIAKLPELFNINPESFYQRNIGFIIFPILTTYFIWKNNLSPKKIVFAAVAFLISLIFINLLPADNKSDTMILSCITCRYFVGVLGFICGDTSKHHKNL

SEQ ID NO: 533 - DNA, 318 bp, Unknown
  Obtained from environmental sample
  misc_feature (1)..(318): n is a, c, g, or t
atggcatttaataaaacaatcactataattacgatggtgtcagtaaaatcgccaataaacccggaaacgattgctgcagcaattaagattaagatcattacgtctttaaactgcgaaagcaacattcttgctatactcttctttttaccttcttccagttcgttggggcctgtttgttttagttttttttcggcttcaagggtagttaaaccttgcttgttcgtattcaataattttaaaacctccggtatgcttaattggtgccattgcatggtaaaatcgcttgtaacattttataaaattatttataaaaaataa

SEQ ID NO: 534 - protein, 105 aa, Unknown
  Obtained from environmental sample
  misc_feature (1)..(105): Xaa is any amino acid
MAFNKTITIITMVSVKSPINPETIAAAIKIKIITSLNCESNILAILFFLPSSSSLGPVCFSFFSASRVVKPCLFVFNNFKTSGMLNWCHCMVKSLVTFYKIIYKK

SEQ ID NO: 535 - DNA, 399 bp, Unknown
  Obtained from environmental sample
  misc_feature (1)..(399): n is a, c, g, or t
atgtcaaaacgcattttgggcggcaccatgattttggatgatggaagctccaggagccaaagcgaagttcacgagcgtcagttagatgagaagataactgaaggtgaccgccggatgattgagttttttgtaaacgataagtttattcccctgctcaggaattggggatttgcttttactgataatgaagtattcgccttcgaccgcacagaagaaataagcctgtcggatcactggaagattgtaaacgaggcttcagaaaatttcgaaatagacccggattgggttgccgaacgtttcaatattaaaatcattggcaagaaagaagcccctaatccaacccaacaacccgtcaagcccgcaaaaccagcgaaagcttttacctcaaattttcaatag

SEQ ID NO: 536 - protein, 132 aa, Unknown
  Obtained from environmental sample
  misc_feature (1)..(132): Xaa is any amino acid
MSKRILGGTMILDDGSSRSQSEVHERQLDEKITEGDRRMIEFFVNDKFIPLLRNWGFAFTDNEVFAFDRTEEISLSDHWKIVNEASENFEIDPDWVAERFNIKIIGKKEAPNPTQQPVKPAKPAKAFTSNFQ

SEQ ID NO: 537 - DNA, 627 bp, Unknown
  Obtained from environmental sample
  misc_feature (1)..(627): n is a, c, g, or t
gtgcttataattacttcgggtaaagcaaatggagaattatacagtgatgatttaataagggatacgctacaatcattcaacgccataaaaacgatacagcaatataatggtgaggcgggatgtaaccgctatattatcagtcaatgtaacagcgcactaaatgtgattgaggtttatggtttgtttttattgaatggatggaaaaaagaaaaattattagtagatatcgttcctctttttgaaaccattgaagatctgaagcatgccccggttattatggaaaccttgtatgcaaataaaacctacaggcaacatttaaaaaagagaaataaccggcaaaccatcatggttggtttttctgatggaacaaaagacgggggatatttaatggccaactggagtattttcaaggcaaaagaaaacctttcgaacatttccagggagtacaatattgatgttgtttattttgatggtagaggtgggccacctgcaagaggcggtggcaaaacacacaagttttacgcctcaatgggaaagaatatttctaataaagaaattcnnnnnnnnnnnnnnnnnnnnnnnnnnnnnnnnnnnnnnnnnnnnnnnnnnnnnnnnnnnaggaggtaa

SEQ ID NO: 538 - protein, 208 aa, Unknown
  Obtained from environmental sample
  misc_feature (1)..(208): Xaa is any amino acid
MLIITSGKANGELYSDDLIRDTLQSFNAIKTIQQYNGEAGCNRYIISQCNSALNVIEVYGLFLLNGWKKEKLLVDIVPLFETIEDLKHAPVIMETLYANKTYRQHLKKRNNRQTIMVGFSDGTKDGGYLMANWSIFKAKENLSNISREYNIDVVYFDGRGGPPARGGGKTHKFYASMGKNISNKEIXXXXXXXXXXXXXXXXXXXXRR

SEQ ID NO: 539 - DNA, 528 bp, Unknown
  Obtained from environmental sample
  misc_feature (1)..(528): n is a, c, g, or t
atgaaaaaatacgatgagaaaaatgggatggaaacccttgtccctcaagaggtaattgaagtaacaggggccagggaacataatttaaagaacataaatattgttattccaaaaaataagttggttgttattacgggcattagcggaagcggcaaatcttcgcttgcatttgatactatttatgccgaaggccaacggcggtatatggaaacatttggagcatatgcccgccaatttattggtgaaatggaacggccggatgtggaccagatcaccggactgtcgcctgttatttccattgaacaaaaaaccacgaataaaaatccccgttcaacagtaggtaccgtaacagaagtatatgatttcttgcgtctcttgtttgccanggcaaagcgagcatactcctataacacaggtaagaaaatgggtaagtgnagtgaggacgaaattgtgaaacatatttttaaaaaatttgnagggctgaaaattagttnattgnccccnttggtnnagagaagaaaggacatn

SEQ ID NO: 540 - protein, 176 aa, Unknown
  Obtained from environmental sample
  misc_feature (1)..(176): Xaa is any amino acid
MKKYDEKNGMETLVPQEVIEVTGAREHNLKNINIVIPKNKLVVITGISGSGKSSLAFDTIYAEGQRRYMETFGAYARQFIGEMERPDVDQITGLSPVISIEQKTTNKNPRSTVGTVTEVYDFLRLLFAXAKRAYSYNTGKKMGKXSEDEIVKHIFKKFXGLKISXLXPLVXRRKDX

SEQ ID NO: 541 - DNA, 702 bp, Unknown
  Obtained from environmental sample
  misc_feature (1)..(702): n is a, c, g, or t
atgaaaataactttttcatttccatcgagaagtaggccaaagaagttctttgcagccttagatagtattcgtgaaatgtcggcttctgataattacgaggtaattgcaaaactagatctggacgacacagaaacaaacaacttcgccaataggggcaggttgctggattacccggaagtaaaacctatatgggcttactctaaaagtaaagtacatgccattaaccggggtttggaatacatacaaggggaagtagtttgctgccattctgatgatatggtctttattaaaaaagggtttgacgatattatcagaagggaaatggagaaagatatttacctacactttccggacggttatgcaaacgaaaggttgtccacgtactcaataatgcacatagattattacaggaggtttaattacatatattttcctcaatacaaatccctgtggtgcgataacgaacaaatggaagtggctaaaaggttaggacgatataaatatgtgaatgagcaaatatttgaacaccggcaccctgcgtggggtttagctgaaaaggatgcacagtacatcgaaacagaaaaatttatattctggacaaagcaactttccaaagagggcaaaataattttngtttatgagactgataaacccttcaaactatctgtctctgtgggactgccgggattttcaagttggtaa

SEQ ID NO: 542 - protein, 233 aa, Unknown
  Obtained from environmental sample
  DOMAIN (4)...(174): Glycosyl transferase
  misc_feature (1)..(233): Xaa is any amino acid
MKITFSFPSRSRPKKFFAALDSIREMSASDNYEVIAKLDLDDTETNNFANRGRLLDYPEVKPIWAYSKSKVHAINRGLEYIQGEVVCCHSDDMVFIKKGFDDIIRREMEKDIYLHFPDGYANERLSTYSIMHIDYYRRFNYIYFPQYKSLWCDNEQMEVAKRLGRYKYVNEQIFEHRHPAWGLAEKDAQYIETEKFIFWTKQLSKEGKIIXVYETDKPFKLSVSVGLPGFSSW

SEQ ID NO: 543 - DNA, 600 bp, Unknown
  Obtained from environmental sample
  misc_feature (1)..(600): n is a, c, g, or t
ttggttccttttattccgaatgttttcggaaaagaaagattgaaaagcgaggaaatccgtttagaaaatgaaggtcagccaacggcaaaaatgccaaaagaagtgacctattctaaaaatattaccgatttgtcacaatggattaatccgctaaatggttatcaatatgattctttcaatgccgatgttttgatcaatcgtgcgaaagttcagaacggtaaagtaacatttgatggcggaatcgaatacggcgctttattctttccgggaagtcacaaaatggcaccaaataagatgctttctttggcttccgccgaaaaaatactgcaactgctaaaagacggagcaacgatttttgtggatgaaaaaccaaatattcagccaggaattcaatcagaaatagatcaaaagaaatggcaagatgtaattgatgaaatctggaataacgccaattcatcaacatggaaaatcggaaaagggacagtcattaaattaccgtatttaggaaatgattttgcttccatcggaattactcaggatatttattttcctaatttaaagcgttctgaagctgaaacattggcttggggcgcatcgtaa

SEQ ID NO: 544 - protein, 199 aa, Unknown
  Obtained from environmental sample
  misc_feature (1)..(199): Xaa is any amino acid
MVPFIPNVFGKERLKSEEIRLENEGQPTAKMPKEVTYSKNITDLSQWINPLNGYQYDSFNADVLINRAKVQNGKVTFDGGIEYGALFFPGSHKMAPNKMLSLASAEKILQLLKDGATIFVDEKPNIQPGIQSEIDQKKWQDVIDEIWNNANSSTWKIGKGTVIKLPYLGNDFASIGITQDIYFPNLKRSEAETLAWGAS

SEQ ID NO: 545 - DNA, 414 bp, Unknown
  Obtained from environmental sample
  misc_feature (1)..(414): n is a, c, g, or t
atgaatcctgagcagatgaatattgatttcagaaaacatataaaaaatggcgtgccattttttaccgaccgcagattggttagtattatattgaacaatcttatttccaacgctatcaggtatagcgataactctgcttctgcgcccttcgttgaggtgatcatcgatgccactgccaaacaaacacgaatagaagtaattgataatggtattggtatttcaaaagaaaaccagcaaaagattttcagcatgttttacagggtatcagacgatgataatggcacgggcatgggactatatttagttaaaaaagccgttgaaaaactatccggtacaatatctctggagtctgaatacaaagtgggctctaagttcacgctaacaattccaaacatgatatccggaaaaaactaa

SEQ ID NO: 546 - protein, 137 aa, Unknown
  Obtained from environmental sample
  DOMAIN (22)...(132): Histidine kinase-, DNA gyrase B-, and HSP90-like ATPase
  misc_feature (1)..(137): Xaa is any amino acid
MNPEQMNIDFRKHIKNGVPFFTDRRLVSIILNNLISNAIRYSDNSASAPFVEVIIDATAKQTRIEVIDNGIGISKENQQKIFSMFYRVSDDDNGTGMGLYLVKKAVEKLSGTISLESEYKVGSKFTLTIPNMISGKN

SEQ ID NO: 547 - DNA, 501 bp, Unknown
  Obtained from environmental sample
  misc_feature (1)..(501): n is a, c, g, or t
ttggactgcttattttattnnnnnnnnnnnnnnnnnnnnnnnnnnnnnnnnnnnnnnnnnnnnnnnnnnnnnnnnnnnnnnntagagaatgtaaatattgatgcgctggaaaaactacaggaagaaggaaaaaaaatctatccaaagccatcagttcttcgcatcattcaaaacaaagtgttacaaaaacaatattattcggaacaccaggtaccaacagctgcgtttgctattattaagtttaaaaatgaaatagctcaatcggcccatcttttacctgccgtgcaaaaactggctactggtggctatgatggaaggggcgttcacattatagaagacctggcatcagcggataacggatttgatgaaaacagcgtactggagaaaaagatcaaaataaaaaaggagatagcacagatccttgcggtagatccgcaaaataaaaatgttttttatccccccccagaaatggtttttaataaagaccttaaccagacttga

SEQ ID NO: 548 - protein, 166 aa, Unknown
  Obtained from environmental sample
  misc_feature (1)..(166): Xaa is any amino acid
MDCLFYXXXXXXXXXXXXXXXXXXXXXXENVNIDALEKLQEEGKKIYPKPSVLRIIQNKVLQKQYYSEHQVPTAAFAIIKFKNEIAQSAHLLPAVQKLATGGYDGRGVHIIEDLASADNGFDENSVLEKKIKIKKEIAQILAVDPQNKNVFYPPPEMVFNKDLNQT

SEQ ID NO: 549 - DNA, 444 bp, Unknown
  Obtained from environmental sample
  misc_feature (1)..(444): n is a, c, g, or t
gtgtttcccggccaaagaacaaacgcaaatgggaattggatgaaaccccattgtttttatggagggaccgagaaatccattttgggaaaattcctgggattggttaaaaaaggggaattaaaggaccggaaggaaaaactacaattattcgaacaagccggaattggaatgacggatgtgattaaatcttgtgtgagattagaaggaacgaaccttgatgaaaatttggagatcaaagaatacaataaggaaacaattgaaaaaattttgaagaactgccagccgaaagttttattcacaagcaggtttgttgaaaaagaatttaaaaagctctttcctgattataagaatacagacattttgccttcaccttcaccgaggtattttaaattgaggattgaggataaggcaaagatttacaaagagaaactgcctaaaatttaa

SEQ ID NO: 550 - protein, 147 aa, Unknown
  Obtained from environmental sample
  misc_feature (1)..(147): Xaa is any amino acid
MFPGQRTNANGNWMKPHCFYGGTEKSILGKFLGLVKKGELKDRKEKLQLFEQAGIGMTDVIKSCVRLEGTNLDENLEIKEYNKETIEKILKNCQPKVLFTSRFVEKEFKKLFPDYKNTDILPSPSPRYFKLRIEDKAKIYKEKLPKI

SEQ ID NO: 551 - DNA, 717 bp, Unknown
  Obtained from environmental sample
  misc_feature (1)..(717): n is a, c, g, or t
atgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactttcggaaattaccaaaaagtttaaatcgaaattgttaaatctatcggaaaaggtttccgaaaaatcacaaaagaaattgaaggagatttccaatattgttaaagatgctatcgtagatgaaccaccaattacaatcacagaaggcggtatgataagacccgaattcagtccagaaatcaaagaaatcaaagatgccatgatgtccggaaaagattggatcaaaagtctacagatccaagaaatcaaaaagacaggaattacttctctaaaagtaaaatttaatagagtgtttggatactacattgaaatcagcgcttcaaatttaagcagagttccagaaaattatattcggaagcaaacattggtcaacggtgaaagattcatcactccggagctaaaagaatgggaagataaaatcctaaatgctgaagaaaaattaattaaacttgaatacgaagtcttcattgagatcaganataaaatcgctgaagaaatcgaatctcttcaagaaattgcagattgtatttcagtaattgatgttatttcaaaatcttccgatcttgcaagaagaaaagatatgtanaaccagaaatacaaatga

SEQ ID NO: 552 - protein, 238 aa, Unknown
  Obtained from environmental sample
  DOMAIN (93)...(184): MutS family domain IV
  misc_feature (1)..(238): Xaa is any amino acid
MYXXXXXXXXXXXXXXXXXXXXXXXXXXXXXXXXXXXELSEITKKFKSKLLNLSEKVSEKSQKKLKEISNIVKDAIVDEPPITITEGGMIRPEFSPEIKEIKDAMMSGKDWIKSLQIQEIKKTGITSLKVKFNRVFGYYIEISASNLSRVPENYIRKQTLVNGERFITPELKEWEDKILNAEEKLIKLEYEVFIEIRXKIAEEIESLQEIADCISVIDVISKSSDLARRKDMXNQKYK

SEQ ID NO: 553 - DNA, 360 bp, Unknown
  Obtained from environmental sample
  misc_feature (1)..(360): n is a, c, g, or t
atgatgaataccaccaaaacaattaattatagtattgacagtttgtgggaggtaaatggcattactaaaataagattggaaaacatagggcaaatgcctatgccggttgatgtaaaatttacgttcagggatagtacatcagaatggcattatattccgctaagtttaatgtttggagaaaaatctgaagagccgtggcaaatgccaagagtagtgtataatgaatggaaatggacgcaccctacttatgaaattcaaaccaaaagaaaattaacggatattatttctgttgaaattgacccaacgcaaaggctggcagatatcgatagaaaaaataacaggatcgagttgaagtggtaa

SEQ ID NO: 554 - protein, 119 aa, Unknown
  Obtained from environmental sample
  misc_feature (1)..(119): Xaa is any amino acid
MMNTTKTINYSIDSLWEVNGITKIRLENIGQMPMPVDVKFTFRDSTSEWHYIPLSLMFGEKSEEPWQMPRVVYNEWKWTHPTYEIQTKRKLTDIISVEIDPTQRLADIDRKNNRIELKW

SEQ ID NO: 555 - DNA, 393 bp, Unknown
  Obtained from environmental sample
  misc_feature (1)..(393): n is a, c, g, or t
ttggagtataaaatgaaaactggctattacattgctaaacttctttatagagatgagcaaaaacagttagacattgtttttgtgcaagacggtattttctatgcttttggttctgatgaacgctataattttagcgaactgggtatagttgctgggccgtttacaatagatgaaattctctctaaattaaaagtaaatcaacctaaaggtacattcaagcctggagataaggttgtaattactaaagtatttactgttttgggtaatacggagtctgatgaagaatttgtaattcaggatgaaaatggtaaattgcagtttgtaagagagaatgaaatctggtatgatgatgaaaatgcgcccgatggaaattatattcaagaaggagtataa

SEQ ID NO: 556 - protein, 130 aa, Unknown
  Obtained from environmental sample
  misc_feature (1)..(130): Xaa is any amino acid
MEYKMKTGYYIAKLLYRDEQKQLDIVFVQDGIFYAFGSDERYNFSELGIVAGPFTIDEILSKLKVNQPKGTFKPGDKVVITKVFTVLGNTESDEEFVIQDENGKLQFVRENEIWYDDENAPDGNYIQEGV

SEQ ID NO: 557 - DNA, 627 bp, Unknown
  Obtained from environmental sample
  misc_feature (1)..(627): n is a, c, g, or t
atgtttaatgtcaatggaactgtattgtcttttacaacgcctgtacaatataaatatacacaccctgttaaaggagaaatttaccagccattgtttgttattccaccagtgaccattgcaagtgctcctgacttgatgatatttaaaaaaggagcgccaatgtcaaaagcaattagtgtagaactgtttgctaataaaaaattaagttctttttcatcggaagttgaattgaaatctgatcacgttgcattatctaaaaaagattcagttggcctgtttgaaaaaaacactaaaaaaagttttttatttacagtgggcagtaaccagttggttaacgaagaagaattggtaaaaggatctgccaaatataccaacggcaaggaaaaaggaattgcaacttcggcactcacaggaatacattatgatcatattcccgagatacgttattttttttccgacaatataaatgtgctgaatattgatttaaaaacagaaggtaaaaaaattgggtatataattggagcgngtgataaagtgcccgaggcactggaacaaatgggatatgatgtaaccctattgaccgataaagaacttgacccgtacagcctctacccatttcatgctatt

SEQ ID NO: 558 - protein, 209 aa, Unknown
  Obtained from environmental sample
  misc_feature (1)..(209): Xaa is any amino acid
MFNVNGTVLSFTTPVQYKYTHPVKGEIYQPLFVIPPVTIASAPDLMIFKKGAPMSKAISVELFANKKLSSFSSEVELKSDHVALSKKDSVGLFEKNTKKSFLFTVGSNQLVNEEELVKGSAKYTNGKEKGIATSALTGIHYDHIPEIRYFFSDNINVLNIDLKTEGKKIGYIIGAXDKVPEALEQMGYDVTLLTDKELDPYSLYPFHAI

SEQ ID NO: 559 - DNA, 789 bp, Unknown
  Obtained from environmental sample
  misc_feature (1)..(789): n is a, c, g, or t
gtgatgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagttgagcaattttactcttcttccagattccctacgcttgaacaaaatttaacttggaacaggttaattcaaggaacggatagggataaatattttattgggaggaacgataattccataaggtgtttttcaataatcaaagaggagactagcaaaggagttaagagggcagagatcgcttttggaccaatctataaagaacccgatgatatagtcgattcaataaaggagattgtaaaatattataaagaacaggggtttatttacataaccattcaactagcagttcccacttcatccgaaacagattacatagagtattgccttaacagggaaatggaaattaattattttttcgatagaaataattggtcttctttgggagtcgaccttacaaagactgataccgaaatattaggagaattttccaaaggtcataaaagcgctgttaagaaagccattaaagacggattaattatcaagagggtggaaactgatagtgatatgaactctttttttgaagtatacaagaggatgaatgaggcgagaaagatcaaatttgatttggagtcttctagaaacctttntatgaaagtgtttcaatacataaaaacggggggcaaggggtttatttattggcagaaaaaaacaccgtggtgttggaggggttat

SEQ ID NO: 560 - protein, 263 aa, Unknown
  Obtained from environmental sample
  misc_feature (1)..(263): Xaa is any amino acid
MMYXXXXXXXXXXXXXXXXXXXXXXXXXXXXXXXXXXXEVEQFYSSSRFPTLEQNLTWNRLIQGTDRDKYFIGRNDNSIRCFSIIKEETSKGVKRAEIAFGPIYKEPDDIVDSIKEIVKYYKEQGFIYITIQLAVPTSSETDYIEYCLNREMEINYFFDRNNWSSLGVDLTKTDTEILGEFSKGHKSAVKKAIKDGLIIKRVETDSDMNSFFEVYKRMNEARKIKFDLESSRNLXMKVFQYIKTGGKGFIYWQKKTPWCWRGY

SEQ ID NO: 561 - DNA, 411 bp, Unknown
  Obtained from environmental sample
  misc_feature (1)..(411): n is a, c, g, or t
ttgagaggattagatgagctttttaatccgttttattgggaggatatagatatttcatatagagcattaaaatccggatacacagtattatttgaaaaacaaagcacaggagttcatgaacatgaattgggcgctataaagaaaaaattcactcaagatgatatcaaaaagattgcttatagaaatcaatttatttttgtatggaaaaatgccgatgaaacgatgatttggtttcattccgtttggcttccgtaccattttataaaagcattagtacgcggtgataaaaacttttttattggatttttaaatgctgtaaaactgctccgtacaatcatcaaaaaaagaaatcacattcagaaacagtatattatttctgattatgatatcattgcaaaatataaagaatga

SEQ ID NO: 562 - protein, 136 aa, Unknown
  Obtained from environmental sample
  misc_feature (1)..(136): Xaa is any amino acid
MRGLDELFNPFYWEDIDISYRALKSGYTVLFEKQSTGVHEHELGAIKKKFTQDDIKKIAYRNQFIFVWKNADETMIWFHSVWLPYHFIKALVRGDKNFFIGFLNAVKLLRTIIKKRNHIQKQYIISDYDIIAKYKE

SEQ ID NO: 563 - DNA, 369 bp, Unknown
  Obtained from environmental sample
  misc_feature (1)..(369): n is a, c, g, or t
gtgataccttcctnnnnnnnnnnnnnnnnnnnnnnnnnnnnnnnnnnnnnnnnnnnnnnnnnnnnnnnnnnngtaaacattgccggaaaacagttcaaagtggctaaagatcagtacatctatgccccccgtttggacggcgaagcaggttcaagtgtaaaatttgacaacgtgcttctcaccgaagacggaggaaccatcagtattggcgcccctactgttaaaggaatcacggtttcaggtaagatcctggagcacgttaaaggcaacaaggtaattgtctttaaaaagaaaagaagaaaaggttaccaggtaagaaatggccaccgccagcagtttaccaaggtgcaaatcgaaagcatcggataa

SEQ ID NO: 564 - protein, 122 aa, Unknown
  Obtained from environmental sample
  DOMAIN (25)...(116): Ribosomal prokaryotic L21 protein
  misc_feature (1)..(122): Xaa is any amino acid
MIPSXXXXXXXXXXXXXXXXXXXXVNIAGKQFKVAKDQYIYAPRLDGEAGSSVKFDNVLLTEDGGTISIGAPTVKGITVSGKILEHVKGNKVIVFKKKRRKGYQVRNGHRQQFTKVQIESIG

SEQ ID NO: 565 - DNA, 579 bp, Unknown
  Obtained from environmental sample
  misc_feature (1)..(579): n is a, c, g, or t
gtgcaaattattgtttttagtaagttagctaaggacgataaagagaaatataaaaagaccatccaacataatggaaatcgatataaacaagtgtgggctaaaatggcaaccgttaaacgtgacatattacctttcaatgataaaagaacatttcgacctgacgaatttgcaatggatgaagatgaatttaaacatgcgaaaaccttatggaaagaattaattgacattattcgaactgacgatgaaattaaacaaatgcttgatattgcagctgaaggatcctttgacattcattgtatcgttgtgaaggatgccgctgaaattgttaatgatggtaaaccacatgagccgctagatggaaagttatttagttcaaaggcgactaaagccatttacaacaaagaaatttcgtatgatttgaatgaacaagctaaatttttctctgaaatgttcaaccttactttaaataaatacaccatgaataattacaagtttaatagctgctttcttaacttgattgttgacacatggcacgaagcctttgaaaagaaaagagtgatggaaaaagatgtattctga

SEQ ID NO: 566 - protein, 192 aa, Unknown
  Obtained from environmental sample
  misc_feature (1)..(192): Xaa is any amino acid
MQIIVFSKLAKDDKEKYKKTIQHNGNRYKQVWAKMATVKRDILPFNDKRTFRPDEFAMDEDEFKHAKTLWKELIDIIRTDDEIKQMLDIAAEGSFDIHCIVVKDAAEIVNDGKPHEPLDGKLFSSKATKAIYNKEISYDLNEQAKFFSEMFNLTLNKYTMNNYKFNSCFLNLIVDTWHEAFEKKRVMEKDVF

SEQ ID NO: 567 - DNA, 315 bp, Unknown
  Obtained from environmental sample
  misc_feature (1)..(315): n is a, c, g, or t
atgctatcacgtttaaagtttaatgttcaaaatttaaagctcaaaattcaatgttcctggtttaatgcttatttaacaatcttgaactttgaatttcaaatttggaatttattagtaattatcggttcaaaattagtgtttttatcgggtattgtagattacattaaaaagggtttatcgggtcttcaacattttttagtaagctatacgccagcggaggacctgcgaaataagacttcgttatcgcccaggtttgccggaataggtcggatttccggtaaatttccaactgatccgaatgctcccacttactaa

SEQ ID NO: 568 - protein, 104 aa, Unknown
  Obtained from environmental sample
  misc_feature (1)..(104): Xaa is any amino acid
MLSRLKFNVQNLKLKIQCSWFNAYLTILNFEFQIWNLLVIIGSKLVFLSGIVDYIKKGLSGLQHFLVSYTPAEDLRNKTSLSPRFAGIGRISGKFPTDPNAPTY

SEQ ID NO: 569 - DNA, 318 bp, Unknown
  Obtained from environmental sample
  misc_feature (1)..(318): n is a, c, g, or t
ttgatcaataatgaatttagatgcatcatcaaaagctgtatcaggtttagcgataataaggcaacttacattctcacgattcaatacatccagatcatttttaatatttaccgcgtttacttcgtaaaattcacgaagctcagttaccatatcggccagtcccaactcaaacatttctccatgtccccggctaaatacaacatgcttcttttgtttatagttgaatactttataaaaagctttacagaaattatactccaatcgctcgatggattgattcagggtaaactctgcaccctggctaaactgactctctaa

SEQ ID NO: 570 - protein, 105 aa, Unknown
  Obtained from environmental sample
  misc_feature (1)..(105): Xaa is any amino acid
MINNEFRCIIKSCIRFSDNKATYILTIQYIQIIFNIYRVYFVKFTKLSYHIGQSQLKHFSMSPAKYNMLLLFIVEYFIKSFTEIILQSLDGLIQGKLCTLAKLTL

SEQ ID NO: 571 - DNA, 633 bp, Unknown
  Obtained from environmental sample
  misc_feature (1)..(633): n is a, c, g, or t
atgtccgagtcctggaaagtacttgatcccgtgatctgttatctctctgaacagcatcgtcagactgatccagaatttactcaaattttaaatgcaattcgtggtcagacgatagatgacgatatatttgaaacattaaaaactcgcattggtgctaaaaataatgagggcaagattgccaagcttttttcgcataacgaagacgtggatcgtcttaataatatagaacttgagaaacttcctggagaatatttcagttatgatatggaaacaaaaggaaagggaactcttgttgaggcacttaaaaaaagcgtgcttgcgccagagagtttgaaactcaaagagggagcgctggtgatgtgtgtaaaaaataattacgaaaaaggttatgtaaatggcactctcggtactgtagttttgtgcgaggaagatggtgtacaaataaaaactcataacggacaaaatataaatataactccagaatcttggatcgtggaagagaatggaaaaataaaagctgaagtttatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 572 - protein, 211 aa, Unknown
  Obtained from environmental sample
  misc_feature (1)..(211): Xaa is any amino acid
MSESWKVLDPVICYLSEQHRQTDPEFTQILNAIRGQTIDDDIFETLKTRIGAKNNEGKIAKLFSHNEDVDRLNNIELEKLPGEYFSYDMETKGKGTLVEALKKSVLAPESLKLKEGALVMCVKNNYEKGYVNGTLGTVVLCEEDGVQIKTHNGQNINITPESWIVEENGKIKAEVYAXXXXXXXXXXXXXXXXXXXXXXXXXXXXXXXXXX

SEQ ID NO: 573 - DNA, 468 bp, Unknown
  Obtained from environmental sample
  misc_feature (1)..(468): n is a, c, g, or t
gtggtcctacagatggaaatgtttttccgattcaacacgatacgacttaggtccaggcctagcattcccaacgctctggcaaccgagtatgataattccatgacaaaatttatacttctcacaactttaatgcttacgacgcgctttgcacaagccggtctcctttacaattattcgcagctcaagctcaaagaccttgatcaaatgtcaaaaattgtgcgcgataagattaaggaatcgtcaacggcgggcggaaatcccgctattccattgaaagaagggctccaagccgtgttttcgcgcccggacgatgatggcatgattgaaaaactcataacgccgctgaagagcgcccttgacgagcataatgcccttgggaaatttccattaagcagctcgtcaaagaagccgtccgtgcattgtaaaatcccaaagctttctaacccgttgttcaggtggaccatttga

SEQ ID NO: 574 - protein, 155 aa, Unknown
  Obtained from environmental sample
  misc_feature (1)..(155): Xaa is any amino acid
MVLQMEMFFRFNTIRLRSRPSIPNALATEYDNSMTKFILLTTLMLTTRFAQAGLLYNYSQLKLKDLDQMSKIVRDKIKESSTAGGNPAIPLKEGLQAVFSRPDDDGMIEKLITPLKSALDEHNALGKFPLSSSSKKPSVHCKIPKLSNPLFRWTI

SEQ ID NO: 575 - DNA, 480 bp, Unknown
  Obtained from environmental sample
  misc_feature (1)..(480): n is a, c, g, or t
gtgaaaatacattggtcaattaataaagatccaaaaacctttctttttcaaaatacacacggaaccaagattgttgttggatgtttaaaagagacttggacaagaggcatggcacgacagttaaaacgtcatactgtctctatgctttctccgaaaaacgaccccgataagtttgatattaagctagattttggaaattggtggctaaatgattttcccagcatagatgacgtattaaagagtgctccatatagtttgactgttttggtggaggacaatttgcagatgacttttgaatattcatttggattgtctaacaattctaaaattggaagtcgatcaatagattcgtcgacaaccgatccaattagtaaggcaaaatattattggaacattaaaggtgcgttaccacctttttataggagctatcttgaagcgaaggaacataaccgggaagaaattgaaagtctgataccttaa

SEQ ID NO: 576 - protein, 159 aa, Unknown
  Obtained from environmental sample
  misc_feature (1)..(159): Xaa is any amino acid
MKIHWSINKDPKTFLFQNTHGTKIVVGCLKETWTRGMARQLKRHTVSMLSPKNDPDKFDIKLDFGNWWLNDFPSIDDVLKSAPYSLTVLVEDNLQMTFEYSFGLSNNSKIGSRSIDSSTTDPISKAKYYWNIKGALPPFYRSYLEAKEHNREEIESLIP

SEQ ID NO: 577 - DNA, 465 bp, Unknown
  Obtained from environmental sample
  misc_feature (1)..(465): n is a, c, g, or t
atgcaactcatcttcgcgaccaacaaccgcaataaagtagaagagatacgtaagatcatccggtcatttgatgttatcaccatgggtgaagccggaattgcagaagacattcccgagccttttgatacgctggaggaaaatgcttttgccaaatcaattttcatttataagcggacaggtaaagcctgtttcagtgaagataccggcctggaagtttatgcattgaatggagagccgggcgtaagaagtgcgcgctatgcaggagaaccttccaacccgggtaagaatacagagttgctgttgaataaattaaatggtatcacagaaagaaaagcacgtttcagaacagtggtttctttgatctataataaagtggaataccagtttgatggaatttgtgaaggaaagataattacagaaaaaacaggcgacaaaggatttggttacgacccggtttttattccg

SEQ ID NO: 578 - protein, 155 aa, Unknown
  Obtained from environmental sample
  DOMAIN (3)...(155): Ham1 family
  misc_feature (1)..(155): Xaa is any amino acid
MQLIFATNNRNKVEEIRKIIRSFDVITMGEAGIAEDIPEPFDTLEENAFAKSIFIYKRTGKACFSEDTGLEVYALNGEPGVRSARYAGEPSNPGKNTELLLNKLNGITERKARFRTVVSLIYNKVEYQFDGICEGKIITEKTGDKGFGYDPVFIP

SEQ ID NO: 579 - DNA, 483 bp, Unknown
  Obtained from environmental sample
  misc_feature (1)..(483): n is a, c, g, or t
atggatctcgataaaataaaaactgatgcggcagggatcgtagcccataaaatgcatgaagcaaatcttacactcaaacagctttttttcctgggaatggatgatgatgaaacaatgatcaataaaggattttgcagcgcagcggatgttatgcaatttgtattagagaaaaagcttgcgttacagcaggaggataaagatatgatcgttatgctgcatgaaattgaatatatagtcaacggtcaacagtcatcagtcaacagttcattagtcgtcaaagggcaagataacctacgcactgccatggcaaaaactgttggcttaccgctgggtattgctgccaaactaatcttaaacggaacaatcaagcttaccggtttacatatccctaccaggaaagaaatttatgaacctgtgctgaaagaattggaagaaaatgggattaaatttcacgaagaaacaaaacagctgtatgaaatataa

SEQ ID NO: 580 - protein, 160 aa, Unknown
  Obtained from environmental sample
  misc_feature (1)..(160): Xaa is any amino acid
MDLDKIKTDAAGIVAHKMHEANLTLKQLFFLGMDDDETMINKGFCSAADVMQFVLEKKLALQQEDKDMIVMLHEIEYIVNGQQSSVNSSLVVKGQDNLRTAMAKTVGLPLGIAAKLILNGTIKLTGLHIPTRKEIYEPVLKELEENGIKFHEETKQLYEI

SEQ ID NO: 581 - DNA, 543 bp, Unknown
  Obtained from environmental sample
  misc_feature (1)..(543): n is a, c, g, or t
gtgcttgtgcgtgatattacgagccgtaaaaaaaccgaactcgctttgatgcaatcagagagtaaaaatcgtcaaatttttgaacttgccagcgatcttatttccacagttgatatcgatggaaatataacttcattaagtcccacatttaaaaaactgacgcagtgggaagttgacgggtggattggaaaaccctttcaggcattgattcatgaagatgatataaagcaggtaaaacgtatttttaatcttgtcatgagcggaaaaacccctaaatcatatacttttagattcaacacaaacgacggtcatttcctttatgtcgagtcatcatcatgccccgtgataaaagagggacgagtgactgaggcaatctcattcattcgagatatatctgaccgaaaaaaacaagacaccgccctatacgaagacccagtgaggtttcaagctctctccgaagccaatcttgaaggatttgctctctctgaaaatggcggtgcgctcgagaggcactcgcggtcaggtaagaatgtatgcctgtga

SEQ ID NO: 582 - protein, 180 aa, Unknown
  Obtained from environmental sample
  DOMAIN (93)...(134): PAC motif
  misc_feature (1)..(180): Xaa is any amino acid
MLVRDITSRKKTELALMQSESKNRQIFELASDLISTVDIDGNITSLSPTFKKLTQWEVDGWIGKPFQALIHEDDIKQVKRIFNLVMSGKTPKSYTFRFNTNDGHFLYVESSSCPVIKEGRVTEAISFIRDISDRKKQDTALYEDPVRFQALSEANLEGFALSENGGALERHSRSGKNVCL

SEQ ID NO: 583 - DNA, 717 bp, Unknown
  Obtained from environmental sample
  misc_feature (1)..(717): n is a, c, g, or t
gtgatgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctttcatgatcggtcttgccgagatttcaggagatcatgttctgaaagatttgattcagacagaacctcttcaggggaaatacggtattctgcactacaaatctctggatgaaagaaatgtagatgttgctcttctgtacgatcattccaaaattgaaattttagaatctgaacctattacttttttcttcgaagaatcgggccttgacgaaaaatattatgacaccacacgtgatatactttttgccaaagtaaaatttgagggagaaatcatcaacgtatttgtacttcaccttccctctaaaagagaaaaagacgttaataagccaaaaagatcatacattcttcaggaattaaaaaacagaatagacaaaatccaggaaaacgcggatgagaaagtaattgtctgcggagattttaatgaaaatcctgatgatgaagtgctggaaatcctttcagacaagacgtttcagaagaatgcacttgaaaatccttttgcagatttattttttaacaaaaaatattctacatttcactacaaaagtggtttgttatttgatcaaattctactgtcagggaatttttatcatcaggaagatcan

SEQ ID NO: 584 - protein, 239 aa, Unknown
  Obtained from environmental sample
  misc_feature (1)..(239): Xaa is any amino acid
MMYXXXXXXXXXXXXXXXXXXXXXXXXXXXXXXXXXXXPFMIGLAEISGDHVLKDLIQTEPLQGKYGILHYKSLDERNVDVALLYDHSKIEILESEPITFFFEESGLDEKYYDTTRDILFAKVKFEGEIINVFVLHLPSKREKDVNKPKRSYILQELKNRIDKIQENADEKVIVCGDFNENPDDEVLEILSDKTFQKNALENPFADLFFNKKYSTFHYKSGLLFDQILLSGNFYHQEDX

SEQ ID NO: 585 - DNA, 306 bp, Unknown
  Obtained from environmental sample
  misc_feature (1)..(306): n is a, c, g, or t
atggcagataataaaataatattttcaatggtgggggtcagcaaaacctttcccccgcaaaaacaggtattgaagaatatatacctttcattcttttacggagcaaagatcggcatcattggtctaaacggctcgggtaaatctaccctccttaaaattattgccggggttgaagataatttcgatggtgaagtgcattttaccaaagagtactcaatcggactgctggaacaggagccgtaccttgatgaaaccaaaactgtgaaggaaattatccaggaaggcgcgcaggaagttgttgatata

SEQ ID NO: 586 - protein, 102 aa, Unknown
  Obtained from environmental sample
  misc_feature (1)..(102): Xaa is any amino acid
MADNKIIFSMVGVSKTFPPQKQVLKNIYLSFFYGAKIGIIGLNGSGKSTLLKIIAGVEDNFDGEVHFTKEYSIGLLEQEPYLDETKTVKEIIQEGAQEVVDI

SEQ ID NO: 587 - DNA, 579 bp, Unknown
  Obtained from environmental sample
  misc_feature (1)..(579): n is a, c, g, or t
ttgggggtgctttcctcctnnnnnnnnnnnnnnnnnnnnnnnnnnnnnnnnnnnnnnnnnnnnnnnnnnattcatttattgaaggataaaggtcgatgcgggctcgtactaccagatggttttttatttggcgaaggtgtggcaacccggataaaggaaaatctgctagagaaatgcaatctccataccattgtgcgcttaccaaatggcgtatttgcaccgtatacagggattaaaaccaatctgcttttttttgaaaagggaacacccacaaaggaaatttggtatttcgaacatccttacccggaaggtataaaaaattacaacaaaacaaaacctattaatataaaagaatttgatctggagaaatcgtggtggaagaaaagactggagaatgaatatgcatggaaagtgagcgctgaagaaatcagaaggagaaattataatatggatatttcgaacccaagaaaaggatctagtgatggcgatctttcaataatagaattatttgataagattgagaatagacaactcgttataagctcaaccatacaaaaactgaaagaagaattattttag

SEQ ID NO: 588 - protein, 192 aa, Unknown
  Obtained from environmental sample
  DOMAIN (4)...(149): N-6 DNA Methylase
  misc_feature (1)..(192): Xaa is any amino acid
MGVLSSXXXXXXXXXXXXXXXXXIHLLKDKGRCGLVLPDGFLFGEGVATRIKENLLEKCNLHTIVRLPNGVFAPYTGIKTNLLFFEKGTPTKEIWYFEHPYPEGIKNYNKTKPINIKEFDLEKSWWKKRLENEYAWKVSAEEIRRRNYNMDISNPRKGSSDGDLSIIELFDKIENRQLVISSTIQKLKEELF

SEQ ID NO: 589 - DNA, 435 bp, Unknown
  Obtained from environmental sample
  misc_feature (1)..(435): n is a, c, g, or t
ttggtaacacaaagtatttacggcacgcctcaacgtacagctactggatttgacctcaggcgccttcaattattattggcggtattagaaaagagaggcggctttcattttggcgtaaaggatgtgtttattaatatagccggcggattaaaagtggaagatccctctattgaccttgcggttttaagtgcattgttatcttcatttgaagatatatcattgccaatgcatatttgctttgcaggtgaagtagggttaagtggagagataagagcggtaaataaaattgatcaacgaattgccgaggctgaaaaattgggatttgaaaaagtggtagtaagtaagcacaatgttaaaagccttaataaaagaaacacaaatatcgagataattgctttaggtaaagtagaagagctttataaatatcttttttaa

SEQ ID NO: 590 - protein, 144 aa, Unknown
  Obtained from environmental sample
  misc_feature (1)..(144): Xaa is any amino acid
MVTQSIYGTPQRTATGFDLRRLQLLLAVLEKRGGFHFGVKDVFINIAGGLKVEDPSIDLAVLSALLSSFEDISLPMHICFAGEVGLSGEIRAVNKIDQRIAEAEKLGFEKVVVSKHNVKSLNKRNTNIEIIALGKVEELYKYLF

SEQ ID NO: 591 - DNA, 711 bp, Unknown
  Obtained from environmental sample
  misc_feature (1)..(711): n is a, c, g, or t
ttgaaacagtatccgctacagaggaggtatttaatcatgggtaaaccgacaggatttttagaataccagagaattaatccggtaaagaaaccgataaaggaaagacttcagaactttaatgaattcgaagagttgattccgggtaataaaattacagaacaggcggcgcgctgtattgattgcggaataccttactgccattcatacgggtgtccggtaaataacaggattcccgattggaatgatatggtttacaaaaaccagtggcagagagcgcttgaaatgcttcattcaacaattaactttcctgaatttacaggcagggtttgtccagctccctgtgagcatgcctgcacattatcaataaacaattcgcctgttactataaaacaaatagaattacagatagttgaacgaggctggaaagaaggatggattaagccgctgccggcagcagtaaaaacaggaaagaagatagcgataattggatcaggacctgcaggactcacagccgcacagcagcttgtaaggaaaggtcatcaggtagttgtttttgaaaagagcgatagaatcggcgggattctgaggtatggaatccctgatttcaaacttgagaaaatggtaatcgacaggcggcttgagcaagtaaaggcagaaggtgttgtttttgagacgggagtaacgtgggcgggaattttctgccaaaaccta

SEQ ID NO: 592 - protein, 237 aa, Unknown
  Obtained from environmental sample
  misc_feature (1)..(237): Xaa is any amino acid
MKQYPLQRRYLIMGKPTGFLEYQRINPVKKPIKERLQNFNEFEELIPGNKITEQAARCIDCGIPYCHSYGCPVNNRIPDWNDMVYKNQWQRALEMLHSTINFPEFTGRVCPAPCEHACTLSINNSPVTIKQIELQIVERGWKEGWIKPLPAAVKTGKKIAIIGSGPAGLTAAQQLVRKGHQVVVFEKSDRIGGILRYGIPDFKLEKMVIDRRLEQVKAEGVVFETGVTWAGIFCQNL

SEQ ID NO: 593 - DNA, 603 bp, Unknown
  Obtained from environmental sample
  misc_feature (1)..(603): n is a, c, g, or t
atgccgcttactaccggaccaggtcctgattatgatccgatgtatgatccttccaataaagcaatttattacgcaaatggaaaacaaattggttcgctagtcgcatacaatattaaaaccggttcttccacagaaattttttctgaacgttcaacacagcccatcatttcccccgatggcaagaaagttttatttttgaaactgattgagccttttagagctgtagaactttgggtttcagatttagagggaaagaatcaagcaaaattggcttctgctgcaatgttgggtactggaatgtggtcacctgatagcagtcaggtttcatttttttcttttgaaaatattaacgaaaagaataaaggctttgtttcatctctagatggccggacgatgattgagatcaaaggaattgaaggaaacattcaaaacattagctggtctaatgatgcgaaaacgctttatgtttctgctacgaaaggtccggtaacacgcacctggagggtcaatgctgatggaacgagagcggaaaaattttgtggacatttctacgcaatggaaccccagtccgatggaaaatatttgctgggtgtagttttatca

SEQ ID NO: 594 - protein, 201 aa, Unknown
  Obtained from environmental sample
  misc_feature (1)..(201): Xaa is any amino acid
MPLTTGPGPDYDPMYDPSNKAIYYANGKQIGSLVAYNIKTGSSTEIFSERSTQPIISPDGKKVLFLKLIEPFRAVELWVSDLEGKNQAKLASAAMLGTGMWSPDSSQVSFFSFENINEKNKGFVSSLDGRTMIEIKGIEGNIQNISWSNDAKTLYVSATKGPVTRTWRVNADGTRAEKFCGHFYAMEPQSDGKYLLGVVLS

SEQ ID NO: 595 - DNA, 549 bp, Unknown
  Obtained from environmental sample
  misc_feature (1)..(549): n is a, c, g, or t
ttgtttttttatctgatgtctgacaaatgttttatataccatttacgaaatgaatgcaaagtcgttgtaatattgttgataaaaattgaaagaatatatgataatcctaatggaaaggataatgatggaaacggtggtttccgaatcttagtggacaggctttggcctcgcggtctaagtaaaaaggaggtgcatattgacttgtggataaaagatgttgcaccaagtactgcgttgagaaaatggtttagtcatgacgaaaaaaaatgggatgaatttaaatcaagatattttaaggaacttgagaaatgcaatgaatcgatagatgtaattttagataagatagaaaaaggctctgtagtattactgtatggagcaaaagacgaaaaatttaacaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 596 - protein, 183 aa, Unknown
  Obtained from environmental sample
  DOMAIN (26)...(142): Protein of unknown function, DUF488
  misc_feature (1)..(183): Xaa is any amino acid
MFFYLMSDKCFIYHLRNECKVVVILLIKIERIYDNPNGKDNDGNGGFRILVDRLWPRGLSKKEVHIDLWIKDVAPSTALRKWFSHDEKKWDEFKSRYFKELEKCNESIDVILDKIEKGSVVLLYGAKDEKFNNAXXXXXXXXXXXXXXXXXXXXXXXXXXXXXXXXXXXXXXXXXXXXXXXXX

SEQ ID NO: 597 - DNA, 492 bp, Unknown
  Obtained from environmental sample
  misc_feature (1)..(492): n is a, c, g, or t
gtgaccggaaaaatagaattgaaggaactaggaagagtacttctacacctcaatcaaaagagaggttataaaagcagcaggaagagtgacgtagaccaaagtaaggaaacagaatatgtagcagcagtcaataacaggtttggacaaattcaagaactcgggtttactgttgggcaatatttttatcatggccttaaagaagatcctcattatagggtaaaagaacaggtatttccaagaatagcctaccaggaagagtttgacctcataataaaagaacagaaaaagcattatcctaatctactaacggaccagaaatgcaatgaaataaggaatgagatcatttactatcaaaggcctctaaaatcccagaaaagcagggtttccatttgtgagtttgaaggaaagttcgagaccatcagcaaagaaggacagatgctgggaggtcttttgttgggtccgaaggttggcaccaaggactttctccgctaa

SEQ ID NO: 598 - protein, 163 aa, Unknown
  Obtained from environmental sample
  misc_feature (1)..(163): Xaa is any amino acid
MTGKIELKELGRVLLHLNQKRGYKSSRKSDVDQSKETEYVAAVNNRFGQIQELGFTVGQYFYHGLKEDPHYRVKEQVFPRIAYQEEFDLIIKEQKKHYPNLLTDQKCNEIRNEIIYYQRPLKSQKSRVSICEFEGKFETISKEGQMLGGLLLGPKVGTKDFLR

SEQ ID NO: 599 - DNA, 579 bp, Unknown
  Obtained from environmental sample
  misc_feature (1)..(579): n is a, c, g, or t
atgatccttccaatagtagcatacggagcacctgttttaagaaaggtagcaggtgacgtcactaaagatcatccccagctggacaagtttattgcagacatgtgggataccatgtattacagtaatggtgttggacttgccgcaccacaggtgaataaagacatccgtgtatttgtggtagatacagaacagatatttgaaaacctggaagatgatgaaaaaggcaaatattcagatgatccgggagtgaaaaaagtattcatcaatccgcatatagtagaactggaaggtgaggagtggtcatacaatgaaggttgtttatctattccaaagatccgtgaagatgtgatgaggcccgaaactgttgtactcgagtacatggacgaaaactttgaaacacacactgaatcattcagcggtattactgcaagagtgattcaacatgagtatgatcatttagaagggaaactttttattgattacctgaaaccccttaaaagaaaaatgctctccggcaaactttctgatatcagcaaaggcaaggttagagtggattataaaaatgatgttgccaaatga

SEQ ID NO: 600 - protein, 192 aa, Unknown
  Obtained from environmental sample
  DOMAIN (2)...(168): Polypeptide deformylase
  misc_feature (1)..(192): Xaa is any amino acid
MILPIVAYGAPVLRKVAGDVTKDHPQLDKFIADMWDTMYYSNGVGLAAPQVNKDIRVFVVDTEQIFENLEDDEKGKYSDDPGVKKVFINPHIVELEGEEWSYNEGCLSIPKIREDVMRPETVVLEYMDENFETHTESFSGITARVIQHEYDHLEGKLFIDYLKPLKRKMLSGKLSDISKGKVRVDYKNDVAK

SEQ ID NO: 601 - DNA, 399 bp, Unknown
  Obtained from environmental sample
  misc_feature (1)..(399): n is a, c, g, or t
atggatttggagcttacttttgatagattaataaaatttgatcttttcgatgatattgttagtagggatacaagtttcgaaaaagtattcgaattattaaaaataataaataatattaaaagcgtcgatcaatttattaaggatacgccgtcataccccggctcaacagaaaaaattgttagagatgaaatgatttcagctattggttctacccttgctattgaaggcataaatattaataaggaagaaatagaggaatcatttcaaaaagcagatataggcgatttcttaagccgaanagagcaggaagctgaaaattctcgtaaagtatataatttcatacgtgaaatttgtcaaagatacaaatcggattttgtttatagtgaacaaattataaaa

SEQ ID NO: 602 - protein, 133 aa, Unknown
  Obtained from environmental sample
  misc_feature (1)..(133): Xaa is any amino acid
MDLELTFDRLIKFDLFDDIVSRDTSFEKVFELLKIINNIKSVDQFIKDTPSYPGSTEKIVRDEMISAIGSTLAIEGININKEEIEESFQKADIGDFLSRXEQEAENSRKVYNFIREICQRYKSDFVYSEQIIK

SEQ ID NO: 603 - DNA, 501 bp, Unknown
  Obtained from environmental sample
  misc_feature (1)..(501): n is a, c, g, or t
gtggccactgcatgcctgaatgctgtgggattaaaagcgagagttttaggacttatgataaaagatgttgaaacaacaaaatatggggcgggacatgtcttattggaagtatatctcaatgatttaaataaatgggctttactggacggtcaatgggatgcagttccaatgttaaacaatataccactcaatgcagtagaatttcaaaaggcaattgtagaaagttatgacggtttagttatcaagacatcttccggcatttcaaaacggaattatattgattggatttatccatacctctactattttactattccatttgacaacagggaaaaaactaattccgaaacaaaaaagtcagaagagaaaagtcatttaatgttagttccactcggagcaaacatgccggcagtttttcaaatcacccacaaaattgactattgcctatataccaattcattgaacgacttttatgcatcacctgacatcagaaaaaaatag

SEQ ID NO: 604 - protein, 166 aa, Unknown
  Obtained from environmental sample
  misc_feature (1)..(166): Xaa is any amino acid
MATACLNAVGLKARVLGLMIKDVETTKYGAGHVLLEVYLNDLNKWALLDGQWDAVPMLNNIPLNAVEFQKAIVESYDGLVIKTSSGISKRNYIDWIYPYLYYFTIPFDNREKTNSETKKSEEKSHLMLVPLGANMPAVFQITHKIDYCLYTNSLNDFYASPDIRKK

SEQ ID NO: 605 - DNA, 633 bp, Unknown
  Obtained from environmental sample
  misc_feature (1)..(633): n is a, c, g, or t
atgatgatctcaaggaaaaagatcgctttattctgtaatgtaaaaccggaagcggtaattgaagcaatggatgcatcacccatttatgaagtgccgctaatgatgctgcgggaaaagcttgatataatcactttacgaaaattaaatacaaccctggttcccgaaactgacctgagcaaatggaaagcttttttggataagctaaaatatcctaaaagcaaagtgaatataggcttgataggaaagtatatggaattgcaggacgcttacaaatcgatccttgaaagctttatccatgccggcgccatgaatgaagtaaaagtgcaggtggtggatgtacacagcgaaagcctgaacaaacataatgtaaaggaaaagctggagcatcttgatggcttactggttgcaccgggatttggcaagcgtggcattgaaggaaagataattgctgtgcaatatgcgcgcgaaaataacctgcccttctttggtatttgcctgggtatgcagatggcggctattgaatttgcccggaatgttttagatattcaaaaggcacattcaactgaaannnnnnnnnnnnnnnnnnnnnnnnnnnnnnnnnnnnnnnnnnnnnnnnnnnnaggagggacttaa

SEQ ID NO: 606 - protein, 210 aa, Unknown
  Obtained from environmental sample
  misc_feature (1)..(210): Xaa is any amino acid
MMISRKKIALFCNVKPEAVIEAMDASPIYEVPLMMLREKLDIITLRKLNTTLVPETDLSKWKAFLDKLKYPKSKVNIGLIGKYMELQDAYKSILESFIHAGAMNEVKVQVVDVHSESLNKHNVKEKLEHLDGLLVAPGFGKRGIEGKIIAVQYARENNLPFFGICLGMQMAAIEFARNVLDIQKAHSTEXXXXXXXXXXXXXXXXXXGGT

SEQ ID NO: 607 - DNA, 543 bp, Unknown
  Obtained from environmental sample
  misc_feature (1)..(543): n is a, c, g, or t
atgctgattgaattgcgtttgtggtggcagtacctatgtaagaatttagataaggaacgaaaaatgtacaaactaatagcggtaggtttgttaattgcaataggtttggcaacgacacagcatagttttgcccaaactaaatcggcagagatggagcgaataattaacgagtaccttaccaataaacaatttatgggtacagtattggttgcagaagcagaccacataattctcaataggggctatgggtacgctaatttggagtggaatattcccaacacgcccgaaacaaaatttagaattgcctctcttacaaaacaatttactgctgcgagcattttattgctggaggaaaaaggtaaattgaaaacaacagatacaattacaagatactttcctgacgcgccggagtcctggaaaaagatcacgattttcgatcttgtcaatcataggtcgggcatttcggatttctcagcctttgtggaaatcaaatggtttcagttatcaccgactaggcccagtaacacaatggagtcagtttaa

SEQ ID NO: 608 - protein, 180 aa, Unknown
  Obtained from environmental sample
  misc_feature (1)..(180): Xaa is any amino acid
MLIELRLWWQYLCKNLDKERKMYKLIAVGLLIAIGLATTQHSFAQTKSAEMERIINEYLTNKQFMGTVLVAEADHIILNRGYGYANLEWNIPNTPETKFRIASLTKQFTAASILLLEEKGKLKTTDTITRYFPDAPESWKKITIFDLVNHRSGISDFSAFVEIKWFQLSPTRPSNTMESV

SEQ ID NO: 609 - DNA, 459 bp, Unknown
  Obtained from environmental sample
  misc_feature (1)..(459): n is a, c, g, or t
ttgaaaaatcaaattacccaaactacttctgcctactttgaaccggcgctggattatgtaattgtaaaaatgccgcgctggaatttcgataaattcaaaggtgcagatgatacgctcggccttcaaatgaaatccgttggcgaggtaatggccattggcagaagctttgccgaagcgattcaaaaggcttgtcagagtctggagaatgaagcagtaggattgggatattatgggaaaaacatgatgcgtgctgaagagattattgaatacataaaaatacctaagtgggacaggattttcagaataaaagatgctttaatggctggtgtgagtgtgaagcgtatttgtgaggaaaccaatatagacaggtggtttatttaccagattcagaagatatgcnnnnnnnnnnnnnnnnnnnnnnnnnnnnnnnnnnnnnnnnnnnnnnnnnnngtcccttaa

SEQ ID NO: 610 - protein, 152 aa, Unknown
  Obtained from environmental sample
  misc_feature (1)..(152): Xaa is any amino acid
MKNQITQTTSAYFEPALDYVIVKMPRWNFDKFKGADDTLGLQMKSVGEVMAIGRSFAEAIQKACQSLENEAVGLGYYGKNMMRAEEIIEYIKIPKWDRIFRIKDALMAGVSVKRICEETNIDRWFIYQIQKICXXXXXXXXXXXXXXXXXVP

SEQ ID NO: 611 - DNA, 735 bp, Unknown
  Obtained from environmental sample
  misc_feature (1)..(735): n is a, c, g, or t
atgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagtattggaatataccggtggctatgaataccgctggcttcaatactgcagatctaaagacattgcatatgtacgcatcccgggacttgccatcaaacgttcacttggtattgtaagagggaaaaatgacagaattgatgcagcacgcattgcccaatttggcgatgaaaaatacaagcagctatctcccgaaaagcctttaaatacaagcattctaaggctaaaggaactgctgggtcttaggaagaaactggtgcgtgaaaatgcaggttacaaggcatctgtaaaagaacgcattcacatgtaccaggtagataaaaaagacttcatagtaaacatgctgaacaaaaaaatgaaagcaaatgaaaagctgattgttgctgtagaaaaacaaattgaagaagtagttcagtcggatgaatcaatatgtaaaaactttgtgcttttaaaatccattcgaggaatagggaatgtgaacgcctggatgacgatagcttacacagaanatttcaggagtttttgtgatgccagaagctatgcagtttatgtaggagtaataccatttgattatancagcgggactagcatcaggngcaaaaaagagtttgtaaatagcaaataa

SEQ ID NO: 612 - protein, 244 aa, Unknown
  Obtained from environmental sample
  misc_feature (1)..(244): Xaa is any amino acid
MYXXXXXXXXXXXXXXXXXXXXXXXXXXXXXXXXXXXVVLEYTGGYEYRWLQYCRSKDIAYVRIPGLAIKRSLGIVRGKNDRIDAARIAQFGDEKYKQLSPEKPLNTSILRLKELLGLRKKLVRENAGYKASVKERIHMYQVDKKDFIVNMLNKKMKANEKLIVAVEKQIEEVVQSDESICKNFVLLKSIRGIGNVNAWMTIAYTEXFRSFCDARSYAVYVGVIPFDYXSGTSIRXKKEFVNSK

SEQ ID NO: 613 - DNA, 441 bp, Unknown
  Obtained from environmental sample
  misc_feature (1)..(441): n is a, c, g, or t
atggacaatccttttcacataaattatcctgaccaggtagatgctgaactggtaagattggctattggtggagataagcaggcattgcaaaatcttataaccaggcaccagatttttatttacaacctggctttaaaaatgactaaaagcattgaagatgcagaagatctgacacaggaagttttgataaaagcaatcaccgccttatcaaaatttgaagggaaaagccaattcagaacatggctttacaggataacggtgaatcattttttaaataccaaaaaaagaaaaacagaattaaaaataacagggtttgaagattatctcgattcaatagatgttatgcctgtttatgaactannacaccaggagaaaacagatctgaacgaaatcatcgaagaactgcgaaatagttgtactgccggaatgttactttgcctg

SEQ ID NO: 614 - protein, 147 aa, Unknown
  Obtained from environmental sample
  DOMAIN (32)...(99): Sigma-70 region 2
  misc_feature (1)..(147): Xaa is any amino acid
MDNPFHINYPDQVDAELVRLAIGGDKQALQNLITRHQIFIYNLALKMTKSIEDAEDLTQEVLIKAITALSKFEGKSQFRTWLYRITVNHFLNTKKRKTELKITGFEDYLDSIDVMPVYELXHQEKTDLNEIIEELRNSCTAGMLLCL

SEQ ID NO: 615 - DNA, 348 bp, Unknown
  Obtained from environmental sample
  misc_feature (1)..(348): n is a, c, g, or t
atgtttaaaaactttattgcgatgcagttcaaaaagccatcgggcatatttggacgttttagttctaacataatgattaagggtaacaaggcaaagtatcaaaggctccttaaagatctcaatcctcaacccggcgacaaattgttagaaattggatatggtccaggtgaaggcctccatataattgcggaatcatgtacctcttgtaccattcatggaattgatttttctaaattgatgtacacgagggctactaaatataataaacaatacctcngacatgattctatgttgttaccatatggagactttttaacaacaccaattgttggtacgaatatgataaaa

SEQ ID NO: 616 - protein, 116 aa, Unknown
  Obtained from environmental sample
  misc_feature (1)..(116): Xaa is any amino acid
MFKNFIAMQFKKPSGIFGRFSSNIMIKGNKAKYQRLLKDLNPQPGDKLLEIGYGPGEGLHIIAESCTSCTIHGIDFSKLMYTRATKYNKQYLXHDSMLLPYGDFLTTPIVGTNMIK

SEQ ID NO: 617 - DNA, 312 bp, Unknown
  Obtained from environmental sample
  misc_feature (1)..(312): n is a, c, g, or t
gtgcgcaagacagaaaactacttgaccagactttattgcacgattatatttttgaatggggaatacaaaaaaaacagtgttgcatggcacttgggtatgtttctttatacaatcattcttatgattctaattgctcttacgatatggactttaaaaaaaatactattactatcaccacaaccaggaaaatcaaaaaaggagaagagttgtttatcaactataatggagagccggataaaaaaacacccgtctggtttgatgcaaaatgaaatttgttttttgcagctattgattgctatgggagtttcgtaa

SEQ ID NO: 618 - protein, 103 aa, Unknown
  Obtained from environmental sample
  misc_feature (1)..(103): Xaa is any amino acid
MRKTENYLTRLYCTIIFLNGEYKKNSVAWHLGMFLYTIILMILIALTIWTLKKILLLSPQPGKSKKEKSCLSTIMESRIKKHPSGLMQNEICFLQLLIAMGVS

SEQ ID NO: 619 - DNA, 807 bp, Unknown
  Obtained from environmental sample
  misc_feature (1)..(807): n is a, c, g, or t
gtgatcgcaagcatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattttattggcgattgtatccctgtcgtgttcaaaaaaacaggaatatattctctctcaaaataagatggttaacgtactcaccgatcttcattttgctgatgctgccggcagtgcattacgtagcacgggcatcgattctgcaagtatttacgggtgggtatttgaaaagaataaaattactgctgccgaatttgactcctctatggtgtattattcacagcatggtgataaactcatccagatctataacaaagttttagcaaatctttcaaaaaaagaagcagatataagaacagaacaggctaaacaaagtgagaaaaaaacaacaaccatttgggaaagtaaaaatgtttacaggttgccttttgatggttctataaataaaatccccctggatgtgcctatagataaaacaggaaaatacacgatctctgtaagattaaaaatcttaaacatggatcaatcaattaacccccatcttacagcctatttctggtatgatgacggaacttctgaaggaaaaaaacttttttttaaaaatgtaccttatcaaaaaaataacaaaacaacaaattattcagcctcttattcccttactgacggaaaatacacccatattaaaggctttgttatcgacgatgataatttaaatctcaattatctaaagcaggccgaa

SEQ ID NO: 620 - protein, 269 aa, Unknown
  Obtained from environmental sample
  misc_feature (1)..(269): Xaa is any amino acid
MIASMXXXXXXXXXXXXXXXXXXXXXXXXXXXXXXXXXXXXXVILLAIVSLSCSKKQEYILSQNKMVNVLTDLHFADAAGSALRSTGIDSASIYGWVFEKNKITAAEFDSSMVYYSQHGDKLIQIYNKVLANLSKKEADIRTEQAKQSEKKTTTIWESKNVYRLPFDGSINKIPLDVPIDKTGKYTISVRLKILNMDQSINPHLTAYFWYDDGTSEGKKLFFKNVPYQKNNKTTNYSASYSLTDGKYTHIKGFVIDDDNLNLNYLKQAE

SEQ ID NO: 621 - DNA, 666 bp, Unknown
  Obtained from environmental sample
  misc_feature (1)..(666): n is a, c, g, or t
ttgcagaaatggcaaaaaaagagggccataaagtctaagtttcaccctgaaataataatgaatccggataaacaaaaaagcgttttggtatgtccattggaatggggccttggtcatgttgcgcgttgtattcccgtgattaaagaattgcaaaatgaaggatttaaagtagtcgttggaaattcgggtaattacaaaaattttatgtcttctttttttgatgacatccggattatttatatcccttcagtgagaatacattacagacacaataaagcattcaagagtattttacttcaggttcctaaactcatttaccagatagttatcgaacatatctatgtagctcaaatcatccgcaaaaataaattttcgatcattatttccgacaacaggtatggtatccggaacaaaaagatcaaatccatattgatcactcatcaggtttttatacagatgccggaaaaactgaacatgttcagacggtttattcattacattacggaaaggatgataaaaaaatttgatgaatgctggatacccgattatacatctgacttaaacagttacagcggaagtttatcacatggaaaagggataccttccnnnnnnnnnnnnnnnnnnnnnnnnnnnnnnnnnnnnnnnnnnnnnnnnnnngtcccttag

SEQ ID NO: 622 - protein, 221 aa, Unknown
  Obtained from environmental sample
  misc_feature (1)..(221): Xaa is any amino acid
MQKWQKKRAIKSKFHPEIIMNPDKQKSVLVCPLEWGLGHVARCIPVIKELQNEGFKVVVGNSGNYKNFMSSFFDDIRIIYIPSVRIHYRHNKAFKSILLQVPKLIYQIVIEHIYVAQIIRKNKFSIIISDNRYGIRNKKIKSILITHQVFIQMPEKLNMFRRFIHYITERMIKKFDECWIPDYTSDLNSYSGSLSHGKGIPSXXXXXXXXXXXXXXXXXVP

SEQ ID NO: 623 - DNA, 309 bp, Unknown
  Obtained from environmental sample
  misc_feature (1)..(309): n is a, c, g, or t
ttgcttccgggtatcatcctaatactgaatagttgctctactagttctgaaaaagcaatcccggaaacgcacaaggttgaaataaaatccatgcaatttcaaccttcacagcttacagttcaaaaaggagacaccgtgatttttacaaataaggatattgttgtgcacgatgtaactgaagaaaaaaataaaagctggtcttcactacccttgtctaccaatcaatcttataccatagtagttaatgaaagtgcagattattattgttccattcaccctgtaatgaagggtaagctaatgatgcaataa

SEQ ID NO: 624 - protein, 102 aa, Unknown
  Obtained from environmental sample
  DOMAIN (20)...(102): Copper binding proteins, plastocyanin/azurin family
  misc_feature (1)..(102): Xaa is any amino acid
MLPGIILILNSCSTSSEKAIPETHKVEIKSMQFQPSQLTVQKGDTVIFTNKDIVVHDVTEEKNKSWSSLPLSTNQSYTIVVNESADYYCSIHPVMKGKLMMQ

SEQ ID NO: 625 - DNA, 513 bp, Unknown
  Obtained from environmental sample
  misc_feature (1)..(513): n is a, c, g, or t
atggatagacttgccaaagaaagtgatttatttagatgtttttgtggtccttcttctacaaattctactaaattattatctaaactaaattggtataatggtatagtaatgccttattattatgatgaacctgaaacattaaaacaaaaacagaaacaaaatcaatctgaaaataacaaaagcattatgagatattgtagcaaggttatggaaaatatagtagaagccgcaaacgataccaataataaacaggtttgctgcattgattttcttataaatgatatagcaaaatcttcattacaacaagctctaaaaattgaaaaagcctatgatgatagtagaattccaggacttatgtattgtacatacaagactgaaactttgctaagcgcagagataaaagaccttgtagaattgtttgaaggacatgatcaggtctttatactaaaacaagatgatgtctataaacttcatatcacaaaggaaaatgtgcataaacttttcttaaattaa

SEQ ID NO: 626 - protein, 170 aa, Unknown
  Obtained from environmental sample
  misc_feature (1)..(170): Xaa is any amino acid
MDRLAKESDLFRCFCGPSSTNSTKLLSKLNWYNGIVMPYYYDEPETLKQKQKQNQSENNKSIMRYCSKVMENIVEAANDTNNKQVCCIDFLINDIAKSSLQQALKIEKAYDDSRIPGLMYCTYKTETLLSAEIKDLVELFEGHDQVFILKQDDVYKLHITKENVHKLFLN

SEQ ID NO: 627 - DNA, 549 bp, Unknown
  Obtained from environmental sample
  misc_feature (1)..(549): n is a, c, g, or t
gtggaaggaaagaaaactgactatacaattattaccgcttcaccagataataaagtttccgtaaggatcaatggtttgaaaaacgaagacaaggatctaaatgcaaggattactattgataaagggctcaaaccggaagcagggaataatgccaccggtgaacctattacagcatcacttggcataccttccccctatattcttaacatcgtggaaatcgaatcacagcacgatggagtggagggcatagcgaaagtgataacgagccagcaactggcaggggagagcctgaagcctttcctggaaatggatcccgatctcaattttaccgttgagcccaatgaaaacgggttcaccctgcgcagcgacaaatttgatgtgaacaaatcctatgcgctgacgattgcaaaaggactgcgggggaaaataggcggcgtgctcaaggaagattattccggcagtattgcgttcggagaactggagtctggtgtcaggtttacgaatagcaaggccgtcctatctttccaaaaatggagcaaagaacattga

SEQ ID NO: 628 - protein, 182 aa, Unknown
  Obtained from environmental sample
  misc_feature (1)..(182): Xaa is any amino acid
MEGKKTDYTIITASPDNKVSVRINGLKNEDKDLNARITIDKGLKPEAGNNATGEPITASLGIPSPYILNIVEIESQHDGVEGIAKVITSQQLAGESLKPFLEMDPDLNFTVEPNENGFTLRSDKFDVNKSYALTIAKGLRGKIGGVLKEDYSGSIAFGELESGVRFTNSKAVLSFQKWSKEH

SEQ ID NO: 629 - DNA, 489 bp, Unknown
  Obtained from environmental sample
  misc_feature (1)..(489): n is a, c, g, or t
atgagtaataattactacaaagatctatggaccaaacccaataatcacggtacaatattttggagggatgtagattttaacaagaaagaatacaaattacaggaacatatgttcaggcaattattggttagtataaagaatctaaacaggcttcatgttgacgaaagagagataaagtcggtgcttgaagttggtgcaggcactggtagaatggcaaagatagtttggaatgaatttccaaatataaaggcatatgatgctgtagatattcataataaaataactaatgcctattataatactgatcataatttatttaataaaataaattggtatgatttggatataacgggtaaatactttgatgaagcatttagaggtagacagtatgatttggtgcttgcaagtgaggtatttatgcatataaaaccaagtgatatagaagtggtgattaaaaaaggtacacgtcttctcgccccgaaagttctt

SEQ ID NO: 630 - protein, 163 aa, Unknown
  Obtained from environmental sample
  misc_feature (1)..(163): Xaa is any amino acid
MSNNYYKDLWTKPNNHGTIFWRDVDFNKKEYKLQEHMFRQLLVSIKNLNRLHVDEREIKSVLEVGAGTGRMAKIVWNEFPNIKAYDAVDIHNKITNAYYNTDHNLFNKINWYDLDITGKYFDEAFRGRQYDLVLASEVFMHIKPSDIEVVIKKGTRLLAPKVL

SEQ ID NO: 631 - DNA, 786 bp, Unknown
  Obtained from environmental sample
  misc_feature (1)..(786): n is a, c, g, or t
atgatgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactaattgcggcaaagcacatttggaaggcttcggcagcgaagaaggcgttcgcaagggaaagggtgagttatacgattttttgcggcattataatggtggtgcttttgttatgtgggattacgaatacttaagagaaatgagcaaaggaattgaaaccatttataaatacggcactcatgatgcagatattattggaactgattccaccaacgacccatttttagaagtaaagtttacaaaaggttttcagggaaacattgcaacaaaacttgttggaaactataacctttcaaatgtattggctgctgtatctgtagggaaattttttaaagtagatgatcgcaaaataaaagaagcaatagaaagctattcgccatcaaatagccgctctcaattaattcaaaaaggaagtaacaagattatcctggacgcctataatgcaaatcccaacagcatgaagtttgccattgaaaatttttccaaagcctcaggagaaaacaagatattggtgttaggcgccatggccgaattaggaaaagacagcattgaagaacatcaacagattttaaacatcatcaaaaactatcaatgggaaaatgttttgttggtgggcgaagatttttctaaaatacacaccccatatgcnattcgactctgctga

SEQ ID NO: 632 - protein, 261 aa, Unknown
  Obtained from environmental sample
  DOMAIN (168)...(254): Mur ligase family, glutamate ligase domain
  misc_feature (1)..(261): Xaa is any amino acid
MMYXXXXXXXXXXXXXXXXXXXXXXXXXXXXXXXXXXXXXXTNCGKAHLEGFGSEEGVRKGKGELYDFLRHYNGGAFVMWDYEYLREMSKGIETIYKYGTHDADIIGTDSTNDPFLEVKFTKGFQGNIATKLVGNYNLSNVLAAVSVGKFFKVDDRKIKEAIESYSPSNSRSQLIQKGSNKIILDAYNANPNSMKFAIENFSKASGENKILVLGAMAELGKDSIEEHQQILNIIKNYQWENVLLVGEDFSKIHTPYAIRLC

SEQ ID NO: 633 - DNA, 684 bp, Unknown
  Obtained from environmental sample
  misc_feature (1)..(684): n is a, c, g, or t
atgaaaaaactttttgccgaactatcaaaatatccgctctacagaaagtatgaacatttaatttttccggcattttcagttcttattttaattctgaccgtgttttatgttgttgtcccccagactttccagtatctggagactatgaacaaaattgaggaagagaatgcgagactttcaaacttaaaaacaaaaacagaaacactgaaaaaagtacatatcaggacatacagggaaaatcttgaaattgcatcaatcgccctgcctcaagataaaaatattacatcagtaatcggcatagtgctttcgatgctcagtaaaaataatattcaggttctggatacttcttactccgatgtatccacagacggtgaaccggctaagaatttcagaattaagtttgatgcgactgggacgggtgcagatacaaagaacttaatttcacaattatcccaggttccaaggttaatgaaggccagcggacttgaatatttgggtacctcacaaaacgacaaagtctcggtgacgctgacgtttttggcatattatgatgccactgtttcgactatcgnaggcgccgaacaggctgtaagcctaatgccgacaaagataccgagatactggttttcatcaaaaattacatatttgcttcctgcaaatacgacacctgntattggtcgggcg

SEQ ID NO: 634 - protein, 228 aa, Unknown
  Obtained from environmental sample
  misc_feature (1)..(228): Xaa is any amino acid
MKKLFAELSKYPLYRKYEHLIFPAFSVLILILTVFYVVVPQTFQYLETMNKIEEENARLSNLKTKTETLKKVHIRTYRENLEIASIALPQDKNITSVIGIVLSMLSKNNIQVLDTSYSDVSTDGEPAKNFRIKFDATGTGADTKNLISQLSQVPRLMKASGLEYLGTSQNDKVSVTLTFLAYYDATVSTIXGAEQAVSLMPTKIPRYWFSSKITYLLPANTTPXIGRA

SEQ ID NO: 635 - DNA, 726 bp, Unknown
  Obtained from environmental sample
  misc_feature (1)..(726): n is a, c, g, or t
gtgagtaccgtcnnnnnnnnnnnnnnnnnnnnnnnnnnnnnnnnnnnnnnnnnnnnnnnnnnnnnnnnnnnnngtaaagaaggggggatgcacttgtgtctaaaggatgttttatattcaatagattggaagaaattaggaatttcccctataaatgtgaatgtagctttaaggtttggtctttctgatgggattgttgttaccccctctagggagggaataatcctcacagaaggagttaaaaagataattaaggataaaattaatgctgtatcagattggtttattggggaatataataaaacaataaaggaatttgaaaattttggggaggctttcccacatttgaagaatggtaataaattcattgatattgaagaaactaggtttcagatagacccattaattccacattcttctattccagtgggggacatcaaagtgaaaggaatcccctctcctaggacaaattttgttagtttagatattttatgtggaaattttattccaataggttacattaattataatggaaattataatggaagtaagcatatatatcaagatataaggcaaatattgatatatgaaaaggaggctatttttttggatgaaactcctataggaaaaataaaggaatttctaaaagaaaaatatactagaaatacatattttattatagaaaagaaaccgatttgggattctataaacagacttttcttctag

SEQ ID NO: 636 - protein, 241 aa, Unknown
  Obtained from environmental sample
  misc_feature (1)..(241): Xaa is any amino acid
MSTVXXXXXXXXXXXXXXXXXXXXXKEGGMHLCLKDVLYSIDWKKLGISPINVNVALRFGLSDGIVVTPSREGIILTEGVKKIIKDKINAVSDWFIGEYNKTIKEFENFGEAFPHLKNGNKFIDIEETRFQIDPLIPHSSIPVGDIKVKGIPSPRTNFVSLDILCGNFIPIGYINYNGNYNGSKHIYQDIRQILIYEKEAIFLDETPIGKIKEFLKEKYTRNTYFIIEKKPIWDSINRLFF

SEQ ID NO: 637 - DNA, 546 bp, Unknown
  Obtained from environmental sample
  misc_feature (1)..(546): n is a, c, g, or t
ttggggtggatacctcctnnnnnnnnnnnnnnnnnnnnnnnnnnnnnnnnnnnnnnnnnnnnnnnnnnnnnnnnnnnggaaggcgaggaatacaaggctgtaaaagaaaaacttgatttatccgaattggtaaaagaccgcgtaaaggattttgctttgcggtttcctgaccgcgtatttgaaatggatattgcgcctggaataaagatcaatggagatgagttgcttttgcaaatgatggtaaataatttgttacaaaacgccataaaatattctcccaaaactaaaccgatacattcggtgttatacaggaaggatggtgaaaccagtttaaggatcattgatgaaggagatggcattgccgaggtggaaaagccattggtatttgataaattttaccgtgtaggaaatgagatgacgcgaaaggcacatggtaccgggctgggattatatttgtgtaaaaaaattgccgaagcgcatttcgcagaaataaaaataacagacaatcttcctaaaggcactattttcaatgtgcatttcaggtaa

SEQ ID NO: 638 - protein, 181 aa, Unknown
  Obtained from environmental sample
  DOMAIN (72)...(181): Histidine kinase-, DNA gyrase B-, and HSP90-like ATPase
  misc_feature (1)..(181): Xaa is any amino acid
MGWIPPXXXXXXXXXXXXXXXXXXXXEGEEYKAVKEKLDLSELVKDRVKDFALRFPDRVFEMDIAPGIKINGDELLLQMMVNNLLQNAIKYSPKTKPIHSVLYRKDGETSLRIIDEGDGIAEVEKPLVFDKFYRVGNEMTRKAHGTGLGLYLCKKIAEAHFAEIKITDNLPKGTIFNVHFR

SEQ ID NO: 639 - DNA, 423 bp, Unknown
  Obtained from environmental sample
  misc_feature (1)..(423): n is a, c, g, or t
atgccttcggtattttttatttccttaatggccggtacgccctggggtggcagtgaagaaatatggtacaaaactgctttacttgctcaacgccgtggatggaaagttggctgtgcagtatatcactgggaagaaaaagaaaaaaagatgcagccattaagagatgccggtgctgatatcttttatttccccaataaaggaagagaaaaaagaaacctgattgaaagaattcaaaacaaggtatctaagcaaagaataaanaaagtcattccaacattaccaattaataaatatgatttggttgtggtaaatatgggagcctttgaaaacacaacacctgcatggagagattttataaaagtttggatcgctacatgggtctttatcataattataaaagacatgaaagttttagtgnagtaa

SEQ ID NO: 640 - protein, 140 aa, Unknown
  Obtained from environmental sample
  misc_feature (1)..(140): Xaa is any amino acid
MPSVFFISLMAGTPWGGSEEIWYKTALLAQRRGWKVGCAVYHWEEKEKKMQPLRDAGADIFYFPNKGREKRNLIERIQNKVSKQRIXKVIPTLPINKYDLVVVNMGAFENTTPAWRDFIKVWIATWVFIIIIKDMKVLVX

SEQ ID NO: 641 - DNA, 612 bp, Unknown
  Obtained from environmental sample
  misc_feature (1)..(612): n is a, c, g, or t
gtgcatgacgctgtgtttgaattattcttcaacctggatgccacagaagaacaactggatttccccacttattatggttcaggaaagaatggttggttcaatgatagtttaactccaggcgaagacatcactcctcttttggatggtatcttgaaatatgttcctgagcctaaaataagcgaaggccctttgcaaatgcagatcacttcgctggactactcctctttccttggccgtattgcgattggtaaagttgcccgcggtataattaaagaaaatcagcagattgctttaatgcaaactgatggctcgataaaaaaacaaaaggtaagagagctgtatgtgtttgaagggatgggtaagaaaaaagtaactgaagtagttgccggtgacctttgtgctgtagtggggctcgaagattttaatatcggtgataccattgccgattctgaaaatcctgaagccttgccaacgatcagcgtggatgagcctacgatgaatatgatgttcggcatcaataactcaccgttttttggtagagatggaaagtttgtcacatcaaggcacttgcgtgaccgtctgatgaagaaacagaaaaaacccgggccttaa

SEQ ID NO: 642 - protein, 203 aa, Unknown
  Obtained from environmental sample
  DOMAIN (78)...(148): Elongation factor Tu domain 2
  misc_feature (1)..(203): Xaa is any amino acid
MHDAVFELFFNLDATEEQLDFPTYYGSGKNGWFNDSLTPGEDITPLLDGILKYVPEPKISEGPLQMQITSLDYSSFLGRIAIGKVARGIIKENQQIALMQTDGSIKKQKVRELYVFEGMGKKKVTEVVAGDLCAVVGLEDFNIGDTIADSENPEALPTISVDEPTMNMMFGINNSPFFGRDGKFVTSRHLRDRLMKKQKKPGP

SEQ ID NO: 643 - DNA, 456 bp, Unknown
  Obtained from environmental sample
  misc_feature (1)..(456): n is a, c, g, or t
ttggacttttctcaatcatctcccaaaaagctcacaatggatatcagcatttttacagacaaaacagctaaaccagaagaaaaagacctaataacagctcttggaaaggcctatcatttatggcaagacatcattcattcagtttacctcaagtatccaaatgcagtaagtgaatggaattttccaggacagaaatatggatggagtcttaaaattaaggacaagaagaggtccattatctatttactacctagagataaacgatttatggttgccttcaatttcggtcaaaaagcttttgaaaaaataattgacagtaatatttctgaagaaataaaacatggccttgaatctgcgaaagtttatgcggaaggtcggggaattcggatcgaagttaaaaatcaaaaggcactcanagatatcagtcagctaattgacattaagttagctttctaa

SEQ ID NO: 644 - protein, 151 aa, Unknown
  Obtained from environmental sample
  misc_feature (1)..(151): Xaa is any amino acid
MDFSQSSPKKLTMDISIFTDKTAKPEEKDLITALGKAYHLWQDIIHSVYLKYPNAVSEWNFPGQKYGWSLKIKDKKRSIIYLLPRDKRFMVAFNFGQKAFEKIIDSNISEEIKHGLESAKVYAEGRGIRIEVKNQKALXDISQLIDIKLAF

SEQ ID NO: 645 - DNA, 861 bp, Unknown
  Obtained from environmental sample
  misc_feature (1)..(861): n is a, c, g, or t
ttgtttgaaagctttatggaaaatactccgctaagtgcatggataacggatgataaaggggtgatacattacctcaatccggcctttagaaaattatataacttgactttggataatctttcccgcactatggatgaaatatttcctaaagacctttctgatgagtacaaagaaaataacttacttgccttgaagtcagggcacatgattgaggtggtggagagaactttgaaagctgatgggaccatggccatttaccgggtgtttaaatttccaatggctatagaaggcaatacaatgattggaggctggtctgttgaaataactgaagaagcaaaattgcaggaacaactaacaaacagtattgaacgatacagttttgtgaatgaagccacttccgatgcaatttacgattgggatccagctggcaatattctttaccgcgggaaaggttttgccatactttttggatatcatgatccatatgtaccgctggacttccgattttcccatatacatccttcagatcttgaacgggtaaagaaaacctacctcagcgcattaaaagatgtttctcttanaagatggaaattaaaatacaggctcagggatgctaaggggatttataaaaatgtagttgataaagcatttatactgcgggaaaatgataaaagtttacggattataggtgccatacaggacataactgagtataatcaacttcaaggaaaaacttgtgttgcagggagaaaagtaaaaaaagagcgattgtggcgttccataatccaaaacacaggaaaaaagaaaggaccccggcttttctggtggatttacatgataaatgggaacccaaatttttat

SEQ ID NO: 646 - protein, 287 aa, Unknown
  Obtained from environmental sample
  misc_feature (1)..(287): Xaa is any amino acid
MFESFMENTPLSAWITDDKGVIHYLNPAFRKLYNLTLDNLSRTMDEIFPKDLSDEYKENNLLALKSGHMIEVVERTLKADGTMAIYRVFKFPMAIEGNTMIGGWSVEITEEAKLQEQLTNSIERYSFVNEATSDAIYDWDPAGNILYRGKGFAILFGYHDPYVPLDFRFSHIHPSDLERVKKTYLSALKDVSLXRWKLKYRLRDAKGIYKNVVDKAFILRENDKSLRIIGAIQDITEYNQLQGKTCVAGRKVKKERLWRSIIQNTGKKKGPRLFWWIYMINGNPNFY

SEQ ID NO: 647 - DNA, 375 bp, Unknown
  Obtained from environmental sample
  misc_feature (1)..(375): n is a, c, g, or t
ttggataaaattaacctgtcagaaaaagtaaaaattgattttaaatttcttacaacggctaaaaaaactccgctaaaaagcgaagataaaattgctgtttacagaattgtacaggaacagctcaataatatattgaaacatgccaatgcaaaaaatgtttttattgagcttgctttaaagattccaaaaattcacctgttcatagaagatgatggcaacggttttaatcctaaaaaattaaataagggccttggtttaaaaaacattcaccaccgtgtggaatactatcacggtaccattgatatagaaagcggtaaaaataaaggttgcaaaatgaccattacgcttaatatattttctgccaataaaaaataa

SEQ ID NO: 648 - protein, 124 aa, Unknown
  Obtained from environmental sample
  DOMAIN (28)...(119): Histidine kinase-, DNA gyrase B-, and HSP90-like ATPase
  misc_feature (1)..(124): Xaa is any amino acid
MDKINLSEKVKIDFKFLTTAKKTPLKSEDKIAVYRIVQEQLNNILKHANAKNVFIELALKIPKIHLFIEDDGNGFNPKKLNKGLGLKNIHHRVEYYHGTIDIESGKNKGCKMTITLNIFSANKK

SEQ ID NO: 649 - DNA, 408 bp, Unknown
  Obtained from environmental sample
  misc_feature (1)..(408): n is a, c, g, or t
atgattaatctcaatcttccctcatacaactataaaataaaaaaagaggatgataaaatctggatcttcgacgtgcttcgcaaaaagtacgttgtgttgacaccggaagaatgggtgcgtcaacactttgtcaattacatgatggaggaactttcgtatccgaaggcgctgatcaaactggagggtggcctcacgtataatcagcttgcgaaaagatctgacattgtcgtatttgatcgggaaggaaaaccgtggatgatcatcgaatgcaaagcggcagattgtgctctttctccggctacgcttaggcaggcttcggtttacaatgctacgctgaaggcaaagtacctggttgtaacaaaccggactgtctcatttctatttcgaaacagactgggatgccggtaa

SEQ ID NO: 650 - protein, 135 aa, Unknown
  Obtained from environmental sample
  misc_feature (1)..(135): Xaa is any amino acid
MINLNLPSYNYKIKKEDDKIWIFDVLRKKYVVLTPEEWVRQHFVNYMMEELSYPKALIKLEGGLTYNQLAKRSDIVVFDREGKPWMIIECKAADCALSPATLRQASVYNATLKAKYLVVTNRTVSFLFRNRLGCR

SEQ ID NO: 651 - DNA, 501 bp, Unknown
  Obtained from environmental sample
  misc_feature (1)..(501): n is a, c, g, or t
ttgataaaacttctccattcccaaaatcattataaaatgacacaattaaaagagggatcaaaagctccgcaatttgagggaaccgatcagaatggcaatctaatcagcctgagccagtttgccgggaaaaaggtaattctttacttctatcccaaggacaatactcctggctgtacggctgaagcatgcaaccttcgtgataattacgactctcttttaaagaaaggttttattatcataggagtcagtccggatagcgaaaagtcacataaaggttttgccggaaaatattcacttccttttccgctaattgccgacaaatcaaaaaaaatacttaacgattatggtgtatggggagaaaagaagatgtttggaaagacttacatgggtgtgaacaggacaacatttattatcgacgagaaaggattcatcgaaaagattatttccaaagttgatacagcaggacatactgaacagatttatacaatttataataaataa

SEQ ID NO: 652 - protein, 166 aa, Unknown
  Obtained from environmental sample
  DOMAIN (18)...(163): AhpC/TSA family
  misc_feature (1)..(166): Xaa is any amino acid
MIKLLHSQNHYKMTQLKEGSKAPQFEGTDQNGNLISLSQFAGKKVILYFYPKDNTPGCTAEACNLRDNYDSLLKKGFIIIGVSPDSEKSHKGFAGKYSLPFPLIADKSKKILNDYGVWGEKKMFGKTYMGVNRTTFIIDEKGFIEKIISKVDTAGHTEQIYTIYNK

SEQ ID NO: 653 - DNA, 735 bp, Unknown
  Obtained from environmental sample
  misc_feature (1)..(735): n is a, c, g, or t
gtgttaagcgcattacgcaattcgagtccccaaataagaaaagctggaattcgattaagcgaacaatatattttgaacggagatcaggagattctgaaaaggttgttctcgatgaaaaatgacgagagcaaagaagtgatcgggcagttggttgtttcattaaaccaacaaggcaatgctttcgctaaggaacaggttgaggacatactccaggggtacaaaaatcatgctttgctatcccgtataaaaaacatgttggtatcgaacgaagaaaaaagaaagttcggcgcaaagatggtagcgctgcatgaggatgccaggaaaagagtcatcaagggcgcagaaattttcagctcgctatgtgcttcatgtcatgggccaaagggagttggtttaccaaataaaattgctcctccattaattggcaaaatcaaattgttgaataatagagaagcgacgataaagatcctgttgcatggattgaaaggccccgttgagggagtctcctatccagacatcatggtgcctatgaaaagttatgacgacgaatggatcgcttcagtattaaattatgttcgcttcgaattgagcatgcaaagtttccctgacctgccggagaagtattttaattcattggcgataactcccggcgaagtcgaagcattgaggaaacagtatgcgaaccgcaaggaaccatggacgtgggaggagttgttactgaagaaaaagaaatga

SEQ ID NO: 654 - protein, 244 aa, Unknown
  Obtained from environmental sample
  DOMAIN (111)...(196): Cytochrome c
  misc_feature (1)..(244): Xaa is any amino acid
MLSALRNSSPQIRKAGIRLSEQYILNGDQEILKRLFSMKNDESKEVIGQLVVSLNQQGNAFAKEQVEDILQGYKNHALLSRIKNMLVSNEEKRKFGAKMVALHEDARKRVIKGAEIFSSLCASCHGPKGVGLPNKIAPPLIGKIKLLNNREATIKILLHGLKGPVEGVSYPDIMVPMKSYDDEWIASVLNYVRFELSMQSFPDLPEKYFNSLAITPGEVEALRKQYANRKEPWTWEELLLKKKK

SEQ ID NO: 655 - DNA, 360 bp, Unknown
  Obtained from environmental sample
  misc_feature (1)..(360): n is a, c, g, or t
ttgatgaataccaccaaaacaattaattatagtattgacagtttgtgggaggtaaatggcattactaaaataagattggaaaacatagggcaaatgcctatgccggttgatgtaaaatttacgttcagggatagtacatcagaatggcattatattccgctaagtttaatgtttggagaaaaatctgaagagccgtggcaaatgccaagagtagtgtataatgaatggaaatggacgcaccctacttatgaaattcaaaccaaaagaaaattaacggatattatttctgttgaaattgacccaacgcaaaggctggcagatatcgatagaaaaaataacaggatcgagttgaagtggtaa

SEQ ID NO: 656 - protein, 119 aa, Unknown; identical to SEQ ID NO: 554
  Obtained from environmental sample
  misc_feature (1)..(119): Xaa is any amino acid

SEQ ID NO: 657 - DNA, 375 bp, Unknown
  Obtained from environmental sample
  misc_feature (1)..(375): n is a, c, g, or t
gtggacagcattggcaaaaaattaaaaattgttgatgtagtgtcagacgctatcggtttaaataacataaccacacagcatattcgtgcagaagaaataaagaacaggaaatttgatttcgcagtaagtcgcgccgtggcatcgttaaaagatctttggcgatggagcaaacccttgttgaaaggatcaaactacaagacacagggtataagtggagaacaaatattacttaaatcaggattgatttgcctcaaaggtggtgacttaacacaagaaataattgaaagcggaatcaaaccaaaaagtatagaaatcacagatttgtttgatgaaaaattttttaaagagaaatatttattgtacgtgtctacttaa

SEQ ID NO: 658 - protein, 124 aa, Unknown
  Obtained from environmental sample
  misc_feature (1)..(124): Xaa is any amino acid
MDSIGKKLKIVDVVSDAIGLNNITTQHIRAEEIKNRKFDFAVSRAVASLKDLWRWSKPLLKGSNYKTQGISGEQILLKSGLICLKGGDLTQEIIESGIKPKSIEITDLFDEKFFKEKYLLYVST

SEQ ID NO: 659 - DNA, 660 bp, Unknown
  Obtained from environmental sample
  misc_feature (1)..(660): n is a, c, g, or t
gtgcctttaaaagcaagaaaagaagatttaataggagttctaaaggcattggtattttcatttgattcactcgctgataaaaaaaatatttcattaaagtttcagagtaattccaatacaaaatttttatggatcgacagagataaactggaaaagattatcaacaatcttctttccaatgcccttaagttcactccggcgggaggatcagttaagatttctgttaatgatattttttatgatggaaaagcgtttaccgaaattattgtatccgataccggcattggaatacctgaaggtaagcttgaaaatatttttgaccggttttatcaagtggataattccacacaaagatcctatggcggatctggaatcggtttggcattggtgaaggagttagttgatcttcacaaatggaaaattaaagttgaaagcggagaaggtaaaggtgcaaactttaaattaatgattccattagctgatgattatctggatgaatccgagaaggtatcagatgaatccagaatcgatactgctgaggatcaaaacaaagtatcaacaactaaacttagtgaccaaattattaaaccggaaaatgctgagacagaaaaaatcacactggaaaataaagcttcattactgatagttgagggattctga

SEQ ID NO: 660 - protein, 219 aa, Unknown
  Obtained from environmental sample
  DOMAIN (45)...(160): Histidine kinase-, DNA gyrase B-, and HSP90-like ATPase
  misc_feature (1)..(219): Xaa is any amino acid
MPLKARKEDLIGVLKALVFSFDSLADKKNISLKFQSNSNTKFLWIDRDKLEKIINNLLSNALKFTPAGGSVKISVNDIFYDGKAFTEIIVSDTGIGIPEGKLENIFDRFYQVDNSTQRSYGGSGIGLALVKELVDLHKWKIKVESGEGKGANFKLMIPLADDYLDESEKVSDESRIDTAEDQNKVSTTKLSDQIIKPENAETEKITLENKASLLIVEGF

SEQ ID NO: 661 - DNA, 549 bp, Unknown
  Obtained from environmental sample
  misc_feature (1)..(549): n is a, c, g, or t
atggagctgcaaggacatgtttgtcctcattacgtcataatccatccggtgtcaaaggaagaaaaatatctgtttatattctcagatattctttcatggtttagaaataactacgtcaaatatagagaaggggtgttggattttaagtaccaatttatattttttgataaagaggaacacgctgttaaacctgataaaagtattccggaaccattaatgaagataggcaatttatatgagttgccagtacaacacttaatctctcctccgggtatctattttctgtgtaagaataatgagataaaatatatcggtcaagctataaatatttcttcacgaataaaagaacatattaaagaaatggaaaaggaatttgattctatattttttatcctttgtccggtgtcacatcttaatgctgttgaatccgcccttattagatattataagcccgagttaaataaaacatgtacaggcaagatgacggctactgataaattaatagtagaaagtcattttgtaaacaagcctttcgaggcaatagtttaa

SEQ ID NO: 662 - protein, 182 aa, Unknown
  Obtained from environmental sample
  DOMAIN (89)...(160): GIY-YIG catalytic domain
  misc_feature (1)..(182): Xaa is any amino acid
MELQGHVCPHYVIIHPVSKEEKYLFIFSDILSWFRNNYVKYREGVLDFKYQFIFFDKEEHAVKPDKSIPEPLMKIGNLYELPVQHLISPPGIYFLCKNNEIKYIGQAINISSRIKEHIKEMEKEFDSIFFILCPVSHLNAVESALIRYYKPELNKTCTGKMTATDKLIVESHFVNKPFEAIV

SEQ ID NO: 663 - DNA, 477 bp, Unknown
  Obtained from environmental sample
  misc_feature (1)..(477): n is a, c, g, or t
ttgtccactaattatcaagttatgaaacggatggttcttattctaacaggtgtccttgccctaatttcgtgtgaacgtgaggaggcaaaggaagaaaaaattaccgaagtcaaagaaatcagaaagcatgaaaaaaatatttccgaacgctttttaagattagatggtcagaccgataccctaagaagttatgaattgggaaaaaatctatttggtaaattccataaaaaaagagcggagttctatgtgattgaacatccgaacaaaaccatttataaccggccagtgaaatgtatcacattatactttctggatggtacattggcaaaaacaaagtatgaattagaggaagacatttctgatgatctgattcatagctacggtaatttcacgatcaaaggttacgatacgcttacacgcaatttattaaaatccgaaaaaatcatccactcccaaaaatcaaaagatagtttttaa

SEQ ID NO: 664 - protein, 158 aa, Unknown
  Obtained from environmental sample
  misc_feature (1)..(158): Xaa is any amino acid
MSTNYQVMKRMVLILTGVLALISCEREEAKEEKITEVKEIRKHEKNISERFLRLDGQTDTLRSYELGKNLFGKFHKKRAEFYVIEHPNKTIYNRPVKCITLYFLDGTLAKTKYELEEDISDDLIHSYGNFTIKGYDTLTRNLLKSEKIIHSQKSKDSF

SEQ ID NO: 665 - DNA, 474 bp, Unknown
  Obtained from environmental sample
  misc_feature (1)..(474): n is a, c, g, or t
atgaaaaagaataatttatctgattttgaaaatagatttttatcattatttccagaaaatgcttttaaagattataataattgttggatatggcaaggtgaattagagactactggttatggtagaatatcctgtaagggtaaacgttatggagtacatcaacttgcctatttaatatttaatggagatattccacaaggacaaatagttagacatacttgtgatgttaaacattgtataaatcctaaacatttagttttaggaaatcatactgacaatgctttagatgtaatgcaaagaaattctcctatgtatgcaaagcttaatgaagaagctgttaaagtgattaaatggatgttaaaatataaaaactatcatgggctatctagaaagttatctcgtttatataatattgattttagtacaatatcagatattaaaagaaaaagaacttggtattgggtacaagtatag

SEQ ID NO: 666 - protein, 157 aa, Unknown
  Obtained from environmental sample
  misc_feature (1)..(157): Xaa is any amino acid
MKKNNLSDFENRFLSLFPENAFKDYNNCWIWQGELETTGYGRISCKGKRYGVHQLAYLIFNGDIPQGQIVRHTCDVKHCINPKHLVLGNHTDNALDVMQRNSPMYAKLNEEAVKVIKWMLKYKNYHGLSRKLSRLYNIDFSTISDIKRKRTWYWVQV

SEQ ID NO: 667 - DNA, 402 bp, Unknown
  Obtained from environmental sample
  misc_feature (1)..(402): n is a, c, g, or t
ttgttcggacgacttcgtaggttcttaggtgaaatgaatgcagcattattcagaaatgcctatagctacaaacctcagtctacggtcgcagagttgttaaatcgcggaatgattaaggttgtcaacgatccacggcttggcaaagatggctttgacattcggtgtatgacaactgttcacgattcattcgtatttaagtttcacaaaagccagattccaaacttgcttcaaatcttgttaatcatcaaagatcatatgactcacacatttacttataaaggaaaaagtttcactatcggattggacgctaagattggcacaagttgggctggaaatactgctgaaataagtaactttacacaagaagaaatagataaagctttaaataaaataggatattaa

SEQ ID NO: 668 - protein, 133 aa, Unknown
  Obtained from environmental sample
  misc_feature (1)..(133): Xaa is any amino acid
MFGRLRRFLGEMNAALFRNAYSYKPQSTVAELLNRGMIKVVNDPRLGKDGFDIRCMTTVHDSFVFKFHKSQIPNLLQILLIIKDHMTHTFTYKGKSFTIGLDAKIGTSWAGNTAEISNFTQEEIDKALNKIGY

SEQ ID NO: 669 - DNA, 438 bp, Unknown
  Obtained from environmental sample
  misc_feature (1)..(438): n is a, c, g, or t
ttgagaggaggtcaacaaaatcgagttctatacaacttgttcggacgacctcgtaggttcttaggtgaaatgaatgcagcattattcagaaatgcctatagctacaaacctcagtctacggtcgcagagttgttaaatcgcggaatgattaaggttgtcaacgatccacggcttggcaaagatggctttgacattcggtgtatgacaactgttcacgattcattcgtatttaagtttcacaaaagccagattccaaacttgcttcaaatcttgttaatcatcaaagatcatatgactcacacatttacttataaaggaaaaagtttcactatcggattggacgctaagattggcacaagttgggctggaaatactgctgaaataagtaactttacacaagaagaaatagataaagctttaaataaaataggatattaa

SEQ ID NO: 670 - protein, 145 aa, Unknown
  Obtained from environmental sample
  misc_feature (1)..(145): Xaa is any amino acid
MRGGQQNRVLYNLFGRPRRFLGEMNAALFRNAYSYKPQSTVAELLNRGMIKVVNDPRLGKDGFDIRCMTTVHDSFVFKFHKSQIPNLLQILLIIKDHMTHTFTYKGKSFTIGLDAKIGTSWAGNTAEISNFTQEEIDKALNKIGY

SEQ ID NO: 671 - DNA, 480 bp, Unknown
  Obtained from environmental sample
  misc_feature (1)..(480): n is a, c, g, or t
atgaaaaagaataatttatctgattttgaaaatagatttttatcattatttccagaaaatgcttttaaagattataataattgttggatatggcaaggtgaattagagactactggttatggtagaatatcctgtaagggtaaacgttatggagtacatcaacttgcctatttaatatttaatggagatattccacaaggacaaatagttagacatacttgtgatgttaaacattgtataaatcctaaacatttagttttaggaaatcatactgacaatgctttagatgtaatgcaaagaaattctcctatgtatgcaaagcttaatgaagaagctgttaaagtgattaaatggatgttaaaatataaaaactatcatgggctatctagaaagttatctcgtttatataatattgattttagtacaatatcagaaattaaaagaaaaagaaccttggtattgggtaccagtatagtatag

SEQ ID NO: 672 - protein, 159 aa, Unknown
  Obtained from environmental sample
  misc_feature (1)..(159): Xaa is any amino acid
MKKNNLSDFENRFLSLFPENAFKDYNNCWIWQGELETTGYGRISCKGKRYGVHQLAYLIFNGDIPQGQIVRHTCDVKHCINPKHLVLGNHTDNALDVMQRNSPMYAKLNEEAVKVIKWMLKYKNYHGLSRKLSRLYNIDFSTISEIKRKRTLVLGTSIV

SEQ ID NO: 673 - DNA, 777 bp, Unknown
  Obtained from environmental sample
  misc_feature (1)..(777): n is a, c, g, or t
ttgctggagaattatcaaagcagtcgttcgcagatgagtcgtgatgagttgattgcagaactggaagcaaacaaaagaaagatcattgaaacgctcggtcattatgacattgagatcgataaaataaaagcgactgttggtcctactgtaacgttatttgaaattgttccaaaagcaggaattagaatttcgaagattaaaaatcttgaagatgatattgctttaagtcttgcagcgcttggtattcgcatcattgctcctataccgggaaaaggaaccattggaattgaagtgcccaaccagcatcctgatattgtcagtatgaaatcagtgctggcttctgaaagattccagaacaatgacatggacctgccgatcggtctgggtaaaacaatttccaatgaagtgtttgtcactgaccttgcaaagatgcctcacttattaatggcaggtgcaacaggtcagggtaaatcagttggattaaatgcaatcctggtttcattattatataaaaagcatcctgcacaggttaaatttgttttggttgatcccaaaaaagtggagcttacactttttaaaacaatagagcggcacttccttgcaaaacttcccggtgaagaagatgcaattataactgatacaaagaaagtagtgaatacattgaattcactttgtgttgaaatggatcagcgctatgagttgctgaaagatgcacaggttcgtaatatcagggaatacaatacaaaattcgttgcacgtaaactgaaatccaaataa

SEQ ID NO: 674 - protein, 258 aa, Unknown
  Obtained from environmental sample
  DOMAIN (107)...(257): FtsK/SpoIIIE family
  misc_feature (1)..(258): Xaa is any amino acid
MLENYQSSRSQMSRDELIAELEANKRKIIETLGHYDIEIDKIKATVGPTVTLFEIVPKAGIRISKIKNLEDDIALSLAALGIRIIAPIPGKGTIGIEVPNQHPDIVSMKSVLASERFQNNDMDLPIGLGKTISNEVFVTDLAKMPHLLMAGATGQGKSVGLNAILVSLLYKKHPAQVKFVLVDPKKVELTLFKTIERHFLAKLPGEEDAIITDTKKVVNTLNSLCVEMDQRYELLKDAQVRNIREYNTKFVARKLKSK

SEQ ID NO: 675 - DNA, 336 bp, Unknown
  Obtained from environmental sample
  misc_feature (1)..(336): n is a, c, g, or t
atggagatcgcgtttaacaaaaccgatgccgacgtcagtatcgagtaccatctcaatccctttgcccagacttatatgttccttttcgggagcaaacatctggagcccaagattaaagagattttttctgagtttgggaatgtagaaattcagaaaatagggagaaacagtgctttaattcgggtaaaaaacgtttccaagaaaagtgaagaatactacctgcatgattcccggaaattcgggatgcagccgaatacccttacccttgtttaccctgagggcaccagaagagatattgaaaatgcaaaatccactccgaacacattttatgtgtga

SEQ ID NO: 676 - protein, 111 aa, Unknown
  Obtained from environmental sample
  misc_feature (1)..(111): Xaa is any amino acid
MEIAFNKTDADVSIEYHLNPFAQTYMFLFGSKHLEPKIKEIFSEFGNVEIQKIGRNSALIRVKNVSKKSEEYYLHDSRKFGMQPNTLTLVYPEGTRRDIENAKSTPNTFYV

SEQ ID NO: 677 - DNA, 486 bp, Unknown
  Obtained from environmental sample
  misc_feature (1)..(486): n is a, c, g, or t
atgaagccgttagtcaataagaaatataagcttgaaaaatttccgggtaagggaggatggacgtttgcaataatacctgaggtgatgcaaaataaacatagtgcctttggctgggtaaaggtgcgcgtcatcatcgatggtcacgagattaaaaaatatcacttgatgccgatgggcaatggcaaattgttcctgcccgtcaaatcagacattagaaaaaaaattggtaaaaagaatggcgatgtcgttcacataatactttatcgagatgatgagcccttggaggtaccggaagaactccggttgtgcttaaacgatgaaccgcgcgctttgaaatatttcgactcgctgtcagataatgagaagattgcaataattaaatggatcttctcggcaaaaaaagaaaacaagaaagttgagagacttgtgttagcgataaacaggctcgtgaataaaaggaagtttaatgagtggcacagcgtctaa

SEQ ID NO: 678 - protein, 161 aa, Unknown
  Obtained from environmental sample
  misc_feature (1)..(161): Xaa is any amino acid
MKPLVNKKYKLEKFPGKGGWTFAIIPEVMQNKHSAFGWVKVRVIIDGHEIKKYHLMPMGNGKLFLPVKSDIRKKIGKKNGDVVHIILYRDDEPLEVPEELRLCLNDEPRALKYFDSLSDNEKIAIIKWIFSAKKENKKVERLVLAINRLVNKRKFNEWHSV

SEQ ID NO: 679 - DNA, 777 bp, Unknown
  Obtained from environmental sample
  misc_feature (1)..(777): n is a, c, g, or t
ttgaatatgagcgttttagaaagtattagaaagcgtaccggactattggttggtattgtaggtttagcccttgtgatctttatccttgagagtttattgggttcgggtagttccatttttggcagtgacagaagcactgttggagttgtaaatggaaagaagatcgagtacaacgaatttataaccaaggttgagaatcagttgaaccagatccgtcaacaaaaacaatcaaatgatattgatgaccaaacacgcaaacaagtggtggattacatctttaatggttatatctctgaattggtgatcaaacctcaatattatgccataggtttatctgttggtgaagatgaattgtatgagaatatggttgtaaatccatcgcaggtggtgttgcaacgtttaaccgatcctaacacgcgtcaattaaatcctcaatttgccttacccgatggttcattggaccgtaacaagtggaaacaagtggtggcaagcgttaccggcgaccaggaaatggcagtaaaacaaatggaagaagatgtgagtaacactcgcctggccgaaaaatattcgatgttgatcaaaaaaggaatgtatgttaccgctgctgaaacaaagcatgattacgttacgcaaggcacaaaactaaatgtgagttttgttgtaaagcgttacgattcggttggcgacagcgctgtgaaagtaagcgatgatgatatcaagaaaatttacgaagaaaataagtacaaatacatcaataccaaaacaacactaagatag

SEQ ID NO: 680 - protein, 258 aa, Unknown
  Obtained from environmental sample
  misc_feature (1)..(258): Xaa is any amino acid
MNMSVLESIRKRTGLLVGIVGLALVIFILESLLGSGSSIFGSDRSTVGVVNGKKIEYNEFITKVENQLNQIRQQKQSNDIDDQTRKQVVDYIFNGYISELVIKPQYYAIGLSVGEDELYENMVVNPSQVVLQRLTDPNTRQLNPQFALPDGSLDRNKWKQVVASVTGDQEMAVKQMEEDVSNTRLAEKYSMLIKKGMYVTAAETKHDYVTQGTKLNVSFVVKRYDSVGDSAVKVSDDDIKKIYEENKYKYINTKTTLR

SEQ ID NO: 681 - DNA, 738 bp, Unknown
  Obtained from environmental sample
  misc_feature (1)..(738): n is a, c, g, or t
atgaaaatgcgggaatttattaaatacggaaataagcaaactttaattctcattgatgaattcggaacaggaacagatcctgcgatgggcggtgcgattgccgaagcatcgctcaacaaattgaatgagctgaaagtttttggcgtggtgacaacgcattatgcgaatttaaaatcatttgcgtctaatcacccgggaatactcaatggaagtatgttgttcgacgaacagggtctgaaaccggaatatgttctggaaacagggaaacccgggagttcctatgcgtttgaaattgcgaggaaatcggaattgcccgaacatgtaatcaatgaagcgatgaaactcgtttccaaagaacatcttcgatttgaggaattattgaaaaatgtgcggattgaaaaagaacatattaagttgcgagataaagaggtgacaaaaaaagaagaagacctgaaaaaaaaggagctcgaacttcaacaggcatttctgcgtgcacgtgaaaaagaagaaaggtataatttgaagaaactggaaaaagaagatgaaacgatcaaacgaatggaacagtcattcaaacaaatgctcgaagaattaaaatcaattcccgaacctgttcagctcgaacagcaaaaacaatcgatcagggaattcatcagttcgaaacggaaacacacctttaaagaaagaaaatccctcgcgataaatacggcgcctaaatttcaacagggtgaaatttaa

SEQ ID NO: 682 - protein, 245 aa, Unknown
  Obtained from environmental sample
  misc_feature (1)..(245): Xaa is any amino acid
MKMREFIKYGNKQTLILIDEFGTGTDPAMGGAIAEASLNKLNELKVFGVVTTHYANLKSFASNHPGILNGSMLFDEQGLKPEYVLETGKPGSSYAFEIARKSELPEHVINEAMKLVSKEHLRFEELLKNVRIEKEHIKLRDKEVTKKEEDLKKKELELQQAFLRAREKEERYNLKKLEKEDETIKRMEQSFKQMLEELKSIPEPVQLEQQKQSIREFISSKRKHTFKERKSLAINTAPKFQQGEI

SEQ ID NO: 683 - DNA, 357 bp, Unknown
  Obtained from environmental sample
  misc_feature (1)..(357): n is a, c, g, or t
atgatccaggcatcttcgggtattgcttctgatggattaacaggaagcattcaaactgaaaacagggtcttcagctcggaagcgacatatattttctaccaggggcgaagccctcagaaaaccggagtattccatacaacaccagaaaaaaatgcggtaagaaatcttattctcagaaaagaaaattatactgatgttgtaatgcttgaacaaccactgaaggtaaaagggcgttttattcttgagtcaggaaacctgaataagaattcatttcatctggatataaaagaaaaagtaaccgctgataacctcaaccggccacttgtgccggagaaagcttcaacaggtattcagtaa

SEQ ID NO: 684 - protein, 118 aa, Unknown
  Obtained from environmental sample
  misc_feature (1)..(118): Xaa is any amino acid
MIQASSGIASDGLTGSIQTENRVFSSEATYIFYQGRSPQKTGVFHTTPEKNAVRNLILRKENYTDVVMLEQPLKVKGRFILESGNLNKNSFHLDIKEKVTADNLNRPLVPEKASTGIQ

SEQ ID NO: 685 - DNA, 387 bp, Unknown
  Obtained from environmental sample
  misc_feature (1)..(387): n is a, c, g, or t
ttgaaagctctggttattatagatatgactaacgatttcgtgtatgagacctacgaatatgcaggaacgttatatgagggaaaacttgtagcccctatggcaaaggaaattgttgacaaaatagccaggctaattataaaggtagtaaaagggggaacagtcagtgttatcagaattccgaaagatcaccttaatgcctttatgaacccggaactcgaactgaaagcagcagagctcggaatcgatgaagtattcgttacaggcctggttgaggaagtctgcatatacattaatagccttggtttccttgaaagagggtttcgaacaaacatcgtaaaaggttgtacagctccatttgatgaagaaaaaggtagggaaagcctttag

SEQ ID NO: 686 - protein, 128 aa, Unknown
  Obtained from environmental sample
  misc_feature (1)..(128): Xaa is any amino acid
MKALVIIDMTNDFVYETYEYAGTLYEGKLVAPMAKEIVDKIARLIIKVVKGGTVSVIRIPKDHLNAFMNPELELKAAELGIDEVFVTGLVEEVCIYINSLGFLERGFRTNIVKGCTAPFDEEKGRESL

SEQ ID NO: 687 - DNA, 702 bp, Unknown
  Obtained from environmental sample
  misc_feature (1)..(702): n is a, c, g, or t
ttgggggacaggaatttaaaattccggtatcctgcccatttatacaaaaacccaccccattctgtgcggatcaaccaatttggcaacctgatagaaggcttgctggtaaacgatatcaaccaggtcgtacaaaccgatataacatatttctggatgaagggcagctttgcatacatggtctttatcattgatgtttattctcgaatgatagtgggctatcacgcctccttaaacctggaagcggcaggtaatctaaaagctttaaaaatgatgattcaactgcgaggcgcaaagaaattaaaaggtctcatccatcactcagataagggatctcaatatcattttaaagaatatcttaaagaattaaaggatcatggtattaaaataagtatgtgtgatacagcttggcaaaatgcttatacagaacgaatcaaccggaccatgaaatatgagtatttacggcaccgtaagattgataatattaaaaaattacgaaaatgtctggatgcagatgtaaaggcctataataccgaccggcctcattggagcttgccacaacaaatgtcacctgcagccttcgaggaatacctaaaaactgaaaaagggaagatgcgcccagaaatgaaaatttataaaagtgaaaaaaatgagttttttttagccatgaggcaatccgataaaaagaaagcagccaaaatatga

SEQ ID NO: 688 - protein, 233 aa, Unknown
  Obtained from environmental sample
  DOMAIN (35)...(195): Integrase core domain
  misc_feature (1)..(233): Xaa is any amino acid
MGDRNLKFRYPAHLYKNPPHSVRINQFGNLIEGLLVNDINQVVQTDITYFWMKGSFAYMVFIIDVYSRMIVGYHASLNLEAAGNLKALKMMIQLRGAKKLKGLIHHSDKGSQYHFKEYLKELKDHGIKISMCDTAWQNAYTERINRTMKYEYLRHRKIDNIKKLRKCLDADVKAYNTDRPHWSLPQQMSPAAFEEYLKTEKGKMRPEMKIYKSEKNEFFLAMRQSDKKKAAKI

SEQ ID NO: 689 - DNA, 729 bp, Unknown
  Obtained from environmental sample
  misc_feature (1)..(729): n is a, c, g, or t
gtggcaggcagattaattgtgatgcanttggtttttgcaatcggcaccattcctaatatagaattggcgaaagattgcggcttgcattgccagcgtggagtgatcgtaaatgaacggttacaaaccaacgatccaaatatatatgctattggagaaatagcagaatttaaaggcatgttatatggtattactgcggcagcggaggagcaggcagctatcattgccgattatttaataggcgacattgcaagtgtttatgacggcagcgtgttcatgaacattataaaaatacatggctttgatttgtgcagtattggtttgcctgaggtgcctaacaatgaggaatatgaagagataattttccaggatacttccatacgatactataaaaaatgcattgttcataaagaccgtttggtaggtgctataatgattggcgataaatcagagttccaggaatttaaggagctgattgccagtaaaacagaattaggtgaaaagcgtttgcagttattgcgtagtggtaaaaaaccagagccggtattaggaaaattggtgtgcagttgcaacagtgtgggtagcgataatatcaaaaataaaattactgaaggttgccaggattttaaacagctgtgcgcactaacaggcgcaggtacaggttgcggctcctgcaggccagaagtaaaaaaaatactgggacaattnatttgggagaaaacaacagcctaa

SEQ ID NO: 690 - protein, 242 aa, Unknown
  Obtained from environmental sample
  DOMAIN (184)...(236): BFD-like [2Fe-2S] binding domain
  misc_feature (1)..(242): Xaa is any amino acid
MAGRLIVMXLVFAIGTIPNIELAKDCGLHCQRGVIVNERLQTNDPNIYAIGEIAEFKGMLYGITAAAEEQAAIIADYLIGDIASVYDGSVFMNIIKIHGFDLCSIGLPEVPNNEEYEEIIFQDTSIRYYKKCIVHKDRLVGAIMIGDKSEFQEFKELIASKTELGEKRLQLLRSGKKPEPVLGKLVCSCNSVGSDNIKNKITEGCQDFKQLCALTGAGTGCGSCRPEVKKILGQXIWEKTTA

SEQ ID NO: 691 - DNA, 417 bp, Unknown
  Obtained from environmental sample
  misc_feature (1)..(417): n is a, c, g, or t
atggagtttcctagaaaggcattgcttaatttaaaaagtatgcttaatacattctcgtctacaaataaaacaagttcgcgtgaacttcttaaagaagaaggtaatggaatgtttttctcaggaaatttattcaacacatatgaaatcataaaggatgatagtaaaacgaacataagtataagtcaggaatatgcatattttgtaaatcggtattttttcattaaggaaagaattgaaaaacataatcgaattgtagactcgattagtaatcttacgccgggttctgctttaacagaatacgttcggcaaaaaattgatcatattcttgaattgcgttctgagatagaaaatatgaagagcgacatttggcaaaaatcaaataagctttttgaattgaatttatccagcaggctatga

SEQ ID NO: 692 - protein, 138 aa, Unknown
  Obtained from environmental sample
  misc_feature (1)..(138): Xaa is any amino acid
MEFPRKALLNLKSMLNTFSSTNKTSSRELLKEEGNGMFFSGNLFNTYEIIKDDSKTNISISQEYAYFVNRYFFIKERIEKHNRIVDSISNLTPGSALTEYVRQKIDHILELRSEIENMKSDIWQKSNKLFELNLSSRL

SEQ ID NO: 693 - DNA, 534 bp, Unknown
  Obtained from environmental sample
  misc_feature (1)..(534): n is a, c, g, or t
atgaagagtgagccccccgcgaataagagaaattatttaactttagcgatcatttatagaaaaacactacctatggctattcgctataaacactccgatgtatacaatacttacttctgcacatttacatgctacaactggttgcatttatttgaaattaccaaatcctatgatttggtgtataattggttctccatattaaaagacgaatgtaatagcgaaataatagcctacgtaattatgcccaaccacatgcactgcatactacattttaaagaagcgggctttaatctcaataaaataatatccaatgggaagcggtttatggcatatgaaattattagaagactggaagaaaaggaggaaaacatcatactaaggctactatctgaatcggttaccgaaagggaaaagaagaagggacagttgcataaagtattcaaagatagttttgacgctaaagttattttttcggataaatttttacatcaaaaaatagactatatccattacaaccccgtaagcgggaagtga

SEQ ID NO: 694 - protein, 177 aa, Unknown
  Obtained from environmental sample
  DOMAIN (77)...(108): Protein of unknown function (DUF1568)
  misc_feature (1)..(177): Xaa is any amino acid
MKSEPPANKRNYLTLAIIYRKTLPMAIRYKHSDVYNTYFCTFTCYNWLHLFEITKSYDLVYNWFSILKDECNSEIIAYVIMPNHMHCILHFKEAGFNLNKIISNGKRFMAYEIIRRLEEKEENIILRLLSESVTEREKKKGQLHKVFKDSFDAKVIFSDKFLHQKIDYIHYNPVSGK

SEQ ID NO: 695 - DNA, 780 bp, Unknown
  Obtained from environmental sample
  misc_feature (1)..(780): n is a, c, g, or t
atgttcaaattcctatcaaaaatattcccttcaaaacatgagaaggatgtaaaagcacttctgccaatagtggaagaagtaaatgccttttatgaagagtataagaatctgaccgatgatgaactccgtgcaaaaactgctgagttcagggagatcataaggaaaaacacccaggaacacgaagataagatagttgagcttcgctcgaagctgaccaatgacatttctcacgatgagcgcaaagaaatctatgacgagcttgaagtgactgaaaatgaacttgatgatattattgaggatactcttaacgaactgctcccgcaggcatttgcagttataaaggatacgagcagaaggctttgcggtactgagtggactgtagccggacagaaatctaaatgggatatggtaccttttgatgttcagcttatcggcggtatggttctccaccagggtaagatatctgaaatggcaacaggtgaaggtaaaacactggtaggtactctgcctatttacctgaatgcacttccgggcaagggagtacacattattacggtaaatgattaccttgcgaagagggatagtgagtggatgggcgagctattcaagttccacggtttaaccgtcggagttatccttaatgatttagataatgacaaaagacgggatgcttacggctgtgatatagtttacggtacaaataatgagttcggctttgattacctgcgtgataacatggttgggataagaagttcatgggcagcgcggtcaaatagataa

SEQ ID NO: 696 - protein, 259 aa, Unknown
  Obtained from environmental sample
  DOMAIN (1)...(259): SecA DEAD-like domain
  misc_feature (1)..(259): Xaa is any amino acid
MFKFLSKIFPSKHEKDVKALLPIVEEVNAFYEEYKNLTDDELRAKTAEFREIIRKNTQEHEDKIVELRSKLTNDISHDERKEIYDELEVTENELDDIIEDTLNELLPQAFAVIKDTSRRLCGTEWTVAGQKSKWDMVPFDVQLIGGMVLHQGKISEMATGEGKTLVGTLPIYLNALPGKGVHIITVNDYLAKRDSEWMGELFKFHGLTVGVILNDLDNDKRRDAYGCDIVYGTNNEFGFDYLRDNMVGIRSSWAARSNR

SEQ ID NO: 697 - DNA, 336 bp, Unknown
  Obtained from environmental sample
  misc_feature (1)..(336): n is a, c, g, or t
gtgaaatcggcggtgaaatttatcaacgacttcgaaaaaactgctgccgacattgcgattgaaaaccgatatgactacgttatttgtggtcatatccatcaaccggaaatcaagaaaataacaacagaaaagggtgaagtattttatttaaattcgggcgactgggtggagaacctcacggcattggagttcgacgggcataattggagcatttatcgttatgctgacgataagaaggcgcaaaccgtaagacttccgaagcgatttaatgagaaacttgataatgatgagctcttccgtgacctggtgaacgaatttttaacggtaaaaaagtga

SEQ ID NO: 698 - protein, 111 aa, Unknown
  Obtained from environmental sample
  misc_feature (1)..(111): Xaa is any amino acid
MKSAVKFINDFEKTAADIAIENRYDYVICGHIHQPEIKKITTEKGEVFYLNSGDWVENLTALEFDGHNWSIYRYADDKKAQTVRLPKRFNEKLDNDELFRDLVNEFLTVKK

SEQ ID NO: 699 - DNA, 477 bp, Unknown
  Obtained from environmental sample
  misc_feature (1)..(477): n is a, c, g, or t
gtgaagatactttacgcgatccagggaacaggcaacggtcaccttgcccgggcagaagatattattccccaccttcaggaatatggcgacctcgatctttttgtaagcggagcgcaggctgacataaaactatcctatcccgtcaagtataaatcaaaaggactcagtttcttcttcggtaaatccggcggcattgattttctcaggacgtttaaaaacaatagctcgaaagaagtttataaagagatcaagaagtttccggtggagaagtatgaccttgtgatcaatgactttgagccaatatcggcctgggcttgtcataagcgcgagatcccttgtgtttcattgagtcatcaatcggctttgttatctgataaatgtccgaagccgaaaacctttgatcctgtaagtgagtgggtcttgaaaaattatgctccagcgaaagatcatgtgaactttcatttctcgcgtttttga

SEQ ID NO: 700 - protein, 158 aa, Unknown
  Obtained from environmental sample
  misc_feature (1)..(158): Xaa is any amino acid
MKILYAIQGTGNGHLARAEDIIPHLQEYGDLDLFVSGAQADIKLSYPVKYKSKGLSFFFGKSGGIDFLRTFKNNSSKEVYKEIKKFPVEKYDLVINDFEPISAWACHKREIPCVSLSHQSALLSDKCPKPKTFDPVSEWVLKNYAPAKDHVNFHFSRF

SEQ ID NO: 701 - DNA, 333 bp, Unknown
  Obtained from environmental sample
  misc_feature (1)..(333): n is a, c, g, or t
atgaaaagactgacaccggaaatttcaaaaattaatttatacgagcaccttaaaaaaacagatacagataccaagggttcaaccagccgttatgaaacagaatatttcatggaaatacctggtgatagtgatggtgtttgggaagttgacggctccaaatttgttcccaactttgacaaaaaaatgagcaaaatagtaagcgactgcgctgtgttggcccaaaagatagccactaaacaggctggctatttttatgcacaggtaagcgtgttcaaagaaaaaagaccagtggtattattaaacatcataagagaatacaacgattgcaaatag

SEQ ID NO: 702 - protein, 110 aa, Unknown
  Obtained from environmental sample
  misc_feature (1)..(110): Xaa is any amino acid
MKRLTPEISKINLYEHLKKTDTDTKGSTSRYETEYFMEIPGDSDGVWEVDGSKFVPNFDKKMSKIVSDCAVLAQKIATKQAGYFYAQVSVFKEKRPVVLLNIIREYNDCK

SEQ ID NO: 703 - DNA, 561 bp, Unknown
  Obtained from environmental sample
  misc_feature (1)..(561): n is a, c, g, or t
atgctggagtttcgaatggttaattatggttcattagaatcagaatattataagagctttgttaagaatatacaggattatgtagtagaccaaggcgcttatagtgctgaccatcgagcaatattgctaggtaactttttagaaacagatgtcgctgtaaaaatagcatggactgatgcacccccatatgttttcgcaaggttgtttacagtccagttattttcgctggaaaatgcaaagcaggttgtgcagaattttatcgataagtgggaaagaagttgggggcgtgacaagctcgaagcacttcgtaaagatattaactttgagagtttttcaaaaagtaatcaactaaagtataaagtatatatttcagccgaagacgatattgaatctgctaaactcagaagagaaatcaagacggtcattaatacttttgctccagcgcctgatattagtgtaagtagtgatgaaagtttcgatttaaataacattggctggagaacaatccagagttatagcaggtggattctaaagcccttccacaagaaaaataattattct

SEQ ID NO: 704 - protein, 187 aa, Unknown
  Obtained from environmental sample
  misc_feature (1)..(187): Xaa is any amino acid
MLEFRMVNYGSLESEYYKSFVKNIQDYVVDQGAYSADHRAILLGNFLETDVAVKIAWTDAPPYVFARLFTVQLFSLENAKQVVQNFIDKWERSWGRDKLEALRKDINFESFSKSNQLKYKVYISAEDDIESAKLRREIKTVINTFAPAPDISVSSDESFDLNNIGWRTIQSYSRWILKPFHKKNNYS

SEQ ID NO: 705 - DNA, 528 bp, Unknown
  Obtained from environmental sample
  misc_feature (1)..(528): n is a, c, g, or t
ttgtatatgcaggcaaaagttgtcgctaattcgattagcctgcccaataattatttacaactaagccgcggcgcattgcaaggtgtttcaaaagatcttggggtaatagatgctaacagcaatgtagtaggaaccgttattgacatcagtaataattattccgttgtaatgagtttgctacacatgcaaagcagcataagtggcaaattaagaaaaacaggcgaagaaggctctgttgtttgggatggcaagcaacccaacatagttttatttaacggaatatctaagggcgttaaaatggcggtgggagattcagtagtaaccagcggattcactgatagatttccatacggcttactcattggaaccgtcaaggaaattttgctggacaaaaaaactaacaactacattataaaactaaaaacagcggcaaacttttataacattcagtttgcttatgtcatcagtaatctcctgaaagaagagccccaacaattattaaaaagagtccagaagtccaatgagtag

SEQ ID NO: 706 - protein, 175 aa, Unknown
  Obtained from environmental sample
  DOMAIN (9)...(159): rod shape-determining protein MreC
  misc_feature (1)..(175): Xaa is any amino acid
MYMQAKVVANSISLPNNYLQLSRGALQGVSKDLGVIDANSNVVGTVIDISNNYSVVMSLLHMQSSISGKLRKTGEEGSVVWDGKQPNIVLFNGISKGVKMAVGDSVVTSGFTDRFPYGLLIGTVKEILLDKKTNNYIIKLKTAANFYNIQFAYVISNLLKEEPQQLLKRVQKSNE

SEQ ID NO: 707 - DNA, 552 bp, Unknown
  Obtained from environmental sample
  misc_feature (1)..(552): n is a, c, g, or t
ttgatcaacagcagcagaaagagtgaaatgacgcaacaagagtttcaaaaattttcttctacattaccaaaccttccggggatttataaatattatgatgcaacaaaccaattgttgtatgtgggcaaggccaaaaatattcgcaaacgggtcggctcttatttcaacaaaaccctggcgagttataaaacacatgaacttgttaagcggatcaataagatagaattcaccattgtcaattcagagcaggatgcattcctgttggagaattcattgatcaaacaatttcaacccatcttcaacatcaatttaaaggatgataagacctatccttatattgttatcaagaacgagccatttccaagagtttttttaacgcgacaaaaaatagaagatggctcgcagtattttggcccttacacttctgtagggagagtaagggagcttctgaactttatcaaacaaaccatccagttaaggacctgtcctcttaatctcaccgaaaaaaatatcagcaaaggaaaatttaaagtttgtcttgaataccattag

SEQ ID NO: 708 - protein, 183 aa, Unknown
  Obtained from environmental sample
  DOMAIN (25)...(107): GIY-YIG catalytic domain
  misc_feature (1)..(183): Xaa is any amino acid
MINSSRKSEMTQQEFQKFSSTLPNLPGIYKYYDATNQLLYVGKAKNIRKRVGSYFNKTLASYKTHELVKRINKIEFTIVNSEQDAFLLENSLIKQFQPIFNINLKDDKTYPYIVIKNEPFPRVFLTRQKIEDGSQYFGPYTSVGRVRELLNFIKQTIQLRTCPLNLTEKNISKGKFKVCLEYH

SEQ ID NO: 709 - DNA, 330 bp, Unknown
  Obtained from environmental sample
  misc_feature (1)..(330): n is a, c, g, or t
ttgnnnnncccatgtatcagatggttttcagctggatatattgaatatctgagtacaactattaacacaaaatattggcttgagtacttacaaaaagtttggaattcagatgcaatcacgcgtgctgcatatcatgatgattttaaaaaattcaaagattatggtatctctcaaattgatatcatgcatgaaaaagcacaacaagagttatcagtaaccaaaattacaccgattagtatatttaaaagatcaaaatcagcgaatgatattattcaagagtttcatctattagacagaagtacagaagaaaatcgctgcacaattatttag

SEQ ID NO: 710 - protein, 109 aa, Unknown
  Obtained from environmental sample
  misc_feature (1)..(109): Xaa is any amino acid
MXXPCIRWFSAGYIEYLSTTINTKYWLEYLQKVWNSDAITRAAYHDDFKKFKDYGISQIDIMHEKAQQELSVTKITPISIFKRSKSANDIIQEFHLLDRSTEENRCTII

SEQ ID NO: 711 - DNA, 594 bp, Unknown
  Obtained from environmental sample
  misc_feature (1)..(594): n is a, c, g, or t
atgaaaaatcaaattttttcgggatttctcttattattcatagtgaatcaagttgcatatgggcaaaatactctctatgggacgatcaagaaagatttatcttatgcgtatttctataagcaaaaagagaataaatttcccattcaacattattcatatagtgttaatgcttatgatttaaaatatgttggtgatggaagtgagttatatgataaagcggtaattaacgatcttcatcattttagattagaagcttcagccgatttagagttaatttcttttgatcagaaaagtggctattacaaatttaagttaaccatcagcgatccctcacttgattatgaaggtttaaaagcgcctgcttatgatcatggattgacaatgaaaggtggttatcgtttctataaaccagtacaagttaaactactaaatggatctgatcccattttttatatagagggattttataaagatgatttgatatcaaaaaaatccaatccatattttgatattgaatttacttggaaagaaaaaatgaaagatatcaatcttgttcgattaaaagaacttcctatcattgttgtaactaaataa

SEQ ID NO: 712 - protein, 197 aa, Unknown
  Obtained from environmental sample
  SIGNAL (1)...(19)
  misc_feature (1)..(197): Xaa is any amino acid
MKNQIFSGFLLLFIVNQVAYGQNTLYGTIKKDLSYAYFYKQKENKFPIQHYSYSVNAYDLKYVGDGSELYDKAVINDLHHFRLEASADLELISFDQKSGYYKFKLTISDPSLDYEGLKAPAYDHGLTMKGGYRFYKPVQVKLLNGSDPIFYIEGFYKDDLISKKSNPYFDIEFTWKEKMKDINLVRLKELPIIVVTK

SEQ ID NO: 713 - DNA, 810 bp, Unknown
  Obtained from environmental sample
  misc_feature (1)..(810): n is a, c, g, or t
atgtatcagatgagtatattcgaagggatgacaaattacaaaaaagataagaaaattacagaattgcactatggcgttaatcgagttacgagtggatgtttaatagatggtggatatgtatttattgtttatggaataattggaacgccagatgttccactaaaagacttaccgcaaatgtttattgaaagttttaaaaaatttccatttctcgaatttgtaaaaaaacaagattttaatggtggaaaaaattgcgtgattatcgctagaaaaattgcgtctctaggtaaaatgcaaacttcaatgactgaagataataaatttaatatattgcaatgtatcttgttaggacatttttttgattcaaatgggttttctgatttattagcatatagaaaaaattttatttttttaaaaacgatattggaaattgatcagtacaatttacattatgatgataaagatacatcgaataatatggattgtgatcaaaacttaaatacagttgcagaacatcagtatgcattaggtttagcgttgatattatttgccaaagaattcgattcttgtgcggcattaaatttctgttttttattaaaccgtacacaaaaaataaatataatcaattttacttataaattaataaacttagatttaaaacaaaaagcaaatattaattcttttgaaaattccacggacattcctatacctgaaaccactaataatttttcattaactttattttcaaatccaataccagatattgctgcaaatacgcagggcattccactaaaagtttttaagcaataa

SEQ ID NO: 714 - protein, 269 aa, Unknown
  Obtained from environmental sample
  misc_feature (1)..(269): Xaa is any amino acid
MYQMSIFEGMTNYKKDKKITELHYGVNRVTSGCLIDGGYVFIVYGIIGTPDVPLKDLPQMFIESFKKFPFLEFVKKQDFNGGKNCVIIARKIASLGKMQTSMTEDNKFNILQCILLGHFFDSNGFSDLLAYRKNFIFLKTILEIDQYNLHYDDKDTSNNMDCDQNLNTVAEHQYALGLALILFAKEFDSCAALNFCFLLNRTQKINIINFTYKLINLDLKQKANINSFENSTDIPIPETTNNFSLTLFSNPIPDIAANTQGIPLKVFKQ

SEQ ID NO: 715 - DNA, 468 bp, Unknown
  Obtained from environmental sample
  misc_feature (1)..(468): n is a, c, g, or t
ttggacaaagatatgttttataactgcatccgatataatctcaagagtcaaagttcgttaagaaccctgcttggttgcctttgctttctggtggcatttacaatgaattcatgtggaagtaaaaaagaaaatgcaaaggccttgaaaaaaatagagattacggttaccggattagacggaaatggagttgccgaaaaaaaaataacagatgacctgatggtgattaatggggtaaaaaccatttcatttaattatctcaacaaccaggttgttgttttatttgacaccacaaaaacaaatcaatccgtaattgttgatgcaattatcaaatccaatgaaggaaaatacaaggtgttggatgtaaaggagaatacggagccacttcaacccgttgttcctgatgtaaagcccgaccagcaggaggatattcatgatgatgtgggtgaaagagataaaaacagtggttag

SEQ ID NO: 716 - protein, 155 aa, Unknown
  Obtained from environmental sample
  misc_feature (1)..(155): Xaa is any amino acid
MDKDMFYNCIRYNLKSQSSLRTLLGCLCFLVAFTMNSCGSKKENAKALKKIEITVTGLDGNGVAEKKITDDLMVINGVKTISFNYLNNQVVVLFDTTKTNQSVIVDAIIKSNEGKYKVLDVKENTEPLQPVVPDVKPDQQEDIHDDVGERDKNSG

SEQ ID NO: 717 - DNA, 468 bp, Unknown; identical to SEQ ID NO: 715
  Obtained from environmental sample
  misc_feature (1)..(468): n is a, c, g, or t

SEQ ID NO: 718 - protein, 155 aa, Unknown; identical to SEQ ID NO: 716
  Obtained from environmental sample
  misc_feature (1)..(155): Xaa is any amino acid

SEQ ID NO: 719 - DNA, 471 bp, Unknown
  Obtained from environmental sample
  misc_feature (1)..(471): n is a, c, g, or t
atggaggttgtcgatgccaaggagcatatcattcctgtatcttcaatcgaatggagcaaatacacaaatcaatttccatatatcatccgccaacggccgggagacaataatgctttaggtcgagtgaaattcttattcccaaactcttacgacatttatatgcatgatacgcccgacaagtccctgttcggtgaggcaacacgcacatttagtcatggatgtatccgactggaggaaccgtacaagcttgccaggttcttgctaagaaatgattcaagctggactgaggaaaaaattaattccctgatttatgggaacaaacagacgtttgtaaaattgaaaagtaaggttccggtatttattgcatatttcacagcttgggttgaccgggatggaaagcttaatttcagagatgatatttatcatcatgacgaaaaaatgaaacgcattttattttctcatagttattaa

SEQ ID NO: 720 - protein, 156 aa, Unknown
  Obtained from environmental sample
  misc_feature (1)..(156): Xaa is any amino acid
MEVVDAKEHIIPVSSIEWSKYTNQFPYIIRQRPGDNNALGRVKFLFPNSYDIYMHDTPDKSLFGEATRTFSHGCIRLEEPYKLARFLLRNDSSWTEEKINSLIYGNKQTFVKLKSKVPVFIAYFTAWVDRDGKLNFRDDIYHHDEKMKRILFSHSY

SEQ ID NO: 721 - DNA, 909 bp, Unknown
  Obtained from environmental sample
  misc_feature (1)..(909): n is a, c, g, or t
gtggtgagctcgaaactcatacttacaattaacttctttgaatacgcgaaaagaaactggcgtggaataagtgatgatgaattaaaaagggtcggatggttcattgagaggcagccgattaaatatagtgccatgcttgactctattttgaaagacgatcctgataaaatatcatcatatgaacctgtgtatcgacaatatggtttgcttaaaaaatacctgcagaaatatcgtgaactcgaaagtgaagaaggatggccaatatcgtcatcaggcattaaagaacttaggtatggagatacatccaatattatttctgaaataaaaaaacaactttacctgtttgaagatttggaagtaaagaattctacaaatgtattcgacgaggaaatggaatccgcagtgaagatttttcaaaagcgtcacggattaaaggaagatggtataattacaggtacaaccctgactgcgatgtcagtatccgtacatgaacgcatgcagcagatattaatcaacatggagcgttgcaggtgggtaccagctgaacagagaggagattacctggtcgtaaatatcccagcctttaaattgttcgtgtataccaacgatgtgttagattggagttgtaacgtaattgtcggcaaatcaaaagcaactaacaatactataatcttcaatgagaatttagagtacatcgtttttagtccttattggaatattcctaaaaatattttaatcaaagagacgctgaaagaaattaagagggacccggaatacctggggaggcatgatatggaggttgtcgatgccaaggagcatatcattcctgtatcttcaatcgaatggagcaaaatcccaaatccatttttccatatatcatcccgcccaacgggccggaaaaacaaataa

SEQ ID NO: 722 - protein, 302 aa, Unknown
  Obtained from environmental sample
  DOMAIN (101)...(162): Putative peptidoglycan binding domain
  misc_feature (1)..(302): Xaa is any amino acid
MVSSKLILTINFFEYAKRNWRGISDDELKRVGWFIERQPIKYSAMLDSILKDDPDKISSYEPVYRQYGLLKKYLQKYRELESEEGWPISSSGIKELRYGDTSNIISEIKKQLYLFEDLEVKNSTNVFDEEMESAVKIFQKRHGLKEDGIITGTTLTAMSVSVHERMQQILINMERCRWVPAEQRGDYLVVNIPAFKLFVYTNDVLDWSCNVIVGKSKATNNTIIFNENLEYIVFSPYWNIPKNILIKETLKEIKRDPEYLGRHDMEVVDAKEHIIPVSSIEWSKIPNPFFHISSRPTGRKNK

SEQ ID NO: 723 - DNA, 693 bp, Unknown
  Obtained from environmental sample
  misc_feature (1)..(693): n is a, c, g, or t
ttgaatatggtaagagtgtatagcagttatcatttggctaagtggacaaaaaggacagtacagtggggaatgcccatttctatttcatttgaacctactacgtcatgcaatttgcggtgccctgaatgtcccagtggcttgagggctttttcaagaccaaccggcatgctgcaaaaagattttttcagggataccattgatcaactttcgaaagagttgatgtacctggttttttatttccagggagagccatacttgaatcccgattttttaaatatggttcagtacgcggcatctaagaaaatttacacggccacatctaccaatgcgcattatttaaatgatgaaaatgcaaaaaaaacagtggaaagcggtttagaccgtttaattatttctatagacggcactacacaggatgtgtaccagcaataccgcataggaggtaaattatcaaaagtgctggaaggtgcagcaaacatagtaaaatggaaaaaagaattaaaaagcaaaactccatttatcattttccagtttttagtggtgaagcataatgaacaccagattaatgaagtggagcagttggcaaaagaaataggtatagatgaagtaagactaaaaacggcacaggtatatgattatgaaaatgatccaaaccatttgattccaactattgctaaatacagccgctattaa

SEQ ID NO: 724 - protein, 230 aa, Unknown
  Obtained from environmental sample
  DOMAIN (30)...(198): Radical SAM superfamily
  misc_feature (1)..(230): Xaa is any amino acid
MNMVRVYSSYHLAKWTKRTVQWGMPISISFEPTTSCNLRCPECPSGLRAFSRPTGMLQKDFFRDTIDQLSKELMYLVFYFQGEPYLNPDFLNMVQYAASKKIYTATSTNAHYLNDENAKKTVESGLDRLIISIDGTTQDVYQQYRIGGKLSKVLEGAANIVKWKKELKSKTPFIIFQFLVVKHNEHQINEVEQLAKEIGIDEVRLKTAQVYDYENDPNHLIPTIAKYSRY

SEQ ID NO: 725 - DNA, 990 bp, Unknown
  Obtained from environmental sample
  misc_feature (1)..(990): n is a, c, g, or t
atgcatctcatcattgctcaccatcctattgtcttttcaggtctgaagaaacttaatggcaaaaactatgtggagcgtacggtgataaaagcacttaaaaatgatatttcaatttatgcaatccataccaacctggataatgttttagaaggagtgaaccaggaaatttgcaggaggcttgggattaaccaggttaaaatactggttgaaaaatcgtcgacgctcagaaaattggtaacctttgctcctcaccaggaggcggagaaagtgaggactgccctttttgaagctggcgccggcaatattggcaagtacagggaatgtagttataacctggctggaacaggcacctttaaggcaaaaccaggggccaatcctgccattggcgaagtcggtaaaagagagaataatcccgaaacaaggattgaagtcatctatgaaaaatataaggaacaatcaattattaaggcattatgggagaaccattcttatgaagaggttgcctatgattgttacgatcttcagaattttaatcaggaaaaaggctcaggaatgataggcatgctagatcagccaatggacactatggacttcctccatcacttaaagagatcaatgctaactaattgtatcagacacactaagataattaaatctaaagtgcaaaagattgcagtttgcggaggctcaggaagttttcttttaccccaggcaatacaagccggggctgatgtatttattacagctgattataaataccatcagtttttcgatgctgacggaaaaatcataattgccgacattggtcactatgaaagtgaacagtttacccctgtactgattcaccactttttaaaggaaaattttcctacattttgccgtccatttgtcggaaagtcaatacccaatccagttaccttattttcaaaaaaaatccaaatggcttgtaaaaaaaaaggcaaaaagccaaaaaaaaagaaagttagaaag

SEQ ID NO: 726 - protein, 330 aa, Unknown
  Obtained from environmental sample
  DOMAIN (3)...(299): NIF3 (NGG1p interacting factor 3)
  misc_feature (1)..(330): Xaa is any amino acid
MHLIIAHHPIVFSGLKKLNGKNYVERTVIKALKNDISIYAIHTNLDNVLEGVNQEICRRLGINQVKILVEKSSTLRKLVTFAPHQEAEKVRTALFEAGAGNIGKYRECSYNLAGTGTFKAKPGANPAIGEVGKRENNPETRIEVIYEKYKEQSIIKALWENHSYEEVAYDCYDLQNFNQEKGSGMIGMLDQPMDTMDFLHHLKRSMLTNCIRHTKIIKSKVQKIAVCGGSGSFLLPQAIQAGADVFITADYKYHQFFDADGKIIIADIGHYESEQFTPVLIHHFLKENFPTFCRPFVGKSIPNPVTLFSKKIQMACKKKGKKPKKKKVRK

SEQ ID NO: 727 - DNA, 324 bp, Unknown
  Obtained from environmental sample
  misc_feature (1)..(324): n is a, c, g, or t
ttgctgttgacttttatatcctgcaaaagggacaacgataaacttgttaccggtacagttgatatcaaaggcggttgcttcacagattcatggttgattgctattgataaccctaacccggaaaaacattcatttttaaggaaaacaacttttcccacagctaccttgtataattgcagtaacgctgtttttatcacccttcctgcatcattagcgaaacctggcaaaaagatcaggtttacttatgtaaatatgcagggttcatgcctgtcgtattcggaagcgccaaatcatattagcgttaaaaatttatccggtttgtag

SEQ ID NO: 728 - protein, 107 aa, Unknown
  Obtained from environmental sample
  misc_feature (1)..(107): Xaa is any amino acid
MLLTFISCKRDNDKLVTGTVDIKGGCFTDSWLIAIDNPNPEKHSFLRKTTFPTATLYNCSNAVFITLPASLAKPGKKIRFTYVNMQGSCLSYSEAPNHISVKNLSGL

SEQ ID NO: 729 - DNA, 375 bp, Unknown
  Obtained from environmental sample
  misc_feature (1)..(375): n is a, c, g, or t
atgaaggatacgatggtgttgtccaaaaaagtgttggtgcctttaaaaataaatgcacaggaagtacaatggcttgtcgtaggagggggtacaaaggcttttgatgctattacacagttgttaggttattctcataagttttcgataactgttgttgctgaagagatggatgcttctattaaacgtgtagcggaaagacatcactccgtaaaattgatagagagaacatacgaaccaggtgatctttcaaattccaatatgatcatcattgctaccggcaataaaattctggatgagaaaatacatgcagaagcaaagcagcaaaacttattggtattcctcccgtcaactccagacgggattataatttcataa

SEQ ID NO: 730 - protein, 124 aa, Unknown
  Obtained from environmental sample
  misc_feature (1)..(124): Xaa is any amino acid
MKDTMVLSKKVLVPLKINAQEVQWLVVGGGTKAFDAITQLLGYSHKFSITVVAEEMDASIKRVAERHHSVKLIERTYEPGDLSNSNMIIIATGNKILDEKIHAEAKQQNLLVFLPSTPDGIIIS

SEQ ID NO: 731 - DNA, 750 bp, Unknown
  Obtained from environmental sample
  misc_feature (1)..(750): n is a, c, g, or t
atgagcgaaggccagaaaatgaaactcaaaatgatcgagattttattggatgacccgactctgttgcttattgatgaacccacaaatcatttagatatagaagggattctttggtttgaaaaatatataaagcatttgccaaaaaccgttgtaatgatttcccatgaccgagagtttctaaataacacagtagatgaaatttgggaaatcgaaaacaaaaagattatccaattcgttggtaattacgataactaccgtgaagaaaaattaaaactaatcgggaaatggaaccaagagtatatatcatttgtaaaacataaagccaagctggaagatttattagctttaagttacaagcgagggaaaggagttcaggctgctaaaaagcgtatagaaagagaagtcgaagggaaatataaggaaaaatatacagcaaagaaaatgaccggagtaaggtttgatagtgccgtaagtaaacataagctaatgctgcggtttgacacagtatcaaaatcctacggaaagaaggaagtttttaaagatttgtcttttgaagtaagagggaatgaaaaggtttggctttttggcccaaatggtgcaggtaaaacaacaatggtaaaaatgattgttggcgaagaattacctacaaccgggaatgttgaactcggggttaatttaaagataggatattttgctcaaaagcagacgcatttagattcatctaaaaatttacttgaatattttatttga

SEQ ID NO: 732 - protein, 249 aa, Unknown
  Obtained from environmental sample
  misc_feature (1)..(249): Xaa is any amino acid
MSEGQKMKLKMIEILLDDPTLLLIDEPTNHLDIEGILWFEKYIKHLPKTVVMISHDREFLNNTVDEIWEIENKKIIQFVGNYDNYREEKLKLIGKWNQEYISFVKHKAKLEDLLALSYKRGKGVQAAKKRIEREVEGKYKEKYTAKKMTGVRFDSAVSKHKLMLRFDTVSKSYGKKEVFKDLSFEVRGNEKVWLFGPNGAGKTTMVKMIVGEELPTTGNVELGVNLKIGYFAQKQTHLDSSKNLLEYFI

SEQ ID NO: 733 - DNA, 705 bp, Unknown
  Obtained from environmental sample
  misc_feature (1)..(705): n is a, c, g, or t
ttgggtgacggcagggtccattttctttttgattttgtaaaaaacaattaccctgcgcagaaggggggcgtagtgctttctaataaggaagaaggatatccaaaaagtgatggttatacagatcacgggcaggatcataaaggcgttgacagaggtgccgacctgcatccatttcttggttataattttcgtatttctgaattgcatgccgctgtaggcctggcacaaataaaaagagtacacgaatttttagctattcaaaaaagaaatcatacggctttaaaaagaattttagaacagattccgggcatacaatttcgaaagctaccagatcccggtggcgatagctgtacatttttaagttggtttctaccaactgaagagatcacgattaaattggtagaagcgttgaaagcagaaggaatccttgcaggcaatttttattggtataacaataactggcattacatccgtaaatgggagcacctcaaaaattctatctcgttgaaccgtttgtcagaggcacaggaacttgcattgcacaaattaaaggatcaggatttttcagtaagcgataagataatgtctcgatgtatttccactttaattagtcttacatggacagaagaacaagttaaagaaaagggagaaaaaatattaagtgttgcactaaaagtattgtcttcttccggcgtttcaatataa

SEQ ID NO: 734 - protein, 234 aa, Unknown
  Obtained from environmental sample
  misc_feature (1)..(234): Xaa is any amino acid
MGDGRVHFLFDFVKNNYPAQKGGVVLSNKEEGYPKSDGYTDHGQDHKGVDRGADLHPFLGYNFRISELHAAVGLAQIKRVHEFLAIQKRNHTALKRILEQIPGIQFRKLPDPGGDSCTFLSWFLPTEEITIKLVEALKAEGILAGNFYWYNNNWHYIRKWEHLKNSISLNRLSEAQELALHKLKDQDFSVSDKIMSRCISTLISLTWTEEQVKEKGEKILSVALKVLSSSGVSI

SEQ ID NO: 735 - DNA, 447 bp, Unknown
  Obtained from environmental sample
  misc_feature (1)..(447): n is a, c, g, or t
atgaaaatcgtagttatcggaagcggtttcggcggattatcctgcgccattcgcctgcaggcacaagggcacgacgtaaaaatcatcgaaaaacgaaacaaactcggcgggcgcgcgtatgtctacgagcaggacgggtttaagtttgacggcggtccgacgatcattaccgcgccgtggctcattgacgagcttttcacgctcgccggaaaacagaccgccgattacgtcaaactcgttaaaattgatcctttttacaacattcgttgggaagacggaacggtttttaactacaacgacgataagcagaatctctatgcgcagattgccaaaatcaatccgaaggagatcgaatcatacaaaaaattcgccaaatcgcttgatgaaatttaccgcgtcggtttcgaattgattgacaagccgttttcgagcattgcgatatggtaa

SEQ ID NO: 736 - protein, 148 aa, Unknown
  Obtained from environmental sample
  misc_feature (1)..(148): Xaa is any amino acid
MKIVVIGSGFGGLSCAIRLQAQGHDVKIIEKRNKLGGRAYVYEQDGFKFDGGPTIITAPWLIDELFTLAGKQTADYVKLVKIDPFYNIRWEDGTVFNYNDDKQNLYAQIAKINPKEIESYKKFAKSLDEIYRVGFELIDKPFSSIAIW

SEQ ID NO: 737 - DNA, 519 bp, Unknown
  Obtained from environmental sample
  misc_feature (1)..(519): n is a, c, g, or t
atgagcgacaaaataaaatataatcgttggacaaaaatttggttttggacagctttgatttcatcttggttgacctttattattttttttacattgccatttggacttctattttgggttatagcattgataattttgtttgtccgcaagacaaaactaaaatggtatttaatctgcttctccgcttggacattaattccgacacttagtttcttatcaggaacaaaagattatttcacaggacaagggacttttagatatgtaggatatccggaacctgaattttacaaccttgacagacaattcagagcttggaattcaacttctggttgtattgggcttgggttggaacctttaacgcagacaccaaataactgggctattaagtttgggacaaatttgtttggatttcaaaatggggtttataaaggaacatatccggacgaaatggaagcaggaaaaatagttgacagcatgggaaaggaaatcaatttttcaaaaaggggaaaggacatttaa

SEQ ID NO: 738 - protein, 172 aa, Unknown
  Obtained from environmental sample
  misc_feature (1)..(172): Xaa is any amino acid
MSDKIKYNRWTKIWFWTALISSWLTFIIFFTLPFGLLFWVIALIILFVRKTKLKWYLICFSAWTLIPTLSFLSGTKDYFTGQGTFRYVGYPEPEFYNLDRQFRAWNSTSGCIGLGLEPLTQTPNNWAIKFGTNLFGFQNGVYKGTYPDEMEAGKIVDSMGKEINFSKRGKDI

SEQ ID NO: 739 - DNA, 945 bp, Unknown
  Obtained from environmental sample
  misc_feature (1)..(945): n is a, c, g, or t
ttgtgtatggagagagtgtatagcagttatcatttgtctaagtggacaaaaaggacggtacgatggggaatgcccatttctatttcatttgaatctactacgtcatgcaatttgcggtgccctgaatgtcccagcggcttgagggctttttcaagaccaaccggcatgctacaaaaagattttttcagggataccattgatcaactttcgaaagagttgatgtacctggttttttatttccagggagagccatacttgaatcccgattttttaaatatggttcagtacgcagcttctaagaaaatttacacggccacatctaccaatgcgcattatttgaatgatgaaaatgcaaaaaaaacagtggaaagcggtttagcccgtttgattatttccatagacggaactacacaggacgtgtaccagcagtaccgtataggaggaaaattatcaaaagtgctggaaggtgcagcaaacatggtaaaatggaaaaaagaattaaaaagcaaaacaccatttatcattttccagtttttagtggtgaagcataatgaacaccagataaatgacgtggagcagctggcaaaagaaataggtatagacgaagtaagactaaaaacggcacaggtatatgattatgaaaatgatccaaatcatttgattccaactattgctaagtacagccgctatagagtcggtgaaaatggtaaaatgaaatttaagggcaataatgagaatcattgctggcgtctctggcatgatcctgtaattacctgggatggggcggtagtaccttgttgttttgacaaaaatgcacaacaccggctgggggaacttaaaaaaaacaaagcttttaaaaaaattttggaaataaccgaggaaattacaaaccaatttccgcctccaaaaaattttttgccaggggaaaaaaaaaaaaatatttga

SEQ ID NO: 740 - protein, 314 aa, Unknown
  Obtained from environmental sample
  DOMAIN (30)...(198): Radical SAM superfamily
  misc_feature (1)..(314): Xaa is any amino acid
MCMERVYSSYHLSKWTKRTVRWGMPISISFESTTSCNLRCPECPSGLRAFSRPTGMLQKDFFRDTIDQLSKELMYLVFYFQGEPYLNPDFLNMVQYAASKKIYTATSTNAHYLNDENAKKTVESGLARLIISIDGTTQDVYQQYRIGGKLSKVLEGAANMVKWKKELKSKTPFIIFQFLVVKHNEHQINDVEQLAKEIGIDEVRLKTAQVYDYENDPNHLIPTIAKYSRYRVGENGKMKFKGNNENHCWRLWHDPVITWDGAVVPCCFDKNAQHRLGELKKNKAFKKILEITEEITNQFPPPKNFLPGEKKKNI

SEQ ID NO: 741 - DNA, 648 bp, Unknown
  Obtained from environmental sample
  misc_feature (1)..(648): n is a, c, g, or t
gtgaaatatccgggaaaatatccaaggcttgataagtacgagcgtttgtcttcttatataaaaagagcgggcggcctcattgacaatgcaaatcttggaggtgctgtgctgttcaggacaaaaactgaattcttaagagaaaaggtagttgagaagccaaagatagattcgctcaaaggcactcctgtatatgatagtttggccgacatgtataaagcgcttgatgaaccggtgagcatcgatctctacaaagcactaaagtacaagaattcaaagtatgacattgtattacaggagaacgatatggtatttgttccggagattaacccgtttatcacagtgaggggcagggtacaatcgccgctgaagattgcatttgataaggaacatacgaacctcggtttttatctggataaagcaggaggttatgggatcaggccatggaggaaacgggtgttcgtgacctatgcaaatggaagaagtaagaaaacgaaaagtatattcttcattcacttcttccccagaatagaagaaggttcaattattacagtgcctgcaaggccggaaggccaggaaataaatgacctggctaagtcaacattactggcagccgtacccgccagttcttacggccgattcatattttaa

SEQ ID NO: 742 - protein, 215 aa, Unknown
  Obtained from environmental sample
  misc_feature (1)..(215): Xaa is any amino acid
MKYPGKYPRLDKYERLSSYIKRAGGLIDNANLGGAVLFRTKTEFLREKVVEKPKIDSLKGTPVYDSLADMYKALDEPVSIDLYKALKYKNSKYDIVLQENDMVFVPEINPFITVRGRVQSPLKIAFDKEHTNLGFYLDKAGGYGIRPWRKRVFVTYANGRSKKTKSIFFIHFFPRIEEGSIITVPARPEGQEINDLAKSTLLAAVPASSYGRFIF

SEQ ID NO: 743 - DNA, 657 bp, Unknown
  Obtained from environmental sample
  misc_feature (1)..(657): n is a, c, g, or t
atgaagcttattttgaacaataatatttttatggagtttgtgccatttgatgatcaaaattttgatgtggatggcaaaatggttgataaccctgatgcactgatgatacacgaagtggaggaaggaaaagaatatgccttacttataagcacaaatgcgggtgcctggcgatacttaatcggagatacgcttcggtttgttgataaacaaagagcagaagtagtaataacaggaaggaccaaacattttttaagcctggttggagaacatttaagtgtagaaaatatgaacagggccatacaaatagtaagtgaagaattaaatatttccattcctgaatacaccgtaattggtttcccgtatgaaaattattttgcacataaatggtacatagcatgcaatgatgctgttgatgagaaattattaagagataaaattgacaagcatctttgtgaattaaacgatgattatgctgtagaaagagcgagtgccttgaaagaaatctttctgaagaagttgcctgaagaagtatttatgaagttcatggcgcaaaaaggaaaattaggcagccagcataaatttccaagagtattaaaaggaaaaatgttacaggattggaatgaatttttgaaaactcccgcactaagtaatgtctaa

SEQ ID NO: 744 - protein, 218 aa, Unknown
  Obtained from environmental sample
  misc_feature (1)..(218): Xaa is any amino acid
MKLILNNNIFMEFVPFDDQNFDVDGKMVDNPDALMIHEVEEGKEYALLISTNAGAWRYLIGDTLRFVDKQRAEVVITGRTKHFLSLVGEHLSVENMNRAIQIVSEELNISIPEYTVIGFPYENYFAHKWYIACNDAVDEKLLRDKIDKHLCELNDDYAVERASALKEIFLKKLPEEVFMKFMAQKGKLGSQHKFPRVLKGKMLQDWNEFLKTPALSNV

SEQ ID NO: 745 - DNA, 690 bp, Unknown
  Obtained from environmental sample
  misc_feature (1)..(690): n is a, c, g, or t
atgagcgaaagtgtgatcaaggccgacaacgtcgggaaatcctatctgattggccatcaaaccaacgaaaagtacgacacgctgcgggatctcatcgtcgaaaaaaccaaaggagtgctgtcgaaacttcggagaccggagtgtcataccaatcggaatatcgaagaattctgggcgctcaaggatgtctctttcgacgtcaaacaaggcgagaggattgctatcatcggccggaatggcgcgggaaagtctacacttttaaaaattttaagccgtatcaccgagccgacgacgggaagggtctcgattaagggccgagtagccagtttgctcgaggtcggaactggttttcattccgaattgagtggccgcgaaaatatttatctgaacggcgcaattctcggcatgagccgccgggaaatcaaagccaagtttgatgagatcgttgcctttgcggaaatcgaaaaatttctcgatacgccagttaaacggttctcaagtgggatgtatgtccgcttggcttttgccgttgcggcacacctagagcaggaaatcttgattgttgatgaagttctagccgttggggacttggaatttcaaaagaagtgtttaggaaagatgcaggacgttaccagcgaaggcaggacggttttatttgtgagtcacaatatggctgcgtacagcatctga

SEQ ID NO: 746 - protein, 229 aa, Unknown
  Obtained from environmental sample
  DOMAIN (70)...(228): ABC transporter
  misc_feature (1)..(229): Xaa is any amino acid
MSESVIKADNVGKSYLIGHQTNEKYDTLRDLIVEKTKGVLSKLRRPECHTNRNIEEFWALKDVSFDVKQGERIAIIGRNGAGKSTLLKILSRITEPTTGRVSIKGRVASLLEVGTGFHSELSGRENIYLNGAILGMSRREIKAKFDEIVAFAEIEKFLDTPVKRFSSGMYVRLAFAVAAHLEQEILIVDEVLAVGDLEFQKKCLGKMQDVTSEGRTVLFVSHNMAAYSI

SEQ ID NO: 747 - DNA, 330 bp, Unknown
  Obtained from environmental sample
  misc_feature (1)..(330): n is a, c, g, or t
gtgttgtctacttatgagggacaacaaattttagtgcttggtgatttagccgaacttggcaaggatgaaaaagaaatacatgcaagcctcggtaagtacgcacgagaaaaaggtgtggattatttatttacgttgggcaaattgagtagctatgcgagtgacactttcggttcgcaggatgattcgcatcatttcaatgacaaagattcattgattggtcacataaaaaatactctcacacctaacacaacaattttaatcaaaggctctcgcagcgccaaaatggatttggtagtgaatgcactttgttcaacgggagacatccactaa

SEQ ID NO: 748 - protein, 109 aa, Unknown
  Obtained from environmental sample
  misc_feature (1)..(109): Xaa is any amino acid
MLSTYEGQQILVLGDLAELGKDEKEIHASLGKYAREKGVDYLFTLGKLSSYASDTFGSQDDSHHFNDKDSLIGHIKNTLTPNTTILIKGSRSAKMDLVVNALCSTGDIH

SEQ ID NO: 749 - DNA, 459 bp, Unknown
  Obtained from environmental sample
  misc_feature (1)..(459): n is a, c, g, or t
atgattgctacgaaagactggatctacaacacgaatatttatgaagttaatcttcgacagtacaccaaagaaggaacgttcaatgcatttgcacagcatttaccaagactgaaagagatgggggtacaaacgctttggttcatgcctattactcctatttcaaaaaaagaaatgaagggaaccatgggcagctattatgcctgctctgattatgtttccatcaatccggaatttggaacagtgtcggattttaaaaaattggttgattatgcacacaaactggagtttaaggtaatcattgactgggtagcaaatcatacaggctgggatcatgtttggacgaaagaacatcctgattggtacgagaaagactggagaggtgaatttaaaagagcagcaggaatggatgatatcatagagtttgattataccaataagggacatgcgccaaggcaatga

SEQ ID NO: 750 - protein, 152 aa, Unknown
  Obtained from environmental sample
  misc_feature (1)..(152): Xaa is any amino acid
MIATKDWIYNTNIYEVNLRQYTKEGTFNAFAQHLPRLKEMGVQTLWFMPITPISKKEMKGTMGSYYACSDYVSINPEFGTVSDFKKLVDYAHKLEFKVIIDWVANHTGWDHVWTKEHPDWYEKDWRGEFKRAAGMDDIIEFDYTNKGHAPRQ

SEQ ID NO: 751 - DNA, 417 bp, Unknown
  Obtained from environmental sample
  misc_feature (1)..(417): n is a, c, g, or t
ttgtttggcatttgtaatttgcttcctggtaaaagtttgaaaaaatggctctacaagcaacatggaatagatgttctctccaatgatcatgcaggttgcattctcattcgtaaactgctcattgaatgtaaacccaagactggaaaaaaaatcaatggatgcctgcagctctttcacaggaaggttgacatagatctgggaaatcattttttttggcttttaactgttagtgtatttgtatcacaaacatactacagcattcagttcaaccatggtggtcctttaagccaaaggtgtggggcaattacgacagtgcggaaaataatcattgaaaaacttatgctctcaatgggagatatcgaatttcagcgtgatcatgctgacagcaacttatcatcatgctgtgtgtgctggtga

SEQ ID NO: 752 - protein, 138 aa, Unknown
  Obtained from environmental sample
  misc_feature (1)..(138): Xaa is any amino acid
MFGICNLLPGKSLKKWLYKQHGIDVLSNDHAGCILIRKLLIECKPKTGKKINGCLQLFHRKVDIDLGNHFFWLLTVSVFVSQTYYSIQFNHGGPLSQRCGAITTVRKIIIEKLMLSMGDIEFQRDHADSNLSSCCVCW

SEQ ID NO: 753 - DNA, 366 bp, Unknown
  Obtained from environmental sample
  misc_feature (1)..(366): n is a, c, g, or t
ttgtttggcatttgtaatttgcttcctggtaaaagtttgaaaaaatggctctacaagcaacatggaatagatgttctctccaatgatcatgcaggttgcattctcattcgtaaactgctcattgaatgtaaacccaagactggaaaaaaaatcaatggatgcctgcagctctttcacaggaaggttgacatagatctgggaaatcattttttttggcttttaactgttagtgtatttgtatcacaaacatactacagcattcagttcaaccatggtgggtcccttaagccaaaggtgtggggccaattacgaccagtggcgaaaaataatcatttgaaaaaactttattgcctctcaaatgggaag

SEQ ID NO: 754 - protein, 122 aa, Unknown
  Obtained from environmental sample
  misc_feature (1)..(122): Xaa is any amino acid
MFGICNLLPGKSLKKWLYKQHGIDVLSNDHAGCILIRKLLIECKPKTGKKINGCLQLFHRKVDIDLGNHFFWLLTVSVFVSQTYYSIQFNHGGSLKPKVWGQLRPVAKNNHLKKLYCLSNGK

SEQ ID NO: 755 - DNA, 510 bp, Unknown
  Obtained from environmental sample
  misc_feature (1)..(510): n is a, c, g, or t
atgattacggaattcgaatataaagcacaccagctatgtgctgaaaatggaactgtcagcggagcggatctcaatgctctctggacaaacatatctaaagaatacaggagtgaatcagtcgaatattacattgaggactccgctgaatgggcctatattaatcatatttaccttacaaacaactactatacctttaattacgcagtttcaaaggcgataacccttgctctcttcaaacagtacaaggaagacccggagaccttcaacgaaaactatgttgcgtacctctcggcaggttcaacaatgccgcctgaggaaaaactcaaaaaatatttcggaatcgaaatcaacaggcagctctttgaagacgcaatggacgtcgtggagttgaggattcaggaattgaatgaactggaaaaaggcaagaatgggcctaaattcgattcgtccgtggaaagcctgaatatttattcagggtctttctggaatagtgaatttaaaaacaaatga

SEQ ID NO: 756 - protein, 169 aa, Unknown
  Obtained from environmental sample
  misc_feature (1)..(169): Xaa is any amino acid
MITEFEYKAHQLCAENGTVSGADLNALWTNISKEYRSESVEYYIEDSAEWAYINHIYLTNNYYTFNYAVSKAITLALFKQYKEDPETFNENYVAYLSAGSTMPPEEKLKKYFGIEINRQLFEDAMDVVELRIQELNELEKGKNGPKFDSSVESLNIYSGSFWNSEFKNK

SEQ ID NO: 757 - DNA, 498 bp, Unknown
  Obtained from environmental sample
  misc_feature (1)..(498): n is a, c, g, or t
ttgtgcaccttccaactgttggaaggtcaagttatatttatcattgaccttccaacgattggaaggtctatactgtgtttatgtgagggtgcgaaaatgaacatcggacaattagctaagtcatctggagtcaatgccaagttgatccgtcattatgagtcgattggccttatacctaaagctcagcggacggattctggttatagggtctattcagaaacagacattcagtttctgagatttatcaaaagatcaagaaagctgggtttttcaatgaaagagatcaaaaagctcatcaatctttggcgcaataaatcgcgcgctagtaaagatgtcaaaactcttgctttaaatcacatccgcgacttagagaccaagattattgaattagaagatatggtgaagaatcttaaggcgctcgccaaaaactgtcatggcgatcaacgtcctgaatgcccgatcattgaagttttagagtcgggaagtagtcatgcgtaa

SEQ ID NO: 758 - protein, 165 aa, Unknown
  Obtained from environmental sample
  DOMAIN (34)...(71): MerR family regulatory protein
  misc_feature (1)..(165): Xaa is any amino acid
MCTFQLLEGQVIFIIDLPTIGRSILCLCEGAKMNIGQLAKSSGVNAKLIRHYESIGLIPKAQRTDSGYRVYSETDIQFLRFIKRSRKLGFSMKEIKKLINLWRNKSRASKDVKTLALNHIRDLETKIIELEDMVKNLKALAKNCHGDQRPECPIIEVLESGSSHA

SEQ ID NO: 759 - DNA, 477 bp, Unknown
  Obtained from environmental sample
  misc_feature (1)..(477): n is a, c, g, or t
atgaaatttaaacttgccattttcgccctgattttaatttcaataaatttaatctcacccaaccttgtcaatgcccagtccggtaatcaggttacgggaaaagtaacagatgagaatgatgaaccgttagtaggtgctacagttaatgtaaaaggaaccaatgtaagtacgaccacaaatagtgacggcagttactctatcagggttccaaataaacaagctattctcgtattttcttacgtgggattaaccgatcaggagatacaggttaagaacagtaataccattaatacacgattgcttttaaatgcgaaagatatgggagaagtagttgttaccgccttaaaacataaaaagaatccaagaagttnagnngtattcgnntgtgcacttgatgncagtaaagtaatacagtgcaaacacgagtttggtaatgcatatccnngcaggnttcggggtgatgtagtatatgcaatg

SEQ ID NO: 760 - protein, 159 aa, Unknown
  Obtained from environmental sample
  SIGNAL (1)...(19)
  misc_feature (1)..(159): Xaa is any amino acid
MKFKLAIFALILISINLISPNLVNAQSGNQVTGKVTDENDEPLVGATVNVKGTNVSTTTNSDGSYSIRVPNKQAILVFSYVGLTDQEIQVKNSNTINTRLLLNAKDMGEVVVTALKHKKNPRSXXVFXCALDXSKVIQCKHEFGNAYPXRXRGDVVYAM

SEQ ID NO: 761 - DNA, 768 bp, Unknown
  Obtained from environmental sample
  misc_feature (1)..(768): n is a, c, g, or t
gtgaaaaataacgaaataaaagagttttacgagttcggtgaatttcgtctggatgtccaaaaacaccgacttctgaaaaatggtgacctaatccttctgacacctaaagaatttgaagtcttgctgatgttgatttctcacgccggaagagtggtcgaaaaagacgaattgctaaaccaaatctggaaggatacttttgttgaagaaggcaccctgacccggaatgtttcctggctccgaaaaaaactcggcagcaaaagtgaaaaaattattgaaacggttcccaaaatcggctatcggtttttgccctcagttcgcaagatcaatgaaactccttttttaattatcgaggaacaaaccgatcaaaaaattacggttgaggaaacctttatcacaccggaccgggctttaccaacccttcaggctccccgccggttaaagccaaagcccggttacttttgggtgaccgtcgccctgggtttgatagccctcagttccttggcgttattaacctaccgttatgtggtaaagtctgattcgcaacagccaatcgttctttctaaagttgttcctttttcgggtctgcccggtcgtgaaaatatgcctgctttttcgcccgatggtcaacgaattacctttatttgggaaaaggagttgggtaatgcagatatttatgtcaaaattatcgggctgggtgaacctctgcaattgactcacagccccgaaaatgattttttccggccttttcacgggacgcagatcgatcgc

SEQ ID NO: 762 - protein, 256 aa, Unknown
  Obtained from environmental sample
  DOMAIN (187)...(226): WD40-like Beta Propeller Repeat
  misc_feature (1)..(256): Xaa is any amino acid
MKNNEIKEFYEFGEFRLDVQKHRLLKNGDLILLTPKEFEVLLMLISHAGRVVEKDELLNQIWKDTFVEEGTLTRNVSWLRKKLGSKSEKIIETVPKIGYRFLPSVRKINETPFLIIEEQTDQKITVEETFITPDRALPTLQAPRRLKPKPGYFWVTVALGLIALSSLALLTYRYVVKSDSQQPIVLSKVVPFSGLPGRENMPAFSPDGQRITFIWEKELGNADIYVKIIGLGEPLQLTHSPENDFFRPFHGTQIDR

SEQ ID NO: 763 - DNA, 792 bp, Unknown
  Obtained from environmental sample
  misc_feature (1)..(792): n is a, c, g, or t
atgaatttgaagaaatcattatcattatcctatgcacgccgcatcgaccgtccaagctaccgacagctaaatccctttaaagtgtttgtggattcttacacctatgtagttggagatcctacgctgagacctgtaatgaccaatgtttatgagctcaaccaaacaatcaaaggaaaatatattactaccataagctatactaatagcaaacagagcattaccgatatttttgtgcaagacgatatttcaaagatctcttaccaaacgccggccaacatccaagattttgaacaatataaccttggtatttacattccctttaaaattaaaaagtggatgagttccacactttccggatcggtttacagaaatatttatgcgagccctttgcaaggcggtaatctgcagcaaagttttaattcctgggacatgaatttaaacaatgtcttcacgtttggaaacaccggttggtcggcagaactgaacgggtattatcaaagtaaaatggtttggggtttattctacattaaaagcctggcacaggttacagcaggggttcaaaaaacatcaaagaataaaaagtctgtatttaagcttagcgtgagtgatattttccttaccaaccatattgcagtagaggttcaataccaaaaccaggattttgtaacagaacgtacctgggattcgagagttgccactttttcttatacttatcgtttcggaaaaagcaccgttgcaaaatcaaggcagcgttcgagcggcgtggaggatgaaaaacgcagagcgnggtaa

SEQ ID NO: 764 - protein, 263 aa, Unknown
  Obtained from environmental sample
  misc_feature (1)..(263): Xaa is any amino acid
MNLKKSLSLSYARRIDRPSYRQLNPFKVFVDSYTYVVGDPTLRPVMTNVYELNQTIKGKYITTISYTNSKQSITDIFVQDDISKISYQTPANIQDFEQYNLGIYIPFKIKKWMSSTLSGSVYRNIYASPLQGGNLQQSFNSWDMNLNNVFTFGNTGWSAELNGYYQSKMVWGLFYIKSLAQVTAGVQKTSKNKKSVFKLSVSDIFLTNHIAVEVQYQNQDFVTERTWDSRVATFSYTYRFGKSTVAKSRQRSSGVEDEKRRAX

SEQ ID NO: 765 - DNA, 417 bp, Unknown
  Obtained from environmental sample
  misc_feature (1)..(417): n is a, c, g, or t
atgtacatgaaggcagccggatactcaaccgtaccattggcaaaaaagctggggattaaaagcatgtcaactatccgggtcctgaatgcgccggaatattattacgagctttttagtgacttgcccgacgacttaaaagaagtcattaggggcacacagaaggtcgacttcttacactactttacgatgaaccggaactatcttaaaaaagatatccgcaaactaaagtcggctattaagaaagaaggaatcatttgggtatcgtggcccaaaaaggcgtcgggtatcataaccgacatcgatgaaaatttcattcgggagattgcattggaaaacggtctcgtcgacgtgaaagtctgtgccattgacgacatttggtcgggtctcaaactggtgattccggtaaaaagcaggtaa

SEQ ID NO: 766 - protein, 138 aa, Unknown
  Obtained from environmental sample
  misc_feature (1)..(138): Xaa is any amino acid
MYMKAAGYSTVPLAKKLGIKSMSTIRVLNAPEYYYELFSDLPDDLKEVIRGTQKVDFLHYFTMNRNYLKKDIRKLKSAIKKEGIIWVSWPKKASGIITDIDENFIREIALENGLVDVKVCAIDDIWSGLKLVIPVKSR

SEQ ID NO: 767 - DNA, 627 bp, Unknown
  Obtained from environmental sample
  misc_feature (1)..(627): n is a, c, g, or t
atgacaaagttggcagtttcagaaggcatcatctcagaaatggagggctttctaaagaaaaatcgaagagcagatcttatcactacataccttttctttctcgagaagaaacaccgtctcgatcctgttgttttcttgcgcgaaaaaaaaatttaccaaagtaaggatgatttaatccgtattttagaaagtcaggggaaactttggcgcgaaaccgaaattaaaattcaaattgggaagccaagtgttaatgaagcaactcgaaaaatctatatctgcccctttacaggtaaagtttttgctgataacactcatccgaaccctcaagatgctatttatgaatgggttatgaagtgtcctgaaaatactgaacggaaagatgggatgcgtgtaaagaagttttacatttcagaagatcctgaagtgatcaagagttatatncaagaacanaaagagcctctcanaaagattgtatacacatcggtcagtacgggaaaattatttcatagtaagaacgcagtgattgaagatttctcagagaatcaaatcagaccgattccggatgaagatgtccnnaccncaaancggtttgagantcagaagaattttagctttatccagctcatt

SEQ ID NO: 768 - protein, 209 aa, Unknown
  Obtained from environmental sample
  misc_feature (1)..(209): Xaa is any amino acid
MTKLAVSEGIISEMEGFLKKNRRADLITTYLFFLEKKHRLDPVVFLREKKIYQSKDDLIRILESQGKLWRETEIKIQIGKPSVNEATRKIYICPFTGKVFADNTHPNPQDAIYEWVMKCPENTERKDGMRVKKFYISEDPEVIKSYXQEXKEPLXKIVYTSVSTGKLFHSKNAVIEDFSENQIRPIPDEDVXTXXRFEXQKNFSFIQLI

SEQ ID NO: 769 - DNA, 483 bp, Unknown
  Obtained from environmental sample
  misc_feature (1)..(483): n is a, c, g, or t
ttgaagtggattccgaaaagtgttcgtaccctgcttggccatcaacgcttccagaaggaactgaaggtactaaagcgtgtgcccgaaagtattggtttcgaacaagccggtaaaattggaatactttacgatgcaactaacgaacacaattccgaaattgtcaaaaattatgttaagcaggtgcgtagtattgccaaaaaggaagtgcttgcaatggggtttgtaaataaaaataaattgcacagcactcaatatgcccagatgggtcttgactttttctgtacccgtgatcttaatttcaaaatgattccttctaatccaatcgttcgtaattttatcaacgaatcatttgatatactcatcaatattacttctggcaaatgccttcctttaacgtacatcaccgctgtctcaaaggcacgtttcaaagtaggaaggttcaacaacaacaacgttcaatgcctggatgaagatccaaaataa

SEQ ID NO: 770 - protein, 160 aa, Unknown
  Obtained from environmental sample
  misc_feature (1)..(160): Xaa is any amino acid
MKWIPKSVRTLLGHQRFQKELKVLKRVPESIGFEQAGKIGILYDATNEHNSEIVKNYVKQVRSIAKKEVLAMGFVNKNKLHSTQYAQMGLDFFCTRDLNFKMIPSNPIVRNFINESFDILINITSGKCLPLTYITAVSKARFKVGRFNNNNVQCLDEDPK

SEQ ID NO: 771 - DNA, 825 bp, Unknown
  Obtained from environmental sample
  misc_feature (1)..(825): n is a, c, g, or t
atgtgcgataactgcgtacatccacgcgaacgctttgaaggatcagagtttgtgaagattgtgatacaggctgtgaagcaaaccaatgagcgttttggattgaatcaccttgtgcatgtaatccgcggtaccgaagatgagtatgtgaaaagctacggacattttgatctgtcgatttatggagccggtgaaaatgaagatgaggatttttggaaatccgttattcggcaaacgttaattttccaatacttagaaaaggacattgagaatattggtgttctgaaaatatcagcacgcggtgaagcattcctgaaaaaacctcatccggttgaacttgcacgtgatcatgatttcacaaccgatttagtagacgaggaagtttcaacggaaaaagcacctgcgaaagcgtacgatgaacgtcttttcgaaatgttgaaaacacttcggaagcacatggcgaaagaacgcgacttgcctccgtatgtaatttttcaggatccatcgcttgaagaaatggctaccacctatcctaccaccaaggaagaccttgcgcaggtgaatggtgtgggtatgggtaaggtgaataaattcggaaaagagtttttagagcttattgaaaaatacattgatgagaatgacattgagacagcaaccgaaattgttgttaagtcatccgttaataaatcaaaaacaaaaattctcatcatacaacaaatcgatagaaaggtagacttagaagagattgcagaaactgccaaaattagttttaatgaatttgctcacgagattgagaacatcagctactcaggcaccaactcattttga

SEQ ID NO: 772 - protein, 274 aa, Unknown
  Obtained from environmental sample
  DOMAIN (135)...(215): HRDC domain
  misc_feature (1)..(274): Xaa is any amino acid
MCDNCVHPRERFEGSEFVKIVIQAVKQTNERFGLNHLVHVIRGTEDEYVKSYGHFDLSIYGAGENEDEDFWKSVIRQTLIFQYLEKDIENIGVLKISARGEAFLKKPHPVELARDHDFTTDLVDEEVSTEKAPAKAYDERLFEMLKTLRKHMAKERDLPPYVIFQDPSLEEMATTYPTTKEDLAQVNGVGMGKVNKFGKEFLELIEKYIDENDIETATEIVVKSSVNKSKTKILIIQQIDRKVDLEEIAETAKISFNEFAHEIENISYSGTNSF

SEQ ID NO: 773 - DNA, 459 bp, Unknown
  Obtained from environmental sample
  misc_feature (1)..(459): n is a, c, g, or t
gtggcagaagatattgttcattccagctttatcaagctttgggagacccatcaaacgctttccgccaatttatcccctaaatcttatttgtataaaattattgataacagcagtctaaatatgttaaggcatgaaaaggtaaagcaacagcatgctgcctatctgctgaggacaacttcagaagacatctctgaaacaagttttgacagtattgatctaaagcagttaagttcagcgattgattccgccattgcagaattgcctgaacagatgcggatcatctttgaactcagaaaatttgaaggattgaaatacgccgaaatagccagccagctgaatatttctgtaaatacagtggatacacaaatgaaaagggctatgaccaaattgagagataaactgtcaggcttcctcgttttttttattgtgttgattttcaaccttttcttaagaaagtaa

SEQ ID NO: 774 - protein, 152 aa, Unknown
  Obtained from environmental sample
  DOMAIN (83)...(132): Sigma-70, region 4
  misc_feature (1)..(152): Xaa is any amino acid
MAEDIVHSSFIKLWETHQTLSANLSPKSYLYKIIDNSSLNMLRHEKVKQQHAAYLLRTTSEDISETSFDSIDLKQLSSAIDSAIAELPEQMRIIFELRKFEGLKYAEIASQLNISVNTVDTQMKRAMTKLRDKLSGFLVFFIVLIFNLFLRK

SEQ ID NO: 775 - DNA, 855 bp, Unknown
  Obtained from environmental sample
  misc_feature (1)..(855): n is a, c, g, or t
ttgattgacttaggacttgattcgtttattaaagataatgcgggcaccattcatgcgcagctaactgcaacgctaattgaagacttaaaatccctcgagacattaagaacaaaatacttccagccatctttagggattactaagaaggaaaaattgaaggaagagtattttgttgagttggacaaaattgctttagatataaacgaatcgcatgatgaaggtctaaaaaaaatagctcaacgacttaaagaatggaacccttttgatgatagcaaattcagcccgtttttttctcctacctggatgttcggtatcgacaaaggttttgatttaataattggaaacccaccctatataggacaaaaaaacaataacgaaaaattcaaagcggtgaaagaatctcctttaggtcgaaaatttcatcaacgaagaatggattatttctactttttcattcataaaggcctcgatttccttaacgcaaatggctgcttatgtttgataaccacaaattattatttcacagctacctatgcggataaactgaggggcgacattaaatctaggagttctattctaaaaatcatcaattttaatgaactaaaattatttgaaagtgctttaggtcaacataactcaataatactattacgtaaaccgtttgataaaactactattgctaataccacagctgtattaaatgcggatggccttgatttggaaattttgcgagatgttttaaaagggatttattctgaagccgtttactcacagaaagataatgctaaaatttatgattctcagaatggaaatattcagatagatctcacggaatcaagtaatagtgatttctga

SEQ ID NO: 776 - protein, 284 aa, Unknown
  Obtained from environmental sample
  misc_feature (1)..(284): Xaa is any amino acid
MIDLGLDSFIKDNAGTIHAQLTATLIEDLKSLETLRTKYFQPSLGITKKEKLKEEYFVELDKIALDINESHDEGLKKIAQRLKEWNPFDDSKFSPFFSPTWMFGIDKGFDLIIGNPPYIGQKNNNEKFKAVKESPLGRKFHQRRMDYFYFFIHKGLDFLNANGCLCLITTNYYFTATYADKLRGDIKSRSSILKIINFNELKLFESALGQHNSIILLRKPFDKTTIANTTAVLNADGLDLEILRDVLKGIYSEAVYSQKDNAKIYDSQNGNIQIDLTESSNSDF

SEQ ID NO: 777 - DNA, 945 bp, Unknown
  Obtained from environmental sample
  misc_feature (1)..(945): n is a, c, g, or t
atgatatgcataatgggaatatatatggtaaagaaaaatccccngggtttgaaactgcatgcagatgaagtcattaaatcaaagcatcattatcgacccatgaggttaacagacctatcatccatcctgttttttacttgtggagttacaagacaactaaaatttgattctggaactttttatatgcgggctgcttctgctactggcgccctatatccaatagaggtgtaccttgtatgcgacaattttccagacgataaactggatgctggaatatatcattttaatcccggggaatttagtctagttccaattcgatcaggagattatagaaaaattctttcctcctattctggaaacgacgtggaaattctcaaatcccccttatcattaatatttacatctaattcttggagaaattcatggaaatatcaatcccgctcttataggcattggttttgggatttaggtgttatcattgccaacttgctggctgtcatcaagtctatgggattggagactcgcttgaaaatgggttttgtagatgatcaagttaataacttgttaggattacaaacgcatagtgaagcctcattacttattgcttctattcatagtagcgcatttcctaacatgaacaaaagtgatagagattctgatggtaatttctctcctcaatacaaaactactctggaaccattatcacatgaaacatatccactttcatccaaacagacattttatcctgatatatggaaagcatatgatgcttcaaaattgattaataatagagaagttatttcatggtctaaagtacaatcaatcaaaacaacgaaaaaaaatagagaaaaaagtaatgtagggaaattgtacgacctcagaaagggattgttcaatagcgatagtatggatggaaacgcgctggatattggtaaagaatcttga

SEQ ID NO: 778 - protein, 314 aa, Unknown
  Obtained from environmental sample
  misc_feature (1)..(314): Xaa is any amino acid
MICIMGIYMVKKNPXGLKLHADEVIKSKHHYRPMRLTDLSSILFFTCGVTRQLKFDSGTFYMRAASATGALYPIEVYLVCDNFPDDKLDAGIYHFNPGEFSLVPIRSGDYRKILSSYSGNDVEILKSPLSLIFTSNSWRNSWKYQSRSYRHWFWDLGVIIANLLAVIKSMGLETRLKMGFVDDQVNNLLGLQTHSEASLLIASIHSSAFPNMNKSDRDSDGNFSPQYKTTLEPLSHETYPLSSKQTFYPDIWKAYDASKLINNREVISWSKVQSIKTTKKNREKSNVGKLYDLRKGLFNSDSMDGNALDIGKES

SEQ ID NO: 779 - DNA, 300 bp, Unknown
  Obtained from environmental sample
  misc_feature (1)..(300): n is a, c, g, or t
atggcaatggaacaaactgacttagataaatatgtgcttttcccatctctatccacgaaagagaataataattttaaagtaagcgcacccataggtttggaatcgtgcaggaaaatatccgaagagaacgagataaaatacgtggaagtgcgattaatgattgttgacgacgacatcaatttcaacgtatcgatagaaaaagataaatacagtccatacaacatattaaaaataagttacaaatgggtagaatatgatcttgaagaacacgtcgaagagtatagcaccaccgagcactga

SEQ ID NO: 780 - protein, 99 aa, Unknown
  Obtained from environmental sample
  misc_feature (1)..(99): Xaa is any amino acid
MAMEQTDLDKYVLFPSLSTKENNNFKVSAPIGLESCRKISEENEIKYVEVRLMIVDDDINFNVSIEKDKYSPYNILKISYKWVEYDLEEHVEEYSTTEH

SEQ ID NO: 781 - DNA, 300 bp, Unknown
  Obtained from environmental sample
  misc_feature (1)..(300): n is a, c, g, or t
atggcaatggaacaaactgacttagataaatatgtgcttttcccatctctatccaagaaagagaataataattttaaagtaagcgcacccataggtttggaatcgtgcaggaaaataaccgaagaaaacgagataaaatacgtggaagtgcgattaatgattgttgacgacgacatcaatttcaacgtatcgatagaaaaagataaatacagtccatacaacatattaaaaataagttacaaatgggtagaatatgatcttgaagaacatgtcgaagagtatagcaacaacgaacaatga

SEQ ID NO: 782 - protein, 99 aa, Unknown
  Obtained from environmental sample
  misc_feature (1)..(99): Xaa is any amino acid
MAMEQTDLDKYVLFPSLSKKENNNFKVSAPIGLESCRKITEENEIKYVEVRLMIVDDDINFNVSIEKDKYSPYNILKISYKWVEYDLEEHVEEYSNNEQ

SEQ ID NO: 783 - DNA, 789 bp, Unknown
  Obtained from environmental sample
  misc_feature (1)..(789): n is a, c, g, or t
gtgcccgatacagcggtattaaaaaatcttgagcttacataccgggttccggatgatgtttttaaaatatctttttcaaacttgcatatttcgggcattggtatagatgacctgttgtcgaaggataacatatcgcttaaacaggtttctgttgcttctcctgtcatcgaggtctatcataaaaaaaagcggtataacggggacagtataacgctttaccaaaagctttttaagcgcatcaaaagtattgcagttaacgaggtacaggtttcggatgcccggttcatcatccacgatcttacaaagggtaaaaccaaccactttagtaatgtatcgctgaacatccaggatgtgctcatagattcttccacacaatcgggcaaaaaaagattcctttttgcaacacatgcaaaactctccgttaagaatttttctgtacataccccggatagcctgtatacggttaaattccctgctatccatatctctgccccggaagatgaacttatcgcatcgaacgtggagatccgtcccaggatgagcagggagcaattcaaaaaacagtcatcagtaagaaaggagatgtatgaaatttctatacccactatacaattgacgggtataaactggtgggcacttgcaaacgaaggaacgcttatcgcaaacggggcagtgattgataaagccaggtgcagtgtttttctcgaccgttcattaccattccgaaatgtaagacgcgacaattttccgcaccagttgttgatgaggatacctgttcctgttccatga

SEQ ID NO: 784 - protein, 262 aa, Unknown
  Obtained from environmental sample
  misc_feature (1)..(262): Xaa is any amino acid
MPDTAVLKNLELTYRVPDDVFKISFSNLHISGIGIDDLLSKDNISLKQVSVASPVIEVYHKKKRYNGDSITLYQKLFKRIKSIAVNEVQVSDARFIIHDLTKGKTNHFSNVSLNIQDVLIDSSTQSGKKRFLFATHAKLSVKNFSVHTPDSLYTVKFPAIHISAPEDELIASNVEIRPRMSREQFKKQSSVRKEMYEISIPTIQLTGINWWALANEGTLIANGAVIDKARCSVFLDRSLPFRNVRRDNFPHQLLMRIPVPVP

SEQ ID NO: 785 - DNA, 699 bp, Unknown
  Obtained from environmental sample
  misc_feature (1)..(699): n is a, c, g, or t
atgaagtttttaatcataaggttttcttctatcggtgatattgttttaaccacccctgttgtccgttgcctgaaaacgcaattacctctttcggaaattcattacctcatcaagccgaaatttaaaatggtaatggaaccaaatccttacatcgataaaattcatgtgttgcaggacgactggaaaaaaatgatggaggagttgagagcagaaaagtttgattacattatcgaccttcatcacaacctgcgaacccttagagtgaaaaaagatttgaaggtcccttccttctcctttaataaacttaatattcagaagctcatttttacaaaactgaagtggaatgtaatgccaaagcgtttgcacattattgaccgttacatggaaacagtgaagtctttcggtgtggaaaatgatggaaagggcatggattattttattccgaaagaagaggaggtaacagagaaggacattcctcattcgcatcatcttgggtatatctccattgttatcggtgcttcctacttcaccaaaaaattgccggtttataaattgcaggaattgtgtaatgccattgatcacccggttattttattaggagctaaggaagaatttcgggaaggagaattgatcgcttctgttgatccaatanaagtgtacaatgcctgcgggaaaattctctttgcatngaagcgctga

SEQ ID NO: 786 - protein, 232 aa, Unknown
  Obtained from environmental sample
  misc_feature (1)..(232): Xaa is any amino acid
MKFLIIRFSSIGDIVLTTPVVRCLKTQLPLSEIHYLIKPKFKMVMEPNPYIDKIHVLQDDWKKMMEELRAEKFDYIIDLHHNLRTLRVKKDLKVPSFSFNKLNIQKLIFTKLKWNVMPKRLHIIDRYMETVKSFGVENDGKGMDYFIPKEEEVTEKDIPHSHHLGYISIVIGASYFTKKLPVYKLQELCNAIDHPVILLGAKEEFREGELIASVDPIXVYNACGKILFAXKR

SEQ ID NO: 787 - DNA, 816 bp, Unknown
  Obtained from environmental sample
  misc_feature (1)..(816): n is a, c, g, or t
atggtaatggaaccaaatccttacatcgataaaattcatgtgttgcaggacgactggaaaaaaatgatggaggagttgagagcagaaaagtttgattacattatcgaccttcatcacaacctgcgaacccttagagtgaaaaaagatttgaaggtcccttccttctcctttaataaacttaatattcagaagctcatttttacaaaactgaagtggaatgtaatgccaaagcgtttgcacattattgaccgttacatggaaacagtgaagtctttcggtgtggaaaatgatggaaagggcatggattattttattccgaaagaagaggaggtaacagagaaggacattcctcattcgcatcatcttgggtatatctccattgttatcggtgcttcctacttcaccaaaaaattgccggtttataaattgcaggaattgtgtaatgccattgatcacccggttattttattaggagctaaggaagaatttcgggaaggagaattgatcgcttctgttgatccaataaaagtgtacaatgcctgcggaaaattctctttgcatgaaagcgctgaccttgttcgtaaatccaaattggtgattgcgcatgatacaggcctgatgcatattgcagcagctttaaaaaaaccggtgatcgctatttggggaagtaccacgccttcgtttggaatggttccttactacggagaaaattatctggcgcatcatgcccaaccgtatgatgatgtgcaggtgcataaattatggtgcagaccttgtacaaaattggaaggaagcgttgtccgcaaggtcatttaa

SEQ ID NO: 788 - protein, 271 aa, Unknown
  Obtained from environmental sample
  DOMAIN (19)...(270): Glycosyltransferase family 9 (heptosyltransferase)
  misc_feature (1)..(271): Xaa is any amino acid
MVMEPNPYIDKIHVLQDDWKKMMEELRAEKFDYIIDLHHNLRTLRVKKDLKVPSFSFNKLNIQKLIFTKLKWNVMPKRLHIIDRYMETVKSFGVENDGKGMDYFIPKEEEVTEKDIPHSHHLGYISIVIGASYFTKKLPVYKLQELCNAIDHPVILLGAKEEFREGELIASVDPIKVYNACGKFSLHESADLVRKSKLVIAHDTGLMHIAAALKKPVIAIWGSTTPSFGMVPYYGENYLAHHAQPYDDVQVHKLWCRPCTKLEGSVVRKVI

SEQ ID NO: 789 - DNA, 630 bp, Unknown
  Obtained from environmental sample
  misc_feature (1)..(630): n is a, c, g, or t
atgtatgtactgcatccccggcatggcgcgcatcatggcgaaaacgcgcccgttactatcaatgccctgatcgaaatccccgaaggaagtaaatgcaaatacgagattgataaaaaaaccgggctgctgaagctggaccgggtgatctactcatcttttcattacccggtgaattatggctttattctccagacattgggagaagacaatgatccgcttgatgtgttggtgatgtgcagcgagtcggtgcaggcactttgcctggtagaagctacagtcatcggaaatatgcaaatgatcgatagcggtgaaaaagatgacaagatcatcgctgtggctgcaaaagacccttctgttaatcacatcaggaacattaacgaaataccgcctcactttttcgcagtgctgaaaaattatttcgagcagtataaggttcttgaaaataaaaaagtagagatagatgatttccaggataaagaagcggcgtgcacaataatctccgaagcaatctcattttacaaaacaagattcccggcatcatccaacgtaatgaaaaaaacatatggacatccaaagtattatcatcctggtcctgattggcatgttcgcaggcctgctaagtcggaatga

SEQ ID NO: 790 - protein, 209 aa, Unknown
  Obtained from environmental sample
  DOMAIN (21)...(175): Inorganic pyrophosphatase
  misc_feature (1)..(209): Xaa is any amino acid
MYVLHPRHGAHHGENAPVTINALIEIPEGSKCKYEIDKKTGLLKLDRVIYSSFHYPVNYGFILQTLGEDNDPLDVLVMCSESVQALCLVEATVIGNMQMIDSGEKDDKIIAVAAKDPSVNHIRNINEIPPHFFAVLKNYFEQYKVLENKKVEIDDFQDKEAACTIISEAISFYKTRFPASSNVMKKTYGHPKYYHPGPDWHVRRPAKSE

SEQ ID NO: 791 - DNA, 504 bp, Unknown
  Obtained from environmental sample
  misc_feature (1)..(504): n is a, c, g, or t
atgacaaacaatctcaatctatcagctctgatagttaggaaatacaatttgggtgataaaatttatttcaagaatatcttcactcatattgacgaacatgaaattgacaatgcctggaattttgcttctcaaaaaattcagaatagagaaattattaaggatgcaacaaatatagaaaccggagaaaaacttttagctgagcgattgtttgatagttatgataaaaatataaccaagatttactcacatttattgcatgaattgaatgcaaaagaacttaaactaaaagatgagaacgtagaaaggcattttagacatttgctggcaattaaatatatcgaacttcaggttgttgaaacaaaagcgaaaaaaagtaaagttcacagacctttaaaaaaaagaatttctaatttcattgtaaaaaactttgtaataatttgtatagttggtgctgttggatattttataataccaaggacaatagaccgtatgctccggagataa

SEQ ID NO: 792 - protein, 167 aa, Unknown
  Obtained from environmental sample
  misc_feature (1)..(167): Xaa is any amino acid
MTNNLNLSALIVRKYNLGDKIYFKNIFTHIDEHEIDNAWNFASQKIQNREIIKDATNIETGEKLLAERLFDSYDKNITKIYSHLLHELNAKELKLKDENVERHFRHLLAIKYIELQVVETKAKKSKVHRPLKKRISNFIVKNFVIICIVGAVGYFIIPRTIDRMLRR

SEQ ID NO: 793 - DNA, 564 bp, Unknown
  Obtained from environmental sample
  misc_feature (1)..(564): n is a, c, g, or t
atgcaccactatttctacgccattcatttgtttgtaaaccgaagaaaatcgctttcggtttttttggctgcactgatgctttttatttttggattttttgcttctcaaatcaaatttgaagaagacataaccaaacttattccaacgaacgacaaagccgatgttacggcaaaagtcttaaaacagttaaatttcgcagacaaaaccactgtcatttttaaactcgaaaaaaatggttctgaagaggatttaaaagaaatggccaccgctttttcggatagtgtttctaaatcttgcaaaccttacattaccggaattcagggcaaaattgatgaagaaaatattcaggaaacgattgattttgtttacaataatctgccactttttttagatgataaagattatgcttccatcgaaaagaaattgctgaaagacagtattgtcgcaaccgttcagggaaattacaaatctattatttcaccatccggatttgtaacaaaaaatttcattctgcaggatccgcttggaatttcgtttatcgctttaaaaaattacagcagctaa

SEQ ID NO: 794 - protein, 187 aa, Unknown
  Obtained from environmental sample
  misc_feature (1)..(187): Xaa is any amino acid
MHHYFYAIHLFVNRRKSLSVFLAALMLFIFGFFASQIKFEEDITKLIPTNDKADVTAKVLKQLNFADKTTVIFKLEKNGSEEDLKEMATAFSDSVSKSCKPYITGIQGKIDEENIQETIDFVYNNLPLFLDDKDYASIEKKLLKDSIVATVQGNYKSIISPSGFVTKNFILQDPLGISFIALKNYSS

SEQ ID NO: 795 - DNA, 549 bp, Unknown
  Obtained from environmental sample
  misc_feature (1)..(549): n is a, c, g, or t
ttgctaaatgcaaaaatcgcttcacatcctactggtctaacgtggtttgaaaacttaacaaaaggaactccacaacacagttttattgagacgctatcagcatcatccaccgaacaaaagttaacagagctctcaacttttaccccacaacatgaggaacaactgaaaaaaaagctaactgaattagcaaatctcaattccgttttgctccaagctgaaattctagttttgcggagtcaggtttcagaattagattccctaatcgaaaaaattgaaatagcacaagctcttctttcagctgcgaactggcaagtcctcattggactgaacacaaaaatagctgaactcgaaagcaaaacacaaactggaattaaagacatcgttgaacaaaaaggtattaaattttacgaaagtgaagaattcaattcatttattcggactgcagaagattatatcaaaattattgatagccctgaatatccaggagaaaggcgactcttgggtatacgtgtttgcaaccgtttgatacttcagcaaaagaactattga

SEQ ID NO: 796 - protein, 182 aa, Unknown
  Obtained from environmental sample
  misc_feature (1)..(182): Xaa is any amino acid
MLNAKIASHPTGLTWFENLTKGTPQHSFIETLSASSTEQKLTELSTFTPQHEEQLKKKLTELANLNSVLLQAEILVLRSQVSELDSLIEKIEIAQALLSAANWQVLIGLNTKIAELESKTQTGIKDIVEQKGIKFYESEEFNSFIRTAEDYIKIIDSPEYPGERRLLGIRVCNRLILQQKNY

SEQ ID NO: 797 - DNA, 360 bp, Unknown
  Obtained from environmental sample
  misc_feature (1)..(360): n is a, c, g, or t
atgcgcaatacggcctgggagatcgagggcgaaggccggggcaccttgcgctggaacttctacagttcgaacaaggacgccttcatcgacggcaccgagttcacctacgacatccgaaacaagaacacgatcctgatcctacagatcgcgcccaagcgcttctcagaggtgctttggaacacgcgctatttcactctcgtgatgccaggcaatctccagaatctctccgtcagcttcgagcgcaagggatcctcaatgctcgacgcgctcgccgactgcgtcgccaagaacgagaagacctacaagaacttcaagccctcgctcgaaaaaatccccgacgcggtgaaggagaagatttaa

SEQ ID NO: 798 - protein, 119 aa, Unknown
  Obtained from environmental sample
  misc_feature (1)..(119): Xaa is any amino acid
MRNTAWEIEGEGRGTLRWNFYSSNKDAFIDGTEFTYDIRNKNTILILQIAPKRFSEVLWNTRYFTLVMPGNLQNLSVSFERKGSSMLDALADCVAKNEKTYKNFKPSLEKIPDAVKEKI

SEQ ID NO: 799 - DNA, 300 bp, Unknown
  Obtained from environmental sample
  misc_feature (1)..(300): n is a, c, g, or t
ttgctgccaagcccgtggcctcatgctcacaacctctggttctacttttctgatataacagtcaacatttactcagcagagtctgaattcgggatctccatcatatgtggtgaccttgtgtcctaccagtgtatacctatccgatatagctgtacacatgttcagtgtgaaatcttttgtcagaatgctttactgctgtgcttgctatccaggatggtcaatatcggggagtctgtatggcggtcacaacaggcatcagggtttcctgaacaagctgacagattccccgctgttgagtga

SEQ ID NO: 800 - protein, 99 aa, Unknown
  Obtained from environmental sample
  misc_feature (1)..(99): Xaa is any amino acid
MLPSPWPHAHNLWFYFSDITVNIYSAESEFGISIICGDLVSYQCIPIRYSCTHVQCEIFCQNALLLCLLSRMVNIGESVWRSQQASGFPEQADRFPAVE

SEQ ID NO: 801 - DNA, 591 bp, Unknown
  Obtained from environmental sample
  misc_feature (1)..(591): n is a, c, g, or t
gtgatcaacacttttgacgaatgtaaagtattggcgacagcctgcaacgggaaagaactaattcaattgatagagaacgggaagttgccacatattatcctgcttgatctcaatatgccggaaatggacggatatgaaacagcgcattggctttaccaacatcatccgtatgtgaagatcctggttctgacaatgtacgattctgaaatagcgctgatccgcctgctgcaattaggggtgcgagggtttctgaaaaaagatattcacccttcggaactcaggagagctctgttatcagtggcagaggatggttattattattctcaccatactaccggcaagcttggtacattgtttcagaaaaccaacaacaggcattcctctattgaaaaagccatgctgaatgaaacagaaattgcgtttttgaaactcgcaagcactgacctcacttataaagaaattgcgccaaaaatgaatatgacgcctagggccattgacggtttccgcgacaacttgttcgacaaactggatgttaagagcagggttggcatggccatatattctattaaaaatggcctggtggatttttga

SEQ ID NO: 802 - protein, 196 aa, Unknown
  Obtained from environmental sample
  DOMAIN (131)...(188): Bacterial regulatory proteins, luxR family
  misc_feature (1)..(196): Xaa is any amino acid
MINTFDECKVLATACNGKELIQLIENGKLPHIILLDLNMPEMDGYETAHWLYQHHPYVKILVLTMYDSEIALIRLLQLGVRGFLKKDIHPSELRRALLSVAEDGYYYSHHTTGKLGTLFQKTNNRHSSIEKAMLNETEIAFLKLASTDLTYKEIAPKMNMTPRAIDGFRDNLFDKLDVKSRVGMAIYSIKNGLVDF

SEQ ID NO: 803 - DNA, 777 bp, Unknown
  Obtained from environmental sample
  misc_feature (1)..(777): n is a, c, g, or t
ttgtggtatgataataaagctgaagaatttttggatcagaaggttgatgaatataatcaaccttcttttattgagcatgatcctatttgcattccacacctgtttacaaagaaacaggacatcgaaattgcaggtttctttgcttccatttttgcctggggaaaccgaactatcatcattaacaaatcaaaagaattgatgaagttgatggagaatactccttatgattttatcattcatcatagcgaaaaggatttaaagcgactggttcaattcaaacaccgcacatttaatacaaccgaccttttgtatttcattttgtttttgaagcatcattatcaacaatcatcatcacttgaaactgctttttcgaaatggatgggcaaaaaagaaaaaaccattgaaaatgctttgaccggctttcacgaatatttcttttcccttgaagatgcacccgttcgcacaaaaaaacatattgctacaccaacaagaaattctacctgcaaacgactgaatatgtttttacggtggatggtgcggaaggataattgtggagtggattttggaatatggaacacgatctctcccgatcaacttatttgtcccattgatgtgcatgtagcaagagttgccaggcagttcaaattaattcaacgaaaacaaattgactggcaaactgcattggaattgactgatcaactcaaaaaatttgaccggaaagatccggtcaaatatgatttcgcattgtttagcctaggcgtgaacaatgaattttag

SEQ ID NO: 804 - protein, 258 aa, Unknown
  Obtained from environmental sample
  misc_feature (1)..(258): Xaa is any amino acid
MWYDNKAEEFLDQKVDEYNQPSFIEHDPICIPHLFTKKQDIEIAGFFASIFAWGNRTIIINKSKELMKLMENTPYDFIIHHSEKDLKRLVQFKHRTFNTTDLLYFILFLKHHYQQSSSLETAFSKWMGKKEKTIENALTGFHEYFFSLEDAPVRTKKHIATPTRNSTCKRLNMFLRWMVRKDNCGVDFGIWNTISPDQLICPIDVHVARVARQFKLIQRKQIDWQTALELTDQLKKFDRKDPVKYDFALFSLGVNNEF

SEQ ID NO: 805 - DNA, 561 bp, Unknown
  Obtained from environmental sample
  misc_feature (1)..(561): n is a, c, g, or t
atgatagtaaatagtatccctaaaccgtctctggcttattttgtagattcctcccgaaaaataaaatatcttaatgattactttgtggaaatttgcaatcttaaaagctctaatgaaataatcgggttttctccttccgatattatagaaagcagtacactggtacatggtaataataaaactaaggcccttgctgaaaaggtgctcgaaactggagaagctatttataaccttgaaggggcgcttaaatttagaggcgcaaataagaccctttccgtaatatgttccgctgttccggtaagagatgattccgaggttatagttggcagccttacaatcataactgatatgacagaaatcagagaaaaagaaaaacaggtccaggacctttttacttatactgaaatctgtctaaaaaaccttgggcagggtatccgaaaagtaggtgagggagacctggacactcgccttgaaaagatcaaagatgacgagtttgggaaaacctttgacgattttattaaccttgtaaagaactggaatccgttgccgaacaacctctag

SEQ ID NO: 806 - protein, 186 aa, Unknown
  Obtained from environmental sample
  misc_feature (1)..(186): Xaa is any amino acid
MIVNSIPKPSLAYFVDSSRKIKYLNDYFVEICNLKSSNEIIGFSPSDIIESSTLVHGNNKTKALAEKVLETGEAIYNLEGALKFRGANKTLSVICSAVPVRDDSEVIVGSLTIITDMTEIREKEKQVQDLFTYTEICLKNLGQGIRKVGEGDLDTRLEKIKDDEFGKTFDDFINLVKNWNPLPNNL

SEQ ID NO: 807 - DNA, 489 bp, Unknown
  Obtained from environmental sample
  misc_feature (1)..(489): n is a, c, g, or t
atgattaaaatgaaatatgatgatcttgacggtgataggtgggaggcaatctgccaagtttgttttaagctcatgtatgaacaagatagttaccaagaaatcaaagcttctcctggagatcatggaattgagggttttactcgaaaaggtgatgctttccagtgttactgtcccgaaaagcaatatacgcaagatgaattgcacaaaaatatacgagacaagatcacaaaagatttaaagaaacttgtaatttatcagaaggaactgaaatcgaaactcaatggcataaaaatcaagcgctggatatttttaacgcctaattatgaaagaaatcaaataattgaccattgtgcaaaaaaatctcaagaataccgccaattaggattagaaatactcgacaatgagtttgatgttctgatctatgatgttgagtttttaaccaaatacttacccgtcgcattaaattctattggtgaaaagctttcatga

SEQ ID NO: 808 - protein, 162 aa, Unknown
  Obtained from environmental sample
  misc_feature (1)..(162): Xaa is any amino acid
MIKMKYDDLDGDRWEAICQVCFKLMYEQDSYQEIKASPGDHGIEGFTRKGDAFQCYCPEKQYTQDELHKNIRDKITKDLKKLVIYQKELKSKLNGIKIKRWIFLTPNYERNQIIDHCAKKSQEYRQLGLEILDNEFDVLIYDVEFLTKYLPVALNSIGEKLS

SEQ ID NO: 809 - DNA, 513 bp, Unknown
  Obtained from environmental sample
  misc_feature (1)..(513): n is a, c, g, or t
atgactaaacatgttattacaatactgttggcttcttactgttttataccatttgtctttgcccaggataaaattcaggtaattactgaaaccggagaggtaaacaataacagtacaaaaagtttattgagtgttgagtcatccaaaaaagaatccttacatgaagcagaaattaaaataaagagcgcggagctttaccgatattccttcgatcttttgcaaaagagcaaaactttaaaggaagaacgaactttcaacattgtatcatcattcaggcagaacatcaggttcggcggattttgggaccgctacgccatagttaattttacacccgatatgttcattaagccatttgatttccttagcgtttacgctgtacacaattccagctacttcatccccataaaagcggttaaagaacattttaagctcatggcaatccaaagcgccgccatattggttattgataattccgttaaacaccttatgccggccggcaaagatccaagataa

SEQ ID NO: 810 - protein, 170 aa, Unknown
  Obtained from environmental sample
  misc_feature (1)..(170): Xaa is any amino acid
MTKHVITILLASYCFIPFVFAQDKIQVITETGEVNNNSTKSLLSVESSKKESLHEAEIKIKSAELYRYSFDLLQKSKTLKEERTFNIVSSFRQNIRFGGFWDRYAIVNFTPDMFIKPFDFLSVYAVHNSSYFIPIKAVKEHFKLMAIQSAAILVIDNSVKHLMPAGKDPR

SEQ ID NO: 811 - DNA, 873 bp, Unknown
  Obtained from environmental sample
  misc_feature (1)..(873): n is a, c, g, or t
atggcagaaaatataaatgttggcggcataaatgtaggtttaaatcccgaagaaatgaaagggaagaaggtaattgtaataattttcggtacaagacccgagatcttaaaactgtttgttctgtaccgaattctcaagaaatccgatgaattttacccgctgctctataacacagcacagcagaaaatatcaggcgatatactccaaaatattggcattcacccggatctgacctcaactgaaaaaccaaaccgctcaagtgatttgaatgagcttatcgcgcatttgctgggtgacttcaacgagaaattcagcgataaatcgcccgtaacaaaaagcatgctgcatggtataatcgttcagggtgatacagcttccgcgttttcaggcgcgctgtggggcttcctgaaccagataccggtatttcacgcagaggctggtttacgtacttatgacaagatgaatcccttcccggaagaattcatgcgcgaagctgtcgccagaatgacgacaattcattttgctccaaaaggtattaaccgcgataacctgataagagagggcataaagcccgaaaatgtctttgtaattggtaacacaattaacgatgctattttcacgctcataaaagaaaagaagataaaagaacccgcgcagaaaaattatatactaagtactttccaccgaagggaaaactggggttttgtagcggattacgcaagagtgctgaactccgttatggatgaggttcaggggtacacagagatcctgcatttgaagcctccaaatccttggatacaaagagcctttgaagaagtggtggaaggtaacccccatgcaaaattaaagatctggagtcccattcccaattaa

SEQ ID NO: 812 - protein, 290 aa, Unknown
  Obtained from environmental sample
  DOMAIN (43)...(289): UDP-N-acetylglucosamine 2-epimerase
  misc_feature (1)..(290): Xaa is any amino acid
MAENINVGGINVGLNPEEMKGKKVIVIIFGTRPEILKLFVLYRILKKSDEFYPLLYNTAQQKISGDILQNIGIHPDLTSTEKPNRSSDLNELIAHLLGDFNEKFSDKSPVTKSMLHGIIVQGDTASAFSGALWGFLNQIPVFHAEAGLRTYDKMNPFPEEFMREAVARMTTIHFAPKGINRDNLIREGIKPENVFVIGNTINDAIFTLIKEKKIKEPAQKNYILSTFHRRENWGFVADYARVLNSVMDEVQGYTEILHLKPPNPWIQRAFEEVVEGNPHAKLKIWSPIPN

SEQ ID NO: 813 - DNA, 387 bp, Unknown
  Obtained from environmental sample
  misc_feature (1)..(387): n is a, c, g, or t
atgatcggaaagagtgaaattaataaaaaaaaggtcaggataagagttacttctcttgtccttttgacaatacttcttttttccctttgctctctttcaggagctgcaagtaaaaatagtaacgatcaagaactaatgtctcaggtttttgcagcggcagaagccaatcttggaaagattaccccggaaaatacacttattatttctgacattggctctcctgcagagtcttatgtattccttgacagcttttattccaaattttataaagaaaattttctgtataccaagaatctccttataagtccagaatgcaaaaaaatagccccacttttggtttggcttttttcaataagggataaacgggaaaagtgtactttttattaa

SEQ ID NO: 814 - protein, 128 aa, Unknown
  Obtained from environmental sample
  misc_feature (1)..(128): Xaa is any amino acid
MIGKSEINKKKVRIRVTSLVLLTILLFSLCSLSGAASKNSNDQELMSQVFAAAEANLGKITPENTLIISDIGSPAESYVFLDSFYSKFYKENFLYTKNLLISPECKKIAPLLVWLFSIRDKREKCTFY

SEQ ID NO: 815 - DNA, 978 bp, Unknown
  Obtained from environmental sample
  misc_feature (1)..(978): n is a, c, g, or t
atgagattatctgatgaagcaaataatttgtataagagacctatagtaacaaatctttacaaacacgccgatgaattgtttgatagtcattcctatgaaaaaggaggactagtattatacatgcttagtaattttattggtgaagagaaatttaaagaagcgataaagaaatatttagatacatatagaggaagtgttgccacaactggagaatttcaaaaaatttgcgaagatgtttttaaagaagacctacaacaatttttcaaacaatggttatatacagctggtcatcccgaacttgaaatacaattttctttaatccaagaaaaaagttatgaaggaaatcaaattaaaaaaattaaaatcaaaattaagcaggtacaaaaagaggattttgaatttaatttccctctagaagtaagaatagtttgtagtgagaaaaatgatgatgaagacaaaataataatcgatagtattgaaaatattgaaatcaacaaaaaagaaactgactatacatttaaacaagaaatacgagctgatacaacaataattaaatgggtatccattgatcctcatttgaaaattcttaaagaaataaaatcaatttctatagttacccaagatgaaaagtttaatttattagatataataagcaatcaacttgaaagtgatattgcaacaatttcagagaaaattacttccattcagtttttgaaagattgttatagtaaaaaatcaatcgaattgctcaaaaacattattttgaccgagccattttatggtatctctgtagaagctgctaatgttcttggttcatatcatgaccaaaaaaattactcgaaggataatgatgcttacaacgctctagaaaaatgcattacacatgatgattttggaaaatttgctccacaaaacagaagagccataataacaaacctagggttatttgaaagagagaaacacttgaataaaaaatga

SEQ ID NO: 816 - protein, 325 aa, Unknown
  Obtained from environmental sample
  misc_feature (1)..(325): Xaa is any amino acid
MRLSDEANNLYKRPIVTNLYKHADELFDSHSYEKGGLVLYMLSNFIGEEKFKEAIKKYLDTYRGSVATTGEFQKICEDVFKEDLQQFFKQWLYTAGHPELEIQFSLIQEKSYEGNQIKKIKIKIKQVQKEDFEFNFPLEVRIVCSEKNDDEDKIIIDSIENIEINKKETDYTFKQEIRADTTIIKWVSIDPHLKILKEIKSISIVTQDEKFNLLDIISNQLESDIATISEKITSIQFLKDCYSKKSIELLKNIILTEPFYGISVEAANVLGSYHDQKNYSKDNDAYNALEKCITHDDFGKFAPQNRRAIITNLGLFEREKHLNKK

SEQ ID NO: 817 - DNA, 831 bp, Unknown
  Obtained from environmental sample
  misc_feature (1)..(831): n is a, c, g, or t
atgaagttttctgtgggcgatcccgtgtatatcaaaagcaatgacgaagaaggagtgatactagagatcatcgatgccgttaccttcagggtaaggtccggcaagtcaacctaccatgcctttctcgaagacctcgaacatccctacctgcgttggtttctgaataaaaagaaggaacccaaagggaccgtctatatcgatcagttgcggcctgaaaaaccaggcggaaggaaagcggttttacctgatggtgtttacctggttttctttcccatttataaaacagaatcattcgacgaagtgattgacaagatcaagatctggctgtacaacgaaactccgaccctctttcaattcacttacctgtcgcgcaaccgcgaagaacttttctttgagcacgaaggcacactgcacccgaattcggaattttacatacatgacctcgccttcgaaaccatggccaacagcccggtgttcagttttcgttttacagaaacccaggataaagcgaaggaaaccgaaatgcaaatcactctaaaacccaaaaagctatttgaattcatggatggcatccgctacgataataaagccttttttcatatgcggctttttgaagagatcgaactgccgaaagtggaaaaaatagaaacccaatctttgagttttaagccctccagcgcaccccgtaaaggacatttcgattttcagcatgccgtgcagacctctaaatatgagattgacctgcatatcgaaaagcttacaccgaatcataatgcgctcggaccttcagaaaaattgcagatccaatctgatgcgtcggnnnnnttttaa

SEQ ID NO: 818 - protein, 276 aa, Unknown
  Obtained from environmental sample
  misc_feature (1)..(276): Xaa is any amino acid
MKFSVGDPVYIKSNDEEGVILEIIDAVTFRVRSGKSTYHAFLEDLEHPYLRWFLNKKKEPKGTVYIDQLRPEKPGGRKAVLPDGVYLVFFPIYKTESFDEVIDKIKIWLYNETPTLFQFTYLSRNREELFFEHEGTLHPNSEFYIHDLAFETMANSPVFSFRFTETQDKAKETEMQITLKPKKLFEFMDGIRYDNKAFFHMRLFEEIELPKVEKIETQSLSFKPSSAPRKGHFDFQHAVQTSKYEIDLHIEKLTPNHNALGPSEKLQIQSDASXXF

SEQ ID NO: 819 - DNA, 516 bp, Unknown
  Obtained from environmental sample
  misc_feature (1)..(516): n is a, c, g, or t
atgaggatttatttgggtgaccttcctaaaagtaataaaatgatgaaaccaaggtaccaagaaatctctcaatcaaaaattccaacaggaactacagaaaatggtaatgttactgttaaagttatagcaggtgaatccttaggtgcaaaagcagtaattgatacaataactccaattatgtatttgcattttaaattagaacctggttctagaataatacagccagtaccagaagaatacaatgtctttgcttatgtaataaaaggaaaaggcgtgtttcaacaaagtaataataataataaaatagttgaaagaggaaatttggtaatatttgataaagatggcaaaagggtatattttcaagctgttgaagattcagaaatgccatttgaattgttattaattggaggcattcctttaagagaaccaatagcaagatatggaccgtttgtgatgaatactcaacaagaaatctatcaagccatagaagattacagaaatgggaaattaggatag

SEQ ID NO: 820 - protein, 171 aa, Unknown
  Obtained from environmental sample
  DOMAIN (61)...(171): Pirin C-terminal region
  misc_feature (1)..(171): Xaa is any amino acid
MRIYLGDLPKSNKMMKPRYQEISQSKIPTGTTENGNVTVKVIAGESLGAKAVIDTITPIMYLHFKLEPGSRIIQPVPEEYNVFAYVIKGKGVFQQSNNNNKIVERGNLVIFDKDGKRVYFQAVEDSEMPFELLLIGGIPLREPIARYGPFVMNTQQEIYQAIEDYRNGKLG

SEQ ID NO: 821 - DNA, 429 bp, Unknown
  Obtained from environmental sample
  misc_feature (1)..(429): n is a, c, g, or t
atgaaaaagtggaggttttctctgtcgatttttttatttgtatgtgtgacttgtttggcacagcaaagggacgaatccgctattagaaaaatactgagcagtcaaattgaggcctggaataatggacagttaactgagtttatggagggctattggaataacgattctttgatatttatcggtaagtcagatgttacgaaggggtggagtgagaccttagagaggtataaaaaaatttaccctgatactgtctctatgggaaaactgacttttgaaattttgaaaacagagcgtttgtctgaaatttatttttttgtaataggcaaatggcacctcacaagaagtgttggcaatttagagggtcacttttctttacttttcaaaaaaataaataatgagtggtttattatagcagatcatagcagctaa

SEQ ID NO: 822 - protein, 142 aa, Unknown
  Obtained from environmental sample
  SIGNAL (1)...(20)
  misc_feature (1)..(142): Xaa is any amino acid
MKKWRFSLSIFLFVCVTCLAQQRDESAIRKILSSQIEAWNNGQLTEFMEGYWNNDSLIFIGKSDVTKGWSETLERYKKIYPDTVSMGKLTFEILKTERLSEIYFFVIGKWHLTRSVGNLEGHFSLLFKKINNEWFIIADHSS

SEQ ID NO: 823 - DNA, 927 bp, Unknown
  Obtained from environmental sample
  misc_feature (1)..(927): n is a, c, g, or t
ttgataaaaggaaccttgaccccaaaaaaaaaatatttggtgctcccctacgacaccctgagttgggaaaataaagaaaaactcggggttttgaatttaaaaaacatacccgccggggctaatatgatgcaggtagcttatgacattattagtgaagggaaaaaagcacttgttttcgtggatgaatcctatgctactaatttttcccgtctcaatcgttttgtaaggccggtttttgaatcagaaggtagtactgtgtttattctttccaatataactgcgccgcaaaaatttaaaataaaggctaaacatgcaattgacgaaatagccatgacaaatgtggtagggatattacctggaaaaacaaagccaggcgagtatgttattttttctgcacactacgatcatttaggaataggaaagccggaaaacggtgacagtatttataatggagcaaatgatgatgctgcaggtacaacagcagtgatcatgttagccaatcattttaaaaaattaaataacaattcccgcacactggtgtttgccacatttacagcggaagaattaggaggttttggttcacaatatttttcaaaacaatttgatccaaagcaggtggtagccatgtttaatatcgagatgattggaaccgaaagtaagtgggggaaaaattctgcttatataaccggctttgaaaaaaccgatatgggaacaattctccaggaaaatctgaaaggtaccccattcagctttcaccccgatccttatcctgaacaggatttattttaccgttcggataatgcaaccttagcaaggcttggtgttcctgcccataccatttctacatcaaaaatggatagtgaaaaatattatcatcgtgtagatgatgagattgaaacgctggacttgaataatatgcggccataa

SEQ ID NO: 824 - protein, 308 aa, Unknown
  Obtained from environmental sample
  DOMAIN (127)...(204): Peptidase family M20/M25/M40
  misc_feature (1)..(308): Xaa is any amino acid
MIKGTLTPKKKYLVLPYDTLSWENKEKLGVLNLKNIPAGANMMQVAYDIISEGKKALVFVDESYATNFSRLNRFVRPVFESEGSTVFILSNITAPQKFKIKAKHAIDEIAMTNVVGILPGKTKPGEYVIFSAHYDHLGIGKPENGDSIYNGANDDAAGTTAVIMLANHFKKLNNNSRTLVFATFTAEELGGFGSQYFSKQFDPKQVVAMFNIEMIGTESKWGKNSAYITGFEKTDMGTILQENLKGTPFSFHPDPYPEQDLFYRSDNATLARLGVPAHTISTSKMDSEKYYHRVDDEIETLDLNNMRP

SEQ ID NO: 825 - DNA, 783 bp, Unknown
  Obtained from environmental sample
  misc_feature (1)..(783): n is a, c, g, or t
ttgcccgagttggtggatgataatttggtaatggcccaaaacctgctacctaggcacataggtccgctaaccagtggagctcacaaatctgtctcccttcgaacgatatgggagaaaatgacagagattcgggatagcctggagaagaacatttatttggaatcgccagttgttgagcagttcaaaggaaaaacatcaactgaagaaactggaaaaaaattgaatgatatcaactctttacaaagtgagctaatgaacgagcttccaaagcttgataatgagatggccatcctaaaacaaatattcgaggaacttcggggaaaattgctcaaattttttgaaatccaaggcgacaaaaatatctcccaaccttcagcgtcgcagttagcagtcgaaattaatcacatcttgtttagtttagccgatcgtttagagaatgctctgcgtaaacaaaatcggattgggtcttatatctatgaagtaaaaacgtatttggatgaagcaatatccctgttttccacgcttgaaaatactgtcaaagctttaccacataaaagtattccctcttaccaagcacagcatatagattctttactgaaccaacttgatgttgcactaaggcaattaaaggaatttgaaaaggggacaaatacatcctatccaaataataatttcaggaaaaattatattcttaagtgggtcatagagactgttgcaattcttcttcttgcgttatttgttggcttgatcggcttatatttatatgtttatgtattaccttag

SEQ ID NO: 826 - protein, 260 aa, Unknown
  Obtained from environmental sample
  misc_feature (1)..(260): Xaa is any amino acid
MPELVDDNLVMAQNLLPRHIGPLTSGAHKSVSLRTIWEKMTEIRDSLEKNIYLESPVVEQFKGKTSTEETGKKLNDINSLQSELMNELPKLDNEMAILKQIFEELRGKLLKFFEIQGDKNISQPSASQLAVEINHILFSLADRLENALRKQNRIGSYIYEVKTYLDEAISLFSTLENTVKALPHKSIPSYQAQHIDSLLNQLDVALRQLKEFEKGTNTSYPNNNFRKNYILKWVIETVAILLLALFVGLIGLYLYVYVLP

SEQ ID NO: 827 - DNA, 405 bp, Unknown
  Obtained from environmental sample
  misc_feature (1)..(405): n is a, c, g, or t
atgaaaaaattcttttcgctgattatttttctgattttttcgtttgcttcattcgcccagaatgcagacagcacctggtttgtaaacaactacaccaaactggaacaatacattcccatgcgtgatggagtaaaattatttacatccatttatattcccaaagatcagagttcgaaacatccgtttttgatgacacgtacaccgtattcatgcgctccttatggcccggataaatttatggccgtgtggcgttcttataagatggcttatgcaaaagaaaatttcatttttgttacccaggatgtcaggggaagatttatgagtgaaggaacatttgtagatgttaggccattcaataaaaatagaaagaataaagaaattgagaagcaaggatctagaccataa

SEQ ID NO: 828 - protein, 134 aa, Unknown
  Obtained from environmental sample
  SIGNAL (1)...(19)
  misc_feature (1)..(134): Xaa is any amino acid
MKKFFSLIIFLIFSFASFAQNADSTWFVNNYTKLEQYIPMRDGVKLFTSIYIPKDQSSKHPFLMTRTPYSCAPYGPDKFMAVWRSYKMAYAKENFIFVTQDVRGRFMSEGTFVDVRPFNKNRKNKEIEKQGSRP

SEQ ID NO: 829 - DNA, 960 bp, Unknown
  Obtained from environmental sample
  misc_feature (1)..(960): n is a, c, g, or t
atgtcaaatgtcgattacgagcgggggatacttaacaaaatagcaattacacactcaacttttattgtaaccccatgctataatgagaacatcaccgtaatcaaatttttaactgagttagacaaaatcttatctgaagtaaacaatagctttaccgtaatagtagtggatgacgcttctattgataatactttggagcttttaaaaaaattttcctttaattctgcaaatattgtttttaaaataatttcccttagatacaaccttggacatcagggggcaatctatcaaggactgttatatgccagaagtttagaagcaagtaatgtcattgtaatggattccgatggggaggacgatccaaaagctatactggaattaataaaacttcaagataataatattgatatagttcatgtagttcgggcaaaacgaaaagagagacttctatttagagccttttataaattttataaaataatttttcgatttataacgaagaagacaatgaattttggaaattactgcatgatcaaccgaaaaattattgatactgtcactgaaacttcttttatccatttcgcaggatatttatctaaacaaaaagcgaagtcatcaaaaataatctataatcgaagatcaagactggacggcaaatcaaaaatgaatcttgatagcctggttcatcatgcattcaaatctttcatagaatacgcagaggatttattgatgctttttttaaagctatttattcttctagccgcagcaatagtaattttaattggatacatactctatgaaaaaatattcaccaataacgccatcttaggctgggctagtactttatcagcaacattatttaatacagcaatcataagtttaggctttttcgtgttaggaattttgcttttgaatatgatgtcaaaaaatgatataaaangcatacggaaaaaattataa

SEQ ID NO: 830 - protein, 319 aa, Unknown
  Obtained from environmental sample
  DOMAIN (21)...(187): Glycosyl transferase
  misc_feature (1)..(319): Xaa is any amino acid
MSNVDYERGILNKIAITHSTFIVTPCYNENITVIKFLTELDKILSEVNNSFTVIVVDDASIDNTLELLKKFSFNSANIVFKIISLRYNLGHQGAIYQGLLYARSLEASNVIVMDSDGEDDPKAILELIKLQDNNIDIVHVVRAKRKERLLFRAFYKFYKIIFRFITKKTMNFGNYCMINRKIIDTVTETSFIHFAGYLSKQKAKSSKIIYNRRSRLDGKSKMNLDSLVHHAFKSFIEYAEDLLMLFLKLFILLAAAIVILIGYILYEKIFTNNAILGWASTLSATLFNTAIISLGFFVLGILLLNMMSKNDIKXIRKKL

SEQ ID NO: 831 - DNA, 309 bp, Unknown
  Obtained from environmental sample
  misc_feature (1)..(309): n is a, c, g, or t
atggatgttataaagactaatcttggctatgatcaaagtagcattaaagacattgaagaaaaaataagtcagaagtatgattttatctatgatgcttttgaagctgtagccatcaaggcacctgaagtattatctactcttgatctacaaccagaagtgattgaagcactacaactagaaagtaagaagattcacattcctcatattgaagttagtgcagtactggatattactgtaaggaagggagatggtatcgacacaataaagaatattttaggatctgtacatggatccaaaaataattcataa

SEQ ID NO: 832 - protein, 102 aa, Unknown
  Obtained from environmental sample
  DOMAIN (13)...(101): Eukaryotic translation initiation factor 2 alpha subunit
  misc_feature (1)..(102): Xaa is any amino acid
MDVIKTNLGYDQSSIKDIEEKISQKYDFIYDAFEAVAIKAPEVLSTLDLQPEVIEALQLESKKIHIPHIEVSAVLDITVRKGDGIDTIKNILGSVHGSKNNS

SEQ ID NO: 833 - DNA, 567 bp, Unknown
  Obtained from environmental sample
  misc_feature (1)..(567): n is a, c, g, or t
atgaagattaaagaaatcatttcacaccttgaaaatatagctccacctcaataccaggagcattatgacaatgcgggtttgataacaggtcagtcattttgggattgtaaaggtgtattgatttgcctggatgtaactgaagaggttattttagaagcaaatcaaaaaaactgcaacctggttatagctcatcatccaatcatttttaagggattaaaaaagatcaatgggaataactatgttgaaaggatcattatcaacgccattaaaaacgatatagctatatatgctattcatactaaccttgataatataagatcgggggtaagtggaaaaatggccagtttattgaatttacaagatcagcatgttttatctccaaaagaaaatatgctgaaaaagcttttgacttttattccaaaaaaccatgtaattgaagtgaggcaagctttatttgatgcaggggcaggtcatattggcaattattcggattgtaagcctttaattccacggggatttgggaacaatttaaaggccgggttttggggggccaaatcccatttttaa

SEQ ID NO: 834 - protein, 188 aa, Unknown
  Obtained from environmental sample
  DOMAIN (10)...(187): NIF3 (NGG1p interacting factor 3)
  misc_feature (1)..(188): Xaa is any amino acid
MKIKEIISHLENIAPPQYQEHYDNAGLITGQSFWDCKGVLICLDVTEEVILEANQKNCNLVIAHHPIIFKGLKKINGNNYVERIIINAIKNDIAIYAIHTNLDNIRSGVSGKMASLLNLQDQHVLSPKENMLKKLLTFIPKNHVIEVRQALFDAGAGHIGNYSDCKPLIPRGFGNNLKAGFWGAKSHF

SEQ ID NO: 835 - DNA, 315 bp, Unknown
  Obtained from environmental sample
  misc_feature (1)..(315): n is a, c, g, or t
ttgaacacaagcaaccttgtgtgttatggaatcagcacaatattcccggaagtcaaagttgggatgctgacatcacaagtcttgtgtcctgggcggagttttaagaccgcaaacccaaaaagaaattccttgtcttcaacagcgcattctgatcacatcggaaaagcagaccgcgcagacagcgctaagctcactcttcaaaaagtaaaagatattgccggtaaacatccagtgattgttaccggtgatgtcatctctgcaccgtcggacgatccttataaaataatcacaaacactaataattctgtccggtag

SEQ ID NO: 836 - protein, 104 aa, Unknown
  Obtained from environmental sample
  misc_feature (1)..(104): Xaa is any amino acid
MNTSNLVCYGISTIFPEVKVGMLTSQVLCPGRSFKTANPKRNSLSSTAHSDHIGKADRADSAKLTLQKVKDIAGKHPVIVTGDVISAPSDDPYKIITNTNNSVR

SEQ ID NO: 837 - DNA, 666 bp, Unknown
  Obtained from environmental sample
  misc_feature (1)..(666): n is a, c, g, or t
atggcctttaggttttcgccaagtgaagaaaattatctcaaaaccattttccatttacaggtgggtaatgaggcggttacaacaaatgctttagctgaaaaattgcaaacaagacccgcatctgtcacggatatgatgaagaaactaaatgcaaaaaagctgcttcattataaaccttattacggattttacctgagtaccgaagggaaaaaaattgccttgagcattatccgccgccatcgtttatgggaatatttccttgcggaaaaattaaaattctcctggaacgaagtgcatgaagtagcagaagaactggaacatgtaagcagtaaaaagttaattgatacacttgaagaatacctggattttccagagtttgatccacacggcgacccaattccggacagtaagggaaaaatgagatcagttgatgaaatacccttaatagaattgcctttaagccaacccgcagaagtgaggcgtgttgcccatcaatctccggagatgcttgaattattgcaacataaaaatattggcatcggcacccgtctcgaagtaaaaaaacattttgattttgatcactcagttgagataaggatcaaaaccaacacactcaccattagcgaacagcttgctaaaaatatttttgtaacgtatgaattttaa

SEQ ID NO: 838 - protein, 221 aa, Unknown
  Obtained from environmental sample
  DOMAIN (146)...(219): FeoA domain
  misc_feature (1)..(221): Xaa is any amino acid
MAFRFSPSEENYLKTIFHLQVGNEAVTTNALAEKLQTRPASVTDMMKKLNAKKLLHYKPYYGFYLSTEGKKIALSIIRRHRLWEYFLAEKLKFSWNEVHEVAEELEHVSSKKLIDTLEEYLDFPEFDPHGDPIPDSKGKMRSVDEIPLIELPLSQPAEVRRVAHQSPEMLELLQHKNIGIGTRLEVKKHFDFDHSVEIRIKTNTLTISEQLAKNIFVTYEF

SEQ ID NO: 839 - DNA, 696 bp, Unknown
  Obtained from environmental sample
  misc_feature (1)..(696): n is a, c, g, or t
atgtatgcagatttgcaagaatgtttttctgctaaaaacggattagtattttccaaccgatttgatgagtttattgcagtgacaaatcaaataagcttacacgatcataaagaaatccatgacagactttcgaaaaaaaatgaaggcataaagatatcaatgacgataggaactggaaaaactccactagaagctgacaaggcaatacaagacataaaaagggatacaaaaaacatgatttttccaaatatttatggtctacaagaaaattgcaatgtaaatgagggccaacaaattaatgaactagaaaatcatagtaaccaaaatgacgtgaaaatattacatatagacgtcaatggttctacctcaatagcaaaaaatctttcaacctatgaaatcacaaatttaatagtaaggttatatctagcaatatcaaattcattcctcaaagaagaaagtttaactttctttttgggtggagataatttcatgattgttgcaaaaaacaatattcaaataaaaaaagtaatagaaatagttaattttttaacaagttcgactggaattaagcttaattgtggtgtaggaaatggcattaacgcaagaagtgctgcagaaatggcaaccaaatcactggattcaataagagcctacagaaaaagcggaaaaataataaatgtttttgaatcgaattga

SEQ ID NO: 840 - protein, 231 aa, Unknown
  Obtained from environmental sample
  DOMAIN (1)...(229): GGDN family
  misc_feature (1)..(231): Xaa is any amino acid
MYADLQECFSAKNGLVFSNRFDEFIAVTNQISLHDHKEIHDRLSKKNEGIKISMTIGTGKTPLEADKAIQDIKRDTKNMIFPNIYGLQENCNVNEGQQINELENHSNQNDVKILHIDVNGSTSIAKNLSTYEITNLIVRLYLAISNSFLKEESLTFFLGGDNFMIVAKNNIQIKKVIEIVNFLTSSTGIKLNCGVGNGINARSAAEMATKSLDSIRAYRKSGKIINVFESN

SEQ ID NO: 841 - DNA, 642 bp, Unknown
  Obtained from environmental sample
  misc_feature (1)..(642): n is a, c, g, or t
ttgcttttcaaaaagccaccaggaaggcggtcgcttttccgcggctttcaatccgaatttgttgatcgcattggtttgaatatgtttaacggcttcttcgatggaatctgtaaacaggcaaagttcaagatcgcttgcggaaatcgttccacgttctttcatacgctcaatatgttcaataatgtctttgtgataagcaacatcaaaaacaatgattggaaattcactgagcatttttgtctggatgagcgtgagcgcctcgaaatattcatccaaagttccaaagccaccgggcatcaccacaaaaacataggaatatttcaggagcagtgttttacgaacaaagaaatatttgatgtttacccatttatccatgtaagcattctggtgttgctcatgcggcaacacgatattgcaacctacgctcctgccgccaacttcacgggcaccacggtttgcggcttccatcacacccgggccaccgcctgtcataattgtaaacccaagcctggctatctcagccgaaagtttgcgtgtttgttcataggttgcatcgtcttccttgaaccttgcggaaccaaaaacagttacgcacggaccaacaaaatggagcgttcgaaatcctttaataaattcaattaa

SEQ ID NO: 842 - protein, 213 aa, Unknown
  Obtained from environmental sample
  misc_feature (1)..(213): Xaa is any amino acid
MLFKKPPGRRSLFRGFQSEFVDRIGLNMFNGFFDGICKQAKFKIACGNRSTFFHTLNMFNNVFVISNIKNNDWKFTEHFCLDERERLEIFIQSSKATGHHHKNIGIFQEQCFTNKEIFDVYPFIHVSILVLLMRQHDIATYAPAANFTGTTVCGFHHTRATACHNCKPKPGYLSRKFACLFIGCIVFLEPCGTKNSYARTNKMERSKSFNKFN

SEQ ID NO: 843 - DNA, 642 bp, Unknown; identical to SEQ ID NO: 841
  Obtained from environmental sample
  misc_feature (1)..(642): n is a, c, g, or t

SEQ ID NO: 844 - protein, 213 aa, Unknown; identical to SEQ ID NO: 842
  Obtained from environmental sample
  misc_feature (1)..(213): Xaa is any amino acid

SEQ ID NO: 845 - DNA, 960 bp, Unknown
  Obtained from environmental sample
  misc_feature (1)..(960): n is a, c, g, or t
ttggaacttccaaaccaggcgaagtttcatccgctaaaatatttatcaaaactatctgatgttttacataaaaacggcgtagaaatatttgaagaaaccttaattaataaaattgatgcaaacgaaaatggagtaattgtaactgcagaaaatgaaaatactataactgccgattatgcagtaatggcgacacatattacacttggaggtcctcttttagttcaaaccgaactagtaccttacaacacatatgttatttgtgtggaaattcaaaataaaactttatctgaaaatttatattgggatacaaacaatccatataattatattcgcgttgataaatccgaaaacggaaatacaatattaattctaggcggagctgatcataaaaccggagaagaaataaataatgctgatgaaaaatataaccaactcgaaaattatttgagaaatatactcccagatgcaaaatataaaattttacttaaatggagcggacaagttattgagtcaatcgacggtcttccatatattggatttttacccgaaaagaaaaataccctaattgcaaccgggttcgccggagccggcatgacattgggaactatttccgcacaaattattaccgacttaataaatcaaaaagaaaatggattaacaaatttatatccggtaacgagagttaagggtgtaaacaattttataaaaaagaattcggaagtacttaaacaatattacagaaaatattttggaaaattcgaaaagatggatgcatacaacctcgaaccaaaccaaggaaaagtttgtgaacaaaacggcaaaaaaatcgccgtttataaatcgccagatggaaaagtaactaaattatctgctgtgtgtacacacatggaatgcatcgtgaaattggaacgacgaccaaaaatcctgggactgccccttgccacggaagtagattcctaa

SEQ ID NO: 846 - protein, 319 aa, Unknown
  Obtained from environmental sample
  misc_feature (1)..(319): Xaa is any amino acid
MELPNQAKFHPLKYLSKLSDVLHKNGVEIFEETLINKIDANENGVIVTAENENTITADYAVMATHITLGGPLLVQTELVPYNTYVICVEIQNKTLSENLYWDTNNPYNYIRVDKSENGNTILILGGADHKTGEEINNADEKYNQLENYLRNILPDAKYKILLKWSGQVIESIDGLPYIGFLPEKKNTLIATGFAGAGMTLGTISAQIITDLINQKENGLTNLYPVTRVKGVNNFIKKNSEVLKQYYRKYFGKFEKMDAYNLEPNQGKVCEQNGKKIAVYKSPDGKVTKLSAVCTHMECIVKLERRPKILGLPLATEVDS

SEQ ID NO: 847 - DNA, 432 bp, Unknown
  Obtained from environmental sample
  misc_feature (1)..(432): n is a, c, g, or t
atgaagaagaacaacctgattgccaaagcgactaccacgatcagcgccctgcgcagtgacatatgggatgcgttgaccacaccggagtcgatcaagcagtacatgttcggtaccgatgtcacgtcgaagttctatgagggcagcccgatcgtctggcgcggcgagtggcagggaaaggtctatgaagataagggcaagatcatgaaagtcgatccgggccgcgtcttccagttcagtcactacagcccgctgtcgggcctgccggaccggcccgacaattatcacatcgtgaccatcgagctgatcgacaagggtggcgaggtgaaagtcgtgctcacacaggacaagaacctgaccgaagaagcacggcagcattccgagaagaactggcaattggtgctggacgcactgaagcaactggtcgaagggtga

SEQ ID NO: 848 - protein, 143 aa, Unknown
  Obtained from environmental sample
  misc_feature (1)..(143): Xaa is any amino acid
MKKNNLIAKATTTISALRSDIWDALTTPESIKQYMFGTDVTSKFYEGSPIVWRGEWQGKVYEDKGKIMKVDPGRVFQFSHYSPLSGLPDRPDNYHIVTIELIDKGGEVKVVLTQDKNLTEEARQHSEKNWQLVLDALKQLVEG

SEQ ID NO: 849 - DNA, 723 bp, Unknown
  Obtained from environmental sample
  misc_feature (1)..(723): n is a, c, g, or t
atgataaggatccagagagttaacccaaaattacgcacaaatggcgtgatgctcggtaaaataatttgtgataataagaaaatagattttagaaatcctgatttggagaatttggtatctcaagtttctacaaagaatatagaaatttattctaatgatataaaaaacaaaaaacaaaaaacgattattttaattgattgtggcgcaaaacaaaatattattagaaggttgttacttagaaatttaagagttgtggtagtaccttgggataccgatgttactaagttagatttttcatttattggagttgttatttcgaatggtccaggtaatccagtaaaagtaggtaaaaccatttctaatgtaaaaaaaataattgcgaagcgtatacctatattaggtatttgtttaggtaatcaaatattggctttagcttcaggagggcagacttataaattaaaatttggacatagaagccaaaaccaaccttgtgtacagagtgggacaaagaaggggtatcttaccactcaaaaccatggttttgctgtcggtaaaataccaaaaggttttaaggagtggttttataatgctaatgataaaactaacgaaggcataattcatcaaaatttacccttcatgtctgtgcaatttcatccagagagttcacctggaccactcgatacagattggatatttgattattttttgaaaaagataaaataa

SEQ ID NO: 850 - protein, 240 aa, Unknown
  Obtained from environmental sample
  DOMAIN (63)...(238): Glutamine amidotransferase class-I
  misc_feature (1)..(240): Xaa is any amino acid
MIRIQRVNPKLRTNGVMLGKIICDNKKIDFRNPDLENLVSQVSTKNIEIYSNDIKNKKQKTIILIDCGAKQNIIRRLLLRNLRVVVVPWDTDVTKLDFSFIGVVISNGPGNPVKVGKTISNVKKIIAKRIPILGICLGNQILALASGGQTYKLKFGHRSQNQPCVQSGTKKGYLTTQNHGFAVGKIPKGFKEWFYNANDKTNEGIIHQNLPFMSVQFHPESSPGPLDTDWIFDYFLKKIK

SEQ ID NO: 851 - DNA, 510 bp, Unknown
  Obtained from environmental sample
  misc_feature (1)..(510): n is a, c, g, or t
atgcaaggtttggccgcagttggtattggcactgatcccacaaatggattaaaagtctccggaaatgggacatttacaggaacagtaacagcaagttgcggagtattatcgtgctcagacatacgctacaagacaaatattcaacatctcacaaattcattatctcatgtgatgtcacttcggggagtttattattattgggacaaagagaaattttccggcaaagactttgataataagcggcaaattgggatcattgctcaggaacttgaaaaagcttatcctgaattagtccatacggacgaagatggatataaaacggttgactacacccgcctttcccctgtgttgctcgaagcgatcaaagaacaacaggtaatgattaattcgcaggaagaaaaaataaacacacaatccgctcaacttaaatcacaacaggagcaaattgattttttgatgaaagagcttatgagcattaaggggcaattgactgcagaggcaaagccgtga

SEQ ID NO: 852 - protein, 169 aa, Unknown
  Obtained from environmental sample
  misc_feature (1)..(169): Xaa is any amino acid
MQGLAAVGIGTDPTNGLKVSGNGTFTGTVTASCGVLSCSDIRYKTNIQHLTNSLSHVMSLRGVYYYWDKEKFSGKDFDNKRQIGIIAQELEKAYPELVHTDEDGYKTVDYTRLSPVLLEAIKEQQVMINSQEEKINTQSAQLKSQQEQIDFLMKELMSIKGQLTAEAKP

SEQ ID NO: 853 - DNA, 630 bp, Unknown
  Obtained from environmental sample
  misc_feature (1)..(630): n is a, c, g, or t
atggtaaaagttctgatatatgacgatcacacacagcgttgcgaaagcttaaaagcgctgatctcctgtacagacgacatggtatgtgttgggacatttaatcattgcagaaatgcattggaagaagttcgggatctggggccgcatgtcattctcatggacattgccatgcccggcgaagacggcataagcggagtaagaaagattaaaaatgaatttccagatgttcggatcatcatgcagactgtatttgaagatgatgcaaagatatttgcaagtcttcaggcaggcgcggagggttatattttaaaaaataccagtccggaaaagatcctttcaagcattcgtgaagtttcacagggcggagcatccatgaccccatcagttgcactccgggttatgaaatttttcaatgaaccgaaacacagtattcctcagtataatcttaccaacaaggaaaaagaagttcttgggctactcgctgaaggaaacagctataagatgatcgcctccaaaatggggctcagctatttcacagtcaacacccacgtgagaaatatctatgaaaagcttcatgtgcattgtgtaggagaggcagtatctctcgctttgaagaataagataatctaa

SEQ ID NO: 854 - protein, 209 aa, Unknown
  Obtained from environmental sample
  DOMAIN (146)...(203): Bacterial regulatory proteins, luxR family
  misc_feature (1)..(209): Xaa is any amino acid
MVKVLIYDDHTQRCESLKALISCTDDMVCVGTFNHCRNALEEVRDLGPHVILMDIAMPGEDGISGVRKIKNEFPDVRIIMQTVFEDDAKIFASLQAGAEGYILKNTSPEKILSSIREVSQGGASMTPSVALRVMKFFNEPKHSIPQYNLTNKEKEVLGLLAEGNSYKMIASKMGLSYFTVNTHVRNIYEKLHVHCVGEAVSLALKNKII

SEQ ID NO: 855 - DNA, 597 bp, Unknown
  Obtained from environmental sample
  misc_feature (1)..(597): n is a, c, g, or t
gtgaaagatacaaaatggaatgactttttggagctgaatagattggtatttatagatcaaactccaaaaaatatagagtcaagggcccttgcaattagttttaatctaattcgaaaacattaccccaacataaaatggattctaagttttgcggatgcctgccaatgcggtagcggaacaatatacagggctagtgggtttcacttaactgccattaagaaaaactcatccttaattgcttttgaaaatggtaaggttttgcataaaaaagtttacactagcggtcattatggatcggaaagaaatggctttttaaaaagtggattcgcaacctggcaagaatatgccgaaaaaaaatatggaaaaataaggacactagaaggttatcagatacgatatataaaattgctttacgacgacattaagttaaattgccagtcaataccatactccgaactagacaaactgacatttcccaaaggtgttagacataccaaacgcgcatcaagcaaagataacgttgcgactgagttccactcagtagagggcggtgtaagtccgaccgatgcgctccattcagaggtggagaatggctag

SEQ ID NO: 856 - protein, 198 aa, Unknown
  Obtained from environmental sample
  misc_feature (1)..(198): Xaa is any amino acid
MKDTKWNDFLELNRLVFIDQTPKNIESRALAISFNLIRKHYPNIKWILSFADACQCGSGTIYRASGFHLTAIKKNSSLIAFENGKVLHKKVYTSGHYGSERNGFLKSGFATWQEYAEKKYGKIRTLEGYQIRYIKLLYDDIKLNCQSIPYSELDKLTFPKGVRHTKRASSKDNVATEFHSVEGGVSPTDALHSEVENG

SEQ ID NO: 857 - DNA, 783 bp, Unknown
  Obtained from environmental sample
  misc_feature (1)..(783): n is a, c, g, or t
atgcaggcccagcaggacatcaggcagtttaggggcgctgtttttgttgtcacacaggataaagtattgttgcgaaaaggttatggtttggctgatatggaatggaatatttcacacacccctgactcaaagtgttgcataggatcaattaccaaacagtttactgctgcttccattttacagctggtggaggaaggcaaactcagcctggatgataagctcagtaaattttacccggactttcccaatggggataaggttacgattcacatgctgctgagccatacctcagggataccgagctatacaagccagaaggactttaattcggtgggaggacaatctttttctcttgactcgatgatcggattttttaagaacaggccttatgatttttctcccggaacgaactggctttataacaattcgggttattttttacttggtgccatcattgaaaaactaagcaatatgagctacacccactatttgcgaaaaaatattttcgacaaactgggtatgcagcaatcaggacttgtccagcttgatactattttatcgaacagggcacggggttatgaaaggaaaggaaaaaactttatcaatgcagagtttatttccatggaatggccttttagtgcaggagccatttattctacgatagatgatctctataaatgggaccgggcatcatatggtgaatgcggtctattaaaaattattcgtaagaaaaaatataaactcccgtcgcgtatcatgttatgggacaaaataaccagataa

SEQ ID NO: 858 - protein, 260 aa, Unknown
  Obtained from environmental sample
  DOMAIN (3)...(260): Beta-lactamase
  misc_feature (1)..(260): Xaa is any amino acid
MQAQQDIRQFRGAVFVVTQDKVLLRKGYGLADMEWNISHTPDSKCCIGSITKQFTAASILQLVEEGKLSLDDKLSKFYPDFPNGDKVTIHMLLSHTSGIPSYTSQKDFNSVGGQSFSLDSMIGFFKNRPYDFSPGTNWLYNNSGYFLLGAIIEKLSNMSYTHYLRKNIFDKLGMQQSGLVQLDTILSNRARGYERKGKNFINAEFISMEWPFSAGAIYSTIDDLYKWDRASYGECGLLKIIRKKKYKLPSRIMLWDKITR

SEQ ID NO: 859 - DNA, 663 bp, Unknown
  Obtained from environmental sample
  misc_feature (1)..(663): n is a, c, g, or t
atggctgaaaggaattttttaacggtttgtatgaaaataattttcattttactattactgctcaccgttagtctccattcatttggccaggcatccacctataaggccgcggcaaaatatttcagggtaaatccgcttgacaggaaattcagtgtttttttaaatcaggtgatgacggatacagtctttgtaacagacgaaataaaaaaaagaactgacagttcattgttttacctgagaggtcattataataatttcaacccgtttctttttaaagccgccatcgttcaactaaccctttccgaggtaggtatgcaaattgatacagtaaaagtggatactgtaatcatctgccagatcactgccgtcacatctggcaatagcacggcaagccaggcagccgaagcaaagacccagtatgaattttttaaaagaaaatatggaaaggattatctcaccagtaacaaagaagatgttattgaaagcaacgaaaaagtaggagaagtaattgattattatcacagctatcccttgcatatgccggtacttacttcctattacagtaaggtaataaacagggataattatgcattttccattctgctgcgacttaagataaaagaaaacattccgactttaccagtagcgccggatggtttttaa

SEQ ID NO: 860 - protein, 220 aa, Unknown
  Obtained from environmental sample
  misc_feature (1)..(220): Xaa is any amino acid
MAERNFLTVCMKIIFILLLLLTVSLHSFGQASTYKAAAKYFRVNPLDRKFSVFLNQVMTDTVFVTDEIKKRTDSSLFYLRGHYNNFNPFLFKAAIVQLTLSEVGMQIDTVKVDTVIICQITAVTSGNSTASQAAEAKTQYEFFKRKYGKDYLTSNKEDVIESNEKVGEVIDYYHSYPLHMPVLTSYYSKVINRDNYAFSILLRLKIKENIPTLPVAPDGF

SEQ ID NO: 861 - DNA, 816 bp, Unknown
  Obtained from environmental sample
  misc_feature (1)..(816): n is a, c, g, or t
ttggaagcatataatctttcagatacgtcagatgatgtgaaagggatagcctttgaaaaattcttaggaaccactttcagaggacaattaggtcaattcttcacgccccggacagtagtagactatatggtaagcattctagacccacaggaaggagaaacagtttgcgatccatgttgcggtagtggaggtttcttaattaaagcatttgagtatgtaagaaacaaaattgaattagagattcaggtacaaaaggaaaaaatcaaagagcaattctatacagacaaatttgatatgctacctgagaaaaagcaaacagaaatcgaaatcacgatcaatgaccttttcaacaaactcaatgcagagttggacttgaaaaacaaacacagccgtttgcgcaagctatcttatgactgcattttcggaactgatgcgaaccctcgcatggcacgaacagcaaaaatgaatatgatcatgcatggtgatggtcatggcggggtgcatcatcacgatggattgctgaatgtaaatggaatttatgaggaaaggtttgatattatcctcactaatcctccttttggtgcgagggtagaaaaatctctaaagattacgcaagctgacatgccctctcaagaaaagattgacaaatacaataggcgttatcccggttatgaaaccaatgccttaagccaaataaaaaacaatatcaataaatcgcttttagacttgtatgatgtcggggaaatgacaggtttaacggaagttctcttcattgaaagatgccttcaccttctaaaccaggaggagaatgcataa

SEQ ID NO: 862 - protein, 271 aa, Unknown
  Obtained from environmental sample
  misc_feature (1)..(271): Xaa is any amino acid
MEAYNLSDTSDDVKGIAFEKFLGTTFRGQLGQFFTPRTVVDYMVSILDPQEGETVCDPCCGSGGFLIKAFEYVRNKIELEIQVQKEKIKEQFYTDKFDMLPEKKQTEIEITINDLFNKLNAELDLKNKHSRLRKLSYDCIFGTDANPRMARTAKMNMIMHGDGHGGVHHHDGLLNVNGIYEERFDIILTNPPFGARVEKSLKITQADMPSQEKIDKYNRRYPGYETNALSQIKNNINKSLLDLYDVGEMTGLTEVLFIERCLHLLNQEENA

SEQ ID NO: 863 - DNA, 1125 bp, Unknown
  Obtained from environmental sample
  misc_feature (1)..(1125): n is a, c, g, or t
atgaaatcattcacagaacctggagccaaaatggaagttaagataaacggcaataaaatttttgctccattaaagggcaaagatttagttcttactccagaagagagggtgaggcaggattttatttgtcggctcgttaatcactttggctatcatttaattcaaatggagcaagaggtcaaagtcaataattcaaaacgagggcagggcaaagcacgtgcagatatcgtcatttggaaaaatgagaaagaaagaattgatgagaaaagtccggtagtagttgtagagtgtaaagccgaacacattaccattcatgaagaagactattaccagggatttaattatgcatcatgggcaggtgcagattttttcattaccaccaacttgaaagaaacaaaagttttcaaagtggtcaaaggcaaaatgccaaaaaagttggacgagattgttgatttaccgaaggcaaaggacataaccaatgaaaagaaaattcaggaattattagcaaagacaaaagcatttacccgtgatgaattttcaaaactgcttttcaaatgccataacataattcgcaacaacgataaactttctcctgaagcagcatttgatgaaatcagcaaaattcttttcatgaaaattcgctatgaacgcaatccagatgaacataccattttcaccttagaggtttttcaaaagcaggaagccaattatgaaaaaaatattcgaccagtgaatagaaaattgcaaggtcagaggatggatattccatacatggactactggtttgaattgaccaaaacagaatttgccgaggatgaaatatttgacgaggacgataagataagaattaggcaaggcagctttgaagcaatcgttacagaattgaaagcatataatctttcagatacctcagaagatgtgaaaagggatacctttgaaaaattcctagaacccactttccgaggacaattaggtcatttcttccgccccggaaaggtagtaaacatttgggtaagcattctagacccccgggaagggagaaacggtttgcgatccctgtttgcgggaaggggaagttttcctaatttaagacctttttgggtatggaaaaaaaccaaaatttga

SEQ ID NO: 864 - protein, 374 aa, Unknown
  Obtained from environmental sample
  DOMAIN (31)...(143): Type I restriction enzyme R protein N terminus (HSDR_N)
  misc_feature (1)..(374): Xaa is any amino acid
MKSFTEPGAKMEVKINGNKIFAPLKGKDLVLTPEERVRQDFICRLVNHFGYHLIQMEQEVKVNNSKRGQGKARADIVIWKNEKERIDEKSPVVVVECKAEHITIHEEDYYQGFNYASWAGADFFITTNLKETKVFKVVKGKMPKKLDEIVDLPKAKDITNEKKIQELLAKTKAFTRDEFSKLLFKCHNIIRNNDKLSPEAAFDEISKILFMKIRYERNPDEHTIFTLEVFQKQEANYEKNIRPVNRKLQGQRMDIPYMDYWFELTKTEFAEDEIFDEDDKIRIRQGSFEAIVTELKAYNLSDTSEDVKRDTFEKFLEPTFRGQLGHFFRPGKVVNIWVSILDPREGRNGLRSLFAGRGSFPNLRPFWVWKKTKI

SEQ ID NO: 865 - DNA, 351 bp, Unknown
  Obtained from environmental sample
  misc_feature (1)..(351): n is a, c, g, or t
atggactatgtatgcagaaatgttaatccaacaaaaattcctattgaatttaaagagttaaataaagaggattttaagggtttggaaattgaaggtaataacaagattattgttcaacctgatgaaaatggatttattggagaagcacttaacgatgtaattaattttagtgatagtaatactgttgttatcaatgcaggtgtcgggcaaggaaaatctacattttgtataagcttggcagagtattacattaatctaactaatgaaaagggagaaaatcaatatgttgtcttgttcgttgctccctacatttctataatcaaccagtatgagaagaaattacttggataa

SEQ ID NO: 866 - protein, 116 aa, Unknown
  Obtained from environmental sample
  misc_feature (1)..(116): Xaa is any amino acid
MDYVCRNVNPTKIPIEFKELNKEDFKGLEIEGNNKIIVQPDENGFIGEALNDVINFSDSNTVVINAGVGQGKSTFCISLAEYYINLTNEKGENQYVVLFVAPYISIINQYEKKLLG

SEQ ID NO: 867 - DNA, 444 bp, Unknown
  Obtained from environmental sample
  misc_feature (1)..(444): n is a, c, g, or t
ttgttgtatttttccgccctcatgcagggtttcagccggatcattttattggtatttattttacttccgcttataagcatggggaagaaaaagcgcaggcttactacgaaggatgtagtaaccatatcggacagcatgctgcgtaataagatgggcgctgagcttttccgctactgcaaatacaacaataactcctactacagctacggtaagggcaggtatcaatactatatagaactgctacctgagaaaaaattgaacaaacaatttgtgaaggcccatatcatctatgatttcctgatgccttacggtgaatgcagcctatacgataccgtgagcagcacaatagatgtatacctggtaaaagaagacagcgtcttcagctttgcctctgaaccggatactagctttattcccctgatagcagtaaaccacgagccctga

SEQ ID NO: 868 - protein, 147 aa, Unknown
  Obtained from environmental sample
  misc_feature (1)..(147): Xaa is any amino acid
MLYFSALMQGFSRIILLVFILLPLISMGKKKRRLTTKDVVTISDSMLRNKMGAELFRYCKYNNNSYYSYGKGRYQYYIELLPEKKLNKQFVKAHIIYDFLMPYGECSLYDTVSSTIDVYLVKEDSVFSFASEPDTSFIPLIAVNHEP

SEQ ID NO: 869 - DNA, 693 bp, Unknown
  Obtained from environmental sample
  misc_feature (1)..(693): n is a, c, g, or t
ttggtggggatgggttgcaatcaatccgtggtttcatttggtgaagatactacaaagcaagatgaattgaaatcagcaaacaagaagaaaaatacacaatatgagaatgaatatgtgtctggtcttctggcatgtgatggatgcaaggagaaaagaaccattaaagactctctttgtttcatttggctcttgaacttggcatcagcctacagagacatgatggtagatgatgtgtacaaatcttttgatttgtcaaatcacacccctcaaagttattggatgatggggtgttgtggtccttttggtattattgattttgcctcaccaggcacaattatattcccaatattgaatcttgacaaacgtgttaaccccaaacaacatgatgattacaattatggagttatctggtgtttgtttgtacatgatataatgcaacaagctttagttccttatgacttcaagtttgatgtgaatcaaaagcaacttatccctgttactgctggtattggtaaaacttggatcagtcctagtatctactctcatctgattactggggaattacaagttatggatgataccacacaagccagacaaatggagcatgagattttactttaccaagtttttagagaaaaaatcttggttttgttgggaaaggttaagatattttcaaatgcaaaattttgctga

SEQ ID NO: 870 - protein, 230 aa, Unknown
  Obtained from environmental sample
  misc_feature (1)..(230): Xaa is any amino acid
MVGMGCNQSVVSFGEDTTKQDELKSANKKKNTQYENEYVSGLLACDGCKEKRTIKDSLCFIWLLNLASAYRDMMVDDVYKSFDLSNHTPQSYWMMGCCGPFGIIDFASPGTIIFPILNLDKRVNPKQHDDYNYGVIWCLFVHDIMQQALVPYDFKFDVNQKQLIPVTAGIGKTWISPSIYSHLITGELQVMDDTTQARQMEHEILLYQVFREKILVLLGKVKIFSNAKFC

SEQ ID NO: 871 - DNA, 867 bp, Unknown
  Obtained from environmental sample
  misc_feature (1)..(867): n is a, c, g, or t
atggtagactccgagaagaccaggaagcatatgatgatgcttgaaaattgctgctatgatttttttgagctgctgacgttaaatatgatccgcaatggtttgtttggcgaattggttcatgccgaaggcgcttacatacacgatctttcaaaggactacctgtttaataaaaatgcgtatgccgacatgtggcgcctgaaagagaacattggcaagaatggcaacctctaccccacccatggtcttggcccgatcgcgcaatgcatgaacattaaccgtggcgataaatttgatcatctcgtcagtatgagtacccatgatttttctttgaaccaggtggccaaagaaatggcggccaaagatgattttttcaaagcatatgttgacaagccttaccgtggaaatatgaacaccacgctgatccgcacaagcaaaggtaaaagcattatgctccaacacgacgtgtctacacttcgtccgtattcacgaattcacctggtcagcggcacaaaagctgttgcacaaaaatggccgggtcctgaacggattgcgtttggtcatagctggatcaaaaaagaagagctggatgacctgtatagcaagtacgctccgccgatagttaaacatatcggggatatagcaaaagaagtgggaggccatggtggaatggattttattatggactggcgcctgatcgattgcctgagaaatggcttaccgcttgaccaggatgtctatgatgccgccgcatggagcagcatctttcatctcagccagcagtcggtaaaggcaagatcaaaaacaatagaggttcctgattttacaagaggcgcatggaaaacaaataacccgttgatcttaccttaa

SEQ ID NO: 872 - protein, 288 aa, Unknown
  Obtained from environmental sample
  misc_feature (1)..(288): Xaa is any amino acid
MVDSEKTRKHMMMLENCCYDFFELLTLNMIRNGLFGELVHAEGAYIHDLSKDYLFNKNAYADMWRLKENIGKNGNLYPTHGLGPIAQCMNINRGDKFDHLVSMSTHDFSLNQVAKEMAAKDDFFKAYVDKPYRGNMNTTLIRTSKGKSIMLQHDVSTLRPYSRIHLVSGTKAVAQKWPGPERIAFGHSWIKKEELDDLYSKYAPPIVKHIGDIAKEVGGHGGMDFIMDWRLIDCLRNGLPLDQDVYDAAAWSSIFHLSQQSVKARSKTIEVPDFTRGAWKTNNPLILP

SEQ ID NO: 873 - DNA, 519 bp, Unknown
  Obtained from environmental sample
  misc_feature (1)..(519): n is a, c, g, or t
atgagaaaaatagtagccgggttcgcctgcagcctggatggattcattgaaggcccaaatggagaatacgattggattatcatagataaggaaatcgattttgccgaacagatgaaacgatacgatagttacctctatggaagaagaacctatgaagctgtcctgaaaatgaagtctaaaatggctaagtcgtccaggcattatgttttttcccattcactcgatcatgttgcagatggttttatcctggtgaaaggaaaccttaaggatgaagtacttaaaatcaaacagggggatggaaaagatatcgcggtatttggaggtgcggatctgcttacaactttattaaatgaaaacctggtggatgaactttctatatccatcattcctgtccttttaggagcgggcaaacccatgatcaatgtattgaataagcgtattcatctaaacctggtaaaaacgcatgcttattcggttggatcagtaaatctgacctatttggttgataaaacccgctaa

SEQ ID NO: 874 - protein, 172 aa, Unknown
  Obtained from environmental sample
  DOMAIN (2)...(163): RibD C-terminal domain
  misc_feature (1)..(172): Xaa is any amino acid
MRKIVAGFACSLDGFIEGPNGEYDWIIIDKEIDFAEQMKRYDSYLYGRRTYEAVLKMKSKMAKSSRHYVFSHSLDHVADGFILVKGNLKDEVLKIKQGDGKDIAVFGGADLLTTLLNENLVDELSISIIPVLLGAGKPMINVLNKRIHLNLVKTHAYSVGSVNLTYLVDKTR

SEQ ID NO: 875 - DNA, 540 bp, Unknown
  Obtained from environmental sample
  misc_feature (1)..(540): n is a, c, g, or t
atgaaaaaaattcaaaattttgactttgattgctttgatttgattgaagacgctcaaaatgcatatagttttcagcctgccttaactgagaaattagataatcatcaaagagaatttgacgagaaaacgattttagaaatcgttctttggaagacaaaccgctatcccaccattccggaaggactaattgacgctatcaatgacctccgaaataattaccacatcgagaaagccaaggtagttttgaggcaactcttgtcgtcaaaaggatttgatttgccaatggcttccactgttcttcggtttgcttgcccagatgaattacaaatcctcgaccaaagagtatatcgatttataatgcccgagcatgaccgcctcaaagcgccctacaatattgatgagaaagtagaattctatttcgactatgtcgataacctaaaattggtgtgtgacaaatatcaaatcccattcagtaaatctgatcgaattttgtatcaactcgataaaaacttaaatgcggacattccaattaaatattga

SEQ ID NO: 876 - protein, 179 aa, Unknown
  Obtained from environmental sample
  misc_feature (1)..(179): Xaa is any amino acid
MKKIQNFDFDCFDLIEDAQNAYSFQPALTEKLDNHQREFDEKTILEIVLWKTNRYPTIPEGLIDAINDLRNNYHIEKAKVVLRQLLSSKGFDLPMASTVLRFACPDELQILDQRVYRFIMPEHDRLKAPYNIDEKVEFYFDYVDNLKLVCDKYQIPFSKSDRILYQLDKNLNADIPIKY

SEQ ID NO: 877 - DNA, 417 bp, Unknown
  Obtained from environmental sample
  misc_feature (1)..(417): n is a, c, g, or t
atggtaggctccctgagcctgaatgatcacttcgttttcgcggaaggctcttccccagggatcacccgcgcttttcttgaaaaacttgaaaaatacgtagtttttgaagactactgttttgtacatgcgggcgttaatccgcttagagatctgaaagctcagcttgatcaggatattttctggattcgacaagaatttatcaataatatccattatttcaaaaagacggtgatctttggtcacacgccttttgaagatgtgatgttccatttgccatataagattggaattgacacaggcttagtttttggaaattctttaagctgtcttgagttaaagcaaaaaaggattttgcaggtggcacgcaatgggagcgaagtaaaagaaagagctttcccccctgaagaaaaaaaataa

SEQ ID NO: 878 - protein, 138 aa, Unknown
  Obtained from environmental sample
  misc_feature (1)..(138): Xaa is any amino acid
MVGSLSLNDHFVFAEGSSPGITRAFLEKLEKYVVFEDYCFVHAGVNPLRDLKAQLDQDIFWIRQEFINNIHYFKKTVIFGHTPFEDVMFHLPYKIGIDTGLVFGNSLSCLELKQKRILQVARNGSEVKERAFPPEEKK

SEQ ID NO: 879 - DNA, 885 bp, Unknown
  Obtained from environmental sample
  misc_feature (1)..(885): n is a, c, g, or t
atgaacgaagacgttcaggtgatagttgctactatagcgtttggcatgggtatcgacaaacccgatatacgtttcgtaatccattataacattccgaagagcatagaaaattactaccaggaaaccggccgtgcaggtcgtgatggactggaaggaaagtgtatactttattattcgcacaaggatgtgtcgaaacttgaacaccttatgcgcgataaaccgctcagtgagcgtgaagttggcgcgcagctgatcgctgaaactgttgcatacgccgaaagcggtgtgtgccgacgtaaaattttgatcagctattttggtgaagaatacaatcatgaaaattgcggcgagtgcgacaactgcgttaatcctaaagagaaggtagaagcgaaagacaatgtggtgaaagtactgaaggtgctaaaggcgcttgatgagcaattcgcaacagagtatgtagtcaacatcctgacgggaaggcttacgcctaacaattctatgtacaggcataatactattcctgaatttgccataggaaacgacgaacccgatcattactggaatacgcttatcaggcaaatgcttttgcatggattgatcagcaaggatattgaagattatggcattcttaagatctgcaaaaaaggaagcgagtttgccaaaaagcctaagacattccagattgtattgaataatctttttgaagaagcgaacgctgatgacgatgaagaatctgcagaaccggttacttcagcagcggcagacgataagctgttcaatatgctgaaggaaatgcggcagaaggaatcaaaaaaacggtcgttgcccccatttgtaattttctggaatcttcatgcaggatatggcaacaatttcctcaaataa

SEQ ID NO: 880 - protein, 294 aa, Unknown
  Obtained from environmental sample
  DOMAIN (1)...(49): Helicase conserved C-terminal domain
  misc_feature (1)..(294): Xaa is any amino acid
MNEDVQVIVATIAFGMGIDKPDIRFVIHYNIPKSIENYYQETGRAGRDGLEGKCILYYSHKDVSKLEHLMRDKPLSEREVGAQLIAETVAYAESGVCRRKILISYFGEEYNHENCGECDNCVNPKEKVEAKDNVVKVLKVLKALDEQFATEYVVNILTGRLTPNNSMYRHNTIPEFAIGNDEPDHYWNTLIRQMLLHGLISKDIEDYGILKICKKGSEFAKKPKTFQIVLNNLFEEANADDDEESAEPVTSAAADDKLFNMLKEMRQKESKKRSLPPFVIFWNLHAGYGNNFLK

SEQ ID NO: 881 - DNA, 573 bp, Unknown
  Obtained from environmental sample
  misc_feature (1)..(573): n is a, c, g, or t
atgattgctactactctactggacaggctggtaacaaagattgctttatatgacgacccggttgcttataaggaactcttcatgctttatcacaaaaggctgatcaggtttgccattaccatcaccaaaacaaaagaatccgcagaagaagtagtatcagacgtatttctgaaagtatgggctacccgctcctctctgacccgggtggagaacatgcacctttacctttatatcattaccaagaatctttctatcaaccggttgctgaaagaccggaaacagcaatctttctcgctggatgaagccgtagtagatattaaaagtatttattccgatcccgagcaggtgatgaccacagccgaaatgtcgcgccgtatacaaaactccatcgaacaactaccacctaagtgccagcttatttttaaattgataagggaggatggtcttaagtacaaagaggtggcaggactgctgaatatctctttaaagaccgttgaaaaccagatgaccattgccctgaaaagaatagccgaatctgtgaaagtgaaccttttaaaaagctctctgaattaa

SEQ ID NO: 882 - protein, 190 aa, Unknown
  Obtained from environmental sample
  DOMAIN (129)...(178): Sigma-70, region 4
  misc_feature (1)..(190): Xaa is any amino acid
MIATTLLDRLVTKIALYDDPVAYKELFMLYHKRLIRFAITITKTKESAEEVVSDVFLKVWATRSSLTRVENMHLYLYIITKNLSINRLLKDRKQQSFSLDEAVVDIKSIYSDPEQVMTTAEMSRRIQNSIEQLPPKCQLIFKLIREDGLKYKEVAGLLNISLKTVENQMTIALKRIAESVKVNLLKSSLN

SEQ ID NO: 883 - DNA, 447 bp, Unknown
  Obtained from environmental sample
  misc_feature (1)..(447): n is a, c, g, or t
atgccccatacaattatttacaattcagaattgcacattgttgaatcaaaattgcaaggagatatgactttaggcgaagtggatgaagtcgtcactaaaatcgcgaaaatagccaaagagaaagactgccgcttaatcttcactgacttaactgatgtgtcacgaaaattatcaattttagagatttacgaattgcctgatcgaataaggaacatattcacctcttttggcattcacatatccctccataggcgggcgaatgtagtcgcgaaagattgggatgattatatttttcatgaaaatgtaatggtcaatcgtggacaaaacgagaaggtgttcactgatgtcgacaaagcaaagaaatggctcattggtaataacacgactgaacaaagtcagctacgtccttgcagtgatggatatcacccaaatgagaagagactgtga

SEQ ID NO: 884 - protein, 148 aa, Unknown
  Obtained from environmental sample
  misc_feature (1)..(148): Xaa is any amino acid
MPHTIIYNSELHIVESKLQGDMTLGEVDEVVTKIAKIAKEKDCRLIFTDLTDVSRKLSILEIYELPDRIRNIFTSFGIHISLHRRANVVAKDWDDYIFHENVMVNRGQNEKVFTDVDKAKKWLIGNNTTEQSQLRPCSDGYHPNEKRL

SEQ ID NO: 885 - DNA, 357 bp, Unknown
  Obtained from environmental sample
  misc_feature (1)..(357): n is a, c, g, or t
atgaacttcccgttcatcgcggagtgccgaaaccattgggtttcggccggcgcgatccaggctctttggcctgtacacagcagaaccctgcaatgcttgacgcatttcagtacgggacgtgggtctataatctccgaattcagtctcaagacggtccaaaaacagccggagaaattcaccaataatttcatcccgcgtccggatctcatgggtctgaataaatctcttaatgtcattactttcgctcacaaacattgtctcaagcttatcgaaataaggatggaggtccggtttaagccgctcaagaataaactcgtggtaatagttataatcattcgttcttttctcgtaagctag

SEQ ID NO: 886 - protein, 118 aa, Unknown
  Obtained from environmental sample
  misc_feature (1)..(118): Xaa is any amino acid
MNFPFIAECRNHWVSAGAIQALWPVHSRTLQCLTHFSTGRGSIISEFSLKTVQKQPEKFTNNFIPRPDLMGLNKSLNVITFAHKHCLKLIEIRMEVRFKPLKNKLVVIVIIIRSFLVS

SEQ ID NO: 887 - DNA, 417 bp, Unknown
  Obtained from environmental sample
  misc_feature (1)..(417): n is a, c, g, or t
ttgatcagtaagcattttaaacagattatgttgttgctcggtctgaatctgagcgataacagcctgaaaggaacacccgaccgtgttgcaaaaatgtatgtgaaagagatcttcagtgggttgaacccagataacaaaccagatattacacttttcgaaaacaaatatcattatggccagatgctggtggaaaaaaatatcaccgtgtattccagttgtgaacaccattttgttcccatcattgggaaagctcacgttgcttactatccgaacgggaaagtgattggattatcaaaaattaatcgcattgttcaatactattccaaaaggcctcaggtgcagagaaagactgaccgaacaaatagcagaagcgttgaaacaggctttgcatacggaagatgtagcagttgtagttga

SEQ ID NO: 888 - protein, 138 aa, Unknown
  Obtained from environmental sample
  DOMAIN (60)...(138): GTP cyclohydrolase I
  misc_feature (1)..(138): Xaa is any amino acid
MISKHFKQIMLLLGLNLSDNSLKGTPDRVAKMYVKEIFSGLNPDNKPDITLFENKYHYGQMLVEKNITVYSSCEHHFVPIIGKAHVAYYPNGKVIGLSKINRIVQYYSKRPQVQRKTDRTNSRSVETGFAYGRCSSCS

SEQ ID NO: 889 - DNA, 462 bp, Unknown
  Obtained from environmental sample
  misc_feature (1)..(462): n is a, c, g, or t
gtggttgcaaaaatgtatgtgaaagagatcttcagtgggttgaacccagataacaaaccagatattacacttttcgaaaacaaatatcattatggccagatgctggtggaaaaaaatatcaccgtgtattccagttgtgaacaccattttgttcccatcattgggaaagctcacgttgcttactatccgaacgggaaagtgattggattatcaaaaattaatcgcattgttcaatactattccaaaaggcctcaggtgcaggaaagactgaccgaacaaatagcagaagcgttgaaacaggctttgcatacggaagatgtagcagttgtagttgatgcagtccatctttgcgtaacttcaagaggaattggtgatgtgaacagttcaacgattaccagtcattattcaggaaaatttttagcagagcaaaccaaaaaggaatttctttcatttctcaaataa

SEQ ID NO: 890 - protein, 153 aa, Unknown
  Obtained from environmental sample
  DOMAIN (33)...(137): GTP cyclohydrolase I
  misc_feature (1)..(153): Xaa is any amino acid
MVAKMYVKEIFSGLNPDNKPDITLFENKYHYGQMLVEKNITVYSSCEHHFVPIIGKAHVAYYPNGKVIGLSKINRIVQYYSKRPQVQERLTEQIAEALKQALHTEDVAVVVDAVHLCVTSRGIGDVNSSTITSHYSGKFLAEQTKKEFLSFLK

SEQ ID NO: 891 - DNA, 771 bp, Unknown
  Obtained from environmental sample
  misc_feature (1)..(771): n is a, c, g, or t
gtgatcggttcggagttttatttaatggagcggcgaaacggtttgataattcgcggaaaatcgccggagattctggaaaattcatccgagctgcaacgcaaagtttgtgcgtcttttatcgaaaatttagtggatctacatctcctcgattataaaaaaatcggtttggaaaatttgggaaaacccgaaggctacgttgaaagacaagttgccggctggacgaaacggtatttcaacgcgaaaaccggcgaacacgccgagctcgaaaaggcgatcgaatggctcaatgaaaacattcccgcgtcagacggcgcaggattgattcataatgactataaattcgacaatgtgatgttcgatccgaatgatctgacgaaaatcgtcgccgttttagactgggaaatgacgacgatcggcgaacctctgatggatttgggttcgtcgctcgcttattggatgcagaaggaaaatggcggcgaaatgctctcgatgccgtttaatccgcgcgttttgatggaaaatatcacgcgccgcgagctcgtcgaaatgtatgaagaaagatccggcaaaaaggtttccgatattcttttctactacgttttcggaacgttcaaactcgccgtaatcgcgcagcaaatctattttcgctacaccaaaggtttcacaaaagacgcgcgttttgcgacattcgatcattttgtcaaaagccttggaaaaatcgctctgcacacgattgaaaagcagggaaatttaaccgagatcaggaaataa

SEQ ID NO: 892 - protein, 256 aa, Unknown
  Obtained from environmental sample
  DOMAIN (4)...(184): Phosphotransferase enzyme family
  misc_feature (1)..(256): Xaa is any amino acid
MIGSEFYLMERRNGLIIRGKSPEILENSSELQRKVCASFIENLVDLHLLDYKKIGLENLGKPEGYVERQVAGWTKRYFNAKTGEHAELEKAIEWLNENIPASDGAGLIHNDYKFDNVMFDPNDLTKIVAVLDWEMTTIGEPLMDLGSSLAYWMQKENGGEMLSMPFNPRVLMENITRRELVEMYEERSGKKVSDILFYYVFGTFKLAVIAQQIYFRYTKGFTKDARFATFDHFVKSLGKIALHTIEKQGNLTEIRK

SEQ ID NO: 893 - DNA, 402 bp, Unknown
  Obtained from environmental sample
  misc_feature (1)..(402): n is a, c, g, or t
atgccaaactggattattagtcgactcgaaagtaatcctcgcttgtttaatcgaaaaaatgcattggcattaaaaacaaaaatagccagcgatagttattcagaaacaatctatcgtcaaccaataattgaggctatgaacttattggaagctaaagaaaatacattatcccaagtcgactttgtcccatatattgaaaaactggttaaaaaggctctcaatagagagcaaagcatgactgaaccagttaagaaaagattttcggtagatggaaaaaatataggtaaattgcattacgatgatcgcaagggtttatcgatcactattaaaccatctgcaataactgatgcagatattgatgttatccatgagtttatagcaacccgaatatctggaaaataa

SEQ ID NO: 894 - protein, 133 aa, Unknown
  Obtained from environmental sample
  misc_feature (1)..(133): Xaa is any amino acid
MPNWIISRLESNPRLFNRKNALALKTKIASDSYSETIYRQPIIEAMNLLEAKENTLSQVDFVPYIEKLVKKALNREQSMTEPVKKRFSVDGKNIGKLHYDDRKGLSITIKPSAITDADIDVIHEFIATRISGK

SEQ ID NO: 895 - DNA, 942 bp, Unknown
  Obtained from environmental sample
  misc_feature (1)..(942): n is a, c, g, or t
ttgagctcatttaatgttcccaaacctcaattattcatagaatatgaagggattaaaggcagcctgaataattttgaatccagaaagatagggattttacaggaactggaattccccacaaactactttttgcggagcgatgtacagcaatcagaagtagatattgcgaagatggagctgaacaaacttgcatatgaagttaagtatcaagccgaaagcgcatatttaagtctattgctgaacattaaacttctggatgctgcgcgtgaaaacctcaaaatatataatgatttcctcttcactgcagaaaggaaatatgatgccggctcaaccagtaaccttgaggtattgggcgcaaaggtgaacaagattaaatacgaaaacgggataaagaacattgagtcggagataattaaatccaaatcagaattgaagaaactaatgaatgtatcatatttcagtttcgaaccggctgatgaacttattttcagggaagttcagctgaataagaacgagatattactggctgcactgtcaaataatcctgagcttaaaattaataagtatcagaaagaaaaattcagcaataagatatcattaacaaaatcccagcttttacctgatctatcatttaaatactacacccaaaaaatcggcaatgatgcaggattctggggggttgaatttggtgtgggcgtacctttatggttctggtgggagcaatcaggcaatataaaagaagctgaccgcgagtttgatattgcatcaagcgaagaaacaggtataaaaaagaatattgaaaatcaggtaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 896 - protein, 314 aa, Unknown
  Obtained from environmental sample
  misc_feature (1)..(314): Xaa is any amino acid
MSSFNVPKPQLFIEYEGIKGSLNNFESRKIGILQELEFPTNYFLRSDVQQSEVDIAKMELNKLAYEVKYQAESAYLSLLLNIKLLDAARENLKIYNDFLFTAERKYDAGSTSNLEVLGAKVNKIKYENGIKNIESEIIKSKSELKKLMNVSYFSFEPADELIFREVQLNKNEILLAALSNNPELKINKYQKEKFSNKISLTKSQLLPDLSFKYYTQKIGNDAGFWGVEFGVGVPLWFWWEQSGNIKEADREFDIASSEETGIKKNIENQVNXXXXXXXXXXXXXXXXXXXXXXXXXXXXXXXXXXXXXXXXXXX

SEQ ID NO: 897 - DNA, 798 bp, Unknown
  Obtained from environmental sample
  misc_feature (1)..(798): n is a, c, g, or t
ttgagctcatttaatgttcccaaacctcaattattcatagaatatgaagggattaaaggcagcctgaataattttgaatccagaaagatagggattttacaggaactggaattccccacaaactactttttgcggagcgatgtacagcaatcagaagtagatattgcgaagatggagctgaacaaacttgcatatgaagttaagtatcaagccgaaagcgcatatttaagtctattgctgaacattaaacttctggatgctgcgcgtgaaaacctcaaaatatataatgatttcctcttcactgcagaaaggaaatatgatgccggctcaaccagtaaccttgaggtattgggcgcaaaggtgaacaagattaaatacgaaaacgggataaagaacattgagtcggagataattaaatccaaatcagaattgaagaaactaatgaatgtatcatatttcagtttcgaaccggctgatgaacttattttcagggaagttcagctgaataagaacgagatattactggctgcactgtcaaataatcctgagcttaaaattaataagtatcagaaagaaaaattcagcaataagatatcattaacaaaatcccagcttttacctgatctatcatttaaatactacacccaaaaaatcggcaatgatgcaggattctggggggttgaatttggtgtgggcgtacctttatggttctggtgggagcaatcaggcaatataaaagaagctgaccgcgagtttgatattgcatcaagcgaagaaacaggtataaaaagaatatga

SEQ ID NO: 898 - protein, 265 aa, Unknown
  Obtained from environmental sample
  misc_feature (1)..(265): Xaa is any amino acid
MSSFNVPKPQLFIEYEGIKGSLNNFESRKIGILQELEFPTNYFLRSDVQQSEVDIAKMELNKLAYEVKYQAESAYLSLLLNIKLLDAARENLKIYNDFLFTAERKYDAGSTSNLEVLGAKVNKIKYENGIKNIESEIIKSKSELKKLMNVSYFSFEPADELIFREVQLNKNEILLAALSNNPELKINKYQKEKFSNKISLTKSQLLPDLSFKYYTQKIGNDAGFWGVEFGVGVPLWFWWEQSGNIKEADREFDIASSEETGIKRI

SEQ ID NO: 899 - DNA, 525 bp, Unknown
  Obtained from environmental sample
  misc_feature (1)..(525): n is a, c, g, or t
atggatatatgcggcagcctgcataaatggttatatgcaccgatcggcagcggtttgctttatgtaaaaaaagaaaagatcccgtcactctatccattatttgccgcatcggaaaacccgcttaaggatgatatcaggaaatttgaacacctcggtacccggcctttctttattgagcaggctatcggaaaagctgttgagtttcatgaaatgatcggaagccagcggaaagaaaaaaggcttcattacctcaaaaattactggatggaaaaagtaaaggatcttccgggggccaggttaaatacttccatgcattcgaaatacggctgtgcgattggaaacataggttttgaaggaagaaaacctgctgaactggatagtttccttctcgataaattcaaagtgcacaccgtagggatcaactgggaaaatatacagggagtaagagtaacaccaaatgtttataccaccactgcaaacctggatgtactcatcgaaggtatccgcgctttcgccaaaacatga

SEQ ID NO: 900 - protein, 174 aa, Unknown
  Obtained from environmental sample
  misc_feature (1)..(174): Xaa is any amino acid
MDICGSLHKWLYAPIGSGLLYVKKEKIPSLYPLFAASENPLKDDIRKFEHLGTRPFFIEQAIGKAVEFHEMIGSQRKEKRLHYLKNYWMEKVKDLPGARLNTSMHSKYGCAIGNIGFEGRKPAELDSFLLDKFKVHTVGINWENIQGVRVTPNVYTTTANLDVLIEGIRAFAKT

SEQ ID NO: 901 - DNA, 399 bp, Unknown
  Obtained from environmental sample
  misc_feature (1)..(399): n is a, c, g, or t
atgatatcaggaaatttgaacacctccgtacccggccttttctttatgaggcaggctatcggaaaagctgttgagtttcatgaaatgatcggaagccagcggaaagaaaaaaggcttcattacctcaaaaattactggatggaaaaagtaaaggatcttccgggggccaggttaaatacttccatgcattcgaaatacggctgtgcgattggaaacataggttttgaaggaagaaaacctgctgaactggatagtttccttctcgataaattcaaagtgcacaccgtagggatcaactgggaaaatatacagggagtaagagtaacaccaaatgtttataccaccactgcaaacctggatgtactcatcgaaggtatccgcgctttcgccaaaacatga

SEQ ID NO: 902 - protein, 132 aa, Unknown
  Obtained from environmental sample
  misc_feature (1)..(132): Xaa is any amino acid
MISGNLNTSVPGLFFMRQAIGKAVEFHEMIGSQRKEKRLHYLKNYWMEKVKDLPGARLNTSMHSKYGCAIGNIGFEGRKPAELDSFLLDKFKVHTVGINWENIQGVRVTPNVYTTTANLDVLIEGIRAFAKT

SEQ ID NO: 903 - DNA, 543 bp, Unknown
  Obtained from environmental sample
  misc_feature (1)..(543): n is a, c, g, or t
atgaataagcaaattcaatttatttttaacacccttgcagtaactagttttttaggagtgattgttttattcgcctcctttttcaataagaaagaactggcgtatgttgactcggttcggctgatgagaggctataaaggtatggaggcggcgcaaaaagacttgcagtctaaaatgatgatttggaatgccaatattgatacacttaaaaatgaatttaataataaagtgattgattaccagaagcgccaggctaaactaagtacgacggagaggaagttaacagaagaattgctatctgttaaagagcaacaacttgtcaattatcagcaaagtgttaccgaaaaggttcagcaggaaaatgctgagctgagtggaaaagtgttgagtaaagtaaacgattttgttaagcggtatggcgaaaagaaacaatacactataattcttgctactactcaggatggtaatatcgtttacgcggatcgtggcatagacataacagatgaagtggtgaacggattaaatgctgagtacattaagtag

SEQ ID NO: 904 - protein, 180 aa, Unknown
  Obtained from environmental sample
  DOMAIN (10)...(175): Outer membrane protein (OmpH-like)
  misc_feature (1)..(180): Xaa is any amino acid
MNKQIQFIFNTLAVTSFLGVIVLFASFFNKKELAYVDSVRLMRGYKGMEAAQKDLQSKMMIWNANIDTLKNEFNNKVIDYQKRQAKLSTTERKLTEELLSVKEQQLVNYQQSVTEKVQQENAELSGKVLSKVNDFVKRYGEKKQYTIILATTQDGNIVYADRGIDITDEVVNGLNAEYIK

SEQ ID NO: 905 - DNA, 762 bp, Unknown
  Obtained from environmental sample
  misc_feature (1)..(762): n is a, c, g, or t
ttgaataaatttattattaatgaaaaaatatattttatgaaatcaaaatcaattaaaggaaatactcctgaagaagttcgattagctttatccgaaagcttgtttgatggatttaaacctactttagctataatttttttatctgtcaatatggatcgagattctatttgtaaaatatttgatgaaaatgggattacaatatttggatcaactgctgcaggagaatttattaatggagaattagaaaaagaatcagcggcaatacttttacttgatatggataaaaataattttttagttcacatcgaagaaagaagtggaaaaagtaagttgagaactgctgcagaaatcggtaaaaagggtttggataaattttcaaatccggcttatcttgttgcaaccgggggctctataattgatggtgaaacgattatcagtggaataaatagcacttcaggtaaatactcaattatttatgggggtattgccggagatgaattacgcggcactgaaacgcatttatttacaaatgacaaatccactcaagacggaattattgcactcatagttgataatgacaatatacaattaacgggtctcgctactcatggctggaagcctatcggaacaatacgcacaataacagattgtgaggaatgtaaggtttatacaatagataatgagccagcattggatattatggttaagtttctgggaatttctttagaagattatcccggggatgaattaattaataattag

SEQ ID NO: 906 - protein, 253 aa, Unknown
  Obtained from environmental sample
  misc_feature (1)..(253): Xaa is any amino acid
MNKFIINEKIYFMKSKSIKGNTPEEVRLALSESLFDGFKPTLAIIFLSVNMDRDSICKIFDENGITIFGSTAAGEFINGELEKESAAILLLDMDKNNFLVHIEERSGKSKLRTAAEIGKKGLDKFSNPAYLVATGGSIIDGETIISGINSTSGKYSIIYGGIAGDELRGTETHLFTNDKSTQDGIIALIVDNDNIQLTGLATHGWKPIGTIRTITDCEECKVYTIDNEPALDIMVKFLGISLEDYPGDELINN

SEQ ID NO: 907 - DNA, 852 bp, Unknown
  Obtained from environmental sample
  misc_feature (1)..(852): n is a, c, g, or t
atgaaatcattcacagaacctggagccaaaatggaagttaagataaacggcaataaaatttttgctccattaaagggcaaagatttagttcttactccagaagagagggtgaggcaggattttatttgtcggctcgttaatcactttggctatcatttaattcaaatggagcaagaggtcaaagtcaataattcaaaacgagggcagggcaaagcacgtgcagatatcgtcatttggaaaaatgagaaagaaagaattgatgagaaaagtccggtagtagttgtagagtgtaaagccgaacacattaccattcatgaagaagactattaccagggatttaattatgcatcatgggcaggtgcagattttttcattaccaccaacttgaaagaaacaaaagttttcaaagtggtcaaaggcaaaatgccaaaaaagttggacgagattgttgatttaccgaaggcaaaggacataaccaatgaaaagaaaattcaggaattattagcaaagacaaaagcatttacccgtgatgaattttcaaaactgcttttcaaatgccataacataattcgcaacaacgataaactttctcctgaagcagcatttgatgaaatcagcaaaattcttttcatgaaaattcgctatgaacgcaatccagatgaacataccattttcaccttagaggtttttcaaaagcaggaagccaattatgaaaaaaatattcgaccagtgaatagaaaattgcaaggtcagaggatggatattccatacatggactactggtttgaattgaccaaaacagaatttgccgaggatgaaatatttgacgagaacgataagataaagaattag

SEQ ID NO: 908 - protein, 283 aa, Unknown
  Obtained from environmental sample
  DOMAIN (31)...(143): Type I restriction enzyme R protein N terminus (HSDR_N)
  misc_feature (1)..(283): Xaa is any amino acid
MKSFTEPGAKMEVKINGNKIFAPLKGKDLVLTPEERVRQDFICRLVNHFGYHLIQMEQEVKVNNSKRGQGKARADIVIWKNEKERIDEKSPVVVVECKAEHITIHEEDYYQGFNYASWAGADFFITTNLKETKVFKVVKGKMPKKLDEIVDLPKAKDITNEKKIQELLAKTKAFTRDEFSKLLFKCHNIIRNNDKLSPEAAFDEISKILFMKIRYERNPDEHTIFTLEVFQKQEANYEKNIRPVNRKLQGQRMDIPYMDYWFELTKTEFAEDEIFDENDKIKN

SEQ ID NO: 909 - DNA, 309 bp, Unknown
  Obtained from environmental sample
  misc_feature (1)..(309): n is a, c, g, or t
atgaataaaaattacgatatttcttttaaaataccagacgatctgttacaatttttaaataatgaaacttattcattgttgattaaaggtgagccaggctcaggaaaaaccgctctatgtttgacaattcttaaagcattaaacataaagaataatttcttttatatttctacaagagtatcgcctaataaattattttattactttaagtggataaataaataccttaaaattaaatattcaaataatcataaaaaaacttctaaaaatataaatagtttagaaccatttttgaagatgcacgtttag

SEQ ID NO: 910 - protein, 102 aa, Unknown
  Obtained from environmental sample
  misc_feature (1)..(102): Xaa is any amino acid
MNKNYDISFKIPDDLLQFLNNETYSLLIKGEPGSGKTALCLTILKALNIKNNFFYISTRVSPNKLFYYFKWINKYLKIKYSNNHKKTSKNINSLEPFLKMHV

SEQ ID NO: 911 - DNA, 495 bp, Unknown
  Obtained from environmental sample
  misc_feature (1)..(495): n is a, c, g, or t
ttggggtccttcggaaactacaatttccagtgtctgtctgtggattcttttcagaatttttcttgttggactggtttacctaatacgaatataccttcccatgttgtgtatatttgtcgggtttccgaccagctgcttatttcgttaataaatatcagactctctattttctcgctagatgtcgcctatgccattatacgcgttttcctcttgtcttggtcccgtgttcttgaacttcatgggattcgtgtggtctcgactatgctaagtcagacttgctatggtcgtatatgccctaacgtgttgctctcaatctcaatatgggacaatctatgtacgcgcttctcgagttttttacagattatttgttgtgtcaattgtgctcttctcacccgagaaggtgttcctctattctgttttcaccgtatgtctttaggatcgctgtctttatgtctcccctgcctatataggtgggtttccgatgttttgttctga

SEQ ID NO: 912 - protein, 164 aa, Unknown
  Obtained from environmental sample
  misc_feature (1)..(164): Xaa is any amino acid
MGSFGNYNFQCLSVDSFQNFSCWTGLPNTNIPSHVVYICRVSDQLLISLINIRLSIFSLDVAYAIIRVFLLSWSRVLELHGIRVVSTMLSQTCYGRICPNVLLSISIWDNLCTRFSSFLQIICCVNCALLTREGVPLFCFHRMSLGSLSLCLPCLYRWVSDVLF

SEQ ID NO: 913 - DNA, 375 bp, Unknown
  Obtained from environmental sample
  misc_feature (1)..(375): n is a, c, g, or t
ttgcattttaccataggtagaaaaaatggtcagttaatagctaataaaatagtagtgcctgatgttataaaaacccaaacccaacttgttgtggatatgcatgaagatttatggaaggaaatcggttataaataccctcgtttcatttattctgtatccaaagatgatgaaacaatgaattatgtgaataacattactcagacgatgccatttttaaaaatatattcttcaggtggatcaagcccattatacgttacaaaacccatctcaaataagggaatttatgccatggtatatgaaacctataaaaaggattcatatgaaaaaaaatattctgatgcaagtcaatttatagatgtgttagataagttatga

SEQ ID NO: 914 - protein, 124 aa, Unknown
  Obtained from environmental sample
  misc_feature (1)..(124): Xaa is any amino acid
MHFTIGRKNGQLIANKIVVPDVIKTQTQLVVDMHEDLWKEIGYKYPRFIYSVSKDDETMNYVNNITQTMPFLKIYSSGGSSPLYVTKPISNKGIYAMVYETYKKDSYEKKYSDASQFIDVLDKL

SEQ ID NO: 915 - DNA, 300 bp, Unknown
  Obtained from environmental sample
  misc_feature (1)..(300): n is a, c, g, or t
atgactcaggttgaattgaagcttgataaaaagaataatgggggtttttacattatggacggagaagaacagataggagaaatggcaataagcatttctgggaaaaatctgactgtttaccatactgaggtttcgcaaaaagcagaaggcaaaggtttaggaaagcaactgttgactgcaatggtcgatcattcccgtaaaaacggcttaaaggttattgcactttgcccttttgttcatgcacagtttatacggcaccccgggcagtacgcagatatctggaacaaggaatctgaataa

SEQ ID NO: 916 - protein, 99 aa, Unknown
  Obtained from environmental sample
  misc_feature (1)..(99): Xaa is any amino acid
MTQVELKLDKKNNGGFYIMDGEEQIGEMAISISGKNLTVYHTEVSQKAEGKGLGKQLLTAMVDHSRKNGLKVIALCPFVHAQFIRHPGQYADIWNKESE

SEQ ID NO: 917 - DNA, 807 bp, Unknown
  Obtained from environmental sample
  misc_feature (1)..(807): n is a, c, g, or t
gtgtttgaagaaacagtagccacgcaatatgaatcggggcagggcgctatcaactggaggtatctaccaaaaaccaaggagatcatctggtattctgaaagagatgactggggacatttgtatttgtatgatgccacaacagggaaattaaaaaatcaaatcaccaaaggtaactgggtggtgttgcgtattaccaaagtggatgaaaagaaccgcttggtttattttatcgccaacgggcaacaaccggagaatccctatttcagccagttctgtaaaataggttttgatggaaagaatatgacggtgcttacgcctgatgccggcactcatcaaatcagttggtcgccttcggaaaattattttatcgatacatggtccaaacccgatatgccatctgtttctgtattacgtgataagaacgggaaaaaaatagtggacctggaaaaaacagatgtatcgagattgaaagcaacgggatggaaaccgccaacacccgtcgccctgaaagcacatgatggcaagaccgatatctatggactggtattcacgccaactaacctcgatcccaataaaaaatacccggtagttgattatatctatcccggtccgcagggaggaagtgtaggcagctgggcatttagtgcaggaagaggggatcaccaggcgctggctgaattgggatttgttgtaatagtgatcgaaggcaccagcaatcccgaccgcaataaaagtttccatgatatgtattatcccaacatgagtgagaatacattaccggatcaaatcaccggatccggaatctga

SEQ ID NO: 918 - protein, 268 aa, Unknown
  Obtained from environmental sample
  misc_feature (1)..(268): Xaa is any amino acid
MFEETVATQYESGQGAINWRYLPKTKEIIWYSERDDWGHLYLYDATTGKLKNQITKGNWVVLRITKVDEKNRLVYFIANGQQPENPYFSQFCKIGFDGKNMTVLTPDAGTHQISWSPSENYFIDTWSKPDMPSVSVLRDKNGKKIVDLEKTDVSRLKATGWKPPTPVALKAHDGKTDIYGLVFTPTNLDPNKKYPVVDYIYPGPQGGSVGSWAFSAGRGDHQALAELGFVVIVIEGTSNPDRNKSFHDMYYPNMSENTLPDQITGSGI

SEQ ID NO: 919 - DNA, 402 bp, Unknown
  Obtained from environmental sample
  misc_feature (1)..(402): n is a, c, g, or t
ttgtcaaaaactgcacgattgaaaaatttaaaaatacatatcggctgttcaagtttcaacacaaaagattggtctggaattttttatccggaagaattgccacgttcaaaatggtttgatttctacacagaaaatttcagaacctatgaattaaatgctactttttataaatttccgaccgttagaactttaaataattggtacaaaaaaacgccagatgactttcagttatcggtcaaagcgccaaaaataattacgcatttaaagaaatttgaagattgcaaaaccgagattgattcgttttatgaaattgcttccgaaggactgaaagaaaaattaaaatgtattttatttcagcttccgccgagtttcagttatacggaagaaaggctgaatcgatga

SEQ ID NO: 920 - protein, 133 aa, Unknown
  Obtained from environmental sample
  DOMAIN (28)...(132): Protein of unknown function DUF72
  misc_feature (1)..(133): Xaa is any amino acid
MSKTARLKNLKIHIGCSSFNTKDWSGIFYPEELPRSKWFDFYTENFRTYELNATFYKFPTVRTLNNWYKKTPDDFQLSVKAPKIITHLKKFEDCKTEIDSFYEIASEGLKEKLKCILFQLPPSFSYTEERLNR

SEQ ID NO: 921 - DNA, 387 bp, Unknown
  Obtained from environmental sample
  misc_feature (1)..(387): n is a, c, g, or t
atgaatgacgattgggatgcgaaaaaagccattaaaaagctgaaagaaatctcagataagatgatntgcgatgcacttttggaccaagatattttttcaggattgggaaacattatcaagaatgaagttttgtaccgcgccagaattcatccggaatcattggtagggaaaattccgagtaaaaaaataaaggaaatcgtggacgaatctcgaatttatagttttgaattcttgaaatggaaaaagaaaaatgaactgaaaaaacattggcttgcccacacaaaaaaaatctgcaaacgatgcgatcttccgatgtttaaagaatatacgggaatcaaaaaacgcagaagtttcttttgtactaattgtcaaaaactgcacgattga

SEQ ID NO: 922 - protein, 128 aa, Unknown
  Obtained from environmental sample
  DOMAIN (2)...(82): Formamidopyrimidine-DNA glycosylase H2TH domain
  misc_feature (1)..(128): Xaa is any amino acid
MNDDWDAKKAIKKLKEISDKMXCDALLDQDIFSGLGNIIKNEVLYRARIHPESLVGKIPSKKIKEIVDESRIYSFEFLKWKKKNELKKHWLAHTKKICKRCDLPMFKEYTGIKKRRSFFCTNCQKLHD

SEQ ID NO: 923 - DNA, 405 bp, Unknown
  Obtained from environmental sample
  misc_feature (1)..(405): n is a, c, g, or t
ttggatagtttgggagttactaaaactggaaaactttctgaaatgaaaaatggtgatccaataaaagtttctgggcttatcaccgttcggcaacggccgggaacggcaaaaggcgtattatttattacgatagaagacgaaagcggtttcgccaatttggtcgtttgggacaccgtttttcaaaaacatagaaaggaaattgtacaagcgcgattgcttatggtggaaggaaaactgcaaattgaaggcaaagtcattcacgtgattgccaacaaatgttttaatctttcgccgcttttacgaaatatgaccgttgattcagacacctcaaaactttcgactttatcaagatctgacgaagatcctacggatgaaatttttcacaaaggtcgaaattttaggtaa

SEQ ID NO: 924 - protein, 134 aa, Unknown
  Obtained from environmental sample
  DOMAIN (21)...(96): OB-fold nucleic acid binding domain
  misc_feature (1)..(134): Xaa is any amino acid
MDSLGVTKTGKLSEMKNGDPIKVSGLITVRQRPGTAKGVLFITIEDESGFANLVVWDTVFQKHRKEIVQARLLMVEGKLQIEGKVIHVIANKCFNLSPLLRNMTVDSDTSKLSTLSRSDEDPTDEIFHKGRNFR

SEQ ID NO: 925 - DNA, 741 bp, Unknown
  Obtained from environmental sample
  misc_feature (1)..(741): n is a, c, g, or t
ttgaacaggcttgttgttaccgacaagccgggagcggaacgctatacttttgaaaattatagctatgaagaagatgcatccaacaaagcccttcataattacatctaccagattgaagaattggtagtaaagggaaagccttcgatctggctcagcaccaagaagggcctcaaaggattgttgaataataaacttcagaatttccttgtccccgataaatcgctcagtcattcgttcttccgcagcctgcttgcggtagatggcgagaactcatacctcattgcaggatcggagatgggactatccttgttcgatccggaaacacaacgctttgaaacggtcgcctacgatgactatcgcgaaatgaatattagccaccgaacgattaccgcattgtacattgatgaaggcggtgtgttgtgggtcggcacaaaaaaaggattgaacaaatttgacacctattcaaaggactttgaagcattccggacgacacagttcgataaatcaaagaacatcatcacaggggtacaaaattcttctctcggaggttattggatatcaaccattggtggtggacttttcaaattcgatggaaaagattctttcacacactataaaatcatcagccgggaagagaatgacttcaccgaatttattcaaaccctgtactccgataacaaaggaaatatctgggtgggtacggcaggtgcaggtgtctatcatttcaatgaaaaggaataa

SEQ ID NO: 926 - protein, 246 aa, Unknown
  Obtained from environmental sample
  misc_feature (1)..(246): Xaa is any amino acid
MNRLVVTDKPGAERYTFENYSYEEDASNKALHNYIYQIEELVVKGKPSIWLSTKKGLKGLLNNKLQNFLVPDKSLSHSFFRSLLAVDGENSYLIAGSEMGLSLFDPETQRFETVAYDDYREMNISHRTITALYIDEGGVLWVGTKKGLNKFDTYSKDFEAFRTTQFDKSKNIITGVQNSSLGGYWISTIGGGLFKFDGKDSFTHYKIISREENDFTEFIQTLYSDNKGNIWVGTAGAGVYHFNEKE

SEQ ID NO: 927 - DNA, 930 bp, Unknown
  Obtained from environmental sample
  misc_feature (1)..(930): n is a, c, g, or t
ttgatgtttgaggacttcacagaggtgtcgccaagagcaatcgaaatattgcaattgctggtggaaaagcatggcgaattggtcacttatcaggaaatagaagaaaaaatctggaaaggctataacagccacacttccttgtaccaacatatcgccagtttacgtaaggcgttgggagatgacccaggctcgcccacttttattaaaacggtttcccgacgtggttaccagtttatcggtgttttcaaagcgcttgatgatggcagtgaaactgttcctgaatcactacctgttgcggtaatcgtcaaaacccctaaaatccttaaaaccttaagcctggtagcttccgttgttgttttggccataggcgtaatgtttgggtatttatacctgagcaaacctgacgaaaatcccaaaattggccattacaaccaattgacagaagcccttaagcagataggtaaaccagaaactattattgccatagagatacaccaggaaaaagagactgtagaaaatttgccagtactcaatgcgctggccgccattaccaagcatcatttggaaagaaaaaaagagcagcacgttgtctatatacccgcgttcaagcgacccaacttttatccacgcctggaaaaacatttttctgactatggccagattcgttatgtattcaagccagtaattaccctggatggcaatcaaattacttatgggctttcggttatatcgttaacagatggctcatcaactccgtttatcaatatcagcgctatagattctatcgccaataacttgcctgaatttgaaaaggtattgttagaaaaacttaaaggggagagtttggttgatcctaatcagcttccaatcctcagccaaaatgcaacagctaatcagtattttgatgatgcgatggatattgccctttga

SEQ ID NO: 928 - protein, 309 aa, Unknown
  Obtained from environmental sample
  DOMAIN (4)...(78): Transcriptional regulatory protein, C terminal
  misc_feature (1)..(309): Xaa is any amino acid
MMFEDFTEVSPRAIEILQLLVEKHGELVTYQEIEEKIWKGYNSHTSLYQHIASLRKALGDDPGSPTFIKTVSRRGYQFIGVFKALDDGSETVPESLPVAVIVKTPKILKTLSLVASVVVLAIGVMFGYLYLSKPDENPKIGHYNQLTEALKQIGKPETIIAIEIHQEKETVENLPVLNALAAITKHHLERKKEQHVVYIPAFKRPNFYPRLEKHFSDYGQIRYVFKPVITLDGNQITYGLSVISLTDGSSTPFINISAIDSIANNLPEFEKVLLEKLKGESLVDPNQLPILSQNATANQYFDDAMDIAL

SEQ ID NO: 929 - DNA, 483 bp, Unknown
  Obtained from environmental sample
  misc_feature (1)..(483): n is a, c, g, or t
gtgtggttggtcatttctccccaaaatcnccctaaaaatgcagacggcctattaaataattatgaccgcttacatttagttagcaaagcgatagaaaatgatatgaggatgaaagcaagtgatattgaatttcatctcccgaaaccttcttatacagtcactactttgtcgtatttaaaagaaaaatatcctgagcatgaatttaccatcattatgggaagtgatagttttcaaaatctctctaagtggaaaaactttaaaattattgtaaataattaccagctaataatttataaaaggcctggctttggaatagaaaaccatctgggagctaaaataataattatgaacgctcctttattagaaatatcggctacatatatacgtgaacttgtaaaagaaaataaatcaataaagtatttagtgcctaataatatagaagaggaaataaaaactaataggttttacaatcaaaaaaaatag

SEQ ID NO: 930 - protein, 160 aa, Unknown
  Obtained from environmental sample
  DOMAIN (1)...(131): Cytidylyltransferase
  misc_feature (1)..(160): Xaa is any amino acid
MWLVISPQNXPKNADGLLNNYDRLHLVSKAIENDMRMKASDIEFHLPKPSYTVTTLSYLKEKYPEHEFTIIMGSDSFQNLSKWKNFKIIVNNYQLIIYKRPGFGIENHLGAKIIIMNAPLLEISATYIRELVKENKSIKYLVPNNIEEEIKTNRFYNQKK

SEQ ID NO: 931 - DNA, 855 bp, Unknown
  Obtained from environmental sample
  misc_feature (1)..(855): n is a, c, g, or t
atgtcttatccganttttgtaaaaaaattattagaaccgcaaattagcagtgacacatcacaagaactcaatgcgaatgtcatttataacgattatatttcccatatcgcctttctaaatggacaagaaattgatccgacaccattttataatgaaaaaattcaaggacagtactcaggtacgtgtgcatggcaagtaatcgcacaaattgcaaggaattatggatttgatagcttgcattttgaagaaattcattacgaaattgttcgtgccactttggttgaattttttcaatcacaaaaagcaactggctttaaagatttagcagcgttacatcagctcgaactaggtattaaaaattacgctttatttttaaaaagcttaagtgaaagagatcgattggaaccagcaagacaacaggctggcttggcactgattaaggatttaaatgcgcaattacaaattgcgcaaaaagcccaacctcaggaaacggtatcatccgtaaagaaaattgaaaatgtcgataaatttgaaatagatagcccttcttgggaagtactaggccactcaagtaaaagtaaactatcactcgtgtcaggaggaaggtatgctgaggcaattcacaaaacttctttagactttcaagagattgttaaattaatcaataaagaacttgctagggaatcagtgccagaacagctcgttgaagaaattcttcgtctcgagaaaattctgttaacgctgcctttgtccgaagaattttggaaaaaaatcactaaaaatgaattgttcagctttaataaaaagcttgtgttattaactgagaattatgtagaaaaaatgcaaaaaacttaa

SEQ ID NO: 932 - protein, 284 aa, Unknown
  Obtained from environmental sample
  misc_feature (1)..(284): Xaa is any amino acid
MSYPXFVKKLLEPQISSDTSQELNANVIYNDYISHIAFLNGQEIDPTPFYNEKIQGQYSGTCAWQVIAQIARNYGFDSLHFEEIHYEIVRATLVEFFQSQKATGFKDLAALHQLELGIKNYALFLKSLSERDRLEPARQQAGLALIKDLNAQLQIAQKAQPQETVSSVKKIENVDKFEIDSPSWEVLGHSSKSKLSLVSGGRYAEAIHKTSLDFQEIVKLINKELARESVPEQLVEEILRLEKILLTLPLSEEFWKKITKNELFSFNKKLVLLTENYVEKMQKT

SEQ ID NO: 933 - DNA, 525 bp, Unknown
  Obtained from environmental sample
  misc_feature (1)..(525): n is a, c, g, or t
atggcttgtttggaaagaatacatattccggaacttgaatccggcatacaatcatggtgggctgcccccaaacgaagacatacatggaaagggactgctcttgaactgatccggctgcatgaaacggtacaaatgatgatagaattgagtttcatgataaaaagcgctaagtacttccaggaaatctggctgcaaccggaaaattggaatttcccccggaagccccggtcgtcaaaaacgagcgcagtaccggatactccccgcttaaccgatgaagaaaaacaaaacccgtttttggtgctgatcaagaattgtaagctggacatcggttggttcagggacgaattgcataaacggctggaagccgcactggatactgaaatggacatagatgacacctatgatactcttggaaatataataaaaattatagaggctttatatgtgatcaatgatgctatcctcgataccggaaagagccagcgcttatttttaattcctggttgtgcagaaggtttgaagtaa

SEQ ID NO: 934 - protein, 174 aa, Unknown
  Obtained from environmental sample
  misc_feature (1)..(174): Xaa is any amino acid
MACLERIHIPELESGIQSWWAAPKRRHTWKGTALELIRLHETVQMMIELSFMIKSAKYFQEIWLQPENWNFPRKPRSSKTSAVPDTPRLTDEEKQNPFLVLIKNCKLDIGWFRDELHKRLEAALDTEMDIDDTYDTLGNIIKIIEALYVINDAILDTGKSQRLFLIPGCAEGLK

SEQ ID NO: 935 - DNA, 606 bp, Unknown
  Obtained from environmental sample
  misc_feature (1)..(606): n is a, c, g, or t
atgcagcaaaatttaaatcaaaattcaaacataggcactttagtcggtagaagggcgcctgattttacggcacatgcttatcatcaaaataagttcaaggatattagactaagcagcttaaaagggaagtgggtagttttagctttttatccaggagactttacttttatatgccctactgaattaagcagatttgcagatttacaccctgactttaagaaggttaatgctgaaatattaagtgtaagcaccgatagcgagcatgttcacaaagcctggtgggatcaatctcaatcaattaaaaaaattcaatatcctatgcttgcagataattccggaaaaatcagcaagatgtacggcgtctatattactgaaggagtagatgaaggaagagctcttcgcgctacttttataattgatcctgatgggatagtaagaagcgcagatatacatgataattccattggaagaagtgttaaggaagtgttaaggaaacttcaagcagctaattatgtcaggcagcatggcggggaagtttgccctgttgaatgggaagctggaagcaaaactttgaaacctggcataggcttagttggaaaaatttaa

SEQ ID NO: 936 - protein, 201 aa, Unknown
  Obtained from environmental sample
  DOMAIN (15)...(164): AhpC/TSA family
  misc_feature (1)..(201): Xaa is any amino acid
MQQNLNQNSNIGTLVGRRAPDFTAHAYHQNKFKDIRLSSLKGKWVVLAFYPGDFTFICPTELSRFADLHPDFKKVNAEILSVSTDSEHVHKAWWDQSQSIKKIQYPMLADNSGKISKMYGVYITEGVDEGRALRATFIIDPDGIVRSADIHDNSIGRSVKEVLRKLQAANYVRQHGGEVCPVEWEAGSKTLKPGIGLVGKI

SEQ ID NO: 937 - DNA, 717 bp, Unknown
  Obtained from environmental sample
  misc_feature (1)..(717): n is a, c, g, or t
atggttgcatgcagcatggaaaaggcattcatgataactcctgtttggagagctgaaaaacataatactatacgccatataaatgaaattaggcaaatggatattgaatgttcatttatgaaccaaatggatgtaatgagaattgaagaaaaatgcgtccagcatattatttcagaagttttaaagagaaataagtttgagattgaattgcttggattaaacgttaaagttccttctgctaaatatgcaagttatgatgagaccattgatttattgaagaaagctggaataaagatagctttgggagatgacttaaatcctgaagctgagaaaaaacttggagagttatatcctgacactttagtctttgttcattcttggccatcatcattaaaaccattttatataatgcctaaagatggtaaagaagattcagattattcagagggattcgattgtatttacaatggcatggaaataacttcaggggggcagagaattcatttgcctgaattactgctaaaaagaataaaacataaagggatgaaaactgacgggttaatggattatgtaaactcttttaggtatggagctcctcctcactccggctggagcattggcttagagcgactgacaatgcttatctgcggattggataatattcgtgaagctactatgttcccaagggacagagatagattaactcctttgatttaa

SEQ ID NO: 938 - protein, 238 aa, Unknown
  Obtained from environmental sample
  DOMAIN (1)...(232): tRNA synthetases class II (D, K and N)
  misc_feature (1)..(238): Xaa is any amino acid
MVACSMEKAFMITPVWRAEKHNTIRHINEIRQMDIECSFMNQMDVMRIEEKCVQHIISEVLKRNKFEIELLGLNVKVPSAKYASYDETIDLLKKAGIKIALGDDLNPEAEKKLGELYPDTLVFVHSWPSSLKPFYIMPKDGKEDSDYSEGFDCIYNGMEITSGGQRIHLPELLLKRIKHKGMKTDGLMDYVNSFRYGAPPHSGWSIGLERLTMLICGLDNIREATMFPRDRDRLTPLI

SEQ ID NO: 939 - DNA, 867 bp, Unknown
  Obtained from environmental sample
  misc_feature (1)..(867): n is a, c, g, or t
ttgcttactattgaacaaataactacacggtataatgagaaatttactatatatgaatcattaaaacatgaagttgaatctttaataaaaaagttattagtaattgataaaattatttatcaaaatattgcttcaagagtaaaaacattaaacagcgtccaaattaaattccgagaaaaacattataatgaatttacacaattaactgattttttaggaatacgaataattacatatactctatcagatgtagaaaaagtttgtaaaacaatagaatccaattttaatgtaatagaaattataagattcaaggatagattagaaagttcagctaaagttggatatttatcaatacatctcatttgtaaattttctgatgaaagaatacgattaacagaatattctcaatataataatatggtatttgaaattcaaataaggactattttacaacatgcttgggctgaaatagaacacgataaatacaaatttgaaggagatttccctcctgatattaaaagaagattcgacgtattgtctgcaactttagaattagttgattatgaatttgatactatttctaaactaaaagaagaatataccgcagatatttatagtaaaacacaaaaaagagatttacatatcccaataaatacaatttcaatagcggaatatttgagagataagttaaaagatattcctgaaatacatccaaactttggtagattagaagatagatcagcagatttaatagcagaattatcaagatttggtatacaatacataaaccaattagatgcattaattgaagaaaaatattttagagatttgaaaaaattagttcaaaatgattatgtcaactatggt

SEQ ID NO: 940 - protein, 289 aa, Unknown
  Obtained from environmental sample
  DOMAIN (45)...(166): Region found in RelA / SpoT proteins
  misc_feature (1)..(289): Xaa is any amino acid
MLTIEQITTRYNEKFTIYESLKHEVESLIKKLLVIDKIIYQNIASRVKTLNSVQIKFREKHYNEFTQLTDFLGIRIITYTLSDVEKVCKTIESNFNVIEIIRFKDRLESSAKVGYLSIHLICKFSDERIRLTEYSQYNNMVFEIQIRTILQHAWAEIEHDKYKFEGDFPPDIKRRFDVLSATLELVDYEFDTISKLKEEYTADIYSKTQKRDLHIPINTISIAEYLRDKLKDIPEIHPNFGRLEDRSADLIAELSRFGIQYINQLDALIEEKYFRDLKKLVQNDYVNYG

SEQ ID NO: 941 - DNA, 555 bp, Unknown
  Obtained from environmental sample
  misc_feature (1)..(555): n is a, c, g, or t
ttgactgctgcaggaagaattgtatccgggcagttaattagaactctcttaattaaaattcagaaagtggatcgaaaaattgaaaagggacgctggaataaaaaaagaatatggaccattgccggtattacggggattgccttgttaatttttgcaagcatctattttacttcgggcaaatcaaaactaaatgttgatgttgaaaggataaccattagcgaagtaagaaaagatgcattccaggaaactatcccgctaaatggcgtggtgcttccccaaaccactatttatcttgatgccgttgaaggtggaagggtagaagaaaaatatgtcgaggacggcgctttcctgaaaaaaggccagcccattctgcggttgtcaaatacagatttggaattaagtttggtaaaccagcaaacatctgtttacaacctgctgacacaaatgcagattgcaaaaaatgctgcgcaacaaaataccaccaccaagctcaatcaaaaaacaggatgtggaaagtgctttaaagaagcgaagcgcatttatgaatctggataa

SEQ ID NO: 942 - protein, 184 aa, Unknown
  Obtained from environmental sample
  misc_feature (1)..(184): Xaa is any amino acid
MTAAGRIVSGQLIRTLLIKIQKVDRKIEKGRWNKKRIWTIAGITGIALLIFASIYFTSGKSKLNVDVERITISEVRKDAFQETIPLNGVVLPQTTIYLDAVEGGRVEEKYVEDGAFLKKGQPILRLSNTDLELSLVNQQTSVYNLLTQMQIAKNAAQQNTTTKLNQKTGCGKCFKEAKRIYESG

SEQ ID NO: 943 - DNA, 885 bp, Unknown
  Obtained from environmental sample
  misc_feature (1)..(885): n is a, c, g, or t
ttggggagttcgggttacatttattcgggaatttcttcccaggtatttttggatgttaaaaccatgcacccactggaaattgcaacctttgcgggcagggttttaaacgagatcaacaccacgttcaaagtaatcagcaaggaaaaagaaacacaataccaatacctgcaaaaaatactggaattggttgacacgggtattttatcgtatgaaatagaaagtggcacagtggtgtggatgaatgaatctttaaaacgactgctgcagctaccctatttaaaaagtatatatagccttgaaaaaagagacaaattcctgttccaggaagtgttgtcgttacaaccaggaattacaaaaattaccacagcacacctggaaaaatcttctttcaaaattcttctgtcggcaactgcttttcaaacagaaggaaaaatttataaattgatcgcttttcagaatgtgagcgaagcattggatgaaacagaatcgaaagcatggcaaaaattgttgagtgtaatgacgcacgagatcatgaactccatcgctcctatttcctcacttgcagacactttaaaaaacaggttgcaacgaacagaaagaactaataatgcagatattgaagacctggaaattggaattgacaccatcaagcgaagaagcgaaggtttgttgaaatttgcagagacgtatcgcaatttgaataaaatcaccacgcttagtttgcaaaaagtttatatccgcgatttgtttggcaatatttaccaactgatgcaacccacactggcgcagaaaaatattgaactggaaattatcttaaaagaccctgccctgcaaattcaagccgatccaaatttatggaacaggtctaatcaattagtgaaataa

SEQ ID NO: 944 - protein, 294 aa, Unknown
  Obtained from environmental sample
  misc_feature (1)..(294): Xaa is any amino acid
MGSSGYIYSGISSQVFLDVKTMHPLEIATFAGRVLNEINTTFKVISKEKETQYQYLQKILELVDTGILSYEIESGTVVWMNESLKRLLQLPYLKSIYSLEKRDKFLFQEVLSLQPGITKITTAHLEKSSFKILLSATAFQTEGKIYKLIAFQNVSEALDETESKAWQKLLSVMTHEIMNSIAPISSLADTLKNRLQRTERTNNADIEDLEIGIDTIKRRSEGLLKFAETYRNLNKITTLSLQKVYIRDLFGNIYQLMQPTLAQKNIELEIILKDPALQIQADPNLWNRSNQLVK

SEQ ID NO: 945 - DNA, 828 bp, Unknown
  Obtained from environmental sample
  misc_feature (1)..(828): n is a, c, g, or t
ttgctaggtcgaggaacgttaatcaatccagatattttcctaaaggaggtaaaagaaaacaagctggagggaagaatttttattgatcgaggatgtactataattgaaccccatcacattgttgctgagaaagaattagttgagagaataggagctgtcggaacaggagtaggtcctgccagagtagatcgagttttaagatctgcaaaacttgcaaaagatatacctaagcttaagaaatatttaactgatgtggcagaagaagttgagaaagcaataattgccaaaaaggatgtgttgatagagggagtacaaggatatgggttgtcgctttttgattatagatattacccctacgttacttcacaggacactacagcgtctcaatttgctgctgacacaggtattggtccactatccgtaaacaatgtaatagttatttttaaagcatacgtttccagagtgggtacagatccaacatataaagagtggagcgaatcaaaagcaaaaaagatgggaattgaggagaggggtacggtttcaggccgaaaaagaaaactatccgactttaacattaatatggcagctgaggcaattaacagaaactctggacaccttgcagttctaacttgtattgataggctatttccaggaaatgaaagtgttcgagaatataaaaaactcacaaaagatgcaaaggactttattaaggtttttggaaacccagataaaaaaaaggctcctcgtttctcaggattccagaatatttccaaagggccccaacctcaacgaaatagtagatctttagtgatatcccccctgggaaag

SEQ ID NO: 946 - protein, 276 aa, Unknown
  Obtained from environmental sample
  DOMAIN (1)...(249): Adenylosuccinate synthetase
  misc_feature (1)..(276): Xaa is any amino acid
MLGRGTLINPDIFLKEVKENKLEGRIFIDRGCTIIEPHHIVAEKELVERIGAVGTGVGPARVDRVLRSAKLAKDIPKLKKYLTDVAEEVEKAIIAKKDVLIEGVQGYGLSLFDYRYYPYVTSQDTTASQFAADTGIGPLSVNNVIVIFKAYVSRVGTDPTYKEWSESKAKKMGIEERGTVSGRKRKLSDFNINMAAEAINRNSGHLAVLTCIDRLFPGNESVREYKKLTKDAKDFIKVFGNPDKKKAPRFSGFQNISKGPQPQRNSRSLVISPLGK

SEQ ID NO: 947 - DNA, 624 bp, Unknown
  Obtained from environmental sample
  misc_feature (1)..(624): n is a, c, g, or t
ttgataaaaggtcctgaaaatcgtttgagttctttgataaaagtttttaataaagctgctcttgaagtttgtgaaggccagcagtatgacatgaattttgaggttcatcctatcgtaactgaagaggattaccttaagatgattggtcttaaaacttcggttttaatagctgcttccctacaacttggatcaataattggcaatgcagatcaagaagatcaggaaaatttataccaatttggcttaaatcttggaattgctttccaattgcaggatgattttctggatacctatggaaatcaggcagaatttgggaaaaaaataggcaatgacattattgccaataaaaaaacttttctgcttgtaaaagccatcgaattctctaccggagaaactaaagaaagactgaattactggctaagagcagaaaagaatgaagaaaaagaaaaaataaagcaggttacttcgatttttgaccagttatctatttcaaaaatgacaaagaacaagatcaattattttcatcagttgtcattggatagtttaaggaaagtaaaagtagccccggagagaaaacaaattctgactgatttggctgagcagttaataatgagaaataattaa

SEQ ID NO: 948 - protein, 207 aa, Unknown
  Obtained from environmental sample
  DOMAIN (1)...(169): Polyprenyl synthetase
  misc_feature (1)..(207): Xaa is any amino acid
MIKGPENRLSSLIKVFNKAALEVCEGQQYDMNFEVHPIVTEEDYLKMIGLKTSVLIAASLQLGSIIGNADQEDQENLYQFGLNLGIAFQLQDDFLDTYGNQAEFGKKIGNDIIANKKTFLLVKAIEFSTGETKERLNYWLRAEKNEEKEKIKQVTSIFDQLSISKMTKNKINYFHQLSLDSLRKVKVAPERKQILTDLAEQLIMRNN

SEQ ID NO: 949 - DNA, 858 bp, Unknown
  Obtained from environmental sample
  misc_feature (1)..(858): n is a, c, g, or t
atgcagaagaataaagtctccttagctaatgttcaaagggcaatgattaaggatccatccaggggtggttctggacttcctccattcgattcacaaggagaagaagccatgattgcacttcatggcagaccagttttattgattagaaataataaaatcgaacgaccagattctgctgaagtgcttagaaaaattcgcccgtttattaagaaaattgaacactcaataccatccgttggcagattagaatttataaattcttcaaagttgtttggaggaacagcatggatgataactgagaatattgttgttaccaataggcatgtagcagaattgatagcacagaagaaaaacaaagtctttccatttaaaaccacatttaccggtctgatgggagccgtattagatttcaaagaggagtatgcaggcccaggggttgcttcccctgaatttgaaattgaaattgaaaaagtacttttcatgactgagtcaagaaaagatgtaccggatattgcgtttttaaaaataaagaatcacaaatatttacccccaccaattccgcttagtgaaagggcattatttgatagacagcaagtaagtgtaattgggtatcctgcagaaactgatacaggcataatcagtgagactgctgctttcaaggtgtttaaggatatctataatgttaagcgatgttctccaggtgatatcatgaatccattgaaggatcaatggtatttttcacactcttgtactaccctacagggtaactctggatctgtggtaattgaccatgaaactggtgcagcagttggcttgcatttctatggtttggttcaagatgcgaactatgcccgttaa

SEQ ID NO: 950 - protein, 285 aa, Unknown
  Obtained from environmental sample
  misc_feature (1)..(285): Xaa is any amino acid
MQKNKVSLANVQRAMIKDPSRGGSGLPPFDSQGEEAMIALHGRPVLLIRNNKIERPDSAEVLRKIRPFIKKIEHSIPSVGRLEFINSSKLFGGTAWMITENIVVTNRHVAELIAQKKNKVFPFKTTFTGLMGAVLDFKEEYAGPGVASPEFEIEIEKVLFMTESRKDVPDIAFLKIKNHKYLPPPIPLSERALFDRQQVSVIGYPAETDTGIISETAAFKVFKDIYNVKRCSPGDIMNPLKDQWYFSHSCTTLQGNSGSVVIDHETGAAVGLHFYGLVQDANYAR

SEQ ID NO: 951 - DNA, 921 bp, Unknown
  Obtained from environmental sample
  misc_feature (1)..(921): n is a, c, g, or t
ttgttttttactttttcctttacaaaccggaaaaagaaaatggcagatcatgttattaaacatggtgatgggataaaggcattggcccttttagtaaatgatgccacagatgcgtgggagcagacaacaaagggtggcgctgcatcctatatagaacctaagcgtttgaatgacgatgatggaacagtagtttatagcggcattcatacatatggagacacggttcatttatttatagaacgaaaaaactatcatggcgtttttatgcctggttatcgcaaatgggaaaatgctttttttcaatcatcctcaaccggtttgcaatatgtagatcattgcgtgggcaatgttggctggaatggaatgaacaaatgggtaaaattttatgaagaagtgatgggcttcaaaaacatcttaacttttgacgataatgatatttctaccgagtactctgccttgatgagtaaggtaatgagtaatggaaacggctatgtaaaatttcctatcaatgaaccggctgaaggaaagaaaaaatcgcaggtagaagaatatttggaattttatcatggcgaaggtgtgcagcatgtggcattggcaactaacgatattgtgcgaacggttacagaattaagaagcaggggtatcgattttttggaagtgcccaccagctattatgaccatattgaggacaggatcggtacaatagatgaagaccttaatccgttaaagacactgggtattttggtggaccgcgatgatgaaggatatttactgcagatatttacgaagcctgtgcaggacaggcctaccattttttttgagataattcaacgcaagggagcaaagagttttggaaagggaaattttaaagcattatttgaagccatagaacgtgaacaagccttacggggaaatctctaa

SEQ ID NO: 952 - protein, 306 aa, Unknown
  Obtained from environmental sample
  DOMAIN (109)...(260): Glyoxalase/Bleomycin resistance protein/Dioxygenase superfamily
  misc_feature (1)..(306): Xaa is any amino acid
MFFTFSFTNRKKKMADHVIKHGDGIKALALLVNDATDAWEQTTKGGAASYIEPKRLNDDDGTVVYSGIHTYGDTVHLFIERKNYHGVFMPGYRKWENAFFQSSSTGLQYVDHCVGNVGWNGMNKWVKFYEEVMGFKNILTFDDNDISTEYSALMSKVMSNGNGYVKFPINEPAEGKKKSQVEEYLEFYHGEGVQHVALATNDIVRTVTELRSRGIDFLEVPTSYYDHIEDRIGTIDEDLNPLKTLGILVDRDDEGYLLQIFTKPVQDRPTIFFEIIQRKGAKSFGKGNFKALFEAIEREQALRGNL

SEQ ID NO: 953 - DNA, 828 bp, Unknown
  Obtained from environmental sample
  misc_feature (1)..(828): n is a, c, g, or t
atggatgatgcttttgacatctggaaaatcaaagggttggaagatggtgtggatgttgcagattcctatgccagcatttttgagtccatcaaacctgttgcagatgaaatgctttacaacgttaaactcaatcttgaccgcaacataaaagagaacaataaaagaggaaccgttatgtacaacctgttgtataaactgtttctttctgtggacaccacaaagaacattgatcttacaaaggagtttggaattccgccggtctacagcatcaattatcaaacactggtagatgattcggcacacaaagtggtcatgcaggttttcttttatggagatgatgatggcaagatgaattacaatggttttatttcggaactgaacagggcgggctggaaagttacagccgatactagatattggcttgccttctcctcaccaaaagggcagccggtggttatttatgccaataagtggttcgatgatgaaaaagaggaaggcgttattgaaaaggcgcaaggtgcattaaggcagtatcttgaagaaaaaaatattcaaccgactattgttgttcatcggggccatagttattgggtgtcttccaccattgagcaaattcaacccgcagcaaaggtggttttgctgggttcatgcggcggatacaatgtaattcataatgtattgcagcatgcgccggatgcgcatatcattgcttccaagcaaacaggtaaaaaagacattaaccagcctttcatgaatattttaaatgaaaagttgaagaatggaagcaatatcgactggatcccgcttttggaaagaattccagggtaa

SEQ ID NO: 954 - protein, 275 aa, Unknown
  Obtained from environmental sample
  misc_feature (1)..(275): Xaa is any amino acid
MDDAFDIWKIKGLEDGVDVADSYASIFESIKPVADEMLYNVKLNLDRNIKENNKRGTVMYNLLYKLFLSVDTTKNIDLTKEFGIPPVYSINYQTLVDDSAHKVVMQVFFYGDDDGKMNYNGFISELNRAGWKVTADTRYWLAFSSPKGQPVVIYANKWFDDEKEEGVIEKAQGALRQYLEEKNIQPTIVVHRGHSYWVSSTIEQIQPAAKVVLLGSCGGYNVIHNVLQHAPDAHIIASKQTGKKDINQPFMNILNEKLKNGSNIDWIPLLERIPG

SEQ ID NO: 955 - DNA, 807 bp, Unknown
  Obtained from environmental sample
  misc_feature (1)..(807): n is a, c, g, or t
atgtcaaagccaaattttggttggagagaatattggatcggtaaagatgcacaaattggagaaaaatccatatcaaaagtcgatccaaccttagcaccattaaaatcttttcttggtttacttggtattataggtattacggcttatgttggactatttaagataggtaaccttagagaaagtcaaaaaactgtttttgtatcctctgcggctggaggggtaggcagtgttgtatgccagttggcaaagataaaaggctgtcatgttgtaggcagctgtggaagtgatgaaaaagtaaaatggttagttaatgaactcggagtagactacgcttttaactatagaaagatcggtttggacaacatgactgacgagctaaaaagagcatgtccaaatggaatcgatctatactttgataatgttggaggtaagcaccttgaagcagctattgacaacatgaatacttttggaagaattactttgtgtggaactacctctcaatacaataataatgacgatgcatactatgataaccaaaactcaaaccatagagtcactaaatcaatctcagaaggtccttccaatctatcattggctgtttcgcatagactcacacttcaaggttttatttggagcgatcactatgatattttgaatgaatttaatacaaacatgtctaaatggattagggaagataagataaaacttaaagaaagtattattgaaggattggaaaatgcaccacaggcctttgccggtctatttagaggggatactataggtagaactctaattaaattgtattag

SEQ ID NO: 956 - protein, 268 aa, Unknown
  Obtained from environmental sample
  DOMAIN (2)...(267): Zinc-binding dehydrogenase
  misc_feature (1)..(268): Xaa is any amino acid
MSKPNFGWREYWIGKDAQIGEKSISKVDPTLAPLKSFLGLLGIIGITAYVGLFKIGNLRESQKTVFVSSAAGGVGSVVCQLAKIKGCHVVGSCGSDEKVKWLVNELGVDYAFNYRKIGLDNMTDELKRACPNGIDLYFDNVGGKHLEAAIDNMNTFGRITLCGTTSQYNNNDDAYYDNQNSNHRVTKSISEGPSNLSLAVSHRLTLQGFIWSDHYDILNEFNTNMSKWIREDKIKLKESIIEGLENAPQAFAGLFRGDTIGRTLIKLY

SEQ ID NO: 957 - DNA, 426 bp, Unknown
  Obtained from environmental sample
  misc_feature (1)..(426): n is a, c, g, or t
atgaactttatacgattattcagagacattgaacttggtgaatggagggttgccaacagagttacgaaagttacttatcaaaaggcttttgtgattggctcttacctgcaagagaaaatagggatagaaatagaggtcaatgatggcaatcctgaattagcccttcaacaagccaaatccatcgccgaaaaattccacaaggataataacccgcagctaaccgatggggttgaatataatccaaatggtagatacgagccgccaatattaacccccatcccatcattagaccgaaaagccatcgaaagacttgagatattaattgatgatgcaaaaacgcttggtgatttggagtggctggttgaagaagttgaaaaatacggattgcaaaaccattacaacaataaactaaaacaactatcatga

SEQ ID NO: 958 - protein, 141 aa, Unknown
  Obtained from environmental sample
  misc_feature (1)..(141): Xaa is any amino acid
MNFIRLFRDIELGEWRVANRVTKVTYQKAFVIGSYLQEKIGIEIEVNDGNPELALQQAKSIAEKFHKDNNPQLTDGVEYNPNGRYEPPILTPIPSLDRKAIERLEILIDDAKTLGDLEWLVEEVEKYGLQNHYNNKLKQLS

SEQ ID NO: 959 - DNA, 558 bp, Unknown
  Obtained from environmental sample
  misc_feature (1)..(558): n is a, c, g, or t
ttggctcgtaatctctcgaaatctattaaccttagtgtaaattgcaaaatgattgcaacggtctacaaatctacaggtagctggtacctggttaaaactgaagaaggtaaggaacttaacgcacgcataaaaggcaaatttaaaattgacggcattacatctacaaatcccatagctgttggcgataacgtaaatgttgaaatggaaaatgaagctgaaggatcggctgttatagatgatatctatccacgaaaaaattacatcaaccgtcagtcacctcacaataaaaatcagcatcatataattgcagccaaccttgaccaatctttactatttgctaccttaaaagatcctaaaacttcccagggctttattgaccgttttttaattacttcagaagcctatcatattcctgcaataatcgtttttaataaaacagatctctacaaaaaaaaagaactcgaaaaattagatgaactaacattgatttataaaacgattggttatgttgttcaaaccatgagtattgtaaatggcagccggtgtaaacgaggttaa

SEQ ID NO: 960 - protein, 185 aa, Unknown
  Obtained from environmental sample
  misc_feature (1)..(185): Xaa is any amino acid
MARNLSKSINLSVNCKMIATVYKSTGSWYLVKTEEGKELNARIKGKFKIDGITSTNPIAVGDNVNVEMENEAEGSAVIDDIYPRKNYINRQSPHNKNQHHIIAANLDQSLLFATLKDPKTSQGFIDRFLITSEAYHIPAIIVFNKTDLYKKKELEKLDELTLIYKTIGYVVQTMSIVNGSRCKRG

SEQ ID NO: 961 - DNA, 516 bp, Unknown
  Obtained from environmental sample
  misc_feature (1)..(516): n is a, c, g, or t
ttggcacaccttacgttttatcaagcccgggacgagtccggttttcgaatacaacaaaatgcgatatttcgagacaatccaggtgacgattacgggatggagtcttccataaatttggagttcttccttcatccgcgcaatttcgatgaactgaaacacgttcagagcggccttatcccctcaacggtgcaaattcagttcgaccacaaactgggagataaaacgtcacctatccaatttggttgggagccggacggcagtggaaagaagtggaacaacaaaactgaggagaagagacaggttccaatcgaaacgctgtccttccaatatgagctacttaaagagagtgaagaccctgataccggcgagaggctaacgagcgcctcggttccggacatagcgcacaaatacgggaaggaattaaaagagggactctccaagttggagagggaggttaagcacattggctggctcatagtaggtgcgaccatcctcgcattgttgatcttgcattga

SEQ ID NO: 962 - protein, 171 aa, Unknown
  Obtained from environmental sample
  misc_feature (1)..(171): Xaa is any amino acid
MAHLTFYQARDESGFRIQQNAIFRDNPGDDYGMESSINLEFFLHPRNFDELKHVQSGLIPSTVQIQFDHKLGDKTSPIQFGWEPDGSGKKWNNKTEEKRQVPIETLSFQYELLKESEDPDTGERLTSASVPDIAHKYGKELKEGLSKLEREVKHIGWLIVGATILALLILH

SEQ ID NO: 963 - DNA, 372 bp, Unknown
  Obtained from environmental sample
  misc_feature (1)..(372): n is a, c, g, or t
atgatccagtttaaacttgatccaaagacaggttctccgttttacaggcaaattatcgatcaaatcaaatttgggatcgcagcaggaaacctaaagacaggtgagcaattaccgactgtaagatcattggcggttgaattgcgtgtgaacctgaataccgtggcaaaggcttacaaggaactggaaattcaaaatgttctggaaacgcaccagggcacaggtacatttataagtagtgatgtgaaaattcagctgcctgcgaaggaacgtcaaaacaaactgaaagaaatatgcaatgagttttcatcgattgcattcagctatggtttctcgatagatgacattatcaaccaactaaaaaaacaaaaataa

SEQ ID NO: 964 - protein, 123 aa, Unknown
  Obtained from environmental sample
  DOMAIN (14)...(77): Bacterial regulatory proteins, gntR family
  misc_feature (1)..(123): Xaa is any amino acid
MIQFKLDPKTGSPFYRQIIDQIKFGIAAGNLKTGEQLPTVRSLAVELRVNLNTVAKAYKELEIQNVLETHQGTGTFISSDVKIQLPAKERQNKLKEICNEFSSIAFSYGFSIDDIINQLKKQK

SEQ ID NO: 965 - DNA, 594 bp, Unknown
  Obtained from environmental sample
  misc_feature (1)..(594): n is a, c, g, or t
ttgcgagttggaactgttggcaaagtcatgccacatcaggaacagaagatcatcgatcttgcgacaggaaaaattctgccccgcggcgaacaaggcgaactttgttatcgtggttatcaaatcatgaaggggtataaccgaaatcctgaaggaacacgggatgccattgatgacaatggatggatgcacagtggtgatcttgccgtgatgaatcccaatggttacgtaaagattaccgggcgtctcaaggacatgattattcgtggaggtgaaaacatttatccgcgggagatcgaggaatttttattcaccaatcccaaagtggccgaagcttatgtcattggtgtgcctgacaaacattacggtgaacaagtcatggtatgggtgaaagtaaaagagggctcaaccatgacagaggatgaagtccgacaattctgtaagggtcagatcatggattataaaattccgaagtacgtcaaaattgttcaggaattccccaccaccgtcactggcaaaatccagaagttcaagatgaaggaagtaagtgtcaaggaacttggccttgaagaactcctaaaacttaaaacagcttag

SEQ ID NO: 966 - protein, 197 aa, Unknown
  Obtained from environmental sample
  misc_feature (1)..(197): Xaa is any amino acid
MRVGTVGKVMPHQEQKIIDLATGKILPRGEQGELCYRGYQIMKGYNRNPEGTRDAIDDNGWMHSGDLAVMNPNGYVKITGRLKDMIIRGGENIYPREIEEFLFTNPKVAEAYVIGVPDKHYGEQVMVWVKVKEGSTMTEDEVRQFCKGQIMDYKIPKYVKIVQEFPTTVTGKIQKFKMKEVSVKELGLEELLKLKTA

SEQ ID NO: 967 - DNA, 906 bp, Unknown
  Obtained from environmental sample
  misc_feature (1)..(906): n is a, c, g, or t
atgacccaaatcccaagcgggggccattacgtctgggcatcggaagacgagaaatacctgtttttgagtatttctgaacagggcagaaaaggcaaccagctttttttcaaaaagtctatgcagacaaaagatactttcaggccaatctcaactgatatggatgcaagcatttacccggtacagaactatgagagcagggtgtatttctacactgatcaaaatgcgccgaacagcaaggtagtttctgctgatcttgataatttagataaagggttgagggatgttctgcccgaaagcgataattcgcttgatgatataaacattgttggcggtaagatgatagcggtatatatgatagatgtgaccgataaagtttttgtgtacgacctggacggaaagttccggtatgaacttaagcttccctcacccggcaatgtattcgggttcaacggcaggaaagatgataagacggttttttacggatttacttcgatgatatcgccgcaatcaatttatttatacgatatagaaaagaacgaatcgaaactgttcaggtcttcggaagtaaagttcaaccctgatgaatatgaatcgaagcaggtctttttctcaagcaaagatggtactcgagtaccgatgtttttggtttataaaaaaggacttaagctcgatgggaacaatcctgtttacctgtacgggtacggcgggttcagtatcagcatgaagccgtatttcagcatttcaaggataatactacttgaaaacggcggcgtatttgcaatgccctgcatcaggggcggcggcgagtacggcgagaaatggcacgaagccggaacaaagctcaataaacagaatgtgttcgacgattttatcgccgcggcggagtacctgatagctgaaaaataa

SEQ ID NO: 968 - protein, 301 aa, Unknown
  Obtained from environmental sample
  misc_feature (1)..(301): Xaa is any amino acid
MTQIPSGGHYVWASEDEKYLFLSISEQGRKGNQLFFKKSMQTKDTFRPISTDMDASIYPVQNYESRVYFYTDQNAPNSKVVSADLDNLDKGLRDVLPESDNSLDDINIVGGKMIAVYMIDVTDKVFVYDLDGKFRYELKLPSPGNVFGFNGRKDDKTVFYGFTSMISPQSIYLYDIEKNESKLFRSSEVKFNPDEYESKQVFFSSKDGTRVPMFLVYKKGLKLDGNNPVYLYGYGGFSISMKPYFSISRIILLENGGVFAMPCIRGGGEYGEKWHEAGTKLNKQNVFDDFIAAAEYLIAEK

SEQ ID NO: 969 - DNA, 900 bp, Unknown
  Obtained from environmental sample
  misc_feature (1)..(900): n is a, c, g, or t
gtgcatcagatgtatatttgcaatgttaagatagtctgcacggataaaaccggcacattgacgcagaataagcttgcagtgcaaaagattactcccctgaccgataaatactccacagcagaaattgaaacactcctcggcacatacgcaaagctttcatctgataagaacgcgacactcaggactctggaagtatataatagtgatagcagcgcaaaagtaattgaggaaattcctttcagctcagagaataagatgagtctgctgcaattagcaatgagcaatgatcaattagcaataaaagataaagaaataaccattgtgtttggcgggtatgatatactgaatgaaagatccgcagggaaacaaaaggcagaggaaatttttgagaaagacgggctgaaggtttacagaaacctgttattcggacttgagacctcggggagaccgctcaaagagcttgaggaagatcttggatcggtgaagatagagcctgtttgcattgtatcaattactgaccaggtaagggatgatgtgatggaggcaataaatctcttccacaagaatgatattgagataaagatactatccggtgataacgcttttgcaattcaggcagttgcaaaagaaataggctggaacatcaatgacagcgagcttatttcaggcagtgaaattgaaaagataagcgatgacgacttctttgatactgtgatgaagaaaaagatatttgcccgccttaagcctgagcataagctgaggataatcaaagcgctcagaaaagaaaagatatacactgcaatgataggtgacggcgttaacgatttgcctgctattaaagagtcagatatgggtattgccatgnnagaaggcagcccgatcacgaaaagaaaccgctga

SEQ ID NO: 970 - protein, 299 aa, Unknown
  Obtained from environmental sample
  DOMAIN (9)...(292): haloacid dehalogenase-like hydrolase
  misc_feature (1)..(299): Xaa is any amino acid
MHQMYICNVKIVCTDKTGTLTQNKLAVQKITPLTDKYSTAEIETLLGTYAKLSSDKNATLRTLEVYNSDSSAKVIEEIPFSSENKMSLLQLAMSNDQLAIKDKEITIVFGGYDILNERSAGKQKAEEIFEKDGLKVYRNLLFGLETSGRPLKELEEDLGSVKIEPVCIVSITDQVRDDVMEAINLFHKNDIEIKILSGDNAFAIQAVAKEIGWNINDSELISGSEIEKISDDDFFDTVMKKKIFARLKPEHKLRIIKALRKEKIYTAMIGDGVNDLPAIKESDMGIAMXEGSPITKRNR

SEQ ID NO: 971 - DNA, 468 bp, Unknown
  Obtained from environmental sample
  misc_feature (1)..(468): n is a, c, g, or t
atgatagatcggattaaatcactggcaaaaaaatatgcgccggaatttattgagataagacagcatttgcatgcacatcctgaacttagttaccaggaatttgaaacgtcgaaatttgtgcagcataaattggaagaatacaatataccttttgaaataaaagctaccaccggcattgttggtgtaatcaagggaaagaacccagagtcaagggtgattgctttgcgtgccgacatggatgcgttaccaatctcagaaaaaaatgatgttccatataaatcaaaaaatgaaggagtaatgcatgcatgcggtcatgatgtacatacaacctgcctgctgggtgcatcaagaatattatctgaaactacaaatgactgggaaggtactgtgaagcttttttttcagcctggtgaagaacgaaatcccggaggtgccagcttgttaattaaagactggtgccttagataa

SEQ ID NO: 972 - protein, 155 aa, Unknown
  Obtained from environmental sample
  DOMAIN (71)...(155): Peptidase family M20/M25/M40
  misc_feature (1)..(155): Xaa is any amino acid
MIDRIKSLAKKYAPEFIEIRQHLHAHPELSYQEFETSKFVQHKLEEYNIPFEIKATTGIVGVIKGKNPESRVIALRADMDALPISEKNDVPYKSKNEGVMHACGHDVHTTCLLGASRILSETTNDWEGTVKLFFQPGEERNPGGASLLIKDWCLR

SEQ ID NO: 973 - DNA, 336 bp, Unknown
  Obtained from environmental sample
  misc_feature (1)..(336): n is a, c, g, or t
atgcaaattgaaaaagtaattgctaatgaaagccattgtgcatttgtggcggtattagaagaaaaggttatcggttggattcacgcctttgtagctttatcaatagaaacaaaatcttttgttgaaatagggggcttggtggttgatgaaaaatacagaaatcttggaaccgggaaaaaattgatagagaatataaaagaatgggcaatttcaaaaaagataaatacacttagggtaagaacgaataccaaaagatcaaagacacatgccttttacttaaataacaattttaaagaaataaaagaacaaaagatttttcaactgcaattagcgtaa

SEQ ID NO: 974 - protein, 111 aa, Unknown
  Obtained from environmental sample
  DOMAIN (15)...(98): Acetyltransferase (GNAT) family
  misc_feature (1)..(111): Xaa is any amino acid
MQIEKVIANESHCAFVAVLEEKVIGWIHAFVALSIETKSFVEIGGLVVDEKYRNLGTGKKLIENIKEWAISKKINTLRVRTNTKRSKTHAFYLNNNFKEIKEQKIFQLQLA

SEQ ID NO: 975 - DNA, 708 bp, Unknown
  Obtained from environmental sample
  misc_feature (1)..(708): n is a, c, g, or t
gtgatcattcttaaaggaaacctttttgcgcataccatttataaggacgttggatacaaacggatgaacgattttgatatccttattaaacaggaagattgggaaaaagcacaggatgtgtaccattctttaggttttattccccttggttttggctggagtggagaaaagcagaaagtggccaagttcagtcatgtgggtatgtcttatatcagtcccgatttttcttgtattattggaacgcagtggggattaaaatctcccactgctgcatttaaggtaaatattactgaagcctggaaaacaagcagagattttaatttttatgacctgagggtcaaacaactttctccggaatataatttactgcatcttgttttacatctgggaatatacaaatgcgggatccgcgatctcatggatgtttacaatctgattttaaaagatcaacccgatccttctaaatttgctgaactagcaaaacaatccaatgccatagaaaaagccatttttactttggaactggctggatgttgcgcggatttaaatccggattatctgcaagctttacgaaaacacagtcagagcaatggttttatcagcagaagactgaaaaaaagaaaggtcctacaggagcaatgcggtgaccttcaaaattcttacaacgattattttcaagacattgaaaagcgtggtgatctattttaa

SEQ ID NO: 976 - protein, 235 aa, Unknown
  Obtained from environmental sample
  misc_feature (1)..(235): Xaa is any amino acid
MIILKGNLFAHTIYKDVGYKRMNDFDILIKQEDWEKAQDVYHSLGFIPLGFGWSGEKQKVAKFSHVGMSYISPDFSCIIGTQWGLKSPTAAFKVNITEAWKTSRDFNFYDLRVKQLSPEYNLLHLVLHLGIYKCGIRDLMDVYNLILKDQPDPSKFAELAKQSNAIEKAIFTLELAGCCADLNPDYLQALRKHSQSNGFISRRLKKRKVLQEQCGDLQNSYNDYFQDIEKRGDLF

SEQ ID NO: 977 - DNA, 462 bp, Unknown
  Obtained from environmental sample
  misc_feature (1)..(462): n is a, c, g, or t
atggctaaaaaattatatttaaaatctgtgattaaacggtttaaattctacaaagatttaggcgataaaacttttgagcaactacatgaggatgattttgattttgttcccgcggaagagtgtaacagtattggaataattattcagcacttaagtggcaatatgcttagcaggtttacagattttttaaccacagatggagaaaaggaatggcgccaacgggatgctgaatttgaaaaaagcggtttgacaaaagaacaactaataaatctttgggaaaaaggatggacttgtgttatcgaaacactggatgaactcagacctaaagatcttaaaaaaactattaccatacgcggtgagtccctgtcagttgttgatgcaattaacaagcaacttgctcactatgccttaccatgtgggaacaaatcatctatgcccggaaagaattatccaaaaaattaa

SEQ ID NO: 978 - protein, 153 aa, Unknown
  Obtained from environmental sample
  DOMAIN (42)...(80): Protein of unknown function (DUF1572)
  misc_feature (1)..(153): Xaa is any amino acid
MAKKLYLKSVIKRFKFYKDLGDKTFEQLHEDDFDFVPAEECNSIGIIIQHLSGNMLSRFTDFLTTDGEKEWRQRDAEFEKSGLTKEQLINLWEKGWTCVIETLDELRPKDLKKTITIRGESLSVVDAINKQLAHYALPCGNKSSMPGKNYPKN

SEQ ID NO: 979 - DNA, 366 bp, Unknown
  Obtained from environmental sample
  misc_feature (1)..(366): n is a, c, g, or t
atgcttagcaggtttacagattttttaaccacagatggagaaaaggaatggcgccaacgggatgctgaatttgaaaaaagcggtttgacaaaagaacaactaataaatctttgggaaaaaggatggacttgtgttatcgaaacactggatgaactcagacctaaagatcttaaaaaaactattaccatacgcggtgagtccctgtcagttgttgatgcaattaacaggcaacttgctcactatgcttaccatgtgggacaaatcatctatgccggaaagattatcagaaataaagagtggaaaaatctatctatgccaaaaaataaaccggtatcaactggcacagtaaacagcccttattattaa

SEQ ID NO: 980 - protein, 121 aa, Unknown
  Obtained from environmental sample
  DOMAIN (1)...(26): Protein of unknown function (DUF1572)
  misc_feature (1)..(121): Xaa is any amino acid
MLSRFTDFLTTDGEKEWRQRDAEFEKSGLTKEQLINLWEKGWTCVIETLDELRPKDLKKTITIRGESLSVVDAINRQLAHYAYHVGQIIYAGKIIRNKEWKNLSMPKNKPVSTGTVNSPYY

SEQ ID NO: 981 - DNA, 675 bp, Unknown
  Obtained from environmental sample
  misc_feature (1)..(675): n is a, c, g, or t
atgacgcatctggaggaggaattgacttttttaaaagcagaaatcacggaaatgtggcaaatggtgatttcacaattgcaaaagacacgtgaagccatgctccagtttgataaagacctggcgcgtgaagtggtcgccacagaaaagcggatcaattcacttgaactgaagatcgaccgcgattgtgaaaacatatttgcactcttcaatcccgttgcagtggatctacgcactgtcctcgcaatccttaagatcaataacaacctggaacgctcgggtgacatagccgaaggcattgccaagtatatcatttttgcagatcttcctttcgaccaggaattgctggattcaacgcagatattgcggatgtacgaagagtccaccggcatcctggaggatgtgctgacctcgtttgaaaatgaagataccaggctggcgcgtagtattttcaaaagagatgagctggtggatgagatcaatatcaacgccacaggtgtcgtggcggactacatacgtacgcatcctgataaaatagaggaaggattatacatcatctccatgatccgtaagctcgagcggattggcgaccattgcaagaatatagcggaagaaattattttcaactacgaagcgaaagtgctcaagcacaaaggaaaaaaaagaaaaatggaatga

SEQ ID NO: 982 - protein, 224 aa, Unknown
  Obtained from environmental sample
  DOMAIN (120)...(205): PhoU family
  misc_feature (1)..(224): Xaa is any amino acid
MTHLEEELTFLKAEITEMWQMVISQLQKTREAMLQFDKDLAREVVATEKRINSLELKIDRDCENIFALFNPVAVDLRTVLAILKINNNLERSGDIAEGIAKYIIFADLPFDQELLDSTQILRMYEESTGILEDVLTSFENEDTRLARSIFKRDELVDEININATGVVADYIRTHPDKIEEGLYIISMIRKLERIGDHCKNIAEEIIFNYEAKVLKHKGKKRKME

SEQ ID NO: 983 - DNA, 519 bp, Unknown
  Obtained from environmental sample
  misc_feature (1)..(519): n is a, c, g, or t
gtggaagaattgagaaaggatgtagggatggtctttcaaaagccaaatccttttcccaaatccatttatgaaaatgtgatctatggactgaggatccagggcatcaataaaaaatctgttcttgatgagactgtcgaacgctccctgaaaagagcagcaatatgggacgaagtaaaagacaatctcagtaaatcagcgctgtctctatccggggggcaacaacagaggatctgtatcgcacggacacttgcagtggaaccatcgatcgtcctgatggatgaacctgcttcggcattggacccgatctccagtgcaaaaattgaggaactcatctatgaactcaagacacaatacacgatcatcatcgtcacgcacaatatgcagcaggcaggtcgcgtgagcgataaggtggcattcttttatctcggcgaactgattgagttttcagagacgaaggagttatttatcaatcccaagcaggaactcactcaaaactacatcacagggaggtttggataa

SEQ ID NO: 984 - protein, 172 aa, Unknown
  Obtained from environmental sample
  DOMAIN (1)...(143): ABC transporter
  misc_feature (1)..(172): Xaa is any amino acid
MEELRKDVGMVFQKPNPFPKSIYENVIYGLRIQGINKKSVLDETVERSLKRAAIWDEVKDNLSKSALSLSGGQQQRICIARTLAVEPSIVLMDEPASALDPISSAKIEELIYELKTQYTIIIVTHNMQQAGRVSDKVAFFYLGELIEFSETKELFINPKQELTQNYITGRFG

SEQ ID NO: 985 - DNA, 450 bp, Unknown
  Obtained from environmental sample
  misc_feature (1)..(450): n is a, c, g, or t
atgcaagagacatttatcataatgagcaaatccttttctataaacgcaatgactggggccaataagcgctttaaaacatcagaagcacgtgactgggaaaccacagtgttgcaccaactaaacagtaaacagaataaacaaaaattcgagaatttaaggtctcattttgaccctaatagacatagctacgcagtaaccataattgtgtactatcctgagacagatttctacacaaaaaaaggtttaattagcgctcacactcaggacgtgtctaattacgaaaagcccctgatagacttagtatttctacccaagtacttcgcacaggacccgccttacggctgtcagaatttaaattgtgatgataaatatattacccgcatgtttagcagtaaacgcccaggtactgagaataagctgatagtacgtttgaaaataataaacagatag

SEQ ID NO: 986 - protein, 149 aa, Unknown
  Obtained from environmental sample
  misc_feature (1)..(149): Xaa is any amino acid
MQETFIIMSKSFSINAMTGANKRFKTSEARDWETTVLHQLNSKQNKQKFENLRSHFDPNRHSYAVTIIVYYPETDFYTKKGLISAHTQDVSNYEKPLIDLVFLPKYFAQDPPYGCQNLNCDDKYITRMFSSKRPGTENKLIVRLKIINR

SEQ ID NO: 987 - DNA, 456 bp, Unknown
  Obtained from environmental sample
  misc_feature (1)..(456): n is a, c, g, or t
ttgaatgactcattgaaatttgccaatgtaaaaaaatttgatgccttgaagcgtactgcttttgttggtggtggattaaaaatatttaactccacaccttatgtgggtttgcattttggaagtattgaaattaacggcgccttatttggatcgtatataatggctggctattattattccccatacctccaggtggtaacgtccaaggactcgctgcaatttcaaaactaccgcaataatatttacctcgaagcaggcatcaatgcttttggttcaaaagtgcccagcattttacgaacgcttaaattgaaattcggccttatgctgccagtaaaaggaagaaagaaagacgatctaaaaccggaagcaaaagatgtgatctcccgacttgctattgaagtaccgctcggagccgtatttcgtttttttctataccacaaaatatggcatcattaa

SEQ ID NO: 988 - protein, 151 aa, Unknown
  Obtained from environmental sample
  misc_feature (1)..(151): Xaa is any amino acid
MNDSLKFANVKKFDALKRTAFVGGGLKIFNSTPYVGLHFGSIEINGALFGSYIMAGYYYSPYLQVVTSKDSLQFQNYRNNIYLEAGINAFGSKVPSILRTLKLKFGLMLPVKGRKKDDLKPEAKDVISRLAIEVPLGAVFRFFLYHKIWHH

SEQ ID NO: 989 - DNA, 684 bp, Unknown
  Obtained from environmental sample
  misc_feature (1)..(684): n is a, c, g, or t
atgctgacgaccggcgtgccctggtattttataggcatcattcacaaaatggaatgcgattgcagttttaataaacacttacataatggtgacccgctaaccgcaaggacaatacaagtgccaaaaggaagaccaaaaatgggtagcatgccatttagttttttagacagtgcagtggatgctcttacttacgaaggctatacccaatggaatgattggagcatcagtggaatgctttattgttttgaaaaatataatggctttggctaccactcaaaaggaattaattcaccttatctctggagtttctccaatcattacacaagtggaaaatttattaaagacggcgtttacaatccccttgcaatttctgggcaaataggtactgctgtcttactgcggcgtatgagcgagttgcaaattgcaatagctggtgaaaaggacctgctaacgcaaataaaagacctgggtcctaaggtaaattttgatcctgggcattatcatgctacagcagtgcggctgcaaagattattgaacggcgttgggcaacatctaaaaatagatggcaaagcaggaagaaatacttctgatgcataccaaagaataagtggaaaatatctaccaggtgacagtaagcaattagctttttccaaaccgggaagccgaaaacggattcaagagtag

SEQ ID NO: 990 - protein, 227 aa, Unknown
  Obtained from environmental sample
  misc_feature (1)..(227): Xaa is any amino acid
MLTTGVPWYFIGIIHKMECDCSFNKHLHNGDPLTARTIQVPKGRPKMGSMPFSFLDSAVDALTYEGYTQWNDWSISGMLYCFEKYNGFGYHSKGINSPYLWSFSNHYTSGKFIKDGVYNPLAISGQIGTAVLLRRMSELQIAIAGEKDLLTQIKDLGPKVNFDPGHYHATAVRLQRLLNGVGQHLKIDGKAGRNTSDAYQRISGKYLPGDSKQLAFSKPGSRKRIQE

SEQ ID NO: 991 - DNA, 582 bp, Unknown
  Obtained from environmental sample
  misc_feature (1)..(582): n is a, c, g, or t
ttgcagctaattacaattcttccccttatgaaaatcaatactgccgaattcatcatcagcaattccgatgtcagcaaatgccctaacgagccgctgccggagtatgcctttatcggcaggagtaatgtggggaagtcgtcactcatcaacatgctgacgggccgcaacagcctcgccaagacttccggcaggccgggcaagacccagctcatcaaccattttaagatcaatgagaactggtacctggtcgatcttcccggctacggctatgcccgcgtatcgaaatcgaccaaagagaccttccagaaattcatcactgattattttgagcgccgtgagcagctcgtatgcgccttcgtattaattgatatccgcctggaagcccagaagatcgatctggagttcatcacctacctgggcgagacagaggtgcctttctgcatcgtatttacaaaaaccgaccagatctcacgcggcaaggtcgaaccagcacattacttgccttaccggaaaagcgcctccctggcccaacaaatttgggaaaaaaaatgccccccaaccacttttggggaacccctcccc

SEQ ID NO: 992 - protein, 194 aa, Unknown
  Obtained from environmental sample
  misc_feature (1)..(194): Xaa is any amino acid
MQLITILPLMKINTAEFIISNSDVSKCPNEPLPEYAFIGRSNVGKSSLINMLTGRNSLAKTSGRPGKTQLINHFKINENWYLVDLPGYGYARVSKSTKETFQKFITDYFERREQLVCAFVLIDIRLEAQKIDLEFITYLGETEVPFCIVFTKTDQISRGKVEPAHYLPYRKSASLAQQIWEKKCPPTTFGEPLP

SEQ ID NO: 993 - DNA, 921 bp, Unknown
  Obtained from environmental sample
  misc_feature (1)..(921): n is a, c, g, or t
atggcagaacgcttgcgcttagatgagaatcggcaagagagttttcaacaagaatcctttgaaagagaaatcgaagttattgccgatttgatcaaggactcaggaaaaaatcacaatgtcattggagtgtacggtccacatactgtcattcgagatgtgttcaaagagaaaattctcgccaaggttctagcagactctcaaaacagctctgataggttgatctttgctccttcaagcaatgatccaggtaaggaacttcttgtggagatgggcagttttcttcaggagaagaaaattgctgaagttcacaagaaactaaaaagcgattttgagaatttttataatacccaggtaaagagcctttttcctttggagaaagcaattaagagttcacttcctccagtctatgcgttggttgcctatttcttaactgttcgaactggattagacaatcctgccattgaaactgctattggaattctgaccggaatcggtggatactttgcaaatgtttttgggcatgatttttttgccagggtgattgtgaaccagtttggtacccacaaaaaaaaggctgtagaattgagaattgcagatgccttaaatagactcgatcagccctttcttgtcgtgcttgattcccttgaaggtctaaaaacagacgcactacgagacctctttatcactctctctaggtcgaagaaattctcaaaccttgtctttctagtcttattagatagagattcagttgaggatcaaagtattcaaagttttatagacaatctcgtaacgaatcgtagatattttcctgacccctctcgctttctcctcgaacactattggaagcaggaagtagtgcgaagcttgaattccacctgcgaaaggcctatttccaagaagaagaatgtagattggaaatag

SEQ ID NO: 994 - protein, 306 aa, Unknown
  Obtained from environmental sample
  misc_feature (1)..(306): Xaa is any amino acid
MAERLRLDENRQESFQQESFEREIEVIADLIKDSGKNHNVIGVYGPHTVIRDVFKEKILAKVLADSQNSSDRLIFAPSSNDPGKELLVEMGSFLQEKKIAEVHKKLKSDFENFYNTQVKSLFPLEKAIKSSLPPVYALVAYFLTVRTGLDNPAIETAIGILTGIGGYFANVFGHDFFARVIVNQFGTHKKKAVELRIADALNRLDQPFLVVLDSLEGLKTDALRDLFITLSRSKKFSNLVFLVLLDRDSVEDQSIQSFIDNLVTNRRYFPDPSRFLLEHYWKQEVVRSLNSTCERPISKKKNVDWK

SEQ ID NO: 995 - DNA, 456 bp, Unknown
  Obtained from environmental sample
  misc_feature (1)..(456): n is a, c, g, or t
ttgcctcttataaaagatgacattgtttgctggatttattatcctaagagcacgtctaaaattaaaacagaccttacaagagataaagggtgggatgaattattaaaacaggacttgcaatgggtgaatcttatttcttttgatgatacctggtcagcctttggtatgcgccagaaaacccaaaaggataaaaagaaagagtcaaaaccaaaggagcgacaaatattcgattatgtagattcaaaaacaaaaacaattcgtttgcctgatgatttatcggctgcatttaaaaaaaataaaaaacatgaaaaatattttaatagccttgccttcagccataaaagagaatatatagaatggattgtttccgctaaaaaagatgaaacaaggaaagaaagaataaaaggaactttacaaaggctggagaaaaagtggaaaaatcctgccaacagataa

SEQ ID NO: 996 - protein, 151 aa, Unknown
  Obtained from environmental sample
  misc_feature (1)..(151): Xaa is any amino acid
MPLIKDDIVCWIYYPKSTSKIKTDLTRDKGWDELLKQDLQWVNLISFDDTWSAFGMRQKTQKDKKKESKPKERQIFDYVDSKTKTIRLPDDLSAAFKKNKKHEKYFNSLAFSHKREYIEWIVSAKKDETRKERIKGTLQRLEKKWKNPANR

SEQ ID NO: 997 - DNA, 426 bp, Unknown
  Obtained from environmental sample
  misc_feature (1)..(426): n is a, c, g, or t
atggagagaatggaaaaaaaactgcagaaccaggaagcgcaggacaaatttcgggaactggcaactgcagtaaatatttgcatgtttaccaccatagacaatgaacaaaatattatgagccgtcccatgtggacagctgatattgatgaagaaggcaatgcctggttttttacgaatgagttttctgaaaaaattcatgaagtgtcaaaagacaatattgtaaacctgatttatgcgcatccgggaaaaaatatttatgtaaatgtaaaaggcacgtgcactgtaattattgacaggaaaaaaatggaagaattgtggaaaccatctatgaaaacctggtttcccgaagggctggatgatacaaagatctgcctggtgaaagtaacaacagaaaatgcatattactggaacacaacgctcgagtaa

SEQ ID NO: 998 - protein, 141 aa, Unknown
  Obtained from environmental sample
  DOMAIN (13)...(100): Pyridoxamine 5'-phosphate oxidase
  misc_feature (1)..(141): Xaa is any amino acid
MERMEKKLQNQEAQDKFRELATAVNICMFTTIDNEQNIMSRPMWTADIDEEGNAWFFTNEFSEKIHEVSKDNIVNLIYAHPGKNIYVNVKGTCTVIIDRKKMEELWKPSMKTWFPEGLDDTKICLVKVTTENAYYWNTTLE

SEQ ID NO: 999 - DNA, 345 bp, Unknown
  Obtained from environmental sample
  misc_feature (1)..(345): n is a, c, g, or t
atgatagtcaacgaaaataattctcaaccatatatgaaaagcttatcaacttgtttgaacaaaatgataagcgatggatatgacgaagattataaactaacggaccggggaatggaatctttgcacagtggaaaaacatacacccccgaacaggttcagatcgttaattttttccgctttgaaggaatgtcagacccggatgataatgccatactatatgttattaaaacagatgatggagctaaaggaactttaatagacggatatggaatttatacggagccgaaaattgcttcttttatgaaagaagtggaaaccattcaaaagaaaactgtaaaaagttag

SEQ ID NO: 1000 - protein, 114 aa, Unknown
  Obtained from environmental sample
  misc_feature (1)..(114): Xaa is any amino acid
MIVNENNSQPYMKSLSTCLNKMISDGYDEDYKLTDRGMESLHSGKTYTPEQVQIVNFFRFEGMSDPDDNAILYVIKTDDGAKGTLIDGYGIYTEPKIASFMKEVETIQKKTVKS

SEQ ID NO: 1001 - DNA, 729 bp, Unknown
  Obtained from environmental sample
  misc_feature (1)..(729): n is a, c, g, or t
gtgaaccgcacatgggtattaatgcataaactatgcaatagcaaagtgccgaaactgcatgaagatatttcagatgatgaagatcgatggatcatgagagaaattgaaagttcaaagttgaaagttgaaagtttgattgaagaatataaatttcgtgatgcgttatttgaggtgatcgacctgtctcgcaagggaaatcaatacatgcaaaagaaggaaccgtggataatagctaagaagaccacggacgacggtccacagtccacagtagcacaaaaagaaattgataattgtttacacctatgtttgcagttaacagccaatcttgcaattcttatcaatccattcttacctaacacagcaaagaagatgctgtacatgatgaaagtggttgataaaatgctggattgggaaaatgcagggaaactaaaattgttgagtgttggttattcattgagacctcctgaattattattcaggaaaattgaagatgatgagataaaagcccaaatagaaaaattaaaaagcggtttggtcaaggcacaagaaacgaatgacaagaaacaagaaacaaaaaagatggaaaataaatttgatcccgataaatatcgggacgcaagtccgaaatctgaaatcacgtatgatgactttgcaaaacntggatcttcgtattggtaccgtaactacgtgcgaaaaagtaganaaaagctgataagnnctgtaaaataa

SEQ ID NO: 1002 - protein, 242 aa, Unknown
  Obtained from environmental sample
  misc_feature (1)..(242): Xaa is any amino acid
MNRTWVLMHKLCNSKVPKLHEDISDDEDRWIMREIESSKLKVESLIEEYKFRDALFEVIDLSRKGNQYMQKKEPWIIAKKTTDDGPQSTVAQKEIDNCLHLCLQLTANLAILINPFLPNTAKKMLYMMKVVDKMLDWENAGKLKLLSVGYSLRPPELLFRKIEDDEIKAQIEKLKSGLVKAQETNDKKQETKKMENKFDPDKYRDASPKSEITYDDFAKXGSSYWYRNYVRKSRXKLIXXVK

SEQ ID NO: 1003 - DNA, 363 bp, Unknown
  Obtained from environmental sample
  misc_feature (1)..(363): n is a, c, g, or t
ttggcattaaaaaaaaaatccccattcccttttcgcggaccagggatttctttttttttcagggccggggaactgaaaaattatgcggaagcaaaatttctgcctgatgatattcagcgcagcacctgctttaaaccattcaatttgttgctcattataagtatggttaaccgttatgatatcagaactgccatctgcatgatgcagtacaatggccaagggtttacctggcgcaaaatcggtaaggccaagtatatcaatggtatcatcttcctggatcttatcgtaatcttctttatttgcaaaggtcaatccaagcatactttgtttcttcaggttggtttcgtgaatacgggcaaatga

SEQ ID NO: 1004 - protein, 120 aa, Unknown
  Obtained from environmental sample
  misc_feature (1)..(120): Xaa is any amino acid
MALKKKSPFPFRGPGISFFFRAGELKNYAEAKFLPDDIQRSTCFKPFNLLLIISMVNRYDIRTAICMMQYNGQGFTWRKIGKAKYINGIIFLDLIVIFFICKGQSKHTLFLQVGFVNTGK

SEQ ID NO: 1005 - DNA, 567 bp, Unknown
  Obtained from environmental sample
  misc_feature (1)..(567): n is a, c, g, or t
ttgatgacacccagcctacccatctacggaaaagcaagcgctggacctgatggccaggttctcctggacgaaccgaatttcggcggagcagttgacgaatcttccttcattcgcatcgatggacaggaatacgatcttcatacgctcaaaggcgatgaccatcaaatcaatatctcacttagagactttgtgtcatccattcttcccaagaagctgggcaaaaccggtgggaaagcgtatggctggctaaaagtaattgggaatagtatgaacgatactaaactgattccgatcaatgaaggcgattatgtattgttctttgagaaccgcaaccccactgtaagcaaaattgttattgctgcgcagtcaacacccgaaacaggaacgcttcgacttttcataaaacaactcattaaaaagaatgatcaattattcttacactcgcagtctcacggcaaggatccagataccggacgagattatgaagacatggaagtaaatgaccggtatcagataattggagaggtggttgcggtagcaaagcaaaagaaaaccaagacccactaa

SEQ ID NO: 1006 - protein, 188 aa, Unknown
  Obtained from environmental sample
  misc_feature (1)..(188): Xaa is any amino acid
MMTPSLPIYGKASAGPDGQVLLDEPNFGGAVDESSFIRIDGQEYDLHTLKGDDHQINISLRDFVSSILPKKLGKTGGKAYGWLKVIGNSMNDTKLIPINEGDYVLFFENRNPTVSKIVIAAQSTPETGTLRLFIKQLIKKNDQLFLHSQSHGKDPDTGRDYEDMEVNDRYQIIGEVVAVAKQKKTKTH

SEQ ID NO: 1007 - DNA, 732 bp, Unknown
  Obtained from environmental sample
  misc_feature (1)..(732): n is a, c, g, or t
ttgacaggggtaactgattatgctgaacacaagattttgactgaaaatgaaagaagctttaatctaactgttttttacggaagggatgcagaatgggctgatgtaataaatgcctgccggcgttacccaatgttttcggacaggcaggtagtagtgctaaaagaagcccagtccatgcgaaatatagaaaagctggagtcgtacatagaaaagcctttgtcctctaccatccttgttgtggcttataaaaataaaaaggtggatggaagaacaaaactggcgaagctgctaaaggaaaagggcacaatactgagtacaaaaaagctgtatgataatgatttgcccgaatggacgcaacaattagtaaagtcaaaaggttattcaataaacaggaaagctctttttcttttaattgaccatattggtaacgaccttaaccggctaaataatgaaatagataaacttgcattgaaccttggaaacagggatacaattaccgaggatgatattgaaacttatgttggcataagcaaagagtttaatgtttttgaattgcaacatgccattgccagccgcgatctgtacaaagccgtacgcattattaactatttcgaagcaaaccctaaggctgctcccatgcagttgatactaccttctttgtataattttttcagtaaagtgcaaatgatttattcaatttcttccagggataaaaggccatgcactcgataa

SEQ ID NO: 1008 - protein, 243 aa, Unknown
  Obtained from environmental sample
  misc_feature (1)..(243): Xaa is any amino acid
MTGVTDYAEHKILTENERSFNLTVFYGRDAEWADVINACRRYPMFSDRQVVVLKEAQSMRNIEKLESYIEKPLSSTILVVAYKNKKVDGRTKLAKLLKEKGTILSTKKLYDNDLPEWTQQLVKSKGYSINRKALFLLIDHIGNDLNRLNNEIDKLALNLGNRDTITEDDIETYVGISKEFNVFELQHAIASRDLYKAVRIINYFEANPKAAPMQLILPSLYNFFSKVQMIYSISSRDKRPCTR

SEQ ID NO: 1009 - DNA, 372 bp, Unknown
  Obtained from environmental sample
  misc_feature (1)..(372): n is a, c, g, or t
atgggaaaaaagggggaactttttttaaaaaaaattattcaaaaggaagccacttccaattcttggacggactccaaattttggctcaggacattcaacaagtatccgttacttttagtggattttggggctcctggggggggcccttgcaggatgatgtctccgataattgatcaggttggtaaggagtacattggcaaattagttgtaggtaaagtaaacgttgatgaaaatccacatatttcaggacagtttgggatatccagcattccaacgttgatattattcaagagaggtcaaactgttaacaatatcattggttcagtatccaaaagcaggatagatgaaatggtaagaatgcatctcgagtaa

SEQ ID NO: 1010 - protein, 123 aa, Unknown
  Obtained from environmental sample
  DOMAIN (20)...(123): Thioredoxin
  misc_feature (1)..(123): Xaa is any amino acid
MGKKGELFLKKIIQKEATSNSWTDSKFWLRTFNKYPLLLVDFGAPGGGPCRMMSPIIDQVGKEYIGKLVVGKVNVDENPHISGQFGISSIPTLILFKRGQTVNNIIGSVSKSRIDEMVRMHLE

SEQ ID NO: 1011 - DNA, 366 bp, Unknown
  Obtained from environmental sample
  misc_feature (1)..(366): n is a, c, g, or t
atgatcgaagcttatggcggaactaaaaaattttacaggaatttttttatcggttctgtttgccctttaggctttgtgcaaaatggaaaaaatctaaattattatgacaataaggaacttttgaaaacaatagaaccttttattgttgaaaatcttacaaagctggtgtcttataaggtaaacaaagaaaaatgcatttgtctcggcggagaaaaaaactttgcttacctgttttcacttaatcaaaaatatcagtggtttaaaaacattgtatcagtgcctcacccaagatttatcatgcagtataaaagaaagtacctccaggattttatcaatctttatttggacgtgttaaaaagaaaataa

SEQ ID NO: 1012 - protein, 121 aa, Unknown
  Obtained from environmental sample
  misc_feature (1)..(121): Xaa is any amino acid
MIEAYGGTKKFYRNFFIGSVCPLGFVQNGKNLNYYDNKELLKTIEPFIVENLTKLVSYKVNKEKCICLGGEKNFAYLFSLNQKYQWFKNIVSVPHPRFIMQYKRKYLQDFINLYLDVLKRK

SEQ ID NO: 1013 - DNA, 483 bp, Unknown
  Obtained from environmental sample
  misc_feature (1)..(483): n is a, c, g, or t
atgaaaagggtcctgctcgctattataggtattattctcgcaattatcgtagttgttggttggaaatttgtttttcctaaaaaaagaggagataatggccctcaaccccagggattgaccgtaagcaggcatagcagtagctttaatgaatcaatgacgaatgcaatgaattcttattatgcccttaccgagtcttttgtgaattgggatactgcaaaagtcaactcatcaattaccgcactaaagattgctgttgacagcattcgtattcctgaaatgcaaaaagattctgccatctatgaaaccgcacaatcaacctgggaatctattaaatcagagataacaggcatgcagttggatacgtccctttatgaaaagagagagtcgctcaatatgttatcagataatttgtttaaactgttacgcatcgttaaatatgatgtagcgaaagtttattaccatgaatggcccgatggcatttga

SEQ ID NO: 1014 - protein, 160 aa, Unknown
  Obtained from environmental sample
  SIGNAL (1)...(20)
  misc_feature (1)..(160): Xaa is any amino acid
MKRVLLAIIGIILAIIVVVGWKFVFPKKRGDNGPQPQGLTVSRHSSSFNESMTNAMNSYYALTESFVNWDTAKVNSSITALKIAVDSIRIPEMQKDSAIYETAQSTWESIKSEITGMQLDTSLYEKRESLNMLSDNLFKLLRIVKYDVAKVYYHEWPDGI

SEQ ID NO: 1015 - DNA, 960 bp, Unknown
  Obtained from environmental sample
  misc_feature (1)..(960): n is a, c, g, or t
ttgccaaaaattgactatggtgcttctgcttctaggattcatgttcctaaaatgtggaagatcaaacctcgaatgtgttatcttcttgacaaacttggtgagggtggattctcccaggtatttaaagtggaatatcaatcatcaacgccatcatcttcatcgtcttcacaacancaaggaaatgaaaaagagattcatgtatttaagagatttaatgtatttcgattgaatgataaggaatntgagatgatctcatcagagattgagacattgtgttcattggataagcatcccaatattgttgctcttattggtgtctcaaacgatcctgattccaaagatggaaatggtgagaaatttggagttgggataatgatggaatactgtgagaatggttcattgagacaatatctggatagaactactccatctccaattgatatgaatttaattcttcagattcttgttgatattgcagaagggatgagttatcttcatcagcattcactcattcatcgtgatttgaagagtgataatattctacttgttaagaatatgaatgcaaagatttgtgattttggtatttcaaagattattgaaatcactgcagcagcaacaaaagggaaaacaataacagctggaacatcacaatataaatcaccagaatcatttgagggtgattttggtgttcattcagatatttatgcatttgggtgtgtgatgtatgaaatattgagtggtaaacgaccctgggatggattaaacgatgctcaaataatgatgaatgtggttatgaagaagattcctcttgatttctcaatgattactcgaagtgatgtctctcttgaattgatgcaaatgatgattcaatgtttggattatgagaagaataaacgacctgaatcatttgcatttgtatcgagtgaattacaatcaatgataccacctgttccttcataa

SEQ ID NO: 1016 - protein, 319 aa, Unknown
  Obtained from environmental sample
  DOMAIN (26)...(314): Protein kinase domain
  misc_feature (1)..(319): Xaa is any amino acid
MPKIDYGASASRIHVPKMWKIKPRMCYLLDKLGEGGFSQVFKVEYQSSTPSSSSSSQXQGNEKEIHVFKRFNVFRLNDKEXEMISSEIETLCSLDKHPNIVALIGVSNDPDSKDGNGEKFGVGIMMEYCENGSLRQYLDRTTPSPIDMNLILQILVDIAEGMSYLHQHSLIHRDLKSDNILLVKNMNAKICDFGISKIIEITAAATKGKTITAGTSQYKSPESFEGDFGVHSDIYAFGCVMYEILSGKRPWDGLNDAQIMMNVVMKKIPLDFSMITRSDVSLELMQMMIQCLDYEKNKRPESFAFVSSELQSMIPPVPS

SEQ ID NO: 1017 - DNA, 927 bp, Unknown
  Obtained from environmental sample
  misc_feature (1)..(927): n is a, c, g, or t
atgttcagatataataaacagaaggaacttcacaatcaaagaaatgaaattgaaattctcatggaagaactcaagaccaatcgtgaaaaatacattgaacttaatgaacaagttgatctcaagaaagaatgtgatcttctcaacattcaatgcaaagaaattgaggaggatatttatgatctctgttttgatcaagatgattcatcactttgcagatttccagatttattgccaaaaattgactatggtgcttctgcttctaggattcatgttcctaaaatgtggaagatcaaacctcgaatgtgttatcttcttgaacaacttggtgagggtggattctcccaggtatttaaagtggaatatcaatcatcaacgccatcatcttcatcgtcttcacaacaacaaggaaatgaaaaagagattcatgtatttaagagatttaatgtatttcgattgaatgataaggaatttgagatgatctcatcagagattgagacattgtgttcattggataagcatcccaatattgttgctcttattggtgtctcaaacgatcctgattccaaagatggaaatggtgagaaatttggagttgggataatgatggaatactgtgagaatggttcattgagacaatatctggatagaactactccatctccaattgatatgaatttaattcttcagattcttgttgatattgcagaagggatgagttatcttcatcagcattcactcattcatcgtgatttgaagagtgataatattctacttgttaagaatatgaatgcaaagatttgtgattttgggtatttccaaagattattgaaaatcactgcaggcagccacaaaaagggaaaaacaaataaccagctgggaaccatcacaaataataaattcacccggaaatcctttttgaaggggtga

SEQ ID NO: 1018 - protein, 308 aa, Unknown
  Obtained from environmental sample
  DOMAIN (102)...(305): Protein kinase domain
  misc_feature (1)..(308): Xaa is any amino acid
MFRYNKQKELHNQRNEIEILMEELKTNREKYIELNEQVDLKKECDLLNIQCKEIEEDIYDLCFDQDDSSLCRFPDLLPKIDYGASASRIHVPKMWKIKPRMCYLLEQLGEGGFSQVFKVEYQSSTPSSSSSSQQQGNEKEIHVFKRFNVFRLNDKEFEMISSEIETLCSLDKHPNIVALIGVSNDPDSKDGNGEKFGVGIMMEYCENGSLRQYLDRTTPSPIDMNLILQILVDIAEGMSYLHQHSLIHRDLKSDNILLVKNMNAKICDFGYFQRLLKITAGSHKKGKTNNQLGTITNNKFTRKSFLKG

SEQ ID NO: 1019 - DNA, 771 bp, Unknown
  Obtained from environmental sample
  misc_feature (1)..(771): n is a, c, g, or t
atgggagatcagttactcagagcccgtgataacgtctggaattcgtacaccatcaaaacaaggcctgttgataagcgtgagaactatataaaaagatgtgttggaatagcgggagatgtgattgagataaaggatgacgttgtttatataaatggaaaattacaaccccctccaccacattcgcagcttcattatattgttacggtaaataatactgcactcgaccctgatattatgaaggaggaatataatcttgattatgaaaaaaatgattatgttgaaaccggcaagcctaatgagtatgaaatggccctgacagcagtcgccaaagacaagatgttgaaaaatggatttgcaaaaagtattgtgcttcattatggctacaatgctggtggtggtgaagtatatccatacgatacgattcataaatggacgagagacaatttcggaccagtgcatattcctgccaagggcgtgactatcacgctgaccgcccagaatatttcaatgtatgagagagctatccgagtatacgaacgtaataaactcgatgtaaaaagcgggaagatatatattaatgacaaggagacaaaccagtatacttttaaaatgaactattactggatgatgggtgataatcggcaggattcacaggacagcagatactggggatttgttcccgaagaccatgtcgtaggagaggcatggttaatatggatgagttgggataagggaatacgttggaaacgcatgttcaatacgatccattaa

SEQ ID NO: 1020 - protein, 256 aa, Unknown
  Obtained from environmental sample
  misc_feature (1)..(256): Xaa is any amino acid
MGDQLLRARDNVWNSYTIKTRPVDKRENYIKRCVGIAGDVIEIKDDVVYINGKLQPPPPHSQLHYIVTVNNTALDPDIMKEEYNLDYEKNDYVETGKPNEYEMALTAVAKDKMLKNGFAKSIVLHYGYNAGGGEVYPYDTIHKWTRDNFGPVHIPAKGVTITLTAQNISMYERAIRVYERNKLDVKSGKIYINDKETNQYTFKMNYYWMMGDNRQDSQDSRYWGFVPEDHVVGEAWLIWMSWDKGIRWKRMFNTIH

SEQ ID NO: 1021 - DNA, 876 bp, Unknown
  Obtained from environmental sample
  misc_feature (1)..(876): n is a, c, g, or t
ttgccgtcgggaatcggcaggacagtcaagattaaaattgtagaaagaaatcctatgccagtacgtttaggtcgcttcgaaatgccgaagcggttgatcaaagatgatacaaccgcgacagagacttatgccaagttcattgccgagccttttgaaacaggctacggccataccgttggcaactcgcttcgccgagtgctcctctcctcgcttgagggcgcggcgatcacttcaatcaaagtcgacggcgccatgcacgagtttaccaccgtggatggagtggtcgaagatgtgacggatatcatccttaacttaaaaaaggttctttttaagtctcacagccgcgatccgcagacggtgcttttgtctgtccacaaagaaggcgcagttaccgcgggcgacattaagctcaatcagaatgttgaaatcgttaatcccaagcagataatctgcaccctcgacaaaaagaagaagttcgagatggagttagaggtcaaagttggccgcggattttgcccgggtgatgagaataagaagcctgatcaggccataggagttgtggcgattgattcgttgttttcgccggtgacccgggtgcgctacgccgtagaaagcgcgcgcgtgggacaacgcacagattatgatcggttgctgatggagatctggaccgatggccgcatctcgcccgacgacgcgctgacccaagcctccgccatcctccagcatcacctcgacgtctttgtgggttacgacaagaatgccgtcgaatttgaagaagttgctgacaagcaggatgatgagaaggccaagctcaaaaagctcctcaatatgagcgtcaatgaaatcgagttgagcgtgcgcgcggctaactgctga

SEQ ID NO: 1022 - protein, 291 aa, Unknown
  Obtained from environmental sample
  DOMAIN (41)...(249): RNA polymerase Rpb3/Rpb11 dimerisation domain
  misc_feature (1)..(291): Xaa is any amino acid
MPSGIGRTVKIKIVERNPMPVRLGRFEMPKRLIKDDTTATETYAKFIAEPFETGYGHTVGNSLRRVLLSSLEGAAITSIKVDGAMHEFTTVDGVVEDVTDIILNLKKVLFKSHSRDPQTVLLSVHKEGAVTAGDIKLNQNVEIVNPKQIICTLDKKKKFEMELEVKVGRGFCPGDENKKPDQAIGVVAIDSLFSPVTRVRYAVESARVGQRTDYDRLLMEIWTDGRISPDDALTQASAILQHHLDVFVGYDKNAVEFEEVADKQDDEKAKLKKLLNMSVNEIELSVRAANC

SEQ ID NO: 1023 - DNA, 567 bp, Unknown
  Obtained from environmental sample
  misc_feature (1)..(567): n is a, c, g, or t
atgaaaaaagaagaaattgatggatttatcgaagacaggtttaaaggaatcgtcaagtatctccgcaaagtccttgtagattttgaaccggaaaacatatgcctgtttagaaatgaaatagagaaattacaagtatttcttcatttactatgcatggaatctgctgatggctgctcttacaggatcaccaaacgaatgaaaacgatctatggatattttggcattttccaaaaccttcagcaacaattaagaaaaacaaatgaatttttaaaaaagtatcccggcagaatccctgttcaatatgtggcgatgttagaaaaagaacaggaattctggaaaaaaaccagcaaagatttcatcgatgcagattacgacttctttattgacaagaaagagattctcaccacattgccggataaattaaccaaaaagtccatcctgaaatttattcattataccctttttgaactgcaatctatgtcctgcaattcaaacggaatatattctttgaaagtacgcggaaaaattatgggaagatatttatttataaattaccgaattttataa

SEQ ID NO: 1024 - protein, 188 aa, Unknown
  Obtained from environmental sample
  misc_feature (1)..(188): Xaa is any amino acid
MKKEEIDGFIEDRFKGIVKYLRKVLVDFEPENICLFRNEIEKLQVFLHLLCMESADGCSYRITKRMKTIYGYFGIFQNLQQQLRKTNEFLKKYPGRIPVQYVAMLEKEQEFWKKTSKDFIDADYDFFIDKKEILTTLPDKLTKKSILKFIHYTLFELQSMSCNSNGIYSLKVRGKIMGRYLFINYRIL

SEQ ID NO: 1025 - DNA, 861 bp, Unknown
  Obtained from environmental sample
  misc_feature (1)..(861): n is a, c, g, or t
atgaagttctttgaaatggatcaaagttctaatttgccggaattcatggaatttgttcacccgagcgaccgtgaaaaacttcgtgagtccatagagggcgctttaaaaggtaatggagattatgattgtgagtaccggtaccgtagaaacggtaaagagaaagtgatatggtcaaaaggtgtagtgagttttaaagataacaagccattattaatgaaaggtacggtgatggatattaccgatcgtcactatatgttgcaaactttaaaacgcaacgaagagctatataaacaagctcaaaaactaactcacatcggtaactgggcctgggatcttgaaacaaatgaagtgaaattctcagatgaattgtatcgcatttatggtttggagatcggtacgtacatggatgccattcgctttttttcgttcgtacatgatgacgataaagagaagatccttacgttactgaaccattcgaaaagtactcatcaaccgcacaccgttgactatagactggtgcgcaaagacggaagtatacgtatcatgcgcagaaatgccgaagttcttttggatgaaaagaacaaaccatataagatcattggtacaggtcaggatataacgaaggaagtagaattgaacagagagattcgcgagcgtgaagagaatttcagccacttgatcaaaaacgcgccggatggcatcattgtaattgatgaaaatagtattattcgattatggaatgaaaaagcgaccgaaatatttggatggaagaacgaagatgttataggcaaagatctcacctcaaccataatgccgaatgcagatcctgatggcaccaaaaaagcaatgtcatcattctaa

SEQ ID NO: 1026 - protein, 286 aa, Unknown
  Obtained from environmental sample
  DOMAIN (221)...(284): PAS domain
  misc_feature (1)..(286): Xaa is any amino acid
MKFFEMDQSSNLPEFMEFVHPSDREKLRESIEGALKGNGDYDCEYRYRRNGKEKVIWSKGVVSFKDNKPLLMKGTVMDITDRHYMLQTLKRNEELYKQAQKLTHIGNWAWDLETNEVKFSDELYRIYGLEIGTYMDAIRFFSFVHDDDKEKILTLLNHSKSTHQPHTVDYRLVRKDGSIRIMRRNAEVLLDEKNKPYKIIGTGQDITKEVELNREIREREENFSHLIKNAPDGIIVIDENSIIRLWNEKATEIFGWKNEDVIGKDLTSTIMPNADPDGTKKAMSSF

SEQ ID NO: 1027 - DNA, 495 bp, Unknown
  Obtained from environmental sample
  misc_feature (1)..(495): n is a, c, g, or t
atgagtaatatcagaattacaaaacaatttagtttcgaaaccggacacgctttgtacggctacgacggaaaatgcaaaaacgttcacggacacagttacaaattatcggtgacagttattggttcgccaatcacagaccggtcaaatgtaaaattcggaatggtaatcgatttttcggatctaaagaaaattgtaaaagaagaaattgtcgatcagtttgaccatgcaacagtttttaacgaaacaacaccgcatatcgaattggcaaatgaattaaaaaatcgtggacatcacgtaattttagttgattatcagcccacaagtgaaaatatggtggttgattttgcagacagaattgttgcaagatttaccttcaggaaattaaactttttctcactaaaacttcaggaaaaacgaaatctttcattttgcaagaaaggttttgccaagtggacaataattttagaacaaagtttccaattaaaaaaaatttaa

SEQ ID NO: 1028 - protein, 164 aa, Unknown
  Obtained from environmental sample
  DOMAIN (1)...(148): 6-pyruvoyl tetrahydropterin synthase
  misc_feature (1)..(164): Xaa is any amino acid
MSNIRITKQFSFETGHALYGYDGKCKNVHGHSYKLSVTVIGSPITDRSNVKFGMVIDFSDLKKIVKEEIVDQFDHATVFNETTPHIELANELKNRGHHVILVDYQPTSENMVVDFADRIVARFTFRKLNFFSLKLQEKRNLSFCKKGFAKWTIILEQSFQLKKI

SEQ ID NO: 1029 - DNA, 600 bp, Unknown
  Obtained from environmental sample
  misc_feature (1)..(600): n is a, c, g, or t
ttgagtgccaacgcccggaaccagcaaaaaatgatccggcacgatcttccggatctttgtaaactgttttgcctgtgttgctccggttacaaacatcaggttctccgggttaccccaactgcttgcttttttaagcactttttcaaacaaaagttcttcgcctgtaccgtcgttggcaatcagcatttcaaaatcaaaagcgccggtattgctggtgagccccaatacgatggtccatttatttttaaactccagaaatggctttacgctgtcttcgcccatatagggcgctactgtaaccgcatcaaaattcatagtttcaaaaaaggcacgcgcatattgcgtggatgtgttgccgatatcccctcttttagcgtctgcgatcttaaaatgcgtagcaggaatataatttacagtctgttccatggcctcccaacccctggtgccaatggcttcataaaatgcagtattgatcttatagctgacgcacagatccagggtggcatcaatgatctgtttgttgaactcaaatatggcatttggttcctttgccaggtgttcaggaagtttgtgaagatctgtatccaggcctacacataa

SEQ ID NO: 1030 - protein, 199 aa, Unknown
  Obtained from environmental sample
  misc_feature (1)..(199): Xaa is any amino acid
MSANARNQQKMIRHDLPDLCKLFCLCCSGYKHQVLRVTPTACFFKHFFKQKFFACTVVGNQHFKIKSAGIAGEPQYDGPFIFKLQKWLYAVFAHIGRYCNRIKIHSFKKGTRILRGCVADIPSFSVCDLKMRSRNIIYSLFHGLPTPGANGFIKCSIDLIADAQIQGGINDLFVELKYGIWFLCQVFRKFVKICIQAYT

SEQ ID NO: 1031 - DNA, 894 bp, Unknown
  Obtained from environmental sample
  misc_feature (1)..(894): n is a, c, g, or t
ttggataattttttaaaaactctttcttcacttcctcctgaagaggcgcttgaacatctcaaagtcattggtcacacattgggcgctttccatagtcttgatgccaagttagaatataatggatatggtcaggccattctatacggttgggttcatggagactttatttcacatcttggaaatatattttacgatcctaaaaccaaaatagttacctttattgattatgaaggtatgaagaagattaagggaagcaattcggagatctctaacttttttacatgggctggagaagctatcagcggttatcaaaaaggtgtggggtatagttcacaagatgccaatgcagaaaaattcatgagagccttactgaaaagctatttaagtgccttttctggtggccccttgaaagttgtagcggctaaagatgcatggaatggaacagatgcctatttccaaaaacgtacaggaacgagtttgtcaaacttagatatggccgagaaatcacaagtagaaaaagcgtggaaccaattagaggatttaacaaaaatacgccccgtatataaacaaggtacaatgataattgaagaacgggtacgatcacaacttagccctgttatccaagtacttgattctaaggtagatttatcaaaattattatggaaccagattgacgatgagggcagcttactcggggcgatttatgaaattgttgatggggagaaaacttattgggtgcgtaaatctctagataaaaatgatgtttataaaacatggaaaaaagctacaggaaaatccactaaaaaaacttttttgaggtaccaccctgggtccttccctaaaatttttttttttccttttttaatccaaaaagggtcccttaaaaatggttaa

SEQ ID NO: 1032 - protein, 297 aa, Unknown
  Obtained from environmental sample
  misc_feature (1)..(297): Xaa is any amino acid
MDNFLKTLSSLPPEEALEHLKVIGHTLGAFHSLDAKLEYNGYGQAILYGWVHGDFISHLGNIFYDPKTKIVTFIDYEGMKKIKGSNSEISNFFTWAGEAISGYQKGVGYSSQDANAEKFMRALLKSYLSAFSGGPLKVVAAKDAWNGTDAYFQKRTGTSLSNLDMAEKSQVEKAWNQLEDLTKIRPVYKQGTMIIEERVRSQLSPVIQVLDSKVDLSKLLWNQIDDEGSLLGAIYEIVDGEKTYWVRKSLDKNDVYKTWKKATGKSTKKTFLRYHPGSFPKIFFFPFLIQKGSLKNG

SEQ ID NO: 1033 - DNA, 300 bp, Unknown
  Obtained from environmental sample
  misc_feature (1)..(300): n is a, c, g, or t
ttgttaataccctcaaatcttatctgtctaacgggatacataagatggtataaattatatgttgaagaggaaaacccctatgagaatgagacccggtgtttaggggctttcgctttcgtgcatttcagcaccaaacaggatatggatataagctcatacagcttatacgtaggcatgctcaataaactcacaaaaaaattaaagaaagaaatccaagatgttaagcctcttatgagcggcatttcccttcgcactccaaatcggtggaggagtgatgagtcaaagtcctcagtcaattaa

SEQ ID NO: 1034 - protein, 99 aa, Unknown
  Obtained from environmental sample
  misc_feature (1)..(99): Xaa is any amino acid
MLIPSNLICLTGYIRWYKLYVEEENPYENETRCLGAFAFVHFSTKQDMDISSYSLYVGMLNKLTKKLKKEIQDVKPLMSGISLRTPNRWRSDESKSSVN

SEQ ID NO: 1035 - DNA, 837 bp, Unknown
  Obtained from environmental sample
  misc_feature (1)..(837): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcttggagtaccgaatggagagaattatataatgctattgccagttataaaaatgacacagcacttcaacttttagaagtaccattcacacagacaaaacatgaaaacataaggcagtatcatatagactttattttcggagcagtacaagaattctatacaccaatttatgacgaacttttttgggtaatgtgggagaacgagaaaaaaataaacgctcaagtattcaacttactttttctaaaaaattcagaaagagcttttcagctaataaaaaagacaattcaaaatgctgatgattattattacctcaacacaggaggtattactgaagacgactcaacacctgtaaatctattagacgtaatgcttgacacaattttagtccgggatagaccgtatgctattgagttaatcaacaaaaatataagagagattaatgttcatcagtttccaactttcgcagacaaggtattaaaaataaaagacatttcttttgtaacatcactttttgacagacttaagtcagaagataatccgcacatatatttaaaagtgacagaagtattgattgccttgaaagacaaggaaattaataaccgtatagtagaggtagccaagacaaatccagccttgaaaaaggattggggaggcaaagagttcacgaaattattaaaggataatggcatcaagtga

SEQ ID NO: 1036 - protein, 278 aa, Unknown
  Obtained from environmental sample
  misc_feature (1)..(278): Xaa is any amino acid
MXXXXXXXXXXXXXXXXXXXXXXXXXXXXXXXXXXXXXXXXXXXXXXAWSTEWRELYNAIASYKNDTALQLLEVPFTQTKHENIRQYHIDFIFGAVQEFYTPIYDELFWVMWENEKKINAQVFNLLFLKNSERAFQLIKKTIQNADDYYYLNTGGITEDDSTPVNLLDVMLDTILVRDRPYAIELINKNIREINVHQFPTFADKVLKIKDISFVTSLFDRLKSEDNPHIYLKVTEVLIALKDKEINNRIVEVAKTNPALKKDWGGKEFTKLLKDNGIK

SEQ ID NO: 1037 - DNA, 705 bp, Unknown
  Obtained from environmental sample
  misc_feature (1)..(705): n is a, c, g, or t
ttgataaggtgcttggagtccgaatggagagaattatataatgctattgccagttataaaaatgacacagcacttcaacttttagaagtaccattcacacagacaaaacatgaaaacataaggcagtatcatatagactttattttcggagcagtacaagaattctatacaccaatttatgacgaacttttttgggtaatgtgggagaacgagaaaaaaataaacgctcaagtattcaacttactttttctaaaaaattcagaaagagcttttcagctaataaaaaagacaattcaaaatgctgatgattattattacctcaacacaggaggtattactgaagacgactcaacacctgtaaatctattagacgtaatgcttgacacaattttagtccgggatagaccgtatgctattgagttaatcaacaaaaatataagagagattaatgttcatcagtttccaactttcgcagacaaggtattaaaaataaaagacatttcttttgtaacatcactttttgacagacttaagtcagaagataatccgcacatatatttaaaagtgacagaagtattgattgccttgaaagacaaggaaattaataaccgtatagtagaggtagccaagacaaatccagccttgaaaaaggattggggaggcaaagagttcacgaaattattaaaggataatggcatcaagtga

SEQ ID NO: 1038 - protein, 234 aa, Unknown
  Obtained from environmental sample
  misc_feature (1)..(234): Xaa is any amino acid
MIRCLESEWRELYNAIASYKNDTALQLLEVPFTQTKHENIRQYHIDFIFGAVQEFYTPIYDELFWVMWENEKKINAQVFNLLFLKNSERAFQLIKKTIQNADDYYYLNTGGITEDDSTPVNLLDVMLDTILVRDRPYAIELINKNIREINVHQFPTFADKVLKIKDISFVTSLFDRLKSEDNPHIYLKVTEVLIALKDKEINNRIVEVAKTNPALKKDWGGKEFTKLLKDNGIK

SEQ ID NO: 1039 - DNA, 603 bp, Unknown
  Obtained from environmental sample
  misc_feature (1)..(603): n is a, c, g, or t
atgtataaactcacggttctgggagaggtcataatcaagaagataaaacccctgataagtgctcgggaggtagtggagaaaaacaactcttactggacaggccatgacctgaacgcaatcccgcgccatctgctggaacgtatatccgaacttgggaattgtacttttatagaacccgacctgaatcatatatatgaaccctctcaaaaaataattgatagcatgggcagtgcaaagcacgcttctacttttgcttcttatttcaaccctgcttatcttcccctgtatgttgagctcggcaggaaagatgccgaactttccctgaattttacccaatcagtctgggaccatctttcaaacgaacactcaaatatgataaatgagttaatggagatggataatgtaagcctctatgtttctaaagaagggataaaacttactgaggttactgtaactgatagaataatgctgctgggtctttttgataaaaaaggtaaattcgaccagcaattcattatgagctctgatcccagtgcccttttgtggggtcaggagctgtttgattatttcaagaggctttccagactggtaaataaaatatga

SEQ ID NO: 1040 - protein, 200 aa, Unknown
  Obtained from environmental sample
  misc_feature (1)..(200): Xaa is any amino acid
MYKLTVLGEVIIKKIKPLISAREVVEKNNSYWTGHDLNAIPRHLLERISELGNCTFIEPDLNHIYEPSQKIIDSMGSAKHASTFASYFNPAYLPLYVELGRKDAELSLNFTQSVWDHLSNEHSNMINELMEMDNVSLYVSKEGIKLTEVTVTDRIMLLGLFDKKGKFDQQFIMSSDPSALLWGQELFDYFKRLSRLVNKI

SEQ ID NO: 1041 - DNA, 444 bp, Unknown
  Obtained from environmental sample
  misc_feature (1)..(444): n is a, c, g, or t
atgtcatatctaaatgttgaacttaaggcccgttgttcagaccgtaataaagcacgtgagtacctggtttcaaaaggcgcggacttcaaaggtgtcgatcatcaaaccgatacttatttcaacgtgccgcatggccggttaaaactgcgcgaagggaatgtcgaaaacaacctgatccgctatgaccgtgaaaaccaggcagggccaaagaattcgcagtttgacctggtaaaagttgaagatgcagcgggactgaagcatacgcttacaaagtcgcttggcatcaaaatgatcgtttcaaaaaaacgggagatctattatatcaaaaatgtaaaatttcacctggatgaagtggagggattgggtgaatttattgaaatagaagcggggaatattttatggcccggatgcaccgaaggaagaattaagaaaatccgtgtaatt

SEQ ID NO: 1042 - protein, 148 aa, Unknown
  Obtained from environmental sample
  DOMAIN (3)...(144): CYTH domain
  misc_feature (1)..(148): Xaa is any amino acid
MSYLNVELKARCSDRNKAREYLVSKGADFKGVDHQTDTYFNVPHGRLKLREGNVENNLIRYDRENQAGPKNSQFDLVKVEDAAGLKHTLTKSLGIKMIVSKKREIYYIKNVKFHLDEVEGLGEFIEIEAGNILWPGCTEGRIKKIRVI

SEQ ID NO: 1043 - DNA, 816 bp, Unknown
  Obtained from environmental sample
  misc_feature (1)..(816): n is a, c, g, or t
ttggaaaagggcggaaaaggctacgttttaaaccatcccggaattagggttgttgcaaaattagcgttgaagctggaaggaaaaaagggtttggccgggataagattgaaacccttattgttggggacaggatttaaaattcggtatcctgccaattatacaaaaaccacccattctgtgcggatcaaccaatttggcaacctgatagaaggcttgctggtaaacgatatcaaccaggtcgtacaaaccgatataacatatttctggatgaagggcagctttgcatacatggtctttatcattgatgtttattctcgaatgatagtgggctatcacgcctccttaaacctggaagcggcaggtaatctaaaagctttaaaaatgatgattcaactgcgaggcgcaaagaaattaaaaggtctcatccatcactcagataagggatctcaatatcattttaaagaatatcttaaagaattaaaggatcatggtattaaaataagtatgtgtgatacagcttggcaaaatgcttatacagaacgaatcaaccggaccatgaaatatgagtatttacggcaccgtaagattgataatattaaaaaattacgaaaatgtctggatgcagatgtaaaggcctataataccgaccggcctcattggagcttgccacaacaaatgtcacctgcagccttcgaggaatacctaaaaactgaaaaagggaagatgcgcccagaaatgaaaatttataaaagtgaaaaaaatgagttttttttagccatgaggcaatccgataaaaagaaagcagccaaaatatga

SEQ ID NO: 1044 - protein, 271 aa, Unknown
  Obtained from environmental sample
  DOMAIN (73)...(233): Integrase core domain
  misc_feature (1)..(271): Xaa is any amino acid
MEKGGKGYVLNHPGIRVVAKLALKLEGKKGLAGIRLKPLLLGTGFKIRYPANYTKTTHSVRINQFGNLIEGLLVNDINQVVQTDITYFWMKGSFAYMVFIIDVYSRMIVGYHASLNLEAAGNLKALKMMIQLRGAKKLKGLIHHSDKGSQYHFKEYLKELKDHGIKISMCDTAWQNAYTERINRTMKYEYLRHRKIDNIKKLRKCLDADVKAYNTDRPHWSLPQQMSPAAFEEYLKTEKGKMRPEMKIYKSEKNEFFLAMRQSDKKKAAKI

SEQ ID NO: 1045 - DNA, 813 bp, Unknown
  Obtained from environmental sample
  misc_feature (1)..(813): n is a, c, g, or t
atgaatgttactgataaagataatgttaccggggtagtggtaaattcccgtgatgtaacagcaaaacgcgaccgtgaagtaaatatccgaaagcttacccaggcagttgagcagagctcgaataccgttgttatcactgacataaacggaagaatagaatatgtaaacaaaaaatttgaagatcttaccggatatttaaaagatgaggtcattggcggtaaccccaatttattgagaagctcttccacaacccctgagcagtataaagagctttggacgaccatcctgacagggaaagtctgggaaggcgagttccagaataccaagaagaacggagaaacctactgggaaaagataaagataactcctataatagattctgatgaaagaataacgaactttatcgctatcaaagatgatattaccgataagaagctaaaggatgaacagcttgaaaaaagcctgaaggaaaaagaaatgatgctgaaggaaatacatcacagggtgaaaaataacctccagatcgtttcaagcctacttaaccttcaggcagaatctgttgaggatacgaagcttaaggcgcagcttacaataagccagaacagggtcaggtctatgtcgataatccaccagctactttacagggcggctgaccttagcagtataacaatagaagagtatttatacagcatttcagggcagcttctggcctcatatgctgagcttagggataagatcactatcaaaattgatgctgaagatatcaagttcacgattgaaactgccgtgccgttttggtttgcttataaatga

SEQ ID NO: 1046 - protein, 270 aa, Unknown
  Obtained from environmental sample
  DOMAIN (30)...(93): PAS domain
  misc_feature (1)..(270): Xaa is any amino acid
MNVTDKDNVTGVVVNSRDVTAKRDREVNIRKLTQAVEQSSNTVVITDINGRIEYVNKKFEDLTGYLKDEVIGGNPNLLRSSSTTPEQYKELWTTILTGKVWEGEFQNTKKNGETYWEKIKITPIIDSDERITNFIAIKDDITDKKLKDEQLEKSLKEKEMMLKEIHHRVKNNLQIVSSLLNLQAESVEDTKLKAQLTISQNRVRSMSIIHQLLYRAADLSSITIEEYLYSISGQLLASYAELRDKITIKIDAEDIKFTIETAVPFWFAYK

SEQ ID NO: 1047 - DNA, 741 bp, Unknown
  Obtained from environmental sample
  misc_feature (1)..(741): n is a, c, g, or t
atggttatcaattatataatattggcccataaagaaccacgccagttatggcgcctgatagagcgattgaatgcctccaaaactttcttctatattcatgtagacaggaatgtggatgtatcaccattcaaagaagtggtaaaaggatatagcaatgtagtgttgctgcctgaaaagaaaagagtggcgtctatttggggtagtcccgggcttgtaaaagctacgttgaataccatggaagaagttataaaagataacaggcagggatacacaattttattaagcgggcaatgttacccgataaaatccaatacacgcatttcttcatttttaaatgagaattacggatacaattttattgagggctttgagctaccggatgaaaggtggcccagttcgggcataagaatgaatcagtatgctttttttctatcttcaaaaaaagaagattttattacggcgccttccttttttgacctagaatttaagtcgcttaacagaagcatcataaaaaagtatttgaaaatattcttccattttccattgaaatctttgacattgttaaagaagcgcaggtttcctgaaaacttaattccatacggcgggatgcagtggtgggcactcccacttgaaaccatcaaatttataaaccagtttgtgacggaaaatcccggttatgtaaaatatcattctttcactttattctctgatgaaattttctttcaaaccattggcccataa

SEQ ID NO: 1048 - protein, 246 aa, Unknown
  Obtained from environmental sample
  DOMAIN (3)...(244): Core-2/I-Branching enzyme
  misc_feature (1)..(246): Xaa is any amino acid
MVINYIILAHKEPRQLWRLIERLNASKTFFYIHVDRNVDVSPFKEVVKGYSNVVLLPEKKRVASIWGSPGLVKATLNTMEEVIKDNRQGYTILLSGQCYPIKSNTRISSFLNENYGYNFIEGFELPDERWPSSGIRMNQYAFFLSSKKEDFITAPSFFDLEFKSLNRSIIKKYLKIFFHFPLKSLTLLKKRRFPENLIPYGGMQWWALPLETIKFINQFVTENPGYVKYHSFTLFSDEIFFQTIGP

SEQ ID NO: 1049 - DNA, 960 bp, Unknown
  Obtained from environmental sample
  misc_feature (1)..(960): n is a, c, g, or t
ttgaagagagcatccaaagtgatcgaagagctgatcgctgatgcgcccaatatcaccattcaatctctttttgaatgtgtcattaaaaaagcaggcatcctgaaccggatcatgcaaagcgcggacaagcactggcagctccaaattcttaccgcgctattcgattttgtaaaggaagaaacgcatcgcgatccgtatatggatctgaaaaaactggttggcttatttgagttgatgcagaaagaaggcatctctataccgctggtacaggtaagcggcagcgaccagggagtgaacctgatgaccgtgcatggatccaaggggctcgagttcgaatatgttttctttgcgggatgcaacgccagcctctgggagaagaaacggaagcccggcggtggatacaaataccccgacaatttattttcctccccggctgcggaaaaaaagatcatggatgaggaagaactgaggagactgttctatgtggcgcttacccgagctgagcaacacctgcatatctcttactgcaaattcaagaacgacgggaaagaactggagccatccatgttcatcgcggaaatcctggatgaacatgctttaactcccgaaaaagtattctttgacgaggaaatactcagcgaattctccgccctgcattacggcgaatccgaagctcctgagatcgaanagatcgaagaagaactggtcagccggttactggataagttcgtgatgaatgtgacagcgctgaacaattacctcaactgccctcttgattctacttcgcaatcttgtacgtattcccgcacccaagaacgaggccaccgaaatcggttcagccgctcaccacgctctcgagaaatattccggaagatgcaggacggcggaaaaaaccagtttccctcccggcaggtttttcatgacgattttatatgggacagggagcggcccgcgaaaatt

SEQ ID NO: 1050 - protein, 320 aa, Unknown
  Obtained from environmental sample
  misc_feature (1)..(320): Xaa is any amino acid
MKRASKVIEELIADAPNITIQSLFECVIKKAGILNRIMQSADKHWQLQILTALFDFVKEETHRDPYMDLKKLVGLFELMQKEGISIPLVQVSGSDQGVNLMTVHGSKGLEFEYVFFAGCNASLWEKKRKPGGGYKYPDNLFSSPAAEKKIMDEEELRRLFYVALTRAEQHLHISYCKFKNDGKELEPSMFIAEILDEHALTPEKVFFDEEILSEFSALHYGESEAPEIEXIEEELVSRLLDKFVMNVTALNNYLNCPLDSTSQSCTYSRTQERGHRNRFSRSPRSREIFRKMQDGGKNQFPSRQVFHDDFIWDRERPAKI

SEQ ID NO: 1051 - DNA, 504 bp, Unknown
  Obtained from environmental sample
  misc_feature (1)..(504): n is a, c, g, or t
atggataagatatcatttgacaagcttcttctcaaaacagcattttgctgtatggcatcagacggacatattgacaagaaagaaatttccatcattgaatcaatgtgtagaaattcacccttatttgatggttttaatttccacgaagagatcaattcacttgtcgagaaaatcaatacacggggaaaagaatttatcttatactactttgatttgcttaaagaaatgcctttgagtgatgaggaacaattgactttgatcgattttgcaataaaagttatacaggcagatgacgaggttcaatattctgaaataaagttcttcaagaacatcaggcatcggctctcaattacagatgacaagatactggatcgatacccggatattgagcaatatcttgaagaggatataataaccgaaagtttcctggacaagttacaagccaatatattgaaagtactgaaatgcctcaatttgaaactatttctacccttagttcttcct

SEQ ID NO: 1052 - protein, 168 aa, Unknown
  Obtained from environmental sample
  misc_feature (1)..(168): Xaa is any amino acid
MDKISFDKLLLKTAFCCMASDGHIDKKEISIIESMCRNSPLFDGFNFHEEINSLVEKINTRGKEFILYYFDLLKEMPLSDEEQLTLIDFAIKVIQADDEVQYSEIKFFKNIRHRLSITDDKILDRYPDIEQYLEEDIITESFLDKLQANILKVLKCLNLKLFLPLVLP

SEQ ID NO: 1053 - DNA, 918 bp, Unknown
  Obtained from environmental sample
  misc_feature (1)..(918): n is a, c, g, or t
atgattcgaggcacccggttgttattgctggatgaggcgcagtctgttcctggcataggcttgaagatcaagatcctccacgatacttttccggaagtgcagatcgtagcatctggttcttcgtcgtttgacatggttgatatgatgtcagaacctcttacaggaaggtcaaggcaatattttcttttcccgctatcctaccaggagatcagtgatgcgacatcggcagcggatgcctatggcgagatcgacaaccttcttcgtttcggttcatatcccgaagtatatctggggaatgaaactgaaaaaaaagaagaactgctgaatatcgcatccaactatttgtacaaagacgttttgactttgggccaactaaagcgaccagatgtgatctatgaaatactaaagctgcttgcgtttcagatcggccatgaagtaagtcttaacgagatatccaacaaaacggggatcagtgtgcacaccgtcaggaaatattgtgacatgcttgagaaggctttcattcttttcaccttgccgtccttttcaaggaacctgcggaatgagatcagcaaatccaaaaagtattatttcatcgatttgggaatcagaaatgctttgatcaacaatttcaatccattgggattgcgaaatgacacaggacagttatgggaaaacttttgcgtcatggaacgcatcaagaaaaatcactatgcccgcaggtttgtcaacacatatttctggcgcacatacgagcagaaagaaatagattacatcgaagacattgatggtaaactctatgctttcgaatttacctgggacgatggtaaaaagaaagttccccaaacctttcttggagcatatcccggcagcgaatataagaaggtgacaaaaagggattttattggaagtttcttttaa

SEQ ID NO: 1054 - protein, 305 aa, Unknown
  Obtained from environmental sample
  misc_feature (1)..(305): Xaa is any amino acid
MIRGTRLLLLDEAQSVPGIGLKIKILHDTFPEVQIVASGSSSFDMVDMMSEPLTGRSRQYFLFPLSYQEISDATSAADAYGEIDNLLRFGSYPEVYLGNETEKKEELLNIASNYLYKDVLTLGQLKRPDVIYEILKLLAFQIGHEVSLNEISNKTGISVHTVRKYCDMLEKAFILFTLPSFSRNLRNEISKSKKYYFIDLGIRNALINNFNPLGLRNDTGQLWENFCVMERIKKNHYARRFVNTYFWRTYEQKEIDYIEDIDGKLYAFEFTWDDGKKKVPQTFLGAYPGSEYKKVTKRDFIGSFF

SEQ ID NO: 1055 - DNA, 510 bp, Unknown
  Obtained from environmental sample
  misc_feature (1)..(510): n is a, c, g, or t
ttgaaaacaaaaacgctaaaagcaaataaggtaaacgtagtgacgttgggctgttccaagaatttggttgacagtgaggtattgatgggtcagttgaaagccaacaactatgatgtggtacatgaaagcaccaagaatgatgctggtattgtaatcatcaacacttgtggatttattgacaatgccaagcaggaaagcattgacacgattctgcattatgccaatctgaaagaaaagggaaagattgacaagctatacgttaccggatgtctttctgagcgctacaaaggcgatctggaacaggaaattcctattgtagacagctattttggaacacgagaattgccacgtttattaaaaacgttaaaagcagactacaaacacgaactgattggcgagcgcttactgactacacccaaccattttgcctattttaaaatatctgaaggctgcgaccgtccctgctctttctgcgctaatccattaaatgcgtggcggacacatctctaa

SEQ ID NO: 1056 - protein, 169 aa, Unknown
  Obtained from environmental sample
  DOMAIN (10)...(111): Uncharacterized protein family UPF0004
  misc_feature (1)..(169): Xaa is any amino acid
MKTKTLKANKVNVVTLGCSKNLVDSEVLMGQLKANNYDVVHESTKNDAGIVIINTCGFIDNAKQESIDTILHYANLKEKGKIDKLYVTGCLSERYKGDLEQEIPIVDSYFGTRELPRLLKTLKADYKHELIGERLLTTPNHFAYFKISEGCDRPCSFCANPLNAWRTHL

SEQ ID NO: 1057 - DNA, 996 bp, Unknown
  Obtained from environmental sample
  misc_feature (1)..(996): n is a, c, g, or t
ttgaaaattaaagttttagagtttagtgattatttttccgagtttgaatataccgcccgggaaatcgaaaaaatgcactcatcaggggtaaaattgtctgagattgcgataattaccaggcaaaacaaagagctttttgtgatggctcagacccttgagcgctttggaatctcctacagcatccataccgacaccaatattttacgggacctacagatccaaaagcttattaatattttaaaagctatcgaatatgtaggttccgaagcacacctgttgcgttcaatgcatgcggattttttgggaatagatccgctggacatttataagctggtgcgtttggcgcgggaaaatgaaacgacggtttttgagatcataaagaataaggaaataatcgacaaaaatctggtgtcatattcaaaaatagttgatcattttgaaaaaattcaaatgtggcagaagttgcaaaataacgaaagctttgagtcactttttgtctcggtcgtgaatgagtcggggtttaaagaggcaatcttaaaaagcgctaaaagatatgaaaccttggataaattaatctgtttgtttgaggaatccagggtgctttatgagagaaatccggattttttactaagtgattttttggattatttggatctttgtataaaacacgatgtagcgcttaaacaaaaagttaaaacccaaaaaacagaatcggttaaattaatgacagctcataagtccaaaggcttggagtttgagtatgtttttatcatacaggcatttgacggacattggggcaactctaaacgccccagaaagaactttaaaatcccctggaatatcttaggtgtatcacttagtctggatattgatgccagtgaagatgaaagacggcttttttatgtggctatgacacgcgcccaaaaaggaattagtattttggattcccccaaaagccctggaaggcaaaaaaccagctggaggggtccattttaa

SEQ ID NO: 1058 - protein, 331 aa, Unknown
  Obtained from environmental sample
  misc_feature (1)..(331): Xaa is any amino acid
MKIKVLEFSDYFSEFEYTAREIEKMHSSGVKLSEIAIITRQNKELFVMAQTLERFGISYSIHTDTNILRDLQIQKLINILKAIEYVGSEAHLLRSMHADFLGIDPLDIYKLVRLARENETTVFEIIKNKEIIDKNLVSYSKIVDHFEKIQMWQKLQNNESFESLFVSVVNESGFKEAILKSAKRYETLDKLICLFEESRVLYERNPDFLLSDFLDYLDLCIKHDVALKQKVKTQKTESVKLMTAHKSKGLEFEYVFIIQAFDGHWGNSKRPRKNFKIPWNILGVSLSLDIDASEDERRLFYVAMTRAQKGISILDSPKSPGRQKTSWRGPF

SEQ ID NO: 1059 - DNA, 618 bp, Unknown
  Obtained from environmental sample
  misc_feature (1)..(618): n is a, c, g, or t
ttgccaattggtagaagaaaaatattttggtacaggtgcataatgtttgtaaataaatcagaacaaagaaacaatttaatggacgagggtttaaaagttgaaggaaagtttacaactgtagcgaaacaaattaaacaagctatcattctggccggcggtttaggaacaagacttcgtgaagctgttcctgatttaccaaaagctatggcgcctgttgccggacgtccttttctttcatttgttatagatgctttaagaatgcagggcattgaacaatttattttttcccttggctataaagcaggtattgttaaaaaatacctggaagaacattatcccacgcttgactactctattgttgtagaggaagaaccatttggaacaggaggcgctatacaattagcatgtagtaaaacccatgatgtaaatgttttagttgccaatggcgatacattgtttaagataaaattacaagagcttgaaaattttcatatacatcaccaggctgaatgtactataggtttaaaacctttagaaaaatttgatcgttatggagtggttcaaattaatcaggaaggttctgttattgcgtttaaagagaaaccagtattacgatga

SEQ ID NO: 1060 - protein, 205 aa, Unknown
  Obtained from environmental sample
  DOMAIN (46)...(205): Nucleotidyl transferase
  misc_feature (1)..(205): Xaa is any amino acid
MPIGRRKIFWYRCIMFVNKSEQRNNLMDEGLKVEGKFTTVAKQIKQAIILAGGLGTRLREAVPDLPKAMAPVAGRPFLSFVIDALRMQGIEQFIFSLGYKAGIVKKYLEEHYPTLDYSIVVEEEPFGTGGAIQLACSKTHDVNVLVANGDTLFKIKLQELENFHIHHQAECTIGLKPLEKFDRYGVVQINQEGSVIAFKEKPVLR

SEQ ID NO: 1061 - DNA, 627 bp, Unknown
  Obtained from environmental sample
  misc_feature (1)..(627): n is a, c, g, or t
atgaaaatgataaagcaaggtggctatgacttagtaagcggttggaaaaaagtgcgccatgataatacacttacaaaaaatattccatcgaaattttttaataccgttaccaggaaggtatcacacattaagctgcacgattttaattgcgggttaaaagcctatcgaaggaaagtagttaaaagcatcgaagtttatggcgaaatgcatcgctatattcctgtgctggctaaatgggcaggctttagaaaaataggtgagaaaatagtagagcaccggccccgaaaatacggcgtaacaaaatttggctgggaacgttttgtaaatggatttcttgatctgctctcgataacatttgtaggaaagttttcgaaaaagcccatgcacttttttggtttgtggggtactttattttttgtttttggtatgatgatgtccttatatcttatcatttccaagatcatcgaaaatacatttgcgcttaccaataaaccctggttttttcttgcactaacatctataattatcgggatgcaattattcttggcaggatttatttccgagcttatttcccgcaatgctccaggtcgcaattcctatttgatagaagaaaaagccggattttaa

SEQ ID NO: 1062 - protein, 208 aa, Unknown
  Obtained from environmental sample
  misc_feature (1)..(208): Xaa is any amino acid
MKMIKQGGYDLVSGWKKVRHDNTLTKNIPSKFFNTVTRKVSHIKLHDFNCGLKAYRRKVVKSIEVYGEMHRYIPVLAKWAGFRKIGEKIVEHRPRKYGVTKFGWERFVNGFLDLLSITFVGKFSKKPMHFFGLWGTLFFVFGMMMSLYLIISKIIENTFALTNKPWFFLALTSIIIGMQLFLAGFISELISRNAPGRNSYLIEEKAGF

SEQ ID NO: 1063 - DNA, 657 bp, Unknown
  Obtained from environmental sample
  misc_feature (1)..(657): n is a, c, g, or t
atgaaaaagtttggcattttcttcaagctttttattgagagtttccttttcgctttcgaagcgctgcgggtgaataagctgcgtacgatactttcacttctcggaatcaccatcggaatatttgccatcatcagcgtttttacggttaccgatgcactggaaagaaaaatcagaacggatgttcaaagtcttggaaacaatgtaatctatgttcagaagtggccgtggacgcctgagggtgaagatgaatatccgtggtggaaatacctgaaccggccattgccaggttataaagaaatgacagagctggagcacagggtcaactctgttgaatccttcgcctatgtggccaccatcggaggtcagctcatcaaatacaaaaacagttctgttgagaatgcttctattctgtgtgtaagtcagcagtacaatgagatcaaatccttcgagcttgaggatggaaggtatttcactgagggcgaatccaccagcggaagaccgatctgtttattgggtgcaaatgttgcagctgcactttttcccgatgggaatgccgttgaaaagaagagagtgtgcgtggaaataaatttgaaatcattggtgtgtaaagaaggaaggaaaaagcatggtggatttccactacacacagacaaataa

SEQ ID NO: 1064 - protein, 218 aa, Unknown
  Obtained from environmental sample
  misc_feature (1)..(218): Xaa is any amino acid
MKKFGIFFKLFIESFLFAFEALRVNKLRTILSLLGITIGIFAIISVFTVTDALERKIRTDVQSLGNNVIYVQKWPWTPEGEDEYPWWKYLNRPLPGYKEMTELEHRVNSVESFAYVATIGGQLIKYKNSSVENASILCVSQQYNEIKSFELEDGRYFTEGESTSGRPICLLGANVAAALFPDGNAVEKKRVCVEINLKSLVCKEGRKKHGGFPLHTDK

SEQ ID NO: 1065 - DNA, 357 bp, Unknown
  Obtained from environmental sample
  misc_feature (1)..(357): n is a, c, g, or t
atgaaaaaaaatacaatcctttgtgttgatgatgactctgacgatttactcttgcttcatgaaacattaaaagatacccgtgaagacttccaggtgatagaggctcataatggacggcaggcactagatcttcttcaaaaactaaagcaggacggtgaacatccctgcctgattatactggatataaatatgcctgttctgaatggtaaagaaactctttccattataaaaaaagatgaggcgctaaaagaaattcctgtggtagtttttacacctccggcagcgactcggaaaaaaaattttgccatcttcatggggttgaaaatggaaaccaagccccccctccttttaccaatt

SEQ ID NO: 1066 - protein, 119 aa, Unknown
  Obtained from environmental sample
  DOMAIN (4)...(111): Response regulator receiver domain
  misc_feature (1)..(119): Xaa is any amino acid
MKKNTILCVDDDSDDLLLLHETLKDTREDFQVIEAHNGRQALDLLQKLKQDGEHPCLIILDINMPVLNGKETLSIIKKDEALKEIPVVVFTPPAATRKKNFAIFMGLKMETKPPLLLPI

SEQ ID NO: 1067 - DNA, 918 bp, Unknown
  Obtained from environmental sample
  misc_feature (1)..(918): n is a, c, g, or t
ttgcgggcaagtcgcaaaaatgatgtcaagaaacttatcgggggcccggggttctacgtctgcaatgagtgcatcggcattggcaaggagatcatcaacgatgacgagcagcaggagaattccgcgcagcggaccgcattgccgaaaccggcagagatcaagacattcctggacgaatatgtgatcgggcaggacgaatcgaagaaacgtctcgcggtagccgtttatcaacattacaagcggctggagatcaacaagcggcgacccgacatcgagctgcagaaatcgaacattcttctcatcgggcccacgggcacagggaaaacgcttctcgcgcagactctggcaaaggtactcagcgtgccgttctgcatcgttgacgcaaccagcctgacagaggcgggatatgtcggggaagacgtcgagaacattttgctccgactgctgcaggccgcgggaaacgacctcgaaaaggcccagcagggaattatctacatcgacgagatcgacaagatctgccgcaaggacgacaacccttctatcacgcgtgacgtctctggcgagggtgtgcagcaggcattgttgaagatcctcgaagggacggtcgcgaacattcctacgggcggcgggcgaaagcatccgcaacaggaattcactcaacttgacacgacgaatatccttttcgtctgcggcggcgcgttcatcggactcgaaaaggtggtcgagaaacgcctgcgcaacaaatcactcggcttccaggcggacatcaaatcaagccggatgcgccagcatgaggcattaacgaagctggagcccgaggaccttatgcattacgggctgattccggaattcgtcggcaggctcccggtagtaggaactctccaaccgctgagagacgcctccttgggnnnnttttaa

SEQ ID NO: 1068 - protein, 305 aa, Unknown
  Obtained from environmental sample
  DOMAIN (5)...(35): ClpX C4-type zinc finger
  misc_feature (1)..(305): Xaa is any amino acid
MRASRKNDVKKLIGGPGFYVCNECIGIGKEIINDDEQQENSAQRTALPKPAEIKTFLDEYVIGQDESKKRLAVAVYQHYKRLEINKRRPDIELQKSNILLIGPTGTGKTLLAQTLAKVLSVPFCIVDATSLTEAGYVGEDVENILLRLLQAAGNDLEKAQQGIIYIDEIDKICRKDDNPSITRDVSGEGVQQALLKILEGTVANIPTGGGRKHPQQEFTQLDTTNILFVCGGAFIGLEKVVEKRLRNKSLGFQADIKSSRMRQHEALTKLEPEDLMHYGLIPEFVGRLPVVGTLQPLRDASLGXF

SEQ ID NO: 1069 - DNA, 954 bp, Unknown
  Obtained from environmental sample
  misc_feature (1)..(954): n is a, c, g, or t
gtggtacagattgtcgacgaagacgtgtccatccattggcatgggatattactgccaccgcagatggatggcgttccttatgtaaacacgccgcccattcatcctggccagacttttacgttccaatttaaaatacgccaacacggtacttattggtaccattcacatacagcgcttcaagaacaaaaaggcgtttacggagcactcgttatccatcccgcaaaaaaaacgatcgcatacgataaagatgttgtagcagtacttagcgattggactgatgaaaatcccgatcaagttttaaaaaatcttaaaaaagatggcgacttttacacctacaagaaagatacgatccggtcgtggttgggcgcaatcaaagcaaactcgttcggtacttttattagtaacgaatggacacgcatgggtggaatggatctttccgatgtgggttatgatgcgtttctgataaatggaaaacgcgattcacagctttttacgggtaagcccggccagaaaattagattgagaataataaacgcaggggcttccagttacttttatgtttctgtcggtaacattccaatgaaagtgatctctgcagatggcgtcgacattgaacccacaatgaccaaagaattacttttaggaatggcggaaacatatgacgtgttactcgaagtgccgcctggaaaaaactacgaactgagggccaccgcccaagacgtgaccggatatgcatctggatggattggtgcaggcgaaaaaatctttgcaccaaccaaagccgttcccgatctgtatgcatctatggatcacagtaaccatgcccggtcacgaaaatcatcacgcacaccacgggcactatcgaaaacgctcacaggtcgacccaacttcgcctcgccgaaaacccaacgaaaactattcccaaaagccccccctaccttaaggaaatctaaa

SEQ ID NO: 1070 - protein, 318 aa, Unknown
  Obtained from environmental sample
  DOMAIN (128)...(254): Multicopper oxidase
  misc_feature (1)..(318): Xaa is any amino acid
MVQIVDEDVSIHWHGILLPPQMDGVPYVNTPPIHPGQTFTFQFKIRQHGTYWYHSHTALQEQKGVYGALVIHPAKKTIAYDKDVVAVLSDWTDENPDQVLKNLKKDGDFYTYKKDTIRSWLGAIKANSFGTFISNEWTRMGGMDLSDVGYDAFLINGKRDSQLFTGKPGQKIRLRIINAGASSYFYVSVGNIPMKVISADGVDIEPTMTKELLLGMAETYDVLLEVPPGKNYELRATAQDVTGYASGWIGAGEKIFAPTKAVPDLYASMDHSNHARSRKSSRTPRALSKTLTGRPNFASPKTQRKLFPKAPPTLRKSK

SEQ ID NO: 1071 - DNA, 777 bp, Unknown
  Obtained from environmental sample
  misc_feature (1)..(777): n is a, c, g, or t
atggctcacacaactttaatactcggtgctggaatggggaaggaaattggatttccagatggccctgaactaaaagatctaataattaagcatcttcaagaccatgagagggaattgaaagatataattcagtggactacggaacaaaccgtcgatgaaatcgctgcaacctatcaaaaccacgctaaccgcattagacagcttgtaacaaaaatcctgtggaatgcggagaatgaatcggccttatcgaccaatggcaagacgtataaattgatgctcaatcaaattcaaacggcccaatccaaaggagattcggtgactattgggacatttaattatgatcggtcccttccctatttaattcatcggataaattctctgaaaccgaaagaaagccatattcaatcccaactcaagcatatttatggtcgtttagcgccactatattttgaggacaccgaaatagagcaaagaaggagtcgtttttaccatgaatatggaaagggtattaatgcttttcgtttaaatagtttacccaaagatgaaaaagctgaacgcatatttagtattgagcgagagttgtttggccgttctaatatttccttcattggtgagagcaatgggaaaaaagagggcattgatgaagatttaaaaaaatcagaatcaaatatttttttctgggtatgggaaacccaccccaggaaaatatggccagccacttgggattttgaatcttcaaacaggaccattaccccggaaccagaattgaataagtaa

SEQ ID NO: 1072 - protein, 258 aa, Unknown
  Obtained from environmental sample
  misc_feature (1)..(258): Xaa is any amino acid
MAHTTLILGAGMGKEIGFPDGPELKDLIIKHLQDHERELKDIIQWTTEQTVDEIAATYQNHANRIRQLVTKILWNAENESALSTNGKTYKLMLNQIQTAQSKGDSVTIGTFNYDRSLPYLIHRINSLKPKESHIQSQLKHIYGRLAPLYFEDTEIEQRRSRFYHEYGKGINAFRLNSLPKDEKAERIFSIERELFGRSNISFIGESNGKKEGIDEDLKKSESNIFFWVWETHPRKIWPATWDFESSNRTITPEPELNK

SEQ ID NO: 1073 - DNA, 558 bp, Unknown
  Obtained from environmental sample
  misc_feature (1)..(558): n is a, c, g, or t
ttggaatttctggattcggggggcatttccccatgggggagggaaaaaaacggggggatggttttttttgctttcgttgttttgaggagcagaagtgaaaaaaactggttgtttgctgacattgcacacagatattatcctccccatcatgaatcaattttatctgcattaaaatcgctcaatccttctcagttgagttcgagaaaggaagcggaagaactactgcgtatttctattcacgatgaaggaacgattcaatttctcctgaagaatctttattggaaagatgataaaacgctgggatggcgtttcggcctgaatgaaatcgaacgtaatatcgatatggtaggagaagcattgccggtaaaaaagatttcagttccaactctttttctcaaaggtgaaaagtccggatatattactgctgaggatgaagtcatgatcagacagattttcactaatgtaaaaatcgatacaatcagcggtgcaggacattgggttcatgctgaaaatccaaaagagtttctgagtaaaacggtagaatttttaaaggcctga

SEQ ID NO: 1074 - protein, 185 aa, Unknown
  Obtained from environmental sample
  misc_feature (1)..(185): Xaa is any amino acid
MEFLDSGGISPWGREKNGGMVFFAFVVLRSRSEKNWLFADIAHRYYPPHHESILSALKSLNPSQLSSRKEAEELLRISIHDEGTIQFLLKNLYWKDDKTLGWRFGLNEIERNIDMVGEALPVKKISVPTLFLKGEKSGYITAEDEVMIRQIFTNVKIDTISGAGHWVHAENPKEFLSKTVEFLKA

SEQ ID NO: 1075 - DNA, 711 bp, Unknown
  Obtained from environmental sample
  misc_feature (1)..(711): n is a, c, g, or t
ttgtcaattaccaagcagttggttgaattacaaaaaggaacaataagtgtgatcagcaaagttgggaagggtagtgaatttagttttagtattccgtataaattatctgaagcacccggtgttaaaaagcaaacccgtgaaaagatcatttcaaatcaacgtttaagaggaaagaaatttttagttatagaagataatgagatcaaccaaaaagtaattttaagtacacttaagtcatggtactcagaatgcgttttagtatcgacagctgttgaaggatttgagcagttaatgaattcggattttgatctgatcttaatggatattgaattgccggtattgaatggttgggactctactcagtatattcgtttaaagtttaaagcgcctaagaaagatattccgatcatcgcattaaccgcttatgcttctgaaagcgataagaaaaagtgcttagagagtggcatgaatgatgtggtaacaaagcctttcgatgctgaagaactttatgttaagattaataacctgctgtttagcgaaagtaaattagctgatgtgacaaaagagcaaaacacatcaaaagaaaattctttggagaatttggaagagaaatacgccaacaacaaagcgggcctcctcgagatatacagtttatatttagcggagttgccagtttatactgaagaattgaaagccttaaaaggctgctaa

SEQ ID NO: 1076 - protein, 236 aa, Unknown
  Obtained from environmental sample
  DOMAIN (58)...(181): Response regulator receiver domain
  misc_feature (1)..(236): Xaa is any amino acid
MSITKQLVELQKGTISVISKVGKGSEFSFSIPYKLSEAPGVKKQTREKIISNQRLRGKKFLVIEDNEINQKVILSTLKSWYSECVLVSTAVEGFEQLMNSDFDLILMDIELPVLNGWDSTQYIRLKFKAPKKDIPIIALTAYASESDKKKCLESGMNDVVTKPFDAEELYVKINNLLFSESKLADVTKEQNTSKENSLENLEEKYANNKAGLLEIYSLYLAELPVYTEELKALKGC

SEQ ID NO: 1077 - DNA, 516 bp, Unknown
  Obtained from environmental sample
  misc_feature (1)..(516): n is a, c, g, or t
atgaccgaatatttcaaaattggcaaattggtgagtgcatttggattaaagggggagttgattcttcagcataacctcggaaagaaaacttcccttaaaggtcttcaggctttgtttgtagaagagcgccgatcttcatttattccatggtttatagaaaacaccagaataaaaagcgttgaagaaatttatgttaagctacaggatgtaaataccagggaagccgcaattaagctaacacaaaaagaagtatggcttactaaacaggatttcaaaaaattttctgccaagtcctcacctattaatttactgggatattcaataatagaaaacaaaaaagaacttggaaccatactggaggtaatagagcagccacaccagcttctttgcagaatagaaattgaaaataaagaggttttaattccattgcacgaagacacgatcataaaaacggatcacaaaaaaaaacaagttactgtggaactgcctgaaggattactggaaatttatttgtag

SEQ ID NO: 1078 - protein, 171 aa, Unknown
  Obtained from environmental sample
  DOMAIN (6)...(90): RimM N-terminal domain
  misc_feature (1)..(171): Xaa is any amino acid
MTEYFKIGKLVSAFGLKGELILQHNLGKKTSLKGLQALFVEERRSSFIPWFIENTRIKSVEEIYVKLQDVNTREAAIKLTQKEVWLTKQDFKKFSAKSSPINLLGYSIIENKKELGTILEVIEQPHQLLCRIEIENKEVLIPLHEDTIIKTDHKKKQVTVELPEGLLEIYL

SEQ ID NO: 1079 - DNA, 381 bp, Unknown
  Obtained from environmental sample
  misc_feature (1)..(381): n is a, c, g, or t
atgagaatcattaaactatttgcattattcttccttacatgcgcttgtaatgaaactcaggaggatagaaacccagaatggattgttattgaagacggcgcatgttacatggaaacccagagggcaaaaatagattatgaaaaagggatactgaaatatgttgtgtatgaaatgaatttagatactaacattgataaatctattaaaaatcaccttagcaagtataatatcgattttatcaacaatggagaaaattgtctgggagacagtaattgttatggccaatacatggcttcgatgattaatcagaaatacgggaaatcttttttagatagtattgtaaatgaatgtagaaagaaggtggataatagtgcatactga

SEQ ID NO: 1080 - protein, 126 aa, Unknown
  Obtained from environmental sample
  SIGNAL (1)...(17)
  misc_feature (1)..(126): Xaa is any amino acid
MRIIKLFALFFLTCACNETQEDRNPEWIVIEDGACYMETQRAKIDYEKGILKYVVYEMNLDTNIDKSIKNHLSKYNIDFINNGENCLGDSNCYGQYMASMINQKYGKSFLDSIVNECRKKVDNSAY

SEQ ID NO: 1081 - DNA, 726 bp, Unknown
  Obtained from environmental sample
  misc_feature (1)..(726): n is a, c, g, or t
atggatgatgaaccattagcaagacttgttgtgcaggagtatttacaaagttatccgcaaataaccattgcccaggtatgtaacgatggattcgaaggagtaaaagcgatcaatcaatatcaacccgacctcatttttttagacatacaaatgccaaagatcaacggctttgaaatgcttgaattaattgaacagccaccagcagtaatatttgctactgcttttgacgaatatgccatcaaggcctttgaagcacatgctgtggattatttattaaaaccttttagtaaagagcgttttgataaagcaatacaaaattggttatcacaaaccaatcacaagcaacaaaaaacagcaactgaatcactacttcaatcagttaatgaactgcctggacaatctgaacggattgtagtaaaaacaggagggaagatcaaaattattgttgtgtcagaattatattatatagaagcggctgatgattatgtaaaactttataccaaagatggaagctatctcaaaaacaaaaccatgggtttttttgaacagactttaaatccatctcagttcgttcgcactcaccgctcctacatcataaacatccaggaaataacccgcattgaaccttatgaaaaagaatcgcaccttgctattttaaaatcaggtgctaaaattccggtaagcaaaacaggttatgtaaaattgcgctctgttttagggttataa

SEQ ID NO: 1082 - protein, 241 aa, Unknown
  Obtained from environmental sample
  DOMAIN (143)...(240): LytTr DNA-binding domain
  misc_feature (1)..(241): Xaa is any amino acid
MDDEPLARLVVQEYLQSYPQITIAQVCNDGFEGVKAINQYQPDLIFLDIQMPKINGFEMLELIEQPPAVIFATAFDEYAIKAFEAHAVDYLLKPFSKERFDKAIQNWLSQTNHKQQKTATESLLQSVNELPGQSERIVVKTGGKIKIIVVSELYYIEAADDYVKLYTKDGSYLKNKTMGFFEQTLNPSQFVRTHRSYIINIQEITRIEPYEKESHLAILKSGAKIPVSKTGYVKLRSVLGL

SEQ ID NO: 1083 - DNA, 840 bp, Unknown
  Obtained from environmental sample
  misc_feature (1)..(840): n is a, c, g, or t
gtgcgcgatgatattttcacttcgctccacattgaagaatttgaattggaagttcgcgatacgaagcgtggtgaagaagaattgacttctgaaattccgaacgtaagtgaggaagctgtgaagcacctcgatgagaacggtatcatccgcatgggtgccgaagttcgcgaaggcgatatcctgattggtaaaatcacccctaaaggtgagactgatcctacgccagaagaaaaactgctccgcgccatctttggtgacaaggctggcgatgtgaaggatgcttccttgaaggcacctccatccttgaagggtgtggttatcgataccaaactattctctcgccctaagcgtgacaaagatgttcgcgtgaagtcgaagaaagagttggatacattgaagtcgcgctacagcaaggaattgcttgacttgcgcggtgagatgatcaagaaactgactacactgctgactggcaaaaccagccagggcgtgaagcataagtttggtgatgagttgatcgcgaaaagcgtgaagttctctggtaaggtgatcgagagcaatcttttcccggacaagaacatctatcgcgatgagagcaactacaacgtgcctgaggaggttaacctgatttcggacgtgagtctggatagctggaccacggatgagcacacgaatgagttgatcgcggccatggtgaagaattacctgaccaaacgcaatattatcgcaggcgactttaagcgtgagcgtttcacactcgaagttggcgatgaactgccagccggtattgttcagttggctaaagtttacatcgcgaagaaacgtaaactgaaaagtgggtga

SEQ ID NO: 1084 - protein, 279 aa, Unknown
  Obtained from environmental sample
  DOMAIN (1)...(275): RNA polymerase Rpb2, domain 6
  misc_feature (1)..(279): Xaa is any amino acid
MRDDIFTSLHIEEFELEVRDTKRGEEELTSEIPNVSEEAVKHLDENGIIRMGAEVREGDILIGKITPKGETDPTPEEKLLRAIFGDKAGDVKDASLKAPPSLKGVVIDTKLFSRPKRDKDVRVKSKKELDTLKSRYSKELLDLRGEMIKKLTTLLTGKTSQGVKHKFGDELIAKSVKFSGKVIESNLFPDKNIYRDESNYNVPEEVNLISDVSLDSWTTDEHTNELIAAMVKNYLTKRNIIAGDFKRERFTLEVGDELPAGIVQLAKVYIAKKRKLKSG

SEQ ID NO: 1085 - DNA, 747 bp, Unknown
  Obtained from environmental sample
  misc_feature (1)..(747): n is a, c, g, or t
atgtcgattgaagtaaaagccctcactaaaatttatggtgatcaaaaagctgtaaacgatatttcctttaatatttccaaaggtgaaatagtaggtttcctgggaccaaacggggctggcaaatcaaccaccatgaaaatgattaccggttatctagcgccggatgaaggtgatattaccgttagtggtattgatgtgaaaaaagatcccctggcatcaaagaaaaaaataggatacctgcctgagtccaatgccttgtattacgatatgtatataaaggagtacttaggttttgtagcagatttacactcaataaataacaggcaacaggcaattagcaatgtgatagaacaggtaggattgacgccggagaaaaataaaaagatcgggcagctttcaaaaggatataaacaaagagtaggcattgcagccgcattgttgcataaccccgaagttttgattttagatgagcctacaagcggccttgaccccaatcaaattgtggagatacggcaggtgataaaggaccagggcagggataagatggttttattttcttcgcatattttacaggaagtagaagccatttgcgaccgtgtaattattataaataaaggaaagattgttgcagacgataaattgagcaacctgcaaaagcaatcttcattaaacgttgtgagggttagttttaaagaaccactggagcaggaatggctgcaacgattaatttggaataaaaatcggtaa

SEQ ID NO: 1086 - protein, 248 aa, Unknown
  Obtained from environmental sample
  DOMAIN (28)...(206): ABC transporter
  misc_feature (1)..(248): Xaa is any amino acid
MSIEVKALTKIYGDQKAVNDISFNISKGEIVGFLGPNGAGKSTTMKMITGYLAPDEGDITVSGIDVKKDPLASKKKIGYLPESNALYYDMYIKEYLGFVADLHSINNRQQAISNVIEQVGLTPEKNKKIGQLSKGYKQRVGIAAALLHNPEVLILDEPTSGLDPNQIVEIRQVIKDQGRDKMVLFSSHILQEVEAICDRVIIINKGKIVADDKLSNLQKQSSLNVVRVSFKEPLEQEWLQRLIWNKNR

SEQ ID NO: 1087 - DNA, 831 bp, Unknown
  Obtained from environmental sample
  misc_feature (1)..(831): n is a, c, g, or t
atgaggtttatatggatgcaccaaaagattatctgcggagggaattctttactacttatcggtttttacatgattatgcaaggaaagcataacataaatactacctgggcccaattagcgatagagttatctactgaaaaaatgttcggtggccagctcaataagtcgctcccagatttggggccggttaagacatcgtgggaaagtactacatctgcttttgcaaaaatgaaactcatacatgaatatgtacggtccaatatggagtggaacaatatttactcccaatatgcagaaaataatattaaagaagtatgggaaaagaaaaaaggaaacgccgctgaaattaatcttatactgcttaatatattaaaggctgctggtttggaaagctatccattattagtaagtgaacgagatcacggaaaagtagatactgtttatcccttccttgaccaatttaataaagtagtggcttatgttgttatcgaggataaccaatatattcttgatgctacggatagacaaactccttcttatttgattccatttaccttgttaaataccaagggttttgtagtggatagaaaaaagaaaagatttataactatagcagatacaaaggcaaaaagttttagtgtagtagaggtcaatggaagggttgaggaaacaggaaaattaagtgcctttgccaaaatcagcaattacgattatgcaaaaattgataagaaggaaacatatgtgtcccgggaaaaaataaatatgggggaatatttttgcaaagatccctacggggaatttttaaaattggattccttttcaccgggttaa

SEQ ID NO: 1088 - protein, 276 aa, Unknown
  Obtained from environmental sample
  misc_feature (1)..(276): Xaa is any amino acid
MRFIWMHQKIICGGNSLLLIGFYMIMQGKHNINTTWAQLAIELSTEKMFGGQLNKSLPDLGPVKTSWESTTSAFAKMKLIHEYVRSNMEWNNIYSQYAENNIKEVWEKKKGNAAEINLILLNILKAAGLESYPLLVSERDHGKVDTVYPFLDQFNKVVAYVVIEDNQYILDATDRQTPSYLIPFTLLNTKGFVVDRKKKRFITIADTKAKSFSVVEVNGRVEETGKLSAFAKISNYDYAKIDKKETYVSREKINMGEYFCKDPYGEFLKLDSFSPG

SEQ ID NO: 1089 - DNA, 801 bp, Unknown
  Obtained from environmental sample
  misc_feature (1)..(801): n is a, c, g, or t
gtgaacgagattcacggaaaggtagatactgtttatcccttccttgcccaatttaataaagtagtggcttatgttgttatcgaggataaccaatatattcttgatgctacggatagacaaactccttcttatttgattccatttaccttgttaaataccaagggttttgtagtggatagaaaaaagaaaagatttataactatagcagatacaaaggcaaaaagttttagtgtagtagaggtcaatggaagggttgaggaaacaggaaaattaagtgcctttgccaaaatcagcaattacgattatgcaaaaattgataagaaggaacaatatatgtccggtaaaaataaatatgaggaagattttgcaagatcctacggtgattttaaaattgattcatttactgttaaagggattgaatcagattctttgcctatggagcataagcttattttgaataatgatttaaataaatccggaacttattttttgctgccttataatttatttacgggctacgataaaaatccgtttctatctgataaccgctttaccaatattgattttgggtccaggcgatcctgcattataaatgaagtatatgcactatccgacaatctgcaggtagagtctttaccaaaaaaaataaagatagtgacacctcaaaactccatggttgtttatagggaggtgcagctaaacgataaaaatgtggaaataaaaatcaccatagaaataaacaggacaacttatactgcagatgaatatgatgtagtaaaggaatttttaaaaaaatgttga

SEQ ID NO: 1090 - protein, 266 aa, Unknown
  Obtained from environmental sample
  misc_feature (1)..(266): Xaa is any amino acid
MNEIHGKVDTVYPFLAQFNKVVAYVVIEDNQYILDATDRQTPSYLIPFTLLNTKGFVVDRKKKRFITIADTKAKSFSVVEVNGRVEETGKLSAFAKISNYDYAKIDKKEQYMSGKNKYEEDFARSYGDFKIDSFTVKGIESDSLPMEHKLILNNDLNKSGTYFLLPYNLFTGYDKNPFLSDNRFTNIDFGSRRSCIINEVYALSDNLQVESLPKKIKIVTPQNSMVVYREVQLNDKNVEIKITIEINRTTYTADEYDVVKEFLKKC

SEQ ID NO: 1091 - DNA, 498 bp, Unknown
  Obtained from environmental sample
  misc_feature (1)..(498): n is a, c, g, or t
ttgggggaaaaaggaaaaaggcggggccagggaaataacctttctttttattcggtaaaaaaaaaaattcaagcggtgggaaagtatttcttgattttcatcccagggcggtccattttggggcaaataaagatgaaagtttcgtggtccattcccaaaggcgagtttttggaaaacgaagatgctttaaccgctgccaaaagagaatttcaagaagaaacaggattttcagttgaaggtccttttgtttctatcggttccattaaacaatccagcgggaaagttgtgcaggtctggtcgtgcgaaggagatttagacgcgtctgcgattcaaagcaatagcttccgtttagaatggccgccacgttcagggaaatatcaagatttccctgaagcggatcgtgctgagtggttttccttaaatatggctcgcaaaaaaattctcaaagtacaaatgcctttcctggagaatttagcacgtctacttcaaatggaatga

SEQ ID NO: 1092 - protein, 165 aa, Unknown
  Obtained from environmental sample
  DOMAIN (24)...(161): NUDIX domain
  misc_feature (1)..(165): Xaa is any amino acid
MGEKGKRRGQGNNLSFYSVKKKIQAVGKYFLIFIPGRSILGQIKMKVSWSIPKGEFLENEDALTAAKREFQEETGFSVEGPFVSIGSIKQSSGKVVQVWSCEGDLDASAIQSNSFRLEWPPRSGKYQDFPEADRAEWFSLNMARKKILKVQMPFLENLARLLQME

SEQ ID NO: 1093 - DNA, 963 bp, Unknown
  Obtained from environmental sample
  misc_feature (1)..(963): n is a, c, g, or t
gtgnnnnttgcccacgcatcagatgcagccatgaaaggcattgccaccaaaattattgacttcatcgcgcagtttgaagatgaattggtaaaggtttggaacaagcccaaatttgtgttgaacagcaattacattattacgctggacaaaatcacaaacgaagctctgctcaagaagattttcaaacacaaaggcatgaaagaccagattgccgaatggcaggaactcggcatggtggacaagaaattcaaacttgatttggtcttggaaaaagatttattgagagaacccgccaacccgcaataccaatatttgccgctggatacgaaatacttcaaagaccttgaattcgatattcttgccctgttcgatgaccttgacgcttctttggatggatggctgatacacagtgagaattatcaggcactcaacacgcttttgccgaagtttcaggaacaaatcaagacaatctatattgacccgccatataacattgatggagatgactttatctaccttgacagatatcggcattcaacctggttaacccttactcaaaatcggattgagttggcaaggaattggatgaatgacgacagcgccttgttcataagcattgatgataatgaacaaccaaacttgagacatggaatcgaacaacttctcggatcttcatcctttattgccgatgtctgcgttgtcaacaacttaaaagggcgtaatgataaggaacacatagccacggcaaacgaaagattattaatttcagtaaatcacagattgaggagaggtatgggtagaaacagcagagattgtgccatagatttgctcaactgtgcggaattaagaatttcgaaaaccgattcaaacgaaaacgagaaacttctacttgggcgaggacgccgattcatcaggcgagagaaactcccaaggcaggaaaacccaggcattcacaagaattaa

SEQ ID NO: 1094 - protein, 320 aa, Unknown
  Obtained from environmental sample
  misc_feature (1)..(320): Xaa is any amino acid
MXXAHASDAAMKGIATKIIDFIAQFEDELVKVWNKPKFVLNSNYIITLDKITNEALLKKIFKHKGMKDQIAEWQELGMVDKKFKLDLVLEKDLLREPANPQYQYLPLDTKYFKDLEFDILALFDDLDASLDGWLIHSENYQALNTLLPKFQEQIKTIYIDPPYNIDGDDFIYLDRYRHSTWLTLTQNRIELARNWMNDDSALFISIDDNEQPNLRHGIEQLLGSSSFIADVCVVNNLKGRNDKEHIATANERLLISVNHRLRRGMGRNSRDCAIDLLNCAELRISKTDSNENEKLLLGRGRRFIRREKLPRQENPGIHKN

SEQ ID NO: 1095 - DNA, 873 bp, Unknown
  Obtained from environmental sample
  misc_feature (1)..(873): n is a, c, g, or t
ttgctaaagagaaagctcaaaccagttgtcgatacaaagaaagaatttacacaacgtaaacttaagtctaacgatccgtccaatttcaatctcatatttgacttcgacagagaagaagtaaaagagttggcaaaaaaattaggtacagagatcggcgaagatgaagttactgaaatcatgaagcatgcttgggcattttcggattccttaaagaagcgcttctatggtacgattaaacatattgctaaaggagttattgaatctatgccagatgcaaagcctactacaaacgatactacgccagaagaatctgttatagcggttccaagtgctgtatcagaaggcgtatatacaaatttagcaatcacaaaagaaggcaatctagaagtttcaataactgatgaaggtaaaaagtttgtcgaagaaaataaactgacaaacatgccgatcaaagaagcattcgagcatttaatgattgacgattttcagcacataaacaacggctggtctgtcattcaaccagaaatgctaggtattgttgaagaatcggtaaatgtcatcggccataaagttaaagtcgtaagcaatgtattgtttcctgttgaccgcgatgcacgattatttgtatatgcagactataagacaaaatcagaaataaccgacttgctagcatatggcaaaatcgttctggaaggttcgggttttgaatttagcgcagatcaattancagtatcggatctcgatgtaagcgaatatcagtatgtagatcgtgatatggatattgctgcagcgttagattcaataagattatctgccgagtctgacagatttgcaggactattcgtgaaaacaggcaggcggagagattattag

SEQ ID NO: 1096 - protein, 290 aa, Unknown
  Obtained from environmental sample
  misc_feature (1)..(290): Xaa is any amino acid
MLKRKLKPVVDTKKEFTQRKLKSNDPSNFNLIFDFDREEVKELAKKLGTEIGEDEVTEIMKHAWAFSDSLKKRFYGTIKHIAKGVIESMPDAKPTTNDTTPEESVIAVPSAVSEGVYTNLAITKEGNLEVSITDEGKKFVEENKLTNMPIKEAFEHLMIDDFQHINNGWSVIQPEMLGIVEESVNVIGHKVKVVSNVLFPVDRDARLFVYADYKTKSEITDLLAYGKIVLEGSGFEFSADQLXVSDLDVSEYQYVDRDMDIAAALDSIRLSAESDRFAGLFVKTGRRRDY

SEQ ID NO: 1097 - DNA, 441 bp, Unknown
  Obtained from environmental sample
  misc_feature (1)..(441): n is a, c, g, or t
ttggaagcatgtggaatgaagaacatacaactgacagcgatactcaaggaaattgaagtaatcaataaaaacaactacgatgaagacattgaaaaattgtctacgatcatcaatggattaattaatagtgtcaagtttcagcatgctggtagatttgatttttcgaataataaagaagtcattaccaacgaattaattaaacaggttggaatttattcctatgccgataatgttaaacaggaaatagtaaatgcaataacagcatttatgagcgatctcgaatcggaacgagagatgccgaaaaagtttgtcagcaacaagacggaatattttgattccaagttatctactaaatggaacaaactaaaaagttcaatcgttaatatactgtcttccggtaataatgtagcaaagaagttgcctgaccgaaatgtaaaatag

SEQ ID NO: 1098 - protein, 146 aa, Unknown
  Obtained from environmental sample
  misc_feature (1)..(146): Xaa is any amino acid
MEACGMKNIQLTAILKEIEVINKNNYDEDIEKLSTIINGLINSVKFQHAGRFDFSNNKEVITNELIKQVGIYSYADNVKQEIVNAITAFMSDLESEREMPKKFVSNKTEYFDSKLSTKWNKLKSSIVNILSSGNNVAKKLPDRNVK

SEQ ID NO: 1099 - DNA, 708 bp, Unknown
  Obtained from environmental sample
  misc_feature (1)..(708): n is a, c, g, or t
atgaaagtgcataatgactttaatttaaatgaaatactttggtacaaaattggaggaagagcaaggctttatatagaagtagaaaacaagaatgatgttaaggaggctttcgaccttattaaaaaagaaaaaatcaacaaatacttctttttaggccttggttctaatctcattttctctgatgaatattacgatggagctattattaaattcgttcctgggactgaacctattagattagtaaagcctcacattatagaagctgatgcgggagtggtcttagatgatgttattagattttcatttgaccataatttatccggacttgagtgggcaggagggttacctggggatgttggagcagccgtacgggggaatgttggagcttttggcggagaaataaaggatgtagtaaaagaagtagaagtttttgacattgtaaacaacaagccaaaatttaagatattgaagaggtttgaacttcagttctcatataggagctctagggtaaaaaagaacaagcttggggttgttaaggcccaatttagactcaatcctacggatgacgcaacaatgcttaaggttcgttcaacttataacaattatattgagtacagaagaataagacctcctcttgaataccccaaaatgtggaaggggtttttaaaaataacgcttattccagaacacgttggagaaaggccttaa

SEQ ID NO: 1100 - protein, 235 aa, Unknown
  Obtained from environmental sample
  misc_feature (1)..(235): Xaa is any amino acid
MKVHNDFNLNEILWYKIGGRARLYIEVENKNDVKEAFDLIKKEKINKYFFLGLGSNLIFSDEYYDGAIIKFVPGTEPIRLVKPHIIEADAGVVLDDVIRFSFDHNLSGLEWAGGLPGDVGAAVRGNVGAFGGEIKDVVKEVEVFDIVNNKPKFKILKRFELQFSYRSSRVKKNKLGVVKAQFRLNPTDDATMLKVRSTYNNYIEYRRIRPPLEYPKMWKGFLKITLIPEHVGERP

SEQ ID NO: 1101 - DNA, 558 bp, Unknown
  Obtained from environmental sample
  misc_feature (1)..(558): n is a, c, g, or t
ttgacctctatgaatatcagtaaagtaactattccctacgagcagactggttatttcagccacatagctattgattatctcgcaggcaaagattcaattaaacctttctacaaatatccttttgaaataaaatcatttgaacaggcaatcactgacaagcaaaagcaggatgttgaccgtgcgctgctgcataaagtattgctggagcaatatgcatcttactcgacttcggaaaatgagggagctataaagaatattgaatctttaaggagtgataacacatttgtagttgtaacagcccaccagcccaatttatttctcggtcccctttatcttctctataaaaatatttccaccattaatttggctgaaagattaaataaagatttcccggataaatatttggtccggtttaattggatgggtagcgaaaaccatgacaccgaagaactccgcccatattcaattattttggaaaaaaccctccctgggaaggatgaaattccatgttggcttttggaaaaaaaaatacttctttcccttcaaaccttggtttga

SEQ ID NO: 1102 - protein, 185 aa, Unknown
  Obtained from environmental sample
  misc_feature (1)..(185): Xaa is any amino acid
MTSMNISKVTIPYEQTGYFSHIAIDYLAGKDSIKPFYKYPFEIKSFEQAITDKQKQDVDRALLHKVLLEQYASYSTSENEGAIKNIESLRSDNTFVVVTAHQPNLFLGPLYLLYKNISTINLAERLNKDFPDKYLVRFNWMGSENHDTEELRPYSIILEKTLPGKDEIPCWLLEKKILLSLQTLV

SEQ ID NO: 1103 - DNA, 969 bp, Unknown
  Obtained from environmental sample
  misc_feature (1)..(969): n is a, c, g, or t
gtgattctttttcccttacgttgtacctggcaaaaatttgggcagcgttttgctttcctcccattcaccatctggcgaatgggtgtacttcatattttgtcgacctggatagtgggccaactattgtacaggttcacagccaaaaatacggtggcaaatatcatctttaatgtgctgttgttcgtcgctcaccaggtaatatggtttctggcgatgtataccctgtcgtatgcggaagccgcggcctgggaaagacagattggttattcaggcaatacgctgagtgatgcgtttggcaggcagatcataggtatctggttcgataccggtaaatatctgatcaaagtgatcacgttttactgtctgcattcctatatcagttttaaaaatgcggagagacataaaggagaattgatactgatgaacaaggatctgcagcttaatttactgaagcagcaacttaaccctcatttttacttcaatacgatgaacaatctatacggtttgtcacgtaaggcaagccccaaattatatccggcatttaaccagttgtcaggtatcatgcattatgtactaaaagaatgtaccgaagagaaagtggccctggagaaggaaattgactttctccgcaattatgtagcgctggaaaaactccggtatgaaacagacacgatcattgagtttgccgtagagggagaaccgcaggataaaaagatcgcgtctctgttgctcatacagtttgtagaaaatgcgttcaaacatgggatgaaagaaaagacgctacaaaactggatgaaagtgttgctgtcggtaaatgggaatgtactcaactttacactggaaaacagttgttataataacaaactgcgggaaggcatcggcctcggtagttctagaaagagactggaactgatgtataagngggcactatcatctggaaacgggaataaaaacaatatatttacgtaa

SEQ ID NO: 1104 - protein, 322 aa, Unknown
  Obtained from environmental sample
  DOMAIN (146)...(227): Histidine kinase
  misc_feature (1)..(322): Xaa is any amino acid
MILFPLRCTWQKFGQRFAFLPFTIWRMGVLHILSTWIVGQLLYRFTAKNTVANIIFNVLLFVAHQVIWFLAMYTLSYAEAAAWERQIGYSGNTLSDAFGRQIIGIWFDTGKYLIKVITFYCLHSYISFKNAERHKGELILMNKDLQLNLLKQQLNPHFYFNTMNNLYGLSRKASPKLYPAFNQLSGIMHYVLKECTEEKVALEKEIDFLRNYVALEKLRYETDTIIEFAVEGEPQDKKIASLLLIQFVENAFKHGMKEKTLQNWMKVLLSVNGNVLNFTLENSCYNNKLREGIGLGSSRKRLELMYKXALSSGNGNKNNIFT

SEQ ID NO: 1105 - DNA, 477 bp, Unknown
  Obtained from environmental sample
  misc_feature (1)..(477): n is a, c, g, or t
gtggcaactcgttctccgagagattgtggaggggtcaactttttgaaagacgtcatcgagcacaaggatggctggcggattttctacattaacggcaagccgatcacgcaggaggctcacctgcaactcctctatcgcctgacctggtttgcatcgcggatggacgtcaaccgtgaggtcaacaacggccggggtccggtggagtacaagatctcggaaggcaacgccgacaagacgctggtggaattcaagctcgcacggaacaccaagctgaaaatgaacctgcagaaccaggtgcagatctacgaaaaggccaacaacacgttgtcgtccatcacggtgatcctctacttcaccgatagcgagtgggcgaaggtaaaaaaaatactgcaggacctgaacatcgacaagagcaagaacatcgtcttgatcgatggccgctccaccaacaaaccctctgcgtcgaccgtgaagtag

SEQ ID NO: 1106 - protein, 158 aa, Unknown
  Obtained from environmental sample
  misc_feature (1)..(158): Xaa is any amino acid
MATRSPRDCGGVNFLKDVIEHKDGWRIFYINGKPITQEAHLQLLYRLTWFASRMDVNREVNNGRGPVEYKISEGNADKTLVEFKLARNTKLKMNLQNQVQIYEKANNTLSSITVILYFTDSEWAKVKKILQDLNIDKSKNIVLIDGRSTNKPSASTVK

SEQ ID NO: 1107 - DNA, 576 bp, Unknown
  Obtained from environmental sample
  misc_feature (1)..(576): n is a, c, g, or t
ttgggcctggaatttccattttatataaatttgaaagaagaaatggctaaaacaataatctcaaaaacaatcaaagatataaatgaaaatccatatgtgattaaggagaatggatgtgctgcatgtcatgttctatttactctatcaaaagaaatgaaacttaatgaacaagaagcatcagatttgttatcagagatactgctttctaatcctgatcttgatttttcatttatagagatggtagaatatgtacatatgaaaaaaagaatgataggaacggtatttgcattaagaacacgcgaggcaaaggacaagtatattttttcaaatttcaagaacactttagcagaattacattcagatctaattagccacggaccagatattgttttacgaaaattgcttttgactatgatctcacttgaaactgcaaaaaatataggaatagaccatcatgcgtcaaccgaagagctttattattttatgagaaaaaatgagctcgaatcggatggtaatataatgaaattcatcaatcaactttatcaaagaattgttagtaaggagaatagcaagtaa

SEQ ID NO: 1108 - protein, 191 aa, Unknown
  Obtained from environmental sample
  misc_feature (1)..(191): Xaa is any amino acid
MGLEFPFYINLKEEMAKTIISKTIKDINENPYVIKENGCAACHVLFTLSKEMKLNEQEASDLLSEILLSNPDLDFSFIEMVEYVHMKKRMIGTVFALRTREAKDKYIFSNFKNTLAELHSDLISHGPDIVLRKLLLTMISLETAKNIGIDHHASTEELYYFMRKNELESDGNIMKFINQLYQRIVSKENSK

SEQ ID NO: 1109 - DNA, 354 bp, Unknown
  Obtained from environmental sample
  misc_feature (1)..(354): n is a, c, g, or t
atgaaagtactgctttatattttaattttattttctggttttaaaagctttggacaggcaaataattctaacccggaagtggaaattattaaggttcatcaggatagtattgccagtgctattagtcagggaccattatcatttttaaataaccctgacttggatggatggtttgaggattttaatgtgaatggggtggaggtgcccaataattatcagcattgcgtaccttgttttaaagatcgcttacttaaggcaaagaagggaaatctattttttcttaaaaatattaaagtaaaaaattcaaccggaaaattatctgttgttggttcaaagcgcattgagataatatga

SEQ ID NO: 1110 - protein, 117 aa, Unknown
  Obtained from environmental sample
  SIGNAL (1)...(18)
  misc_feature (1)..(117): Xaa is any amino acid
MKVLLYILILFSGFKSFGQANNSNPEVEIIKVHQDSIASAISQGPLSFLNNPDLDGWFEDFNVNGVEVPNNYQHCVPCFKDRLLKAKKGNLFFLKNIKVKNSTGKLSVVGSKRIEII

SEQ ID NO: 1111 - DNA, 354 bp, Unknown; identical to SEQ ID NO: 1109
  Obtained from environmental sample
  misc_feature (1)..(354): n is a, c, g, or t

SEQ ID NO: 1112 - protein, 117 aa, Unknown; identical to SEQ ID NO: 1110
  Obtained from environmental sample
  SIGNAL (1)...(18)
  misc_feature (1)..(117): Xaa is any amino acid

SEQ ID NO: 1113 - DNA, 969 bp, Unknown
  Obtained from environmental sample
  misc_feature (1)..(969): n is a, c, g, or t
atgaaaaaggatgcatttttacattatactgacctgagtccctatgcgaaatctctattaaaatttacgcagcattccattaacaataaggccgcagtaattctggatttcgggaagtttgaagtggagcctgaaatcattaaaacaggaaagatcagcgaggtattaagtggtaagcccaatatccttgtgcagattttgaaagagccgattgctgctaaaggcccacgcttaagctgtgaaatatctttgccaggccgttttgtggtactcactccttttaacgatgtcgtagcagtatcccgtaagattcattcttctgaggaaagaaaaaggcttcaaagaatagttgaatccataaaacaaaagaattttggcgttattgttcgtactgcagcagaaggaaagaacactgctgaacttcacgaagacctttccgagttggtggacacgtggcatacaattcagcaaaatcttaaaaatgccgtagcaccagctaaaattctgagcgaacaaacaaaaactacgagtattctgagagatcttttaaatgaagattttaatcgtattgtaattaacgataagagtattttctctgaaactaaaagttatattcagcgcattgctcccgaaaaagcggatatagtcacatttcatcaaaacggtaatccgattttcgaccaatatggtattaccaaacaggtaaaagcatcctttggaaaaaccgtaaatctgaatagtggagcttatcttatcatagagcacactgaggcgttgcatgtcattgacgtaaatagtggctataaaagtgtaagtaataaccaggaacaaaatgctctagaaacaaatttagaagcggctgaagagattgcacggcagctaaggctaagggatataggtggtattatagtggtagattttattgatatgaagcttccggacaataagaaaaagctgatcgaggcatga

SEQ ID NO: 1114 - protein, 322 aa, Unknown
  Obtained from environmental sample
  misc_feature (1)..(322): Xaa is any amino acid
MKKDAFLHYTDLSPYAKSLLKFTQHSINNKAAVILDFGKFEVEPEIIKTGKISEVLSGKPNILVQILKEPIAAKGPRLSCEISLPGRFVVLTPFNDVVAVSRKIHSSEERKRLQRIVESIKQKNFGVIVRTAAEGKNTAELHEDLSELVDTWHTIQQNLKNAVAPAKILSEQTKTTSILRDLLNEDFNRIVINDKSIFSETKSYIQRIAPEKADIVTFHQNGNPIFDQYGITKQVKASFGKTVNLNSGAYLIIEHTEALHVIDVNSGYKSVSNNQEQNALETNLEAAEEIARQLRLRDIGGIIVVDFIDMKLPDNKKKLIEA

SEQ ID NO: 1115 - DNA, 717 bp, Unknown
  Obtained from environmental sample
  misc_feature (1)..(717): n is a, c, g, or t
ttggctttatttcctttgcctacgactggcgggcacaggatttacccaatatggaaaccgaaactggcaactttaaaaaaacatgcaattaaattaagcagtgtctggttttggataaacggagggaaagaccaggtgctggatgaggccaatgagaatattttaagaacactcgcaaaaactaatacaaaaactgaattatgggtaagcttcccaaagagctatttcgacggactcacagatgaggaaaaaataaaaaaaggtgttcaaactctccggtatattcatcaacgtacttcggagataggatgtacagttgcgttatataatcatgaagattggtttggagagcctgccaatgaagtgaagatcattaaagcatccgggttaagtaatgtacacattgtatataattttcatcatggacatacacaggtagacaggtttgatgaaattctgaaaattgccggtccttatctcagcacggtaaatcttaatggtatgagcggtagcgagtttaatatacttaccattggtaaaggaacacaggaactggagatgctactaaaattaaaagcttcaggctttaatggcaccattggcattattggccatacagaaaacgaagatgtagcgctggtactgcaaagaaatattgacggattgaagaaattgctcgctgaaatgggagaaatgaaagcattgagcacctattaa

SEQ ID NO: 1116 - protein, 238 aa, Unknown
  Obtained from environmental sample
  misc_feature (1)..(238): Xaa is any amino acid
MALFPLPTTGGHRIYPIWKPKLATLKKHAIKLSSVWFWINGGKDQVLDEANENILRTLAKTNTKTELWVSFPKSYFDGLTDEEKIKKGVQTLRYIHQRTSEIGCTVALYNHEDWFGEPANEVKIIKASGLSNVHIVYNFHHGHTQVDRFDEILKIAGPYLSTVNLNGMSGSEFNILTIGKGTQELEMLLKLKASGFNGTIGIIGHTENEDVALVLQRNIDGLKKLLAEMGEMKALSTY

SEQ ID NO: 1117 - DNA, 807 bp, Unknown
  Obtained from environmental sample
  misc_feature (1)..(807): n is a, c, g, or t
ttgaagcgctgttgggaaaaaaatccttgcttggccaggaatcaaatttggggccaattacgggaaattggctgcggctcaatacggggtttgaaggttacgaaaggaaatgtggtcattaccatggacgttgatctgcaggattcgccggaagaaatcccggacctctacaaaatgatcacgaaagacggctttgatcttgtctccggctggaaagaaaaacgctacgacccgatcaccaaaaccatcccgacaaaattattcaacgccgccacgcgcaggatgtcgggaataaagctgcacgatttcaactgcggactcaaagcctatcgcagcgatgtggtaaaaagcattgaagtgtacggcgaaatgcatcgttacattcctgtcattgcaaaacgcgcgggctttaccaatattggtgaaaaaagcgtggcgcaccaggcaaggaaatacggcacaacgaaattcggactcgaacgttttgtaaatggctttctcgacctgctttccatttcattcgtcaccaaattcggaaagcgcccgatgcactttttcgggctgaacggaacgctcatgttcatcctcggtttttgcggatttctttacctcatcatcaataagctctggatcgtttaccacgatcattccatcgcgccacgcgttaccgaaagtccgtggttttatatttcgctcgtcgccatggtcatcgggacgcagcttttcctcgcaggcttcctcgccgaattattagcgcgtaattctcctgatcggaatacttatcttattgagaagaaggttggttga

SEQ ID NO: 1118 - protein, 268 aa, Unknown
  Obtained from environmental sample
  misc_feature (1)..(268): Xaa is any amino acid
MKRCWEKNPCLARNQIWGQLREIGCGSIRGLKVTKGNVVITMDVDLQDSPEEIPDLYKMITKDGFDLVSGWKEKRYDPITKTIPTKLFNAATRRMSGIKLHDFNCGLKAYRSDVVKSIEVYGEMHRYIPVIAKRAGFTNIGEKSVAHQARKYGTTKFGLERFVNGFLDLLSISFVTKFGKRPMHFFGLNGTLMFILGFCGFLYLIINKLWIVYHDHSIAPRVTESPWFYISLVAMVIGTQLFLAGFLAELLARNSPDRNTYLIEKKVG

SEQ ID NO: 1119 - DNA, 651 bp, Unknown
  Obtained from environmental sample
  misc_feature (1)..(651): n is a, c, g, or t
atgaaaaaattatttttaatcctttgtatatttttttcggtagaatcttttagtcagcatatacctgactttataaaaaaagattcacttacagtatggttcactgaatattcatcggttattgaaattactgccccggtaagaagcaatgggataaagcagacattatttacccggcttttaaaaaataaatgcatcccaattaatactaatgccaaggatagaatttctgaaaataaatattgtggtggtaatttaattcagaccgagacattctcagattcatttaatccttacagaaatcatcttagcagcttatctgaaaataacaggcaggaaatgctaaataaagaaattgcatgccattgcgataaaaatgtgcaaacaaagctggatgtatacaagctaaatcaggttttattttatcagagcaataagatacatataagaaatatgcttgtttctccattatgcctcaacaaaaaaactaaagaaaataacaaaaatctatttacatggacatcctgtttttcggctttatataaccaggggggccaaaagattttatcctcatcaaaaaaacaattaactgacctcggaagtaaagaaacaatgtatatgctcacgaattacagtgcttcagatacttaa

SEQ ID NO: 1120 - protein, 216 aa, Unknown
  Obtained from environmental sample
  SIGNAL (1)...(18)
  misc_feature (1)..(216): Xaa is any amino acid
MKKLFLILCIFFSVESFSQHIPDFIKKDSLTVWFTEYSSVIEITAPVRSNGIKQTLFTRLLKNKCIPINTNAKDRISENKYCGGNLIQTETFSDSFNPYRNHLSSLSENNRQEMLNKEIACHCDKNVQTKLDVYKLNQVLFYQSNKIHIRNMLVSPLCLNKKTKENNKNLFTWTSCFSALYNQGGQKILSSSKKQLTDLGSKETMYMLTNYSASDT

SEQ ID NO: 1121 - DNA, 399 bp, Unknown
  Obtained from environmental sample
  misc_feature (1)..(399): n is a, c, g, or t
atggaagcaaatttacatcagatccgcaagcatcgctattatagcgaagaatttaagaaaagcctagttgccagttttgaaaagggtgaatttagcgtttcgcagctggaaaaattatatggcattcgaaatgtcagcatttacaggtgggtctataaatattctcgttttaatgaaaaaggcagtagaattgtagagatggtaaatagcaatcaagataaagtaaaagagctggcaaaaaaagtaaaggaactggaacagatggttgggcaaaagcaaatagcaattgaatatttagaaaaaatgattgaattagctaagagtgatttaaacatagatataaaaaaaaattacaattcgcgactatctgctggttcaaatccaataaagaaaaaatag

SEQ ID NO: 1122 - protein, 132 aa, Unknown
  Obtained from environmental sample
  DOMAIN (11)...(99): Transposase
  misc_feature (1)..(132): Xaa is any amino acid
MEANLHQIRKHRYYSEEFKKSLVASFEKGEFSVSQLEKLYGIRNVSIYRWVYKYSRFNEKGSRIVEMVNSNQDKVKELAKKVKELEQMVGQKQIAIEYLEKMIELAKSDLNIDIKKNYNSRLSAGSNPIKKK

SEQ ID NO: 1123 - DNA, 597 bp, Unknown
  Obtained from environmental sample
  misc_feature (1)..(597): n is a, c, g, or t
atgattgtagtttttgatgaatacattcttccttttctgcttttatcctgttctgttccgcaaaaggttagttgggacagaaccaaagagggcaacgttcgtcatatagggtcgaaagcacttgaaacgaaaattgacaatgcaacatataggttcaacctgacagtattctcaggacaaaaatcaaaatactattgcttattgataagctcgttatggagaatagaaaataacggtatagtattaattaagcttggcaatgacgagaccgtaaaattagtatctgacaattctaacgtaggtgaagttgattggccaacatattcaccaataattggcgggacttcaacttctggagtgatgactacaaaaaaagttgactactatacatcaatttatttgttgcaggaggacgttttaagcaaaatcgaacagtatggaattcacaaaattagaattcagtttggaaactcatacaaagaacaaaattgggaaagggataaactaggaaaatatattagaaactctcacgaaattctggaattgcagttacaaaaaccagttgcaccatctaaatctattgaacaggacttttaa

SEQ ID NO: 1124 - protein, 198 aa, Unknown
  Obtained from environmental sample
  misc_feature (1)..(198): Xaa is any amino acid
MIVVFDEYILPFLLLSCSVPQKVSWDRTKEGNVRHIGSKALETKIDNATYRFNLTVFSGQKSKYYCLLISSLWRIENNGIVLIKLGNDETVKLVSDNSNVGEVDWPTYSPIIGGTSTSGVMTTKKVDYYTSIYLLQEDVLSKIEQYGIHKIRIQFGNSYKEQNWERDKLGKYIRNSHEILELQLQKPVAPSKSIEQDF

SEQ ID NO: 1125 - DNA, 525 bp, Unknown
  Obtained from environmental sample
  misc_feature (1)..(525): n is a, c, g, or t
ttgggacagaacccaagagggcaacgttcgtcatatagggtcgaaagcactgaaacgaaaattgacaatgcaacatataggttcaacctgacagtattctcaggacaaaaatcaaaatactattgcttattgataagctcgttatggagaatagaaaataacggtatagtattaattaagcttggcaatgacgagaccgtaaaattagtatctgacaattctaacgtaggtgaagttgattggccaacatattcaccaataattggcgggacttcaacttctggagtgatgactacaaaaaaagttgactactatacatcaatttatttgttgcaggaggacgttttaagcaaaatcgaacagtatggaattcacaaaattagaattcagtttggaaactcatacaaagaacaaaattgggaaagggataaactaggaaaatatattagaaactctcacgaaattctggaattgcagttacaaaaaccagttgcaccatctaaatctattgaacaggacttttaa

SEQ ID NO: 1126 - protein, 174 aa, Unknown
  Obtained from environmental sample
  misc_feature (1)..(174): Xaa is any amino acid
MGQNPRGQRSSYRVESTETKIDNATYRFNLTVFSGQKSKYYCLLISSLWRIENNGIVLIKLGNDETVKLVSDNSNVGEVDWPTYSPIIGGTSTSGVMTTKKVDYYTSIYLLQEDVLSKIEQYGIHKIRIQFGNSYKEQNWERDKLGKYIRNSHEILELQLQKPVAPSKSIEQDF

SEQ ID NO: 1127 - DNA, 312 bp, Unknown
  Obtained from environmental sample
  misc_feature (1)..(312): n is a, c, g, or t
ttgtccagttggcataatattttttcattattactgggatacacgccttttgacttaactaattcatcttcaaaagttaaaggaattggaaatccatttgcagttcataaaggtgaaaccgatgaaaggggcagttcatggacacacaaatgcatttatacaaaaaaatggctaatcgattggcagaaaatatacaatctcaaaacaattaaaacttatggagcaggatactatccattacccagttgggttggccaatatttgcaaaaacattcagcctttattacgatagttgcacaaaagaatgaataa

SEQ ID NO: 1128 - protein, 103 aa, Unknown
  Obtained from environmental sample
  misc_feature (1)..(103): Xaa is any amino acid
MSSWHNIFSLLLGYTPFDLTNSSSKVKGIGNPFAVHKGETDERGSSWTHKCIYTKKWLIDWQKIYNLKTIKTYGAGYYPLPSWVGQYLQKHSAFITIVAQKNE

SEQ ID NO: 1129 - DNA, 309 bp, Unknown
  Obtained from environmental sample
  misc_feature (1)..(309): n is a, c, g, or t
ttgcgtcaattcactgtaaggcacataaattgtataatcacgatactttgcaagaatcttaaagaatatataagcagatacaaaaagcttttccagagattttcccaaataaaaatttttaagtgttatccatcgaataaattgaggaatacgatatgtctctacctcaatattaagatcctgaaaataggatggttctgtatccagacataccaaatttacattttgtggggctctttttgcaatctcataggcacgtctaaatcctccagcattcataacggtgtttgcctctggatgccaggataa

SEQ ID NO: 1130 - protein, 102 aa, Unknown
  Obtained from environmental sample
  misc_feature (1)..(102): Xaa is any amino acid
MRQFTVRHINCIITILCKNLKEYISRYKKLFQRFSQIKIFKCYPSNKLRNTICLYLNIKILKIGWFCIQTYQIYILWGSFCNLIGTSKSSSIHNGVCLWMPG

SEQ ID NO: 1131 - DNA, 312 bp, Unknown
  Obtained from environmental sample
  misc_feature (1)..(312): n is a, c, g, or t
ttgccatacggcatgttgtggtgccttttgaaaaagagattcttacccctgtgcaatgctttaatgaaattggtgatgacaggattgagaacttcggatgggattgacagggcgaggattaaaaaattgggtgatgaatttgatcagtatttaacagaggaggcaaagcctttgattgaagaggggaaaattaatatcaatagtgagggaaattttgtgctgatgcccgagtattatttttatgcggatgggatagcggcggatttgtttatgactgaggaggcaggccctgagaaagtggagatcgagtaa

SEQ ID NO: 1132 - protein, 103 aa, Unknown
  Obtained from environmental sample
  misc_feature (1)..(103): Xaa is any amino acid
MPYGMLWCLLKKRFLPLCNALMKLVMTGLRTSDGIDRARIKKLGDEFDQYLTEEAKPLIEEGKININSEGNFVLMPEYYFYADGIAADLFMTEEAGPEKVEIE

SEQ ID NO: 1133 - DNA, 822 bp, Unknown
  Obtained from environmental sample
  misc_feature (1)..(822): n is a, c, g, or t
atgaaactttcacccgagcccgagtatgtcgccctttccaatgcgttgcagctctattacgaaaaggaagttgccttcaggtgttttgattccttctatgagttcttgcaaaaggactttgttgaagtcctgaagactgataaagtcaaggaaaaggattttgatgtttccaattttctttatgtactgcgcccctactataaaggtggtgagtttgattatttactcaatgcaaccaaggaccttgaaatgctgcaggaacgctttattgtgtttgaactcgacaatattaaggaccaccccatactgttcccggtcgttacgatcatcatcatggaagtgtttatctccaagatgcgtaaactgaaaggtatccgcaagatgatcctgatcgaggaagcatggaaagccattgcaagagaaggtatggcggagtatattaaatacctattcaaaacagtccgaaaattctttggtgaagctattgttgtgacgcaggaagtggaagatattatttcttccccggtagtgaagcaggcgatcatcaataactcagattgtaaaattctgctggatcaaagcaaataccaaaacaagtttgaacagatccaggaactgctgggactgaccgaaaaggaaaaggcgcttgtactgtctatcaacaaagcgaacgatcccacagaaaaatataaggaagtattcatttcattgggtggtatgctaaataaagtatactctgttggaggtatttccagcacgaatacctggccgtacaccacttgcggcccagcttgggatatgcagcttgatgtacctgcctga

SEQ ID NO: 1134 - protein, 273 aa, Unknown
  Obtained from environmental sample
  misc_feature (1)..(273): Xaa is any amino acid
MKLSPEPEYVALSNALQLYYEKEVAFRCFDSFYEFLQKDFVEVLKTDKVKEKDFDVSNFLYVLRPYYKGGEFDYLLNATKDLEMLQERFIVFELDNIKDHPILFPVVTIIIMEVFISKMRKLKGIRKMILIEEAWKAIAREGMAEYIKYLFKTVRKFFGEAIVVTQEVEDIISSPVVKQAIINNSDCKILLDQSKYQNKFEQIQELLGLTEKEKALVLSINKANDPTEKYKEVFISLGGMLNKVYSVGGISSTNTWPYTTCGPAWDMQLDVPA

SEQ ID NO: 1135 - DNA, 834 bp, Unknown
  Obtained from environmental sample
  misc_feature (1)..(834): n is a, c, g, or t
ttgtattctcaattaaacaataaaccaaagtcagatttcttccagttaaaatacttgtcactcaaagattcagttaacaatttggaaaagttggccagcatagcggaaatagagaataacagggccttggaaagacttgaagctgaaaaacaaaaagagaacgctatcagtgacatgaaacgcggggcggaaaagcgaatgcaaaatttggtcacgggatttgttgtattctcgttcattatggttcttattttctctattatcatcttccgtcgatttaaattctcaaaaaaacaaaatgagatcattgaggaaaagcaaaaagagatcctggattctatacactatgcaaaacgtattcaatctgctttactcgcacacagagattatattgattcgcacttaaaagataatttcattctcttcaaaccaaaagatattgtaagcggagatttttattgggcagcgaatagggataataaattctatttagcgtcttgcgatagcactgggcacggagttccgggcgcgttcatgagtttgcttaacattgggtttttaggagaagctattaaagaaaaaaatatccttgaaccgaataagatcctcaatcatgtacgtgaacgtttgatagatggaattagtaaagaagggcagaaggatggatttgatggaattttaatttgcgttgataagcaaaatagtaaacttacttacgctgcggcaaacaacgcgcctgtagttgtgcgcaatggtgaactcctggaattggaatgcgatcgcatgccggtgggacagggcggaagtaatgacccattagacttttacttttga

SEQ ID NO: 1136 - protein, 277 aa, Unknown
  Obtained from environmental sample
  misc_feature (1)..(277): Xaa is any amino acid
MYSQLNNKPKSDFFQLKYLSLKDSVNNLEKLASIAEIENNRALERLEAEKQKENAISDMKRGAEKRMQNLVTGFVVFSFIMVLIFSIIIFRRFKFSKKQNEIIEEKQKEILDSIHYAKRIQSALLAHRDYIDSHLKDNFILFKPKDIVSGDFYWAANRDNKFYLASCDSTGHGVPGAFMSLLNIGFLGEAIKEKNILEPNKILNHVRERLIDGISKEGQKDGFDGILICVDKQNSKLTYAAANNAPVVVRNGELLELECDRMPVGQGGSNDPLDFYF

SEQ ID NO: 1137 - DNA, 459 bp, Unknown
  Obtained from environmental sample
  misc_feature (1)..(459): n is a, c, g, or t
atgaaaatactaaccattgtttttttagttggatttttttgcttcgttcaagctgaatcatcgataactcttgatgaggtgatccgaaatcatgttaaagcgatcggagggaaagaagcgatcgaaaaagtgaaatcactccaatataaattggaaattactgagccgaagttcaccgtgaatggagtttatcgtgccgatcgcaatatgcatatgcggattgatatttccaaggatggaaaagtcgtttacatcgaggctttcaatggtaagagtggatggggaagccggagtgaagatggtcctcgaaatgattcaanccctgaaggtactgcaggtctttggcatgggattgtcatgcctgacaaattattcggaattcatgaaaatggaatcgattggaaacccagtgaatttggaaggccgaaaagcgtgggttactccattattattgattaa

SEQ ID NO: 1138 - protein, 152 aa, Unknown
  Obtained from environmental sample
  SIGNAL (1)...(18)
  misc_feature (1)..(152): Xaa is any amino acid
MKILTIVFLVGFFCFVQAESSITLDEVIRNHVKAIGGKEAIEKVKSLQYKLEITEPKFTVNGVYRADRNMHMRIDISKDGKVVYIEAFNGKSGWGSRSEDGPRNDSXPEGTAGLWHGIVMPDKLFGIHENGIDWKPSEFGRPKSVGYSIIID

SEQ ID NO: 1139 - DNA, 795 bp, Unknown
  Obtained from environmental sample
  misc_feature (1)..(795): n is a, c, g, or t
gtgctagtaacctattcgactttgcgtcaggacatcgagcagtttaaaggcattacttttgacacgattgtcacagatgaagcgcaggcaattaaaaattccgattctctttcacataaagcgtgtctgctattaaatgccaaacaccggctggcacttaccggaacgccagtagaaaattcattagacgatcttttttctattttgaatttcgttagcccaggacttcttggaggcgccacacgcgcgaaaatcctgggtgcgactcgtaaaaacgaagacagcataactgatgaaagtgaagtcaatctagagaaggagacactggctcttttatcacgtgcgctcaaaccctttattttaaggcgcacgaagggacaggtcctgaaagaacttccatccaagactgagaacgtccttcattgcgagctcagcgaaaaagagcagcagttttacacagaacttcgtgatttttaccgcgcgaatctgaagggcgagatcagccgggtggggctaggcaaatctaaaattgtcgtactcgaagcgcttcttcgtctgcgccaggccgcttgtcatccgggtctcatcgacaaaaacctgcgtggggctgaaagtgccaaagttgaaacccttattgaccagcttaagaacgtgattgccgaaggacacaaagctctcgtcttttcacaattcacgtcgtttctggacattgtgaaatcccaattcgaaaaagaaaagatttcgtatttgtatctggacggaaaacctcttcaaaagacagacaagatcgcgtga

SEQ ID NO: 1140 - protein, 264 aa, Unknown
  Obtained from environmental sample
  DOMAIN (1)...(196): SNF2 family N-terminal domain
  misc_feature (1)..(264): Xaa is any amino acid
MLVTYSTLRQDIEQFKGITFDTIVTDEAQAIKNSDSLSHKACLLLNAKHRLALTGTPVENSLDDLFSILNFVSPGLLGGATRAKILGATRKNEDSITDESEVNLEKETLALLSRALKPFILRRTKGQVLKELPSKTENVLHCELSEKEQQFYTELRDFYRANLKGEISRVGLGKSKIVVLEALLRLRQAACHPGLIDKNLRGAESAKVETLIDQLKNVIAEGHKALVFSQFTSFLDIVKSQFEKEKISYLYLDGKPLQKTDKIA

SEQ ID NO: 1141 - DNA, 456 bp, Unknown
  Obtained from environmental sample
  misc_feature (1)..(456): n is a, c, g, or t
ttggtgtttgaagattggtgtataattataaaatgcaaaagaaaaaaatatttgctccaattattgaaacttatcattttgttccacgcaaatacggaagggatttgcttttggatatcgggaggaatagaaacattgaagaatttcgtgttaggaaacacgccgcaccagataagtttctatgaaatacttttcatagaaaaaggaaaaggtagctttgcattggatgaaaaccaaatgaccatagaacccggaacaattatatttacttcaaccgggcaggttcgtcgatggaatgtcaaacaagcagtaaccggctatacacttttctttgaaccagatttcgcgaatctgctgtttatcgatgatttattcccttatcgttttcaactctttcatcaatattctaaaccaacaagtatcaaaatgccgataaaagattctcaccaaccttga

SEQ ID NO: 1142 - protein, 151 aa, Unknown
  Obtained from environmental sample
  misc_feature (1)..(151): Xaa is any amino acid
MVFEDWCIIIKCKRKKYLLQLLKLIILFHANTEGICFWISGGIETLKNFVLGNTPHQISFYEILFIEKGKGSFALDENQMTIEPGTIIFTSTGQVRRWNVKQAVTGYTLFFEPDFANLLFIDDLFPYRFQLFHQYSKPTSIKMPIKDSHQP

SEQ ID NO: 1143 - DNA, 813 bp, Unknown
  Obtained from environmental sample
  misc_feature (1)..(813): n is a, c, g, or t
ttgggcttcctgcttatggagccaccaactttcagtcgggtgtataacaggcggcaggaaactgcggttggtaaaataaacgcccaggaaatagacatacaggaatacgaggaaaaatacgtcgaagacattaagagccaggaagagcaaatgcgcggacagcctcttaacgatgaaatgcgtaactacatgcgcggcatgacctgggaccaactggtaaatgatgccatttttaataaggtttacgaaaagctgggcatagcagtaacccctgctgaaatggctgagttacttgccggcaacgaaaacgtacatccttacgtaaggcaaaatttctcgaaccctcaaaccgggcagttcgatcccggccaggttcgattgtttcttcaagatattgacaaagatgatccgggtaccgagcccggcacacgccgtaagcaatggacccgttttgaagaaggtatacagaaagaccagtatcaaaaaaaatacgaaaaccttatcaccaagggcctttacgttcctgcatggcagggcgaaatggcatataacgatcaaacaaagtcggttgattttaaatatgtgcagttgccttataccgatattaatgatgcagatattaaagtaacggatgaggagttcaaaaaatacatcgacgcacaccccgctaagtttaaacgtgatgacgaaacacgcaaaatacagtatgtaactttcgatattgttgcttcatctgccgattcattggcaattattaatagccttgaagctaaaagggaagattttgccaaaggcgaaaaagttgaccgatga

SEQ ID NO: 1144 - protein, 270 aa, Unknown
  Obtained from environmental sample
  misc_feature (1)..(270): Xaa is any amino acid
MGFLLMEPPTFSRVYNRRQETAVGKINAQEIDIQEYEEKYVEDIKSQEEQMRGQPLNDEMRNYMRGMTWDQLVNDAIFNKVYEKLGIAVTPAEMAELLAGNENVHPYVRQNFSNPQTGQFDPGQVRLFLQDIDKDDPGTEPGTRRKQWTRFEEGIQKDQYQKKYENLITKGLYVPAWQGEMAYNDQTKSVDFKYVQLPYTDINDADIKVTDEEFKKYIDAHPAKFKRDDETRKIQYVTFDIVASSADSLAIINSLEAKREDFAKGEKVDR

SEQ ID NO: 1145 - DNA, 783 bp, Unknown
  Obtained from environmental sample
  misc_feature (1)..(783): n is a, c, g, or t
atgaatttactgatagaaaacgcttcacagatagttacctgcggcacacacggcagaaaattcaaagccggaaaacatcaatctgaaatcggcctgcttaagaatgccagcgtgtatattgaaagcggaaaaatcaagtggatggggaaaaaacttccgccatcggttaagaaaaagaatattaaaaaaattgacggttataataaaaccattctgcccggattcattgattcgcacacacattcggtttttgcaggcagcagggcagatgaatactcaatgcgcataaatggcagcacttacgaagaaatagccaaagcaggcggagggatactcagtacggttcaatccgtaaggaaagcttcgaaatcagaattgaagaagcttgccgccgtgcggataaggtcttcgataggttttggggttactacaattgaagtaaaatccggctatggacttaatacagcagcggaaattaaaatgcttgaagttattaatgggctggctaaagagttaccaatcgatgtatattcaactttccttggtgcccatacatttgctatagaaaaaagccgtgatgaatatatagatgaaataatatttgatatgatacctcaaatatcaaaacgcaggcttgctgtgtttattgatgctttttgcgagaagaattatttttccgttaaagatactatcagaatatttgaacaggggataaagtacggctttacgccgaaacttcatacaaaccagttttattcaataggcgtgtgcaggctgctgtaa

SEQ ID NO: 1146 - protein, 260 aa, Unknown
  Obtained from environmental sample
  misc_feature (1)..(260): Xaa is any amino acid
MNLLIENASQIVTCGTHGRKFKAGKHQSEIGLLKNASVYIESGKIKWMGKKLPPSVKKKNIKKIDGYNKTILPGFIDSHTHSVFAGSRADEYSMRINGSTYEEIAKAGGGILSTVQSVRKASKSELKKLAAVRIRSSIGFGVTTIEVKSGYGLNTAAEIKMLEVINGLAKELPIDVYSTFLGAHTFAIEKSRDEYIDEIIFDMIPQISKRRLAVFIDAFCEKNYFSVKDTIRIFEQGIKYGFTPKLHTNQFYSIGVCRLL

SEQ ID NO: 1147 - DNA, 399 bp, Unknown
  Obtained from environmental sample
  misc_feature (1)..(399): n is a, c, g, or t
ttggaatccggggccagaaaagcggccttttttgtggaaaagggcttaaaagatggttttttggttggtgtggcgacagtggaaattaatgtggttaanaaaacaaaaaaaagaattttgggtattatgtggccctgtgggttcaacacaaacccccgcctgagaangctagaaaatgggtttcgtgggtgttgtcggaanccgtattcaacttttnccgtgattaaaaagttcaagccaaaaattgagaagataacagttnacacaaaatggaacctgtggatgggggaancttntattttccttcacttaatggaccgaactaacaaaanaaaagaagaaaaaggtttctttaactgggaaaagggactggcaaacctgttatacanaatttattaa

SEQ ID NO: 1148 - protein, 132 aa, Unknown
  Obtained from environmental sample
  misc_feature (1)..(132): Xaa is any amino acid
MESGARKAAFFVEKGLKDGFLVGVATVEINVVXKTKKRILGIMWPCGFNTNPRLRXLENGFRGCCRXPYSTFXVIKKFKPKIEKITVXTKWNLWMGEXXIFLHLMDRTNKXKEEKGFFNWEKGLANLLYXIY

SEQ ID NO: 1149 - DNA, 459 bp, Unknown
  Obtained from environmental sample
  misc_feature (1)..(459): n is a, c, g, or t
atggatggtgcttatgaacttattgtaaccggaaaggataaaagcaataatgagatcggggcaatcgaatatagagtagcttttgaagtaaacaataagcccatgatctccaacatgcttaattacccaaatccatttaccacttctacagcttttgtatttaccttaactggtagcgaggtgcctcaggaatttaaaattcagattttaaccgttacgggtaaggtaattcgagaagttacccgggaagaactagggccgctgcatattggtagaaatattaccgagttcaagtgggatggttctgatcagtttgggcaaaagctggcgaatggtatttacctctatagagtagtaacaagcttaaacggtaaagccttggaaaaatacaagtcgcaaagtgataaaactgataagttctttaataatggttatggtaaaatgtatctcatgagataa

SEQ ID NO: 1150 - protein, 152 aa, Unknown
  Obtained from environmental sample
  misc_feature (1)..(152): Xaa is any amino acid
MDGAYELIVTGKDKSNNEIGAIEYRVAFEVNNKPMISNMLNYPNPFTTSTAFVFTLTGSEVPQEFKIQILTVTGKVIREVTREELGPLHIGRNITEFKWDGSDQFGQKLANGIYLYRVVTSLNGKALEKYKSQSDKTDKFFNNGYGKMYLMR

SEQ ID NO: 1151 - DNA, 450 bp, Unknown
  Obtained from environmental sample
  misc_feature (1)..(450): n is a, c, g, or t
atgtcaaaaaagaaacaagaagttaaacaagaagagccgataaaaagagaaccggttaaaatcgttcatatcaatgatatgtaccagaactggtttctcgactatgcttcttacgtaatccttgagcgtgcagtgcctcatatcaatgatggactgaagcctgttcagcgacgcatcctccattccatgtatgaaatggaagatgggcgctacaataaagtggccaatgttattggtcactgcatgaagtatcacccacacggagatgtaagtattggtgatgccttagtgcaattaggccagaaggaactggttattgatacgcagggaaactggggtaatatttatacaggagatagtgctgctgcttcacgttatatagaangccgccttagcaagtttgctttaaaagttgttttcaatccaaagactactcaatgggggctttag

SEQ ID NO: 1152 - protein, 149 aa, Unknown
  Obtained from environmental sample
  misc_feature (1)..(149): Xaa is any amino acid
MSKKKQEVKQEEPIKREPVKIVHINDMYQNWFLDYASYVILERAVPHINDGLKPVQRRILHSMYEMEDGRYNKVANVIGHCMKYHPHGDVSIGDALVQLGQKELVIDTQGNWGNIYTGDSAAASRYIEXRLSKFALKVVFNPKTTQWGL

SEQ ID NO: 1153 - DNA, 537 bp, Unknown
  Obtained from environmental sample
  misc_feature (1)..(537): n is a, c, g, or t
atgaaaaaaatcgctgtattttttaagttgcctggagcaatggatgaaccattttcaaagggtgattacttcactgcatattctgaattatcagaggaagtctctgcccttggtggacaattctatatcgtgcgagatcaaaaaacatatctaggaaatggctccttttcacgttcgtggattatagaaaatggagatctcactgaaacaggtccagttacggtagaagtaatctataataagggtaagttcataagcgatggaactatacctatctttaattgcgaacggattaccaaagaatgcgataataaatggaccatgtaccaacgtctctcacagtattgtccactaactttttttgctgaaactgcatcacagntaaaaaaaattctcccaaaaatgtcaacagacaaggttgtttttaagccatacgtgggaggagaaggtctcggagtcaaattacagataagactttattcaaggacacaaagaccttatgtttccagcagtgttcagaattttagacactcatag

SEQ ID NO: 1154 - protein, 178 aa, Unknown
  Obtained from environmental sample
  misc_feature (1)..(178): Xaa is any amino acid
MKKIAVFFKLPGAMDEPFSKGDYFTAYSELSEEVSALGGQFYIVRDQKTYLGNGSFSRSWIIENGDLTETGPVTVEVIYNKGKFISDGTIPIFNCERITKECDNKWTMYQRLSQYCPLTFFAETASQXKKILPKMSTDKVVFKPYVGGEGLGVKLQIRLYSRTQRPYVSSSVQNFRHS

SEQ ID NO: 1155 - DNA, 489 bp, Unknown
  Obtained from environmental sample
  misc_feature (1)..(489): n is a, c, g, or t
atgcagaaatggttgagtgaagggtctcactataaggacaagctatttgcggaagaggtgtcacaaaataaattggctgaatacgattgtattataattggaagttctgtttatttaggccaattgttgataagcaaatggctggaaaaacatgaacccattttagtgaataaaggactattcctgtttatagtatgtggaactaatcctgaagagaagcaaaagttaagaagcatagtacatgctggcgttcctgctgaaataagaaaccagtgtgagttgtattttttgcgtggaagaatagatgtcaagaaattgtcctggcttgataggttcataattggccttggttcaaaacttgctcaaacacaggaagaaaaagccatgttctccaattttgattttgtggataaaagtaatacagaaccattgttaagggctattcagaaatatcaaatccacgatagtaaatcttctgtaatgcattaa

SEQ ID NO: 1156 - protein, 162 aa, Unknown
  Obtained from environmental sample
  misc_feature (1)..(162): Xaa is any amino acid
MQKWLSEGSHYKDKLFAEEVSQNKLAEYDCIIIGSSVYLGQLLISKWLEKHEPILVNKGLFLFIVCGTNPEEKQKLRSIVHAGVPAEIRNQCELYFLRGRIDVKKLSWLDRFIIGLGSKLAQTQEEKAMFSNFDFVDKSNTEPLLRAIQKYQIHDSKSSVMH

SEQ ID NO: 1157 - DNA, 657 bp, Unknown
  Obtained from environmental sample
  misc_feature (1)..(657): n is a, c, g, or t
atggaaaagataatattggcattaaacagtaaccaactaaattattcagttgttgaatttgcttactatacagccaaacttactggttcaaaactgacaggtattttcatggaagctcctgtttatgagcctgtaacagaaagtgaggaaatacaggataactcgggtaaacttaataagcctgttttaattaaagcaaaacaagtgactctggatacagaaaaaggtatgcactactttaaggaagcttgtaccaaagaaaaagttcgttatgaagttttccaaagtgaaggctcctctgctgaagatgtcatttttgaaagccgttttgccgacctgctgatcattgatgtcgaaactgctgtaggtaacaataacgaaagttctcaatttgcaaaagagatacttgccagggcagagtgcccggtcatccttcctccaatatcatttaaaggaattgatgaaattattttttgctatgatggaagccggtcttcagtgtttgcaatgaagcaatttacttatctatttcctcaatatgaagataaaaaagtaactgttctcgaagtgaatgaagaacgagtttcatctatctatgaaacagataaagttcgacacttgttgaaacgtcctnattctcaaattgcgtttatgtag

SEQ ID NO: 1158 - protein, 218 aa, Unknown
  Obtained from environmental sample
  misc_feature (1)..(218): Xaa is any amino acid
MEKIILALNSNQLNYSVVEFAYYTAKLTGSKLTGIFMEAPVYEPVTESEEIQDNSGKLNKPVLIKAKQVTLDTEKGMHYFKEACTKEKVRYEVFQSEGSSAEDVIFESRFADLLIIDVETAVGNNNESSQFAKEILARAECPVILPPISFKGIDEIIFCYDGSRSSVFAMKQFTYLFPQYEDKKVTVLEVNEERVSSIYETDKVRHLLKRPXSQIAFM

SEQ ID NO: 1159 - DNA, 579 bp, Unknown
  Obtained from environmental sample
  misc_feature (1)..(579): n is a, c, g, or t
ttgacaacctcgacgccattatccccttcggttaccgcgtcaaattccaacaaagccacccaattcagaatatggcccacaaaaacattacataattatatcatcaaaggcttcgccattgacgaagaaaggctaaaaaacggctcccattttggaaaagactatttgaaagaattggtcgagaaaatccgtgaaatccgagctagtgaacgcctcttctacaaaaaaatcaccgacatttacgctcaatgcagcatggattacgatccaaaatcggaaatcactcagagcttttatgccaccgttcaaaacaagttacactgggccattaccggcgaaacagctgccgaaattgtcgcccatcgggcggacagcaaaaagccccacatgggactcactcattggaaaggcgggctaaaaagcaaagtcctaaaaacagacatcagcatcgccaaaaattacctcagtccaaaagaaatcgacgaattaaatcatattgtcaccatgtatttggactatgccgaattacaggctaaaaaacagatccccatgaaaatgtctgattgggttaaaaattag

SEQ ID NO: 1160 - protein, 192 aa, Unknown
  Obtained from environmental sample
  misc_feature (1)..(192): Xaa is any amino acid
MTTSTPLSPSVTASNSNKATQFRIWPTKTLHNYIIKGFAIDEERLKNGSHFGKDYLKELVEKIREIRASERLFYKKITDIYAQCSMDYDPKSEITQSFYATVQNKLHWAITGETAAEIVAHRADSKKPHMGLTHWKGGLKSKVLKTDISIAKNYLSPKEIDELNHIVTMYLDYAELQAKKQIPMKMSDWVKN

SEQ ID NO: 1161 - DNA, 588 bp, Unknown
  Obtained from environmental sample
  misc_feature (1)..(588): n is a, c, g, or t
gtggagcgaatttgnntncggattgcccgcacagtagtggacaacagaatgattctttatttaatcctttatccaaaagttgaaaatattaacttaaagtatattttatgcttattgaattcaagtttattatcttatcaataccaaaaactaaatcctgagctagggcgtgtttttgctcaggtcaaaatagattatgtaaatgagctgcccataattttaatcgataacaacagacaagtttacttcatccaaaaagctgaccaaatgctctccctcaacaaagcttttcacgaaaaaatccaaaaattcctcaagcttattcaggctgaattcggaattgaaaaattgagcaagaaaatagagaaattctacgaactcacttttgaggaatttgttaagcagctcaaagtaaaatccctggggctggaaaagaaggcagatttgctggatttttttgagaagaataaaaaggagcttgtggagttgaaggctcaaatcgattcaacggatagagagattgatgagatggtgtttgatttgtatgggttgacggaggaggagaggaaggtggtgctggccagctga

SEQ ID NO: 1162 - protein, 195 aa, Unknown
  Obtained from environmental sample
  misc_feature (1)..(195): Xaa is any amino acid
MERIXXRIARTVVDNRMILYLILYPKVENINLKYILCLLNSSLLSYQYQKLNPELGRVFAQVKIDYVNELPIILIDNNRQVYFIQKADQMLSLNKAFHEKIQKFLKLIQAEFGIEKLSKKIEKFYELTFEEFVKQLKVKSLGLEKKADLLDFFEKNKKELVELKAQIDSTDREIDEMVFDLYGLTEEERKVVLAS

SEQ ID NO: 1163 - DNA, 549 bp, Unknown
  Obtained from environmental sample
  misc_feature (1)..(549): n is a, c, g, or t
atgacccgctataaattcctgcctgttttttttacgctgatctttgtgtttagcagttttagccagcctgcttttaagccggaagcaactaataaaaagaatgacaaaatagaatggctaacgattgaacaagcagcagcaaaatcgaagaaaaagccccggaagatttttatcgatgtatataccgactggtgtggctggtgtaaaaaaatggataagacgacttttctggagccggaagtaattaaatacatcaacaagaactactatgccgtaaagctgaacgccgaaggcaaagaaccaattaccctgaacggcaaaacctataattttaaaccggaataccggtcgcatgagcttgccatagaattgctgcagggccagatgagttacccgaccaccgtgtacctcgacgagaaatttaacatgctgtcgccggttccgggttttatgtcagcctccgatctgatcaatatcctgcagtattacggtggcaaccatcacaaaaaaatgagcttcgacgattaccagaagttgccgaagatctaa

SEQ ID NO: 1164 - protein, 182 aa, Unknown
  Obtained from environmental sample
  misc_feature (1)..(182): Xaa is any amino acid
MTRYKFLPVFFTLIFVFSSFSQPAFKPEATNKKNDKIEWLTIEQAAAKSKKKPRKIFIDVYTDWCGWCKKMDKTTFLEPEVIKYINKNYYAVKLNAEGKEPITLNGKTYNFKPEYRSHELAIELLQGQMSYPTTVYLDEKFNMLSPVPGFMSASDLINILQYYGGNHHKKMSFDDYQKLPKI

SEQ ID NO: 1165 - DNA, 447 bp, Unknown
  Obtained from environmental sample
  misc_feature (1)..(447): n is a, c, g, or t
gtgtttaaatttcttaataaacagccgttttgggtaaaccttttaatcgtcatagcacttttatttgttatcggttttttgtttttacaatcacttgattggctcaccaatcatggcgcctacttaaaagtgcctacagtaaaaggtaagaaggtcgacgaaggtatcaagttactggaagacctggggtttgaggtagtaatacaggattctttatactttgaagacattccgaagtatactgttataaaacaattacctgagccagatgccacggtaaaacgaaatcgaactgtgtatttaacaataaaccgtgcattgccgccctatatagacatgcccaagttagaagtgttaagttttagatatgctttggatacattacaaaagcatcatgttaactcgcgggatacaagcagtagaccgatgtcaacgcaagggtgctag

SEQ ID NO: 1166 - protein, 148 aa, Unknown
  Obtained from environmental sample
  DOMAIN (40)...(105): PASTA domain
  misc_feature (1)..(148): Xaa is any amino acid
MFKFLNKQPFWVNLLIVIALLFVIGFLFLQSLDWLTNHGAYLKVPTVKGKKVDEGIKLLEDLGFEVVIQDSLYFEDIPKYTVIKQLPEPDATVKRNRTVYLTINRALPPYIDMPKLEVLSFRYALDTLQKHHVNSRDTSSRPMSTQGC

SEQ ID NO: 1167 - DNA, 495 bp, Unknown
  Obtained from environmental sample
  misc_feature (1)..(495): n is a, c, g, or t
atgaaacagttttcaggtaatcattctggatccggttcagaaaagaatgcttggtatgatacaggtttaagagtcgatggaacaatacaactccaaacagaattcccacatccaaacaatcatgactttaaactctctgatgcagaacaatttatcaaaaagatttctaaaggacttgaaggaaattggattggattgaaatggtgtgtaatgttagtcaaaccaaacggaacaagaaaagacggaatacgtctaagaatgtgggttgatgaagatccattagatgtaaataacaaaccaaagaataactggaaattagtatatgactttatagacacaggacaagtaatcccagcagataaacaactagtcgatgaacaagattgtgaaattagaagaagtgatactgattcacatgatgtctatggtgatggaagaatcataacaggttccaagaaaggtgatccaggtttacacgtgagacctttatcttaa

SEQ ID NO: 1168 - protein, 164 aa, Unknown
  Obtained from environmental sample
  misc_feature (1)..(164): Xaa is any amino acid
MKQFSGNHSGSGSEKNAWYDTGLRVDGTIQLQTEFPHPNNHDFKLSDAEQFIKKISKGLEGNWIGLKWCVMLVKPNGTRKDGIRLRMWVDEDPLDVNNKPKNNWKLVYDFIDTGQVIPADKQLVDEQDCEIRRSDTDSHDVYGDGRIITGSKKGDPGLHVRPLS

SEQ ID NO: 1169 - DNA, 381 bp, Unknown
  Obtained from environmental sample
  misc_feature (1)..(381): n is a, c, g, or t
atgaaaatcgtagttatcggaagcggtttcggcggattatcctgcgccattcgcctgcaggcacaagggcacgacgtaaaaatcatcgaaaaacgaaacaaactcggcgggcgcgcgtatgtctacgagcaggacgggtttaagtttgacggcggtccgacgatcattaccgcgccgtggctcattgacgagcttttcacgctcgccggaaaacagaccgccgattacgtcaaactcgttaaaattgatcctttttacaacattcgttgggaagacggaacggtttttaactacaacgacgataagcagaatctctatgcgcagattgccaaaatcaatccgaagacgctcgaatcatacaaaaattccccaatcgcttga

SEQ ID NO: 1170 - protein, 126 aa, Unknown
  Obtained from environmental sample
  misc_feature (1)..(126): Xaa is any amino acid
MKIVVIGSGFGGLSCAIRLQAQGHDVKIIEKRNKLGGRAYVYEQDGFKFDGGPTIITAPWLIDELFTLAGKQTADYVKLVKIDPFYNIRWEDGTVFNYNDDKQNLYAQIAKINPKTLESYKNSPIA

SEQ ID NO: 1171 - DNA, 372 bp, Unknown
  Obtained from environmental sample
  misc_feature (1)..(372): n is a, c, g, or t
atgaacctatataaatatcaaagtaaatattatgcgaaagagaataacaaaaataaaaaacaaactaatctctatatggtaactcaacaggcaatcaaatgtttaaaactatatatttgtctttgtctgcttgctggtaaaaatatatgttgtactgaagagccttatgataagattacaaaagaaattatagatgttatgactgatactattgataatcatatccgaaaatgccctagtggtagatttgggtttgtattatttcccaaagatataagtgatgtgaataaacgccaaaaattgtccttagataatctttttctaaacaagggtagtcatatttctgattttatacatcacttaaatcggtaa

SEQ ID NO: 1172 - protein, 123 aa, Unknown
  Obtained from environmental sample
  misc_feature (1)..(123): Xaa is any amino acid
MNLYKYQSKYYAKENNKNKKQTNLYMVTQQAIKCLKLYICLCLLAGKNICCTEEPYDKITKEIIDVMTDTIDNHIRKCPSGRFGFVLFPKDISDVNKRQKLSLDNLFLNKGSHISDFIHHLNR

SEQ ID NO: 1173 - DNA, 966 bp, Unknown
  Obtained from environmental sample
  misc_feature (1)..(966): n is a, c, g, or t
ttgtntaaagtgaaaatacgaaaaantgtcaattttatctgcaaaatcgattttttcccggctgtatttactaggatctctaattatcttgatattcgttattctctttttaagaattatagacatctacttttgttttgtataaatgaaaaagatttaaaggaaggattttcgggcaaagctaaagatgaaatatttgagacaatacattttgattattcttttcttgattcgaaaatttttgaaatgatttatcttcaaaaacagtgcataagatttcatgaaacatctaaatcctgtgaatcaaatgaattttgcgaatactattactattatcaatataacaagtatacacctgatcatctgaataaaacgataaaaaaagaagaatttttaaaccctagtaaatctctgttaaaaaaagactttgaaaatgatattaaaattattgaagccgatttatttcctttattcggaccaaagataaaaattattcagaaagatattgggtatgacaggtttattaccaagattgataatatagattcgtacttaaatggcgagatcagtacaatcgaaatacaatatgatttttttaacacttccaataaccataatcttagttcaataaccatttttatcgcttcaaacaaacatattgaaaaatggaaaagtgatttttttccttttgattctttaaataatattgagaaaaaaagcttagataacaatggcgttaaaaagatacattattatcaatttatagatcataatcaatttgtctatttaggaaacaaaatttcattttccaacataatgataaaatattttacttttaagtatgtaattaataagatgaattatcatgaacattttaatacaatttcgaaagcatttctactgaaactcaatcagaactttatcttagtgaggatgatgcgatttgtaaatctgtttaaccagtaa

SEQ ID NO: 1174 - protein, 321 aa, Unknown
  Obtained from environmental sample
  misc_feature (1)..(321): Xaa is any amino acid
MXKVKIRKXVNFICKIDFFPAVFTRISNYLDIRYSLFKNYRHLLLFCINEKDLKEGFSGKAKDEIFETIHFDYSFLDSKIFEMIYLQKQCIRFHETSKSCESNEFCEYYYYYQYNKYTPDHLNKTIKKEEFLNPSKSLLKKDFENDIKIIEADLFPLFGPKIKIIQKDIGYDRFITKIDNIDSYLNGEISTIEIQYDFFNTSNNHNLSSITIFIASNKHIEKWKSDFFPFDSLNNIEKKSLDNNGVKKIHYYQFIDHNQFVYLGNKISFSNIMIKYFTFKYVINKMNYHEHFNTISKAFLLKLNQNFILVRMMRFVNLFNQ

SEQ ID NO: 1175 - DNA, 576 bp, Unknown
  Obtained from environmental sample
  misc_feature (1)..(576): n is a, c, g, or t
ttggtaacctgcgaactggcaagaattaccagagccgacgaagagaatggacagctacggattcaattggtgtacctcagcaagattctccttntaacatccggcacgggaattcttcgaactaaaaaaggagtggaaaatagttttgattcgcctgatagcattaatgcgatggattggagtttgaagacaagcaataaagagatatatgagtatgtgaaaggattgataaaaatgcgaaaggaacatccggcttttagaatgaagagtgcaaaagaaatttcagaaaacattcaatttttcctttcccaggaagatggagtcattatagaaaacattgaatttttaaaaacccgacaaaaaggaattattagttatatcattaatggagagaaggtaaaagataaatggaaaaaaattctcgtggtctttaatggaaatgaaactaaaaagccttttggcttaccagggggcatttggaaaatggctgtttggaataatcagtatgaagaggctgacattccaagtcattttttggtagggccttatagttgtacaattttataccaggaataa

SEQ ID NO: 1176 - protein, 191 aa, Unknown
  Obtained from environmental sample
  misc_feature (1)..(191): Xaa is any amino acid
MVTCELARITRADEENGQLRIQLVYLSKILLXTSGTGILRTKKGVENSFDSPDSINAMDWSLKTSNKEIYEYVKGLIKMRKEHPAFRMKSAKEISENIQFFLSQEDGVIIENIEFLKTRQKGIISYIINGEKVKDKWKKILVVFNGNETKKPFGLPGGIWKMAVWNNQYEEADIPSHFLVGPYSCTILYQE

SEQ ID NO: 1177 - DNA, 612 bp, Unknown
  Obtained from environmental sample
  misc_feature (1)..(612): n is a, c, g, or t
gtggatcagaaaaaatcattgtctttattatttctcattccggcggtgtctgtcattgccatcccgaccccggtccatgttgatgtctataaggtagatgtaaattcaagtaaaattgaatggtttgctgaaaaagtgaccggcaagcataacggaaccattaaattatcatccggggagatccataataaccatggccagctgggaggcaagttttcaattgacatgactaccataacggtcagtgatcttaccggtgaaaaaaaagggaagcttgaaaatcacctgaaatcagatgatttctttggggtgcaaaaacacccgtcgtctgaatttgaaatcacctcagtgaaaccccgttcgggggttgtggcaggagaacccaattttgatgttaccgggcggttaaccattaaaggaatcacgaacgaaatatctttcccggcacttataaaatttgaaggcccgaaaatcaccgcaaaaggtgaagctaaagttgaccggtcgaaatttgatgtccggtatggttcaaaaacattttatgaagacataggagacagggcaatttatgatgagttcattctaaaaattgaccttgtggcgaatcgctga

SEQ ID NO: 1178 - protein, 203 aa, Unknown
  Obtained from environmental sample
  SIGNAL (1)...(20)
  DOMAIN (30)...(203): YceI like family
  misc_feature (1)..(203): Xaa is any amino acid
MDQKKSLSLLFLIPAVSVIAIPTPVHVDVYKVDVNSSKIEWFAEKVTGKHNGTIKLSSGEIHNNHGQLGGKFSIDMTTITVSDLTGEKKGKLENHLKSDDFFGVQKHPSSEFEITSVKPRSGVVAGEPNFDVTGRLTIKGITNEISFPALIKFEGPKITAKGEAKVDRSKFDVRYGSKTFYEDIGDRAIYDEFILKIDLVANR

SEQ ID NO: 1179 - DNA, 510 bp, Unknown
  Obtained from environmental sample
  misc_feature (1)..(510): n is a, c, g, or t
atgcagccaatgatacatacagctggcttagtgacgaatctaattttaggtatattgaagaataaagttataataatagcccttctgtttgtgagtgcggatatctgctctcaaaccttgacattggattttaatggaaaaccaaaggttaatgccgaacaatttggttcaggctttactcttaactttgaaaagggtcgaaacgaaattgctaattcagagttgtttgccttatggctggcaggggataaggcatataaggataatgatcttcagcttgcaaaaaaatatttgattgagtttgaagcctccgaaattataggggaaaatatggaagagcgtttttcaaatataagtaaattcagaaatgctaagtaccatgcctgtgatattctgaagaaaatttattataaagaaaaaaatttcacctcttctctttcgtatcatacaaaaatgttaaattacagatccggaatttgtgtagtaatgacgggggttggtaacacctga

SEQ ID NO: 1180 - protein, 169 aa, Unknown
  Obtained from environmental sample
  misc_feature (1)..(169): Xaa is any amino acid
MQPMIHTAGLVTNLILGILKNKVIIIALLFVSADICSQTLTLDFNGKPKVNAEQFGSGFTLNFEKGRNEIANSELFALWLAGDKAYKDNDLQLAKKYLIEFEASEIIGENMEERFSNISKFRNAKYHACDILKKIYYKEKNFTSSLSYHTKMLNYRSGICVVMTGVGNT

SEQ ID NO: 1181 - DNA, 543 bp, Unknown
  Obtained from environmental sample
  misc_feature (1)..(543): n is a, c, g, or t
ttgatgaaaatcgcaaacgatatccgtatgttgtcgtcaggtccgcgttcaggcattggtgaaatttttattccggataacgaaccaggttcttctatcatgcccggaaaagtaaatccaacgcaatgcgaggcgataacgatgatagctgcacaggtaatgggcaatgatgtagctattaacatcggtggttcgatgggccattttgaactgaatgtttttaagccggtaatgatctataactttttacatagtgcaagattgattggtgatggctgtgtaagttttaatgataaatgcgcagttggaattgaaccaattcaatcgaacataaaaaaacatgtggataattcattaatgcttgttactgcacttaatactaaaattggttattacaagtctgctgaaattgctcaaaaggcacacaaagaaggaacaactttgaaagaaatggcagtaaaattgggttatgtcacacccgaacaatttgatgaattgggttataccggaaaagatggtaggaaagctttaggtagcaattag

SEQ ID NO: 1182 - protein, 180 aa, Unknown
  Obtained from environmental sample
  misc_feature (1)..(180): Xaa is any amino acid
MMKIANDIRMLSSGPRSGIGEIFIPDNEPGSSIMPGKVNPTQCEAITMIAAQVMGNDVAINIGGSMGHFELNVFKPVMIYNFLHSARLIGDGCVSFNDKCAVGIEPIQSNIKKHVDNSLMLVTALNTKIGYYKSAEIAQKAHKEGTTLKEMAVKLGYVTPEQFDELGYTGKDGRKALGSN

SEQ ID NO: 1183 - DNA, 375 bp, Unknown
  Obtained from environmental sample
  misc_feature (1)..(375): n is a, c, g, or t
atggaaaatcctgataaggaaataattaactttttaaaagaaaacaaagtagcaactgtatgctgttccgaaagcaatattcctttttgcttcaactgtttttatgccattatggaagaggacatgtttcttgtttttaaatctgacgagaataccaaacatgctaaaatcctggcggaaaattttgatgtagccggtacggttacagctcctttttttactctgggaaaactaaaaggaatacagtttgggggaagagtaagaaatgaaaaatcaatcatgagtaaggcattgtggttttattatggacgtttccttatgcatgacagttctgcgaaaatattattattgagcttgatatttaaaggtcactga

SEQ ID NO: 1184 - protein, 124 aa, Unknown
  Obtained from environmental sample
  misc_feature (1)..(124): Xaa is any amino acid
MENPDKEIINFLKENKVATVCCSESNIPFCFNCFYAIMEEDMFLVFKSDENTKHAKILAENFDVAGTVTAPFFTLGKLKGIQFGGRVRNEKSIMSKALWFYYGRFLMHDSSAKILLLSLIFKGH

SEQ ID NO: 1185 - DNA, 729 bp, Unknown
  Obtained from environmental sample
  misc_feature (1)..(729): n is a, c, g, or t
ttgacggcaatgcgcaggacaacgaaatatgtctctgacctgaaggatctgcttgagcttaccaattccatttactgtatcggatatgggtttgaaacgacagataacggcacgcagcgttttaggattgaaaaaatagattatttctataacaatagcatcaaagttttatcccttggtaaagtttacgatataaaaaagaagattgattccaagcgatattacaatcaaatagagtatggctattccacaaagatagacattggccaggtaaatgctatcgatgagttcaacacactacgacgttcatcccttccaattaaaaatacaaaaggacagttaaaagtcgccactaacattattaccagtggatacgccatagaatatgaaagaaggctttcgaatggcacaaaagacggcaagtatgatgataacaactttgctatcgttgttatccgtgatggcgaaacattcagaacaaaaacaggatcggaagctgacggatatatcgcggcatcgttctcaaatgttataagccctgaaacttcctacaaccttgatataagccctgccagatgtttaaagaattggtcaaacatcattgctgcatgcctggtaaatagtacgagcaaagaagtaaaattctcttatcgagacacgcattatcacatgacttccctcaagccgggcgaagtactcatagttagtgcagatgaagtactgatgtga

SEQ ID NO: 1186 - protein, 242 aa, Unknown
  Obtained from environmental sample
  misc_feature (1)..(242): Xaa is any amino acid
MTAMRRTTKYVSDLKDLLELTNSIYCIGYGFETTDNGTQRFRIEKIDYFYNNSIKVLSLGKVYDIKKKIDSKRYYNQIEYGYSTKIDIGQVNAIDEFNTLRRSSLPIKNTKGQLKVATNIITSGYAIEYERRLSNGTKDGKYDDNNFAIVVIRDGETFRTKTGSEADGYIAASFSNVISPETSYNLDISPARCLKNWSNIIAACLVNSTSKEVKFSYRDTHYHMTSLKPGEVLIVSADEVLM

SEQ ID NO: 1187 - DNA, 558 bp, Unknown
  Obtained from environmental sample
  misc_feature (1)..(558): n is a, c, g, or t
atgcaattcaaggagatcattgggcaaaaaaaagcaaaggattcattccaccggatggtgggtgaaaaccgcgtgccccatgccatcatcttgaaaggcaaacccggcatagggaagctcgcatttgccaacgccatcgcccaatacgtgaactgcgaaatgcccaccggcacggacagttgtggaaagtgctccagttgctcgaagatcaggaaaggcatccatccagacgtacgtttcatcctacctatcatctccaacaaggtggaaggaaagaacccggtctcggacgacttcatggctcagtttcgggagcaatttgtcagcaatccctattatccattcaatgcatgggtgggattgatgcagggcgagaacaaacaagtgggaatccgcatccatgagatcagcgaactgaagcgcaagatcaccctcaaggcctttgaggccaagtacaaggtggtgatcatttggaatgcggaaaagatcatacggaggccgccaatgccatgctcaagctattggaagagccggcggatccgacattgcttctcttga

SEQ ID NO: 1188 - protein, 185 aa, Unknown
  Obtained from environmental sample
  misc_feature (1)..(185): Xaa is any amino acid
MQFKEIIGQKKAKDSFHRMVGENRVPHAIILKGKPGIGKLAFANAIAQYVNCEMPTGTDSCGKCSSCSKIRKGIHPDVRFILPIISNKVEGKNPVSDDFMAQFREQFVSNPYYPFNAWVGLMQGENKQVGIRIHEISELKRKITLKAFEAKYKVVIIWNAEKIIRRPPMPCSSYWKSRRIRHCFS

SEQ ID NO: 1189 - DNA, 675 bp, Unknown
  Obtained from environmental sample
  misc_feature (1)..(675): n is a, c, g, or t
ttgccaaacctgataaaaattctccaagaggatacaaaacttacaaaaaggactcttctagaaattctaaaaagaatagataatcttgatgtattctttaagaacccataccaatacgccaattatgctgcaaatgcgattaagttatcaatccaagatctagcaaaaaagggaatttcctatatcgaaattggtgaagatttccctttgacaatatttgaccaagaagtccaagcttatgaaaaatacattgtgaaattaaatagcaaaaaaacactttatcaaaaaaggtcaggagcgcaagaagacgtcttaataattgatccaagcccctcagaagagggagtatcgcaaccagaaaagaggtttgcggaactggcagattccaattctaatgttcgcttcatatttaaattgccggatacctacttcattgacacaccagttggaaaatatactccagattgggctgttgtcatagaaagggaaaaccaaagccagatttactttatcgcggagactaaagacacgaacatatctggaaatcttcgattagaagaacaaataagaatactttcagctagagcaatgattaaacagatcatgccggaggtggtatctaaggcacccgtgtcaaattttctgatctcgatgactaatcataattactattag

SEQ ID NO: 1190 - protein, 224 aa, Unknown
  Obtained from environmental sample
  misc_feature (1)..(224): Xaa is any amino acid
MPNLIKILQEDTKLTKRTLLEILKRIDNLDVFFKNPYQYANYAANAIKLSIQDLAKKGISYIEIGEDFPLTIFDQEVQAYEKYIVKLNSKKTLYQKRSGAQEDVLIIDPSPSEEGVSQPEKRFAELADSNSNVRFIFKLPDTYFIDTPVGKYTPDWAVVIERENQSQIYFIAETKDTNISGNLRLEEQIRILSARAMIKQIMPEVVSKAPVSNFLISMTNHNYY

SEQ ID NO: 1191 - DNA, 516 bp, Unknown
  Obtained from environmental sample
  misc_feature (1)..(516): n is a, c, g, or t
gtgattgaatgtaaatctgaaattcaaaatatgaaaaatgttgctatccagcacccgaagacgagtattgaaccaggcgtagatggaaaaatagtattagataaattatttgaagtaaagcatataccggtaggaatacaagattggtacaaggctcttgaaaaaggcttgcgtgattatgatgataagatatggacaaatattgggaatgtatatataggcgtctactcgccagaaaaatctttcgcttctgttagattaaacaaagcgagcatacaagttgaatacttttctcgtgggacacctatttctggtaccaaggttgctaatattaaatcatcacctagatggggtaaattctccattaagcaagagggacaacttcaatgggctctcggggtactaaaagaatcacaggcgcggttaaaagccgccatgaaggacggtgagcctacagcctattttagtgggggagtcagacctggcaattcacacgaagaggaagaacaagattag

SEQ ID NO: 1192 - protein, 171 aa, Unknown
  Obtained from environmental sample
  misc_feature (1)..(171): Xaa is any amino acid
MIECKSEIQNMKNVAIQHPKTSIEPGVDGKIVLDKLFEVKHIPVGIQDWYKALEKGLRDYDDKIWTNIGNVYIGVYSPEKSFASVRLNKASIQVEYFSRGTPISGTKVANIKSSPRWGKFSIKQEGQLQWALGVLKESQARLKAAMKDGEPTAYFSGGVRPGNSHEEEEQD

SEQ ID NO: 1193 - DNA, 414 bp, Unknown
  Obtained from environmental sample
  misc_feature (1)..(414): n is a, c, g, or t
gtgaaacttttaacacaactaatcgcgttgttagcggggcaacttatctactattcaagtaacttgcttaaaaataatccgggagaaccaccaggtggccgggttggccacaaaaagatagtaactcaaatgaaacgattcagtgcagtattattaggaagcattatggccataacagctcttgctcagaaaaacaatacagaaaacacacttctctggaagataagcggaaacgggctttcaaagccttcttatctttttggtactatccatatgctttgcaaagacgatgcggtactcagcgatagccttaaaagtatcattaaaaacgtaaaggaagtttactttgaagtggacctggacaatatgtttgaaatgctggctgtgatgggcaaagatgaaaatgagggatga

SEQ ID NO: 1194 - protein, 137 aa, Unknown
  Obtained from environmental sample
  misc_feature (1)..(137): Xaa is any amino acid
MKLLTQLIALLAGQLIYYSSNLLKNNPGEPPGGRVGHKKIVTQMKRFSAVLLGSIMAITALAQKNNTENTLLWKISGNGLSKPSYLFGTIHMLCKDDAVLSDSLKSIIKNVKEVYFEVDLDNMFEMLAVMGKDENEG

SEQ ID NO: 1195 - DNA, 468 bp, Unknown
  Obtained from environmental sample
  misc_feature (1)..(468): n is a, c, g, or t
ttggacaaagatatgttttataactgcatccgatataatctcaagagtcaaagttcgttaagaaccctgcttggttgcctttgctttctggtggcatttacaatgaattcatgtggaagtaaaaaagaaaatgcaaaggccttgaaaaaaatagagattacggttaccggattagacggaaatggagttgccgaaaaaaaaataacagatgacctgatggtgattaatggggtaaaaaccatttcatttaattatctcaacaaccaggttgttgttttatttgacaccacaaaaacaaatcaatccgtaattgttgatgcaattatcaaatccaatgaaggaaaatacaaggtgttggatgtaaaggagaatacggagccacttcaacccgttgttcctgatgtaaagcccgaccagcaggaggatattcatgatgatgtgggtgaaagagataaaaacagtgtatag

SEQ ID NO: 1196 - protein, 155 aa, Unknown
  Obtained from environmental sample
  misc_feature (1)..(155): Xaa is any amino acid
MDKDMFYNCIRYNLKSQSSLRTLLGCLCFLVAFTMNSCGSKKENAKALKKIEITVTGLDGNGVAEKKITDDLMVINGVKTISFNYLNNQVVVLFDTTKTNQSVIVDAIIKSNEGKYKVLDVKENTEPLQPVVPDVKPDQQEDIHDDVGERDKNSV

SEQ ID NO: 1197 - DNA, 300 bp, Unknown
  Obtained from environmental sample
  misc_feature (1)..(300): n is a, c, g, or t
atgactatccccataacaacaataagacaagaaataattgattatgtaaatacaaattatattggaatcaaattagaagaagacgaagcaatagaacttgctgatgagctcatagaaatcatagaagataaatttatttcaaaagaagaacttgtagaaaaattacataacaaaataaacttctgtgatcaagaaatgaaaaaaccagaaaatattgctgttaatgattgcttgggttgtatagaatcaaagaagaaagcatttgaagaagttatcgcaatgctgaaggtgaaaaaatga

SEQ ID NO: 1198 - protein, 99 aa, Unknown
  Obtained from environmental sample
  misc_feature (1)..(99): Xaa is any amino acid
MTIPITTIRQEIIDYVNTNYIGIKLEEDEAIELADELIEIIEDKFISKEELVEKLHNKINFCDQEMKKPENIAVNDCLGCIESKKKAFEEVIAMLKVKK

SEQ ID NO: 1199 - DNA, 300 bp, Unknown
  Obtained from environmental sample
  misc_feature (1)..(300): n is a, c, g, or t
ttgagaacactgttacccaaaactgaaatattagataatgaagatttagtattatcaccattgcaaattaaattagttgaagttattgctgaaggaaactatcataatccgcttacaagtgttcaaattgctgacaagctaaatttattacttaatacaaattacactaaaactcacataacaagcatgtttgtccacttacgaaagaaattggcagaaattggtgtaattatgcctgcggttaaccttaagaaacctggcaaacatggttacttttttacaagaaaaatacaggtgtaa

SEQ ID NO: 1200 - protein, 99 aa, Unknown
  Obtained from environmental sample
  misc_feature (1)..(99): Xaa is any amino acid
MRTLLPKTEILDNEDLVLSPLQIKLVEVIAEGNYHNPLTSVQIADKLNLLLNTNYTKTHITSMFVHLRKKLAEIGVIMPAVNLKKPGKHGYFFTRKIQV

SEQ ID NO: 1201 - DNA, 471 bp, Unknown
  Obtained from environmental sample
  misc_feature (1)..(471): n is a, c, g, or t
ttggttggattaggaatttctgcattggttttctacaacttatcaaaaaatcactggaaaaaatatagcgctgtaaaaaaaccatttccgccggagtgggaagaagttttgcaggaaaaagtcgctttttttcatacgttggatgagaatgcaaaaaaacgtttccgccaggccatacaagtatttatttcaattaaaagaatcagcggaatcagcacgcaaataactgaagaagataaagttctggttgcttgcagcgccatcatccccattttcggatttgaccgttgggagtatcataatttaaaagaagttttgttatatccgggaagttttagacacgattatagtgttgatggtaaggaagatagagtgatacagggaatggttggcagcggcggccatatgaatggaatgatgatattaagtttacccgatcttcgtcgcgggtttgaaaacgtggctgattaa

SEQ ID NO: 1202 - protein, 156 aa, Unknown
  Obtained from environmental sample
  DOMAIN (1)...(155): Protein of unknown function (DUF980)
  misc_feature (1)..(156): Xaa is any amino acid
MVGLGISALVFYNLSKNHWKKYSAVKKPFPPEWEEVLQEKVAFFHTLDENAKKRFRQAIQVFISIKRISGISTQITEEDKVLVACSAIIPIFGFDRWEYHNLKEVLLYPGSFRHDYSVDGKEDRVIQGMVGSGGHMNGMMILSLPDLRRGFENVAD

SEQ ID NO: 1203 - DNA, 546 bp, Unknown
  Obtained from environmental sample
  misc_feature (1)..(546): n is a, c, g, or t
atgcctaatgtcttagacacatcagggaccatgaatcctaaaaatttttcttattcttgggaaaaagacaacaaagatcaaataagttcttctgattgggggaaaaataactttatcttcaaaaaaagttttttagacaccattaatcaagtggctgttaaaatatctagtttacacaatacgattaacaccggtggtaaaataattttaagaaataacattcctaagattgttttttaccaagaagatccactatttgggatacaaacacaagaatctttgaaaaatggtttcaatgtaaataatgatggagtggttattgtggcaataccttattttatgccaacgaaagatggcaaggttgataatctagaattcagctggagtgtaggggatgctcctattccagtacaaaagccaaaaaacaaaattgcagtaaagcctgataataatcaaaagggtaatactgtaatcaaagtagaggcaaataactttaatagtgtggcttctcctgcaatatccagacttatttctgtaagcttttaa

SEQ ID NO: 1204 - protein, 181 aa, Unknown
  Obtained from environmental sample
  misc_feature (1)..(181): Xaa is any amino acid
MPNVLDTSGTMNPKNFSYSWEKDNKDQISSSDWGKNNFIFKKSFLDTINQVAVKISSLHNTINTGGKIILRNNIPKIVFYQEDPLFGIQTQESLKNGFNVNNDGVVIVAIPYFMPTKDGKVDNLEFSWSVGDAPIPVQKPKNKIAVKPDNNQKGNTVIKVEANNFNSVASPAISRLISVSF

SEQ ID NO: 1205 - DNA, 327 bp, Unknown
  Obtained from environmental sample
  misc_feature (1)..(327): n is a, c, g, or t
atgcagcagaatcaacttaaaacatcagtagtctcagtgggtaatttgttgcaatattctcaactgaaaattccggtttaccagcgtccttataagtggacacaaaaaaacgtgtctcagcttctaaaagacatttacaacttccgcaacaaatctgcttaccgtttcgggactattgtaattcatgatgataatggcgtctatcatattgtagatggccagcaacgcattctcacactagttttaattgttaaagcaatattaaaacaccacaaaagcgatgtaaaaaatccggaactaaaaaacctgcttttttcacctcgatga

SEQ ID NO: 1206 - protein, 108 aa, Unknown
  Obtained from environmental sample
  misc_feature (1)..(108): Xaa is any amino acid
MQQNQLKTSVVSVGNLLQYSQLKIPVYQRPYKWTQKNVSQLLKDIYNFRNKSAYRFGTIVIHDDNGVYHIVDGQQRILTLVLIVKAILKHHKSDVKNPELKNLLFSPR

SEQ ID NO: 1207 - DNA, 660 bp, Unknown
  Obtained from environmental sample
  misc_feature (1)..(660): n is a, c, g, or t
atgatggtgtactcgctctttcggaagaggatgcttcactttacaaaaattcaggttgtacaatttccggttgaaattgtacccataggaattgatactggtacttatgaaatcaatgacaccaacggagccgaggatatatttcatcttggttcaatggactggatgccgaaccttgagggagtaaaatggtttctcaacaatgtttatccccagatactagaaaaatcaccttctgttaaaattcatctcgcaggaaaagggatgcctgagtggatttataaacttcgttcaggaaatctcatggtgtatgggcgtatcgaaaatgcgcgacaatttatgtataacaagaaattaatgatcgtaccgttgctttctggtggaggaatgcgtgtaaaaataattgaaggtatggcaatgggccggacaattatttcaacaacaataggagcggaaggcattaaatataaaaatggttatgacctgttaattgctgataatccagaggagtttgtaatgcatataataaaatgtttaactgataagtccttcgcagctgaaattggaaaaaatgccaggaagctggcagaatcagagtatgataattctgttaccggtaagtcagttatcaggttctataacaaactgacagaaaaatga

SEQ ID NO: 1208 - protein, 219 aa, Unknown
  Obtained from environmental sample
  DOMAIN (31)...(195): Glycosyl transferases group 1
  misc_feature (1)..(219): Xaa is any amino acid
MMVYSLFRKRMLHFTKIQVVQFPVEIVPIGIDTGTYEINDTNGAEDIFHLGSMDWMPNLEGVKWFLNNVYPQILEKSPSVKIHLAGKGMPEWIYKLRSGNLMVYGRIENARQFMYNKKLMIVPLLSGGGMRVKIIEGMAMGRTIISTTIGAEGIKYKNGYDLLIADNPEEFVMHIIKCLTDKSFAAEIGKNARKLAESEYDNSVTGKSVIRFYNKLTEK

SEQ ID NO: 1209 - DNA, 627 bp, Unknown
  Obtained from environmental sample
  misc_feature (1)..(627): n is a, c, g, or t
ttggataatatatcggtcaatacaaatgatctctggttacgttgggccgccattttacatgatatagcaaaacctgtcaccaaacgatttgaagacggacatggatggacctttcacgggcatgaagtggtaggaggaagaatggtgccgaagatatttgctaaactaaagctcccgctaagtgaaaaaatgcgatttgtcagaaaactggtggaacttcatttacgtcccattagtttgacaaaagagaatattaccgactctgccatcaggcgtttattatttgatgcgggggaagattttgatgcgctgatgctgctttgtgatgcggatattacatccaagaacaaacaaaaagtaaaacggtaccaggagaattttcaactggtaagaacgcgttgcaaagaagtggaagaaaaggaccaggtgcgtaactggcagccacccattagcggtgaagaaataatggaaatgtttgatttgcttccttcgaggccggtaggaattttgaaaaatgccttaaaagatgctatccttgatggtataattcctaatagttatgaggccgcttatgaataccttgttgaaaaagcaaaggaaatggatttgaaaataaagaaatcgtaa

SEQ ID NO: 1210 - protein, 208 aa, Unknown
  Obtained from environmental sample
  DOMAIN (1)...(116): HD domain
  misc_feature (1)..(208): Xaa is any amino acid
MDNISVNTNDLWLRWAAILHDIAKPVTKRFEDGHGWTFHGHEVVGGRMVPKIFAKLKLPLSEKMRFVRKLVELHLRPISLTKENITDSAIRRLLFDAGEDFDALMLLCDADITSKNKQKVKRYQENFQLVRTRCKEVEEKDQVRNWQPPISGEEIMEMFDLLPSRPVGILKNALKDAILDGIIPNSYEAAYEYLVEKAKEMDLKIKKS

SEQ ID NO: 1211 - DNA, 336 bp, Unknown; identical to SEQ ID NO: 675
  Obtained from environmental sample
  misc_feature (1)..(336): n is a, c, g, or t

SEQ ID NO: 1212 - protein, 111 aa, Unknown; identical to SEQ ID NO: 676
  Obtained from environmental sample
  misc_feature (1)..(111): Xaa is any amino acid

SEQ ID NO: 1213 - DNA, 450 bp, Unknown
  Obtained from environmental sample
  misc_feature (1)..(450): n is a, c, g, or t
atgctaactattatcagaaccaactccgaaaacaaggattttatccatcttgttaaatatcttgatgctgaattagcagtactggacggtgacgaacatgaattttacgcgcagcttaataaaacacataatttaaaacaggtggttgtcgcttatgaaaatggcaaaccaatcgcttgtggtgcattaagagaacattcaccaaccatcatggaggttaaacgaatgtacacgttacgggagaacaggggcaaaggaatcgcaactaaaatcttaactgaattagaaaaatgggcagccgaattatcctatcagaaatgtattttggaaacgggcaagcgacagccggatgcgatctggttatatcaaaagaatggatacaaggtcattcccaattacggcaaatatcttgtcatggagaacagcgtatgttttgaaaaagaaatttga

SEQ ID NO: 1214 - protein, 149 aa, Unknown
  Obtained from environmental sample
  DOMAIN (49)...(128): Acetyltransferase (GNAT) family
  misc_feature (1)..(149): Xaa is any amino acid
MLTIIRTNSENKDFIHLVKYLDAELAVLDGDEHEFYAQLNKTHNLKQVVVAYENGKPIACGALREHSPTIMEVKRMYTLRENRGKGIATKILTELEKWAAELSYQKCILETGKRQPDAIWLYQKNGYKVIPNYGKYLVMENSVCFEKEI

SEQ ID NO: 1215 - DNA, 672 bp, Unknown
  Obtained from environmental sample
  misc_feature (1)..(672): n is a, c, g, or t
ttgaagatatatttaccaagaatgaagaaaagtcacagaaagaatgctgagcaggttgtcaagttatttcatactatggcagatgagcatggttatatgaacacatacaacatgttcaacacaagagctttcagagattctctgatgataccatctgcaatatgggcagaattggaaccagaaatcagagagaagatcaatgaagccagaaagagagctaaagaaaagagaggttctttcaagccaaaagatgacaatacatcaaagtatcctaagagccagaacatggatattccaaatcagtatcctaatgtcaaacccaagaatacaattgctaatctggttagttctatgaatgatattgatcttggagatatggacagtgaatctactgatgacaatatgcttgaccactcaatcaatatggttagagggacaattccaatagacccaccatcagatgtcattgatctgaaggcacactttgaatacattgacagcaatttttgtgatgacatgatatatgccatttctgatggaggtgcagactcatgtattttgggtatgaatgccaaagttctggcttatacaggaagatatgcatacttggttggttatgatcccaccaacacaataacgagactaagtccccattgtgagtgcactaattaa

SEQ ID NO: 1216 - protein, 223 aa, Unknown
  Obtained from environmental sample
  misc_feature (1)..(223): Xaa is any amino acid
MKIYLPRMKKSHRKNAEQVVKLFHTMADEHGYMNTYNMFNTRAFRDSLMIPSAIWAELEPEIREKINEARKRAKEKRGSFKPKDDNTSKYPKSQNMDIPNQYPNVKPKNTIANLVSSMNDIDLGDMDSESTDDNMLDHSINMVRGTIPIDPPSDVIDLKAHFEYIDSNFCDDMIYAISDGGADSCILGMNAKVLAYTGRYAYLVGYDPTNTITRLSPHCECTN

SEQ ID NO: 1217 - DNA, 573 bp, Unknown
  Obtained from environmental sample
  misc_feature (1)..(573): n is a, c, g, or t
gtggatcacacaggatgggtcgctgtcgggttacagcttcatctcggcaaagatttttcgatgtattcgagcgaaatgggtttgactttatacccggcatacctgtcgcggaagttctcacgtgaatacatacccgtaaatgcagtaagaaatattgttgatgatattttcccggaccagagcagcgataaaacgctcatagaacaaatggtagagaaaggcaaacgcatttatctgatagataagctgatgccatctgttgcagacacattaaaaaccggatacactgctttgcaactggaaggatgccggaaaaatgaagcgtttatctggaattattttgtgaagaatgggttgatatttaataacgacccgtctatcatcaaaaattacattggtgattcaccgaacacgccggaatttggtgacgagtcgccagggtatattggcttgtttgttggatggcagatcgtgaagaaatttatggagaagaatgaaggcatgagcctggataaattgatggtgattgctccaggaaaactgttcgaagaaagtaaataccgtccgcgataa

SEQ ID NO: 1218 - protein, 190 aa, Unknown
  Obtained from environmental sample
  misc_feature (1)..(190): Xaa is any amino acid
MDHTGWVAVGLQLHLGKDFSMYSSEMGLTLYPAYLSRKFSREYIPVNAVRNIVDDIFPDQSSDKTLIEQMVEKGKRIYLIDKLMPSVADTLKTGYTALQLEGCRKNEAFIWNYFVKNGLIFNNDPSIIKNYIGDSPNTPEFGDESPGYIGLFVGWQIVKKFMEKNEGMSLDKLMVIAPGKLFEESKYRPR

SEQ ID NO: 1219 - DNA, 750 bp, Unknown
  Obtained from environmental sample
  misc_feature (1)..(750): n is a, c, g, or t
ttgctgaaagatacccgaccacaagatgaaattctgcttccggaagaattgtcatgtccttacgacggattaagtttagcggaaatctcgcctcgatctttttcgttcaatagtccatatggcgcgtgcgaagattgccacggacttggctttaaaaaagatataacagaagaattaataattcctgataaaatattatcagtggccgaaggtggaataatgccatggacttactcgccaactaattactacggcgtacttctgcgcaatgcctgtgagcatttcggcatcgattttgatgctgcgatagaaactcaggacgaaactaagattaaaaaattactttacggaactggcgccccatttcaaatgaagctgcgttactttagtggcggtgctgcacaatatttcaacgtttggtacaaaggcctaatcccacatttagaaaatcgttacaaagaaaccgaatccgattctgttcgcgaagaaattgaaaaatatatgctgaccaacgagtgccaaacttgtaagggagctcggttaaaacaagaatctttgatcgtcaaagttaacgacaaaaatattgccgaagtttcacaactttctatcgataacgcccacgaatttttcaagaatctaaaactgacaaaacgggaattagcgattgccgaaaaagttatatatgaaattactaatcgattagaatttttgagtaaagttggattaacttatttgacacttgatcgttaa

SEQ ID NO: 1220 - protein, 249 aa, Unknown
  Obtained from environmental sample
  misc_feature (1)..(249): Xaa is any amino acid
MLKDTRPQDEILLPEELSCPYDGLSLAEISPRSFSFNSPYGACEDCHGLGFKKDITEELIIPDKILSVAEGGIMPWTYSPTNYYGVLLRNACEHFGIDFDAAIETQDETKIKKLLYGTGAPFQMKLRYFSGGAAQYFNVWYKGLIPHLENRYKETESDSVREEIEKYMLTNECQTCKGARLKQESLIVKVNDKNIAEVSQLSIDNAHEFFKNLKLTKRELAIAEKVIYEITNRLEFLSKVGLTYLTLDR

SEQ ID NO: 1221 - DNA, 372 bp, Unknown
  Obtained from environmental sample
  misc_feature (1)..(372): n is a, c, g, or t
ttgatgtcaaaaaagatcgttgcggtgatctgcggtggatataccgcggaaaaaaatatttctctcatgagcggggaagttgtgtttcagaatatcgaccgcgaaaaatatgagccttacaaagtgatcgtagacacagacggctggtttgtggatcccataaaatcaaaaatcgaattaaatgatttcagcttcacagccgatggaagaaaaataaaatttgattgcgtcttcaatgccattcacgggtcacctggtgaagacggtaaaatccagggctattttgatatgatgaaaatcccgtattccaattgcggtcccctcgcttcgggcgttacttttaataaattacttggacaaaagaaattgtga

SEQ ID NO: 1222 - protein, 123 aa, Unknown
  Obtained from environmental sample
  DOMAIN (5)...(114): D-ala D-ala ligase N-terminus
  misc_feature (1)..(123): Xaa is any amino acid
MMSKKIVAVICGGYTAEKNISLMSGEVVFQNIDREKYEPYKVIVDTDGWFVDPIKSKIELNDFSFTADGRKIKFDCVFNAIHGSPGEDGKIQGYFDMMKIPYSNCGPLASGVTFNKLLGQKKL

SEQ ID NO: 1223 - DNA, 1005 bp, Unknown
  Obtained from environmental sample
  misc_feature (1)..(1005): n is a, c, g, or t
ttggtgcaggactacgatttttactggctatacaagaacaaaaattgtaggcttcagatgggcggctccgatcagtggggaaatatcgttaccggaacagaattaattcgcaggaaagccgatggtgaagcgttcgcgttgacaacaaaactaattacgaaagctgacggaactaagttcggaaaatctgagggcggtaatgtatggcttgatcctaaaaaaacatcgccatacaaattctaccaatactggttaaatgtttcagacgatgatgcttcgacttttatcaagatcttcacgcagcttacgaaagaagaaattgatggactcattgcagagcatgcactggcgcctcacgcgcgcaagcttcaacaggttctggcaaaagacatcacgatcagagtacattcacaaggcgaatacgaaaatgccataaaagcatcgaatatattgttcggtaattccactacagaagaactcgaatcgcttgacgaggaaaccttgctttcggtattcgaaggtgttccgcaagttaaaattacaaaaggcgactacgcgaacacttcttcggtcatcgatcttctttcaaccgtatctcaaaatattatttttccttcaaaaggtgaggcgcgcaagatgattcagggtggtggtgtgagcgtgaacaaggccagggttgaagatatgaacgcaaaacctgcctatacacttcttcaaaacaagtatctgctggcgcagaaaggaaagaagaattactacctaattgttattgagtactacagttgccggtttcaagctgcaagtcgcaagtcgaggcagtcatgccacctgcgaaccgcgaattgcaataaatttctattttcccagattgaaaaagttatagctactgaaactgaatcaccggttcctagcgttgcagttactccgtgggtgcttggtctaaacttcgacaacccaggtgttccggctctatgtcgaccgaagaaatccccccaaacaaggtga

SEQ ID NO: 1224 - protein, 334 aa, Unknown
  Obtained from environmental sample
  DOMAIN (1)...(153): tRNA synthetases class I (W and Y)
  misc_feature (1)..(334): Xaa is any amino acid
MVQDYDFYWLYKNKNCRLQMGGSDQWGNIVTGTELIRRKADGEAFALTTKLITKADGTKFGKSEGGNVWLDPKKTSPYKFYQYWLNVSDDDASTFIKIFTQLTKEEIDGLIAEHALAPHARKLQQVLAKDITIRVHSQGEYENAIKASNILFGNSTTEELESLDEETLLSVFEGVPQVKITKGDYANTSSVIDLLSTVSQNIIFPSKGEARKMIQGGGVSVNKARVEDMNAKPAYTLLQNKYLLAQKGKKNYYLIVIEYYSCRFQAASRKSRQSCHLRTANCNKFLFSQIEKVIATETESPVPSVAVTPWVLGLNFDNPGVPALCRPKKSPQTR

SEQ ID NO: 1225 - DNA, 405 bp, Unknown
  Obtained from environmental sample
  misc_feature (1)..(405): n is a, c, g, or t
ttgctgttgaaaatgaatagtatttttgagcagatgaagaattacctgcttcctgcaataatagtggtggcaacagtcataaccgccagtttcacatttatcgaaaagaataaccatgtttcaaaactggaactgggcaaaaaactcttcggggataaaatattatcaaaagatttttcgatcagttgcgcgtcctgccacaagcccgaatttgcctttgcagataccactgcttttagtaaagggatcgggggcaaacttacccgccgcaacacaccttcagttctcaacatgaaaaaccgcccctattatttctgggatggcagagccgtgagcnttgagatgcaggcgttaatgcctattcaaaacccggacgaaatggtgtgccagttcttgatccactag

SEQ ID NO: 1226 - protein, 134 aa, Unknown
  Obtained from environmental sample
  DOMAIN (12)...(132): Di-haem cytochrome c peroxidase
  misc_feature (1)..(134): Xaa is any amino acid
MLLKMNSIFEQMKNYLLPAIIVVATVITASFTFIEKNNHVSKLELGKKLFGDKILSKDFSISCASCHKPEFAFADTTAFSKGIGGKLTRRNTPSVLNMKNRPYYFWDGRAVSXEMQALMPIQNPDEMVCQFLIH

SEQ ID NO: 1227 - DNA, 414 bp, Unknown
  Obtained from environmental sample
  misc_feature (1)..(414): n is a, c, g, or t
atgcaaccaatctacaggcaaaggctgaagaaatactttatatggattgcctggattgtaatcattcaatttactcttgtcaacataagtgctgctatttatgcttataaattcactcatttttatactaatcctcccccatataattccaataaaaatatttttgtaaagacatggaagcttttttccggccccgatatttacaaactcccacccgacacaattacgccacccggttatgaacagacaaagtttgcaaccaatcacgcccttgctattgaaggatggtacggaaaggctgatactgctaaaggctgcattattttttttcatggcattacaaatgacaaatcctctttgttgcaggaagcagatgaatttcaacactcgaggatatcatgttttacttattga

SEQ ID NO: 1228 - protein, 137 aa, Unknown
  Obtained from environmental sample
  misc_feature (1)..(137): Xaa is any amino acid
MQPIYRQRLKKYFIWIAWIVIIQFTLVNISAAIYAYKFTHFYTNPPPYNSNKNIFVKTWKLFSGPDIYKLPPDTITPPGYEQTKFATNHALAIEGWYGKADTAKGCIIFFHGITNDKSSLLQEADEFQHSRISCFTY

SEQ ID NO: 1229 - DNA, 390 bp, Unknown
  Obtained from environmental sample
  misc_feature (1)..(390): n is a, c, g, or t
gtgttgaaattcatctgcttcctgcaacaaagaggatttgtcatttgtaatgccatgaaaaaaaataatgcagcctttagcagtatcagcctttccgtaccatccttcaatagcaagggcgtgattggttgcaaactttgtctgttcataaccgggtggcgtaattgtgtcgggtgggagtttgtaaatatcggggccggaaaaaagcttccatgtctttacaaaaatatttttattggaattatatgggggaggattagtataaaaatgagtgaatttataagcataaatagcagcacttatgttgacaagagtaaattgaatgattacaatccaggcaatccatataaagtatttcttcagcctttgcctgtagattggttgcattaa

SEQ ID NO: 1230 - protein, 129 aa, Unknown
  Obtained from environmental sample
  misc_feature (1)..(129): Xaa is any amino acid
MLKFICFLQQRGFVICNAMKKNNAAFSSISLSVPSFNSKGVIGCKLCLFITGWRNCVGWEFVNIGAGKKLPCLYKNIFIGIIWGRISIKMSEFISINSSTYVDKSKLNDYNPGNPYKVFLQPLPVDWLH

SEQ ID NO: 1231 - DNA, 444 bp, Unknown
  Obtained from environmental sample
  misc_feature (1)..(444): n is a, c, g, or t
atgcaaacaaattatttagttataggatcaggcattgcaggacttacgtatgcactaaaagtggcgcaggaatgccctgataaaaaagtaactattcttactaaaacgcaaagtgatgaaaccaacaccaaatatgcccagggaggcatagcgggtgtaatggattttgataacgatagtttttccaaacatatagaagatacgcttgtggcaggcgacgggctttgcaataaaaaaattgttgagattgttgtaaaggaaggggtagaacgtattaatgaattaatagagtggggcgccttgtttgataaggagcccgatggagattataaacttggaaaggaagggggccatagtgaaagccgtatcctgcatcataaagatgtaaccggtgcagaaatggaaagagcctactggaagctattaaaaaatgccccaatatag

SEQ ID NO: 1232 - protein, 147 aa, Unknown
  Obtained from environmental sample
  misc_feature (1)..(147): Xaa is any amino acid
MQTNYLVIGSGIAGLTYALKVAQECPDKKVTILTKTQSDETNTKYAQGGIAGVMDFDNDSFSKHIEDTLVAGDGLCNKKIVEIVVKEGVERINELIEWGALFDKEPDGDYKLGKEGGHSESRILHHKDVTGAEMERAYWKLLKNAPI

SEQ ID NO: 1233 - DNA, 690 bp, Unknown
  Obtained from environmental sample
  misc_feature (1)..(690): n is a, c, g, or t
ttgcggagcgatgtacagcaatcagaagtagatattgcgaagatggagctgaacaaacttgcatatgaagttaagtatcaagccgaaagcgcatatttaagtctattgctgaacattaaacttctggatgctgcgcgtgaaaacctcaaaatatataatgatttcctcttcactgcagaaaggaaatatgatgccggctcaaccagtaaccttgaggtattgggcgcaaaggtgaacaagattaaatacgaaaacgggataaagaacattgagtcggagataattaaatccaaatcagaattgaagaaactaatgaatgtatcatatttcagtttcgaaccggctgatgaacttattttcagggaagttcagctgaataagaacgagatattactggctgcactgtcaaataatcctgagcttaaaattaataagtatcagaaagaaaaattcagcaataagatatcattaacaaaatcccagcttttacctgatctatcatttaaatactacacccaaaaaatcggcaatgatgcaggattctggggggttgaatttggtgtgggcgtacctttatggttctggtgggagcaatcaggcaatataaaagaagctgaccgcgagtttgatattgcatcaagcgaagaaacaggtataaaaagaatattgaaatcagtaaatcattcttga

SEQ ID NO: 1234 - protein, 229 aa, Unknown
  Obtained from environmental sample
  misc_feature (1)..(229): Xaa is any amino acid
MRSDVQQSEVDIAKMELNKLAYEVKYQAESAYLSLLLNIKLLDAARENLKIYNDFLFTAERKYDAGSTSNLEVLGAKVNKIKYENGIKNIESEIIKSKSELKKLMNVSYFSFEPADELIFREVQLNKNEILLAALSNNPELKINKYQKEKFSNKISLTKSQLLPDLSFKYYTQKIGNDAGFWGVEFGVGVPLWFWWEQSGNIKEADREFDIASSEETGIKRILKSVNHS

SEQ ID NO: 1235 - DNA, 501 bp, Unknown
  Obtained from environmental sample
  misc_feature (1)..(501): n is a, c, g, or t
atgaatccgttaatagtcgaatcgttcgcggaaatggtccgcgaaaagggcatagaccgcgacatcctgatgagcgtcatcgaggagacgtttgccatgatggtccgtaaaaaatacggaattgatgccaaattcgatatcgtcatgaatatggacaaaggcgatattgaaatttacattgaaaaatcagtcgttgaaaaggttgaaaacccttcaactgaaatatcggtcgaagatgcccaggcaaagtccggcgaagaactcgaagcgggcgacgaatatgtagagatcgtcaaaatgacgaaggactttggccgccgccttgtcattacggctaagcaaaacttaaaccaaaagattcgagagatagagaaggataatctcttcaatgagtatacgggattaatgggagatatcattgtcggcgaagtataccagcagcgccgcggtgacctctttattcttcacaatcgacgtgaacttcctttaaccggcaagtga

SEQ ID NO: 1236 - protein, 166 aa, Unknown
  Obtained from environmental sample
  misc_feature (1)..(166): Xaa is any amino acid
MNPLIVESFAEMVREKGIDRDILMSVIEETFAMMVRKKYGIDAKFDIVMNMDKGDIEIYIEKSVVEKVENPSTEISVEDAQAKSGEELEAGDEYVEIVKMTKDFGRRLVITAKQNLNQKIREIEKDNLFNEYTGLMGDIIVGEVYQQRRGDLFILHNRRELPLTGK

SEQ ID NO: 1237 - DNA, 495 bp, Unknown
  Obtained from environmental sample
  misc_feature (1)..(495): n is a, c, g, or t
ttgaaagaaaaatttccaaatatcttatttattgatgatgacgtttggaactcgccaatcgcaccaactaaacaatttattgataagtgtcattccaaatttatttatatttggaataaagatattgttgatgaaatttatgtcgttaaatcacaagatggaaaatatcatggaagaaaagatgtagatgtaattagatttacaaggtgttatcacaagcctgaaggtctttggtatggtgaaattttgtttggttcgaattctgcctatccgaattttgaaccgatgaaaacctttacaaaagaagtttggaggatacttaacaaaatgtgcgagaaagtggttgcagtaaatcctcaaactagagacataataaatgacgacgtttcttatttcagagtaggtaaaaataccgttgagtggtgtaaagaaaatacgaataattttcttagttattaccaaacagcttttttaccaaaatcgttttatgaataa

SEQ ID NO: 1238 - protein, 164 aa, Unknown
  Obtained from environmental sample
  misc_feature (1)..(164): Xaa is any amino acid
MKEKFPNILFIDDDVWNSPIAPTKQFIDKCHSKFIYIWNKDIVDEIYVVKSQDGKYHGRKDVDVIRFTRCYHKPEGLWYGEILFGSNSAYPNFEPMKTFTKEVWRILNKMCEKVVAVNPQTRDIINDDVSYFRVGKNTVEWCKENTNNFLSYYQTAFLPKSFYE

SEQ ID NO: 1239 - DNA, 420 bp, Unknown
  Obtained from environmental sample
  misc_feature (1)..(420): n is a, c, g, or t
gtggtagacaaccatactttggtggaccatcagaagccgaactgtaatagcaacgagctttataagggaatcattgaagaccgttcctcggcgacttttaacggaaagatttatgtcagaaaggatgcgcaaaagacaaatgcatttcaatcgaacaaaaatatcttgttgagtgacgatggtacgatcaatacaaaaccccagttagagatctatgccgacgacgttaaatgttctcatggaacttccaccggtaaattggatgaagacaagatcttttatttgcgtgcacgtggattgagcgagaccagtgcgaagaaattattgatgcatgcatttgcgtcggaagtggtggataccattaagattgaagctttacgtgaatatgtagaagccaaaatttcaaaacggtttgaataa

SEQ ID NO: 1240 - protein, 139 aa, Unknown
  Obtained from environmental sample
  DOMAIN (1)...(113): Uncharacterized protein family (UPF0051)
  misc_feature (1)..(139): Xaa is any amino acid
MVDNHTLVDHQKPNCNSNELYKGIIEDRSSATFNGKIYVRKDAQKTNAFQSNKNILLSDDGTINTKPQLEIYADDVKCSHGTSTGKLDEDKIFYLRARGLSETSAKKLLMHAFASEVVDTIKIEALREYVEAKISKRFE

SEQ ID NO: 1241 - DNA, 528 bp, Unknown
  Obtained from environmental sample
  misc_feature (1)..(528): n is a, c, g, or t
ttggataattatgtgttctccaaccagccatctgtaaataaggaccagatttacatgctatccaattgtgattttgttcgcctgaaacaaaaattaatcgtcattggcatttcaggcgtagggaaaagtcacattacctgcgggctcggtttaaaagcagtcgaaaaaggatttaaagtcgcgcagtacaattcgaatgatcttgttgatctgttgatagatatgaaaaagaatagtggctacgacaaatttcttaaggatttactttcaatggacctggtcattattgatgaaatgtgtttgttagaatatccgccggaagggtcaacgcttttaatgcgcctgctggataaattggatgaaaacattgcagtggcctttacttcaaatcgtgaattatcggattgggtgccattctttcccgatgaagttgttgccagcgcctttgtcgacagaagcattaattacgcgacaattattaagatagtcggaaaaagtaaccgtgcggctcaacatcagaccacctaa

SEQ ID NO: 1242 - protein, 175 aa, Unknown
  Obtained from environmental sample
  DOMAIN (1)...(160): IstB-like ATP binding protein
  misc_feature (1)..(175): Xaa is any amino acid
MDNYVFSNQPSVNKDQIYMLSNCDFVRLKQKLIVIGISGVGKSHITCGLGLKAVEKGFKVAQYNSNDLVDLLIDMKKNSGYDKFLKDLLSMDLVIIDEMCLLEYPPEGSTLLMRLLDKLDENIAVAFTSNRELSDWVPFFPDEVVASAFVDRSINYATIIKIVGKSNRAAQHQTT

SEQ ID NO: 1243 - DNA, 603 bp, Unknown
  Obtained from environmental sample
  misc_feature (1)..(603): n is a, c, g, or t
gtgttgaacttcgctgtcatcaaaaatgcgtaccagnctgtagtggtgcttaacccttctgtaaacggtaaccctaaattgaagttgtctgaaaccattattgataatgcttatgacattggcctgcttggtatcaacacacaaattactggccagaatttgttgataagtaactgtgataaaaatatggttttagtgaatggtggcaattacgagttttcgcattgcaccgttgccagttatgtcaaccgtcttatagaacatataaacccagttttaacgcttagtgattatttagacaactcacagaatacaccgaataatttagatgcgacatttcgtaattgcattttttggggtgaaggaggtaagctagaaaatgaggtccaggtttttaaaaaaggcactccctcaatcaagttcgaagatgtcttgtggaaggttaaagagcagcctgtaaacccaacaggtaagttttttaataatgaagatcctttgtttgtttcaatagatacggaaaagaaattttatgatttccgattaaaagaaaattcaaaagcagttaataacggagctaatacttcaatcaactttcggatttga

SEQ ID NO: 1244 - protein, 200 aa, Unknown
  Obtained from environmental sample
  misc_feature (1)..(200): Xaa is any amino acid
MLNFAVIKNAYQXVVVLNPSVNGNPKLKLSETIIDNAYDIGLLGINTQITGQNLLISNCDKNMVLVNGGNYEFSHCTVASYVNRLIEHINPVLTLSDYLDNSQNTPNNLDATFRNCIFWGEGGKLENEVQVFKKGTPSIKFEDVLWKVKEQPVNPTGKFFNNEDPLFVSIDTEKKFYDFRLKENSKAVNNGANTSINFRI

SEQ ID NO: 1245 - DNA, 345 bp, Unknown
  Obtained from environmental sample
  misc_feature (1)..(345): n is a, c, g, or t
gtggaccacctggatgaaaacgggaaggctcattatgtaaacacggttatgcaatctttgggggatattagtgatcctaatatcaggcgagaagcaatagcatctgatgtaaatgatatggtttgttccgcaaaacagaggcttgaatggtgtaagcatgttcagattattcaagaccttcggcatacgaaatcgctggaaactttttacaagcagataccgcaaaagaggatactctgcgcagaacttggatatcaatctcctgaagctggaaattcattcgaacagctatggccattttttaagggaatctattgtttaggttgtgtgaaaagaaagctgtga

SEQ ID NO: 1246 - protein, 114 aa, Unknown
  Obtained from environmental sample
  misc_feature (1)..(114): Xaa is any amino acid
MDHLDENGKAHYVNTVMQSLGDISDPNIRREAIASDVNDMVCSAKQRLEWCKHVQIIQDLRHTKSLETFYKQIPQKRILCAELGYQSPEAGNSFEQLWPFFKGIYCLGCVKRKL

SEQ ID NO: 1247 - DNA, 435 bp, Unknown
  Obtained from environmental sample
  misc_feature (1)..(435): n is a, c, g, or t
atgggaaaaaatatacagaaattgacgaaaaatgttgctcagacacaacgtatagcaaaagaacttggtgccattctcaaaaatgggggaattttggcattgtatggtgatttaggtagtggtaatacaacatttgcacaaggggtagctcgaagcgtagggataacacagcgaattatatctccaacatttattatcatgagagaatatgatctgaaggggaaagcggggaagttttaccatgtagatctttatagaataaaagacaaaaaagatattgaagaactaggattaaaagaaattatggatgataggagtaatattattgttattgaatggccagaacgattaggagagtttttacccaaaaatgcaaaaaagatacaattcaattatttatcagaaaaggaaagagagattacttatgaacaataa

SEQ ID NO: 1248 - protein, 144 aa, Unknown
  Obtained from environmental sample
  DOMAIN (15)...(140): Uncharacterised P-loop hydrolase UPF0079
  misc_feature (1)..(144): Xaa is any amino acid
MGKNIQKLTKNVAQTQRIAKELGAILKNGGILALYGDLGSGNTTFAQGVARSVGITQRIISPTFIIMREYDLKGKAGKFYHVDLYRIKDKKDIEELGLKEIMDDRSNIIVIEWPERLGEFLPKNAKKIQFNYLSEKEREITYEQ

SEQ ID NO: 1249 - DNA, 306 bp, Unknown
  Obtained from environmental sample
  misc_feature (1)..(306): n is a, c, g, or t
atgatatctgacattgtattttcgataggattgtatcttcctaatgatacctgtattgctttctctcaaacggccaaatcttatagaaaattatttacttctgataacttttggaaggtcaaattaagatatgacttccgatttgagaagaaaacatatttatcatatattacatatcagagacaaaagagatttctaagctacaaagcttatttgcatgttatatctactgataattgtgatcaagcattattatcatctcttgttcaatactctttaaataaccttcatcacccgtgtatatga

SEQ ID NO: 1250 - protein, 101 aa, Unknown
  Obtained from environmental sample
  misc_feature (1)..(101): Xaa is any amino acid
MISDIVFSIGLYLPNDTCIAFSQTAKSYRKLFTSDNFWKVKLRYDFRFEKKTYLSYITYQRQKRFLSYKAYLHVISTDNCDQALLSSLVQYSLNNLHHPCI

SEQ ID NO: 1251 - DNA, 309 bp, Unknown
  Obtained from environmental sample
  misc_feature (1)..(309): n is a, c, g, or t
atgatatctgacattgtattttcgataggattgtatcttcctaatgatacctgtattgctttctctcaaacggccaaatcttatagaaaattatttacttctgataacttttggaaggtcaaattaagatatgacttccgatttgagaagaaaacatatttatcatatattacatatcagagacaaaagagatttctaagctacaaagcttatttgcatgttatatctactgataattgtgatcaagcattattatcatctcttgttcaatactctttaaataaccttactcacccagtggttatatga

SEQ ID NO: 1252 - protein, 102 aa, Unknown
  Obtained from environmental sample
  misc_feature (1)..(102): Xaa is any amino acid
MISDIVFSIGLYLPNDTCIAFSQTAKSYRKLFTSDNFWKVKLRYDFRFEKKTYLSYITYQRQKRFLSYKAYLHVISTDNCDQALLSSLVQYSLNNLTHPVVI

SEQ ID NO: 1253 - DNA, 510 bp, Unknown
  Obtained from environmental sample
  misc_feature (1)..(510): n is a, c, g, or t
atggcaattaacatgaatagaagaacatttctaaaagcatctgccgccctgggaataacaagcgttgctttaccatcattgcttaaagcatataacataagtgacgattacgaagatatgaagtgtaagaagattctaaaatctttcgatgcttcacttaaaaatatgtcggtaaatgatgtgataattgaagtaggtaaatcatttttagcagtgccatatgtagcgggaacgcttgatacaaatccgaataaggaaagattaattgtgtatgtatccggacttgactgcgttaccttctgcgaaaatgctctcacaatgtcgcgcataataaagcagggtgatacgagcttcgataactataaaaaggagctgactaagataagatacagagacggagtacttgacggatatccgtcgcggctccattatttctcggactggatttacgataacgaggcaaaaacaattgtgagagatatacnaaaggaatcgaccagtggaatatag

SEQ ID NO: 1254 - protein, 169 aa, Unknown
  Obtained from environmental sample
  misc_feature (1)..(169): Xaa is any amino acid
MAINMNRRTFLKASAALGITSVALPSLLKAYNISDDYEDMKCKKILKSFDASLKNMSVNDVIIEVGKSFLAVPYVAGTLDTNPNKERLIVYVSGLDCVTFCENALTMSRIIKQGDTSFDNYKKELTKIRYRDGVLDGYPSRLHYFSDWIYDNEAKTIVRDIXKESTSGI

SEQ ID NO: 1255 - DNA, 471 bp, Unknown
  Obtained from environmental sample
  misc_feature (1)..(471): n is a, c, g, or t
gtgaaggaagtaaagaatgaagctgaagaacttaaaaaatgcgcctcagattacgcaaacatagttatcacctctagagaaaagcttagttcttcagatgattttgaagatgtctattcacttactcctttaataacagacgacgctttaatattattcgaaaaacattatggcacagctataactaatacagcagaaataaaaattctccgacaagaaattttagaagatttattgaacaataatccattagctataaaattagttactaattctagaacaagttcaaaaaatatggctgagttgcgaaatcagttacaaaaacatttttttgaatctataaatgaagattactctttagtttttaaaaataatgcagatttaatattgaaagacaaatctatatatcaatcaattaattattcttatacaacattaaattcaaaggaaaagatagcatttgattattaa

SEQ ID NO: 1256 - protein, 156 aa, Unknown
  Obtained from environmental sample
  misc_feature (1)..(156): Xaa is any amino acid
MKEVKNEAEELKKCASDYANIVITSREKLSSSDDFEDVYSLTPLITDDALILFEKHYGTAITNTAEIKILRQEILEDLLNNNPLAIKLVTNSRTSSKNMAELRNQLQKHFFESINEDYSLVFKNNADLILKDKSIYQSINYSYTTLNSKEKIAFDY

SEQ ID NO: 1257 - DNA, 540 bp, Unknown
  Obtained from environmental sample
  misc_feature (1)..(540): n is a, c, g, or t
atgagcaaacaaagaattttaattcctttcgtaggattaaaactaggaaaacaccattttgagtatcaaataaataacacgttctttaagaactttgagtacgatgagtttcaaagttcagatattaaagtcaatttacttttcgataagaaaagtaatatgttagagttagaattcaaacacaaaggaacagtaaatgtgccttgtgatctgacaggcgaggattttgatttacctataaaagggaaaatgaaactgattgttcgctttggagaagaatttaatgatgataatgaagagttgttgattttaccacatggtgaacatgaagtagatattgcacaatatatttatgaaatgatcgcgctttctgttccgcagaagagaatccatccaggtgttaaagacggaagtctgcaaacagaagctttaacaaaactgaatgagttaagtgtaaaagaacaaaaagaagagagtaacaaagaagaagatattgacccgcgttgggaaaaattaaagaaactattaacggataaataa

SEQ ID NO: 1258 - protein, 179 aa, Unknown
  Obtained from environmental sample
  DOMAIN (11)...(174): Uncharacterized ACR, COG1399
  misc_feature (1)..(179): Xaa is any amino acid
MSKQRILIPFVGLKLGKHHFEYQINNTFFKNFEYDEFQSSDIKVNLLFDKKSNMLELEFKHKGTVNVPCDLTGEDFDLPIKGKMKLIVRFGEEFNDDNEELLILPHGEHEVDIAQYIYEMIALSVPQKRIHPGVKDGSLQTEALTKLNELSVKEQKEESNKEEDIDPRWEKLKKLLTDK

SEQ ID NO: 1259 - DNA, 381 bp, Unknown
  Obtained from environmental sample
  misc_feature (1)..(381): n is a, c, g, or t
atgttagagttagaattcaaacacaaaggaacagtaaatgtgccttgtgatctgacaggcgaggattttgatttacctataaaagggaaaatgaaactgattgttcgctttggagaagaatttaatgatgataatgaagagttgttgattttaccacatggtgaacatgaagtagatattgcacaatatatttatgaaatgatcgcgctttctgttccgcagaagagaatccatccaggtgttaaagacggaagtctgcaaacagaagctttaacaaaactgaatgagttaagtgtaaaagaacaaaaagaagagagtaacaaagaagaagatattgacccgcgttgggaaaaattaaagaaactattaacggataaataa

SEQ ID NO: 1260 - protein, 126 aa, Unknown
  Obtained from environmental sample
  DOMAIN (1)...(121): Uncharacterized ACR, COG1399
  misc_feature (1)..(126): Xaa is any amino acid
MLELEFKHKGTVNVPCDLTGEDFDLPIKGKMKLIVRFGEEFNDDNEELLILPHGEHEVDIAQYIYEMIALSVPQKRIHPGVKDGSLQTEALTKLNELSVKEQKEESNKEEDIDPRWEKLKKLLTDK

SEQ ID NO: 1261 - DNA, 594 bp, Unknown
  Obtained from environmental sample
  misc_feature (1)..(594): n is a, c, g, or t
atggagaagttaaaagaggcagggctaaaactaactaaacaagatgctgtggttttatctcagttttctagaattcaggtaacagaagaaaattctccagtttctaaccagaagcttaaaattctattaattgatggagatcatagatacaaaagcaatattttacaagtacttgagtgttttgatgtggaagtggagtttttgaaccttccatcatcatggatagcaagaaatggagcattagaatttgccaaaaggccaacatatgatttagtactttggggggatacttctagtttaggacctgaaaaaaagatagaggatatccttacaattctcggactttcaaaggatgatatgagatgtattccagttgaaagatattccagaattgttaatagcagagatcagaattctattacgattaatcaacttgcttcatttttattacaactcgaagtagagcttaagacagacatcgaccctttgaaagagcattctgttcttaaaaaagaaaaagcaattcgattagggaatttattatatccaattgatcaaagtaaagttaaagttcttgtaattgatggtccttaa

SEQ ID NO: 1262 - protein, 197 aa, Unknown
  Obtained from environmental sample
  misc_feature (1)..(197): Xaa is any amino acid
MEKLKEAGLKLTKQDAVVLSQFSRIQVTEENSPVSNQKLKILLIDGDHRYKSNILQVLECFDVEVEFLNLPSSWIARNGALEFAKRPTYDLVLWGDTSSLGPEKKIEDILTILGLSKDDMRCIPVERYSRIVNSRDQNSITINQLASFLLQLEVELKTDIDPLKEHSVLKKEKAIRLGNLLYPIDQSKVKVLVIDGP

SEQ ID NO: 1263 - DNA, 657 bp, Unknown
  Obtained from environmental sample
  misc_feature (1)..(657): n is a, c, g, or t
atggagaagttaaaagaggcagggctaaaactaactaaacaagatgctgtggttttatctcagttttctagaattcaggtaacagaagaaaattctccagtttctaaccagaagcttaaaattctattaattgatggagatcatagatacaaaagcaatattttacaagtacttgagtgttttgatgtggaagtggagtttttgaaccttccatcatcatggatagcaagaaatggagcattagaatttgccaaaaggccaacatatgatttagtactttggggggatacttctagtttaggacctgaaaaaaagatagaggatatccttacaattctcggactttcaaaggatgatatgagatgtattccagttgaaagatattccagaattgttaatagcagagatcagaattctattacgattaatcaacttgcttcatttttattacaactcgaagtagagcttaagacagacatcgaccctttgaaagagcattctgttcttaaaaaagaaaaagcaattcgattagggaatttattatatccaattgatcaaagtaaagttaaagttcttgtaattgatggtcctaagtttggagaaagtgaagtatatatgcatttagtcgcaatgaacatggatgtaatttctttgtaa

SEQ ID NO: 1264 - protein, 218 aa, Unknown
  Obtained from environmental sample
  misc_feature (1)..(218): Xaa is any amino acid
MEKLKEAGLKLTKQDAVVLSQFSRIQVTEENSPVSNQKLKILLIDGDHRYKSNILQVLECFDVEVEFLNLPSSWIARNGALEFAKRPTYDLVLWGDTSSLGPEKKIEDILTILGLSKDDMRCIPVERYSRIVNSRDQNSITINQLASFLLQLEVELKTDIDPLKEHSVLKKEKAIRLGNLLYPIDQSKVKVLVIDGPKFGESEVYMHLVAMNMDVISL

SEQ ID NO: 1265 - DNA, 468 bp, Unknown
  Obtained from environmental sample
  misc_feature (1)..(468): n is a, c, g, or t
atggactttagtccaaaaaccgaattattttgttcaaaaaatggatatttttacaagaaaatactgatgaggactgagaagaatgtttctctgaagaaatttaacacttttgggcttgattacgttgcagcttgcatgattcatgtgaaagatgaaaatgaagcaataactcttttcaaaagtaacctgataaacaaagagcctcttttggtcctcgggggaggcagcaatattctgtttaccggtaatttctcaggaacaattatacatccggaaattgaaggaataaaaattgaaaagcaatcaggaaatgatgtgattgtttctgccggttcaggcataaactgggatactttcgtggaatggacggtaagcaggggattttttggattggagaatctttcctttattccgggtaacgttggggctactccgatccagaatataggtgcgtatgtacagaagtaa

SEQ ID NO: 1266 - protein, 155 aa, Unknown
  Obtained from environmental sample
  misc_feature (1)..(155): Xaa is any amino acid
MDFSPKTELFCSKNGYFYKKILMRTEKNVSLKKFNTFGLDYVAACMIHVKDENEAITLFKSNLINKEPLLVLGGGSNILFTGNFSGTIIHPEIEGIKIEKQSGNDVIVSAGSGINWDTFVEWTVSRGFFGLENLSFIPGNVGATPIQNIGAYVQK

SEQ ID NO: 1267 - DNA, 393 bp, Unknown; identical to SEQ ID NO: 555
  Obtained from environmental sample
  misc_feature (1)..(393): n is a, c, g, or t

SEQ ID NO: 1268 - protein, 130 aa, Unknown; identical to SEQ ID NO: 556
  Obtained from environmental sample
  misc_feature (1)..(130): Xaa is any amino acid

SEQ ID NO: 1269 - DNA, 393 bp, Unknown; identical to SEQ ID NO: 555
  Obtained from environmental sample
  misc_feature (1)..(393): n is a, c, g, or t

SEQ ID NO: 1270 - protein, 130 aa, Unknown; identical to SEQ ID NO: 556
  Obtained from environmental sample
  misc_feature (1)..(130): Xaa is any amino acid

SEQ ID NO: 1271 - DNA, 405 bp, Unknown
  Obtained from environmental sample
  misc_feature (1)..(405): n is a, c, g, or t
atgttgatggatagacttaatctggaggaagcatttgagcatcaacaacctataaaagatgctttaggaaagattagagaagaggttgaaaagcctgttggaacaaaggctaatcccaatgaggtaatttcataccttaaagaaagaattaatgatatgaaaccaaagaaagaacctataggtcaaaaagaaataactcctaaagaaattattgaatctgcatcaaaactaccttctgatcttgaaactgtccttaaagaacaaaaggaatatgtggaaagtatagggaaagaagctagagatttaaagcaagattatgatttgcagaataatagaataaatcaatttaaaaagtcaggaagtacattggaagacttcattaaatgtgtattgggatctaaataa

SEQ ID NO: 1272 - protein, 134 aa, Unknown
  Obtained from environmental sample
  misc_feature (1)..(134): Xaa is any amino acid
MLMDRLNLEEAFEHQQPIKDALGKIREEVEKPVGTKANPNEVISYLKERINDMKPKKEPIGQKEITPKEIIESASKLPSDLETVLKEQKEYVESIGKEARDLKQDYDLQNNRINQFKKSGSTLEDFIKCVLGSK

SEQ ID NO: 1273 - DNA, 570 bp, Unknown
  Obtained from environmental sample
  misc_feature (1)..(570): n is a, c, g, or t
ttgttacagacaaagtataaattggttgggaatgtgaaggctaaaatgttcttccaacgcaaagtggttcttcttaatggaattgccaacagaactgaggttcaaattacttggaataaactttcgtatgtaagaggagattcacacgtgnctatcgtctcaccttctcttgctgtgaaatcgaagacttggtacgaatatagctcttctgcttggggatgcggacaagacgattgcaacaaaccttcttcttggtatcaagaaacttctggttttgctactcaatatctcacaggtcctaaagatgacgccaaaatgaaaatcttccaagccaaacataccatcactttcaatttccaaattcgagtggattatgttgtccctcaagtaaatatttattccctttttcttaattttttttttgatcttcttttcaaaataatcaaaaaacagacaagtgctccaggcaatttagctggtggtgaagccataaccatcttctttcaaggaaacttgttgcaagtaacaaactcaatcaatgatattcagtgtcgaattggaactaagtaa

SEQ ID NO: 1274 - protein, 189 aa, Unknown
  Obtained from environmental sample
  misc_feature (1)..(189): Xaa is any amino acid
MLQTKYKLVGNVKAKMFFQRKVVLLNGIANRTEVQITWNKLSYVRGDSHVXIVSPSLAVKSKTWYEYSSSAWGCGQDDCNKPSSWYQETSGFATQYLTGPKDDAKMKIFQAKHTITFNFQIRVDYVVPQVNIYSLFLNFFFDLLFKIIKKQTSAPGNLAGGEAITIFFQGNLLQVTNSINDIQCRIGTK

SEQ ID NO: 1275 - DNA, 360 bp, Unknown
  Obtained from environmental sample
  misc_feature (1)..(360): n is a, c, g, or t
ttgacttgtcctccaatttttaaggtggccggcaacttatcagacaatatgtacattgtgcaagacaagaatagtaaatggggagcgtacaatgacaaaggactattaattgttgaatgcaaatttgatgagatatggcactttaatgaaggacttgcaaaatttaaactgaatggcaaatggggattcgtggacaagaaaggaaaaataattattgaaccaacatttgaatacgcaagtcagtttacgaatggacttgcatatgcggagataaacggaaaatcgggctttataaataaaaaggggaaatttgtaattgcacccaaatttgaaattaataaaggaagtagatttgaataa

SEQ ID NO: 1276 - protein, 119 aa, Unknown
  Obtained from environmental sample
  DOMAIN (94)...(110): KWG Leptospira
  misc_feature (1)..(119): Xaa is any amino acid
MTCPPIFKVAGNLSDNMYIVQDKNSKWGAYNDKGLLIVECKFDEIWHFNEGLAKFKLNGKWGFVDKKGKIIIEPTFEYASQFTNGLAYAEINGKSGFINKKGKFVIAPKFEINKGSRFE

SEQ ID NO: 1277 - DNA, 435 bp, Unknown
  Obtained from environmental sample
  misc_feature (1)..(435): n is a, c, g, or t
atgaagaatagttactttgaccttattcagcaaacatattattttccacaggaaggttttgatctcctcaacggtgatctgagcttccatggcatctccctcaagtacctcatcgataagtacggcactcctttcaaaataacctatctgcccaagatcggcgatcagatcaagaaagccaagaactggtttaacagatccatgaaaagccacggttaccagggaaaatacaggtactgctactgtacaaaatgttgccacttcagccatgtgatcaaaaaagccctggagtatgatgtagatctggaaacctcctccgcatttgatattgaccttatcgtgagcctctaccggagcgggcacatcgatcgcgacctgacctcatccacaacggctataaacagaaagtatatggccgcagtgcgcnattcttga

SEQ ID NO: 1278 - protein, 144 aa, Unknown
  Obtained from environmental sample
  misc_feature (1)..(144): Xaa is any amino acid
MKNSYFDLIQQTYYFPQEGFDLLNGDLSFHGISLKYLIDKYGTPFKITYLPKIGDQIKKAKNWFNRSMKSHGYQGKYRYCYCTKCCHFSHVIKKALEYDVDLETSSAFDIDLIVSLYRSGHIDRDLTSSTTAINRKYMAAVRXS

SEQ ID NO: 1279 - DNA, 681 bp, Unknown
  Obtained from environmental sample
  misc_feature (1)..(681): n is a, c, g, or t
gtgatattccgcgcagacgtaacaaaccatgcaatagattgcttggaaagaatttggatgaccatcgaagatttaagaaatgttacaagggttagtgcaatgatggtaaacgaagaaaaaataggtgtttttcaggatgccggggaaaaagactggtgggatatggataaattacccaaaaacataaagttagtaacaaatctatatgatttattacaggacgagattaaaggagctattataataagcgataggataatcaccaatggtactgtacttaataaatcagtcctatatagaccaaaaactttggttattggagtgggacttcactggaatactactgaggaaactattcaaacaggaatcaaaaaggtcctagaacaatctcagcttagttttggtagtataaagtccattgcttcattagataagggaaaacgtataaagggattagatgattattgtaagaacaataattttccattgattctgtttcctagagatgaattagataagataaatgtcccaaatccgtcagagatagtaggaaggtttgaaggtacctcgagcgttgcggaggcctcctctatagcggaatctaatggtaatctcatagtaccaaaatacaagtttccaccggatttgactgtcgcaattagtagggtgcaaatggaatga

SEQ ID NO: 1280 - protein, 226 aa, Unknown
  Obtained from environmental sample
  DOMAIN (1)...(222): CbiG
  misc_feature (1)..(226): Xaa is any amino acid
MIFRADVTNHAIDCLERIWMTIEDLRNVTRVSAMMVNEEKIGVFQDAGEKDWWDMDKLPKNIKLVTNLYDLLQDEIKGAIIISDRIITNGTVLNKSVLYRPKTLVIGVGLHWNTTEETIQTGIKKVLEQSQLSFGSIKSIASLDKGKRIKGLDDYCKNNNFPLILFPRDELDKINVPNPSEIVGRFEGTSSVAEASSIAESNGNLIVPKYKFPPDLTVAISRVQME

SEQ ID NO: 1281 - DNA, 843 bp, Unknown
  Obtained from environmental sample
  misc_feature (1)..(843): n is a, c, g, or t
ttggatatgattttgatttgttcaagtttacaggagtttgttttggtnttttcagtcagcggaattaaaccaatttactaccattatttttttctcagtaagcaaaaactgcttgatctcccttctccccaaacaagaaaaaataaacccaaggcagggcgagaaggtattaccacgggctattttgtgccctatttcctagtggagcgtctgggtttggataagcggccgggggtagtaacttttgatgataaaaaaattgccaaggacatgcgcaagtttttgagtggtgcagaaagagtggggattttaggtccagcaccggcagtgcatttcagccgttctcatgctgatttggttttcctggatgatgaattatggccgattttgcaggaaaaaagtaaggaggaaattaatcagatcaaagaaacttcttacattttggctgatttactggaggaaattaaatgggcgattactcctgaggagagaatggatttattggccgaacatttagataaagagatattacggaagggtgatgatgtggctttcccatcattagtagaaagccgacatggcaataaaaacatactctacttactgggattgaaggctaaaataaagcaaaaagatctcatctacatcaatattggcgcgcagaaaaatggtttttttgctgatgccggacgtacttattttgtgaataatccagttttggaaaaaaaatatcgcaaatttgaacaagctttttttacctttgtgaaggcattaagacctggtcaaaaattagcagatattacctggtcaattccaaacacaattagtttaactcggagctga

SEQ ID NO: 1282 - protein, 280 aa, Unknown
  Obtained from environmental sample
  misc_feature (1)..(280): Xaa is any amino acid
MDMILICSSLQEFVLVFSVSGIKPIYYHYFFLSKQKLLDLPSPQTRKNKPKAGREGITTGYFVPYFLVERLGLDKRPGVVTFDDKKIAKDMRKFLSGAERVGILGPAPAVHFSRSHADLVFLDDELWPILQEKSKEEINQIKETSYILADLLEEIKWAITPEERMDLLAEHLDKEILRKGDDVAFPSLVESRHGNKNILYLLGLKAKIKQKDLIYINIGAQKNGFFADAGRTYFVNNPVLEKKYRKFEQAFFTFVKALRPGQKLADITWSIPNTISLTRS

SEQ ID NO: 1283 - DNA, 606 bp, Unknown
  Obtained from environmental sample
  misc_feature (1)..(606): n is a, c, g, or t
ttggcacaggcatttgtaattggagcagattttatagtacccgataaagtagccttgatattggccgataatattttttatggtaccgggcttgggagtcaattacagcaattaaacaatattgatggaggttatgtatttgcttacgaagtatcggatccggaaagatatggcgtggttgaatttgataaggattataaagtgctttccattgaagaaaaaccacagcaaccaaaatcaaacttcgcagttccgggtctttatttttatgataacgaagtggtcagtatttccaaaaacctaaagccatcacttcgtggtgagtacgaaataacggatgtgaataaagagtacttaaaaagaggcaggttgaaagtttttatccttgaccggggtactgcatggctggataccggcacatttgaatcattaaatgatgccagcgagtttgtaagagtaattgaaaaaaggcaaggcaccaagatcgggtgtatagaagaaattgcctaccggatgaattttataaaaaaagatcaattattacaacaagccgaagctcttgcaaaaagtggttatggcatttacctcaaaaacctggttaagtaa

SEQ ID NO: 1284 - protein, 201 aa, Unknown
  Obtained from environmental sample
  DOMAIN (1)...(154): Nucleotidyl transferase
  misc_feature (1)..(201): Xaa is any amino acid
MAQAFVIGADFIVPDKVALILADNIFYGTGLGSQLQQLNNIDGGYVFAYEVSDPERYGVVEFDKDYKVLSIEEKPQQPKSNFAVPGLYFYDNEVVSISKNLKPSLRGEYEITDVNKEYLKRGRLKVFILDRGTAWLDTGTFESLNDASEFVRVIEKRQGTKIGCIEEIAYRMNFIKKDQLLQQAEALAKSGYGIYLKNLVK

SEQ ID NO: 1285 - DNA, 423 bp, Unknown
  Obtained from environmental sample
  misc_feature (1)..(423): n is a, c, g, or t
gtgtatggtgatggcctgtatacccgcgactggctttttgtaaaagaccatgcagcagctattgaccttgtttatcataaaagcagggatggcgaaacctataatattggtggttttaacgaatggaaaaatattgacctggttaagctattgtgcaaacaaatagatgaaaaattaggaagagcgccaggtagcagtgaaaaacttatcaattatataaaagaccgtcccggccatgaccgtcgttatgctattgatgcatcaaagatcaataaagaattaggctggaaacccagcgtaacatttgaagaaggactaagccagacaatagactggtacctgcaaaatacagaatggctcgagcacgtaacaagcggagcgtatcagaagtattacgaagttcaatatgctgcccatggctga

SEQ ID NO: 1286 - protein, 140 aa, Unknown
  Obtained from environmental sample
  DOMAIN (1)...(117): NAD dependent epimerase/dehydratase family
  misc_feature (1)..(140): Xaa is any amino acid
MYGDGLYTRDWLFVKDHAAAIDLVYHKSRDGETYNIGGFNEWKNIDLVKLLCKQIDEKLGRAPGSSEKLINYIKDRPGHDRRYAIDASKINKELGWKPSVTFEEGLSQTIDWYLQNTEWLEHVTSGAYQKYYEVQYAAHG

SEQ ID NO: 1287 - DNA, 561 bp, Unknown
  Obtained from environmental sample
  misc_feature (1)..(561): n is a, c, g, or t
atgaaattgaatgttttcaaagtcattgactttcgagttttaagtggattagttggtgaaacatttattacacagatttgtcaacttacaaatagttttattaaaaatccaagcttagatggttatcccgatcttttaattcataattcggaaatcgaaaagcagtattttaagaactgtacaacgaaagaattgattcgatacaagtatggaggaattgaagttaagaacacctttggaactaaaaaagcaaattcgtatttaattcaaggtgataaaagaataaatgatatttctcaaaagctagactggaaggcacatcaccgagaaacaaataaacttatagctattcaatctgattatataaatgaaattccagtaattgcagctttgtattacagcgatcaattaatatatgacgattgggctgatgtgcaaaagccgaaaggtgaaagtgctatgacttctttctcagtcattacaaattcaggctttcaaaaattaaagaagggggcaaaagtttgtattgatatgcctgaatatttgaactttattaattga

SEQ ID NO: 1288 - protein, 186 aa, Unknown
  Obtained from environmental sample
  misc_feature (1)..(186): Xaa is any amino acid
MKLNVFKVIDFRVLSGLVGETFITQICQLTNSFIKNPSLDGYPDLLIHNSEIEKQYFKNCTTKELIRYKYGGIEVKNTFGTKKANSYLIQGDKRINDISQKLDWKAHHRETNKLIAIQSDYINEIPVIAALYYSDQLIYDDWADVQKPKGESAMTSFSVITNSGFQKLKKGAKVCIDMPEYLNFIN

SEQ ID NO: 1289 - DNA, 873 bp, Unknown
  Obtained from environmental sample
  misc_feature (1)..(873): n is a, c, g, or t
atgggtgatcttcaattaatgaataaaaacataaaacaatgggtaaaaaaagggcttactgacgaattaaaaagtagaatttatgaaattgatcactttgacgataggtctgattttgaaaaggttattcaatccattttttttcttgccaatataccttcaaaacagaggttttccagaaaaggtgtaactggttatgatggtgatgatgtaatgaagaaattaaacaactacaacaaccgtatttctgacaaaatatataatgggaatacagaagacttcaaactgtttgtatcaaatttattcaaaaatgcaaagtctccttttgtttttgaagtggactttatccgcgtttacaatgatcagtttgatgaaaatttccctctaaacaaagatgagctaagtaaaataaccttgaattatttcgaaagattttgtaatgaaaacaatacctttagctcacatatttggagattatttcatggttgcactcgtgttgattgggtgtcctccggtccgaatacatcaaccaagaaagaaacaatttcaatagacgctacgaaaattcttattgattttgttagagaaaaagatactgatggatttttacttgcaataattcagcctgaaactttcgatgagaaaactcatgctatatcgaatattgtcataacgttatttggagattgggaaaaattcaaacaatttgtacaggaaataaatccaaagaaaagtaagtacttagaagaatctaaggccttttttgaagcctttgaacaagtagagtataaacgctatgtttctttcccatttaaagtaattcctgttgaaagaaacatcaaaaacctaaaaataaagacgattaatttatga

SEQ ID NO: 1290 - protein, 290 aa, Unknown
  Obtained from environmental sample
  misc_feature (1)..(290): Xaa is any amino acid
MGDLQLMNKNIKQWVKKGLTDELKSRIYEIDHFDDRSDFEKVIQSIFFLANIPSKQRFSRKGVTGYDGDDVMKKLNNYNNRISDKIYNGNTEDFKLFVSNLFKNAKSPFVFEVDFIRVYNDQFDENFPLNKDELSKITLNYFERFCNENNTFSSHIWRLFHGCTRVDWVSSGPNTSTKKETISIDATKILIDFVREKDTDGFLLAIIQPETFDEKTHAISNIVITLFGDWEKFKQFVQEINPKKSKYLEESKAFFEAFEQVEYKRYVSFPFKVIPVERNIKNLKIKTINL

SEQ ID NO: 1291 - DNA, 519 bp, Unknown
  Obtained from environmental sample
  misc_feature (1)..(519): n is a, c, g, or t
gtgaaaccaatatattctaatgataggaaggctccgaggatgagaaagggaaagttctctaaaatgataataactagagagttatggaagaaatttattgcagaatttccagagtataaggaaatgagctggaaggatttctataataattggttagatatagcacagactattagacaagagacagtgaataatcctctaggtgttaaattgggtagctatacaggagaattaaagcttcagtatttacctcacaagtttaaggcagaagatgcagtaacatctggagagttaggagagaaaataaatttcttgaatatacctatgaagggtaaagttgctaaagtaaagtgggaaagaagatgggctgtcaagttcaataaaatactacagttctatgcctttgatgagacgagagagattaatcagatggcaaaggagtatattgataaatattctgataaattgagaatctctaggaatacattaggaggcccttctattggagacaaaaaatga

SEQ ID NO: 1292 - protein, 172 aa, Unknown
  Obtained from environmental sample
  misc_feature (1)..(172): Xaa is any amino acid
MKPIYSNDRKAPRMRKGKFSKMIITRELWKKFIAEFPEYKEMSWKDFYNNWLDIAQTIRQETVNNPLGVKLGSYTGELKLQYLPHKFKAEDAVTSGELGEKINFLNIPMKGKVAKVKWERRWAVKFNKILQFYAFDETREINQMAKEYIDKYSDKLRISRNTLGGPSIGDKK

SEQ ID NO: 1293 - DNA, 576 bp, Unknown
  Obtained from environmental sample
  misc_feature (1)..(576): n is a, c, g, or t
atgaccgagggagccctctaccagggatgtataaaaaacaacccggcagcgcaaaaagcattgtacgaaaagttcagtgctaaaatgttgtctgtttgttaccgttatggccataaccgtgaagatgcagaggatatgttacaggaaggttttataaaggtgtttgcccaaatacatacttttcagaatcgtggttctttcgaaggttgggtgcgaagaattatgatacatacctgtatcaataatttgaaaaagaacaagcgattcaatgaaagtgtagatcttatacatgccacaagcatacaaattaaagaagaaaccattccttctattatccaggcaaaacaggtgattgagtgcataaggttattacctattggatatagaacggttttaaacttatatgccattgagggtttctcgcacagggaaattggtgaaatgctggatatagaagaaagtacaagccgtagtcaatatacaagagctaaagctatgttagaagatattttgataaagaaaaaaattttacagaaacaaaaaacaccattgttcattgcctctggcgggcaataa

SEQ ID NO: 1294 - protein, 191 aa, Unknown
  Obtained from environmental sample
  DOMAIN (120)...(169): Sigma-70, region 4
  misc_feature (1)..(191): Xaa is any amino acid
MTEGALYQGCIKNNPAAQKALYEKFSAKMLSVCYRYGHNREDAEDMLQEGFIKVFAQIHTFQNRGSFEGWVRRIMIHTCINNLKKNKRFNESVDLIHATSIQIKEETIPSIIQAKQVIECIRLLPIGYRTVLNLYAIEGFSHREIGEMLDIEESTSRSQYTRAKAMLEDILIKKKILQKQKTPLFIASGGQ

SEQ ID NO: 1295 - DNA, 576 bp, Unknown
  Obtained from environmental sample
  misc_feature (1)..(576): n is a, c, g, or t
atgaccgaggaagccatcttacaaggatgtataaaaaacaacccgacagcgcaaaaagcattgtacgaaaagttcagtgctaaaatgttgtctgtttgttaccgttatggccataaccgtgaagatgcagaggatatgttacaggaaggttttataaaggtgtttgcccaaatacatacttttcagaatcgtggttctttcgaaggttgggtgcgaagaattatgatacatacctgtatcaataatttgaaaaagaacaagcgattcaatgaaagtgtagatcttatacatgccacaagcatacaaattaaagaagaaaccattccttctattatccaggcaaaacaggtgattgagtgcataaggttattacctattggatatagaacggttttaaacttatatgccattgagggtttctcgcacagggaaattggtgaaatgctggatatagaagaaagtacaagccgtagtcaatatacaagagctaaagctatggtagaaaatattttgataaagaaaaaatttttacggaaacaaaaaacaccattgttcattgcctctggcgggcaataa

SEQ ID NO: 1296 - protein, 191 aa, Unknown
  Obtained from environmental sample
  DOMAIN (21)...(89): Sigma-70 region 2
  misc_feature (1)..(191): Xaa is any amino acid
MTEEAILQGCIKNNPTAQKALYEKFSAKMLSVCYRYGHNREDAEDMLQEGFIKVFAQIHTFQNRGSFEGWVRRIMIHTCINNLKKNKRFNESVDLIHATSIQIKEETIPSIIQAKQVIECIRLLPIGYRTVLNLYAIEGFSHREIGEMLDIEESTSRSQYTRAKAMVENILIKKKFLRKQKTPLFIASGGQ

SEQ ID NO: 1297 - DNA, 744 bp, Unknown
  Obtained from environmental sample
  misc_feature (1)..(744): n is a, c, g, or t
atgctgaaagccataatcatcgatgatgaacggaatggaaggattgccctgaggcaaaagcttcatgactattgcccgatcgtggaagtagtagccgaagccgagaatggccgcgaaggtatagagcagattgagaaacacaacccccaactggtgttcctggatattgaaatgcctgaactggatggatttcaaatgctgctgcagctcccggaaaagaaatttcatctcgtttttacaacagcgtatgaccactatgccatcaaggctataaagtatgccgcttttgattatctgctgaaacccatagatatcgaggaactcaagattaccgttgaaagattgttgcgacaaagtcagcctgatcaaaccatcaaaagactggaaacgcttgaacagaattttattaccaaacctgttttaaataaaatagcaattccgacgctggatggccttttgttttttgatatccatcaaatggtccgccttgaagctcagagtaactatacggtcatctatttcaatgaccatcccaagctcatggccagccggaccctgaaggaatttgaagagatcctgcccacggatatttttttccggccacacaactctcatatgatcaacctcaattacatcaagcgctacctgaaaggtgatggaggccagatcgaaatgaaaaatggagattatattttagtatccagacgaaagaaggaggagtttctgaaagcgattggcaggtga

SEQ ID NO: 1298 - protein, 247 aa, Unknown
  Obtained from environmental sample
  DOMAIN (150)...(246): LytTr DNA-binding domain
  misc_feature (1)..(247): Xaa is any amino acid
MLKAIIIDDERNGRIALRQKLHDYCPIVEVVAEAENGREGIEQIEKHNPQLVFLDIEMPELDGFQMLLQLPEKKFHLVFTTAYDHYAIKAIKYAAFDYLLKPIDIEELKITVERLLRQSQPDQTIKRLETLEQNFITKPVLNKIAIPTLDGLLFFDIHQMVRLEAQSNYTVIYFNDHPKLMASRTLKEFEEILPTDIFFRPHNSHMINLNYIKRYLKGDGGQIEMKNGDYILVSRRKKEEFLKAIGR

SEQ ID NO: 1299 - DNA, 552 bp, Unknown
  Obtained from environmental sample
  misc_feature (1)..(552): n is a, c, g, or t
gtgcggagcatacttagcagccaggatatatttaacaggtttgtcattaatgcagtgaagaacttcagtattgaaactcaaaagccggagattaccgatgaacagtctgtattaaattcagttggaataacacccggttcggatactatttcatttacgggaaataccaataacaaaatgggcttttacttaaccctgggtgaaggctggagagaattaaataagattggtattactgaacatctgaacaaaaaatttgttgggacacgatatttaaatggtactttaggagcagcaatatcggtaatttcacttgcccctgaagattctgcagaaatgtttataaattatagcctaacaactttaggcgagatgaaatttaaagttagaaattctgaaaaaattgaaaaagggaaaaactacgttcagttttttgaattttcgtgcgggaataaaaaatacctcatgatatttgaagcttcaagatatacttacgaacagtacaaacaaatttattctgatattattaacacatttagtatggactgctga

SEQ ID NO: 1300 - protein, 183 aa, Unknown
  Obtained from environmental sample
  misc_feature (1)..(183): Xaa is any amino acid
MRSILSSQDIFNRFVINAVKNFSIETQKPEITDEQSVLNSVGITPGSDTISFTGNTNNKMGFYLTLGEGWRELNKIGITEHLNKKFVGTRYLNGTLGAAISVISLAPEDSAEMFINYSLTTLGEMKFKVRNSEKIEKGKNYVQFFEFSCGNKKYLMIFEASRYTYEQYKQIYSDIINTFSMDC

SEQ ID NO: 1301 - DNA, 306 bp, Unknown
  Obtained from environmental sample
  misc_feature (1)..(306): n is a, c, g, or t
atgaagcttttcattcagagcactgtaaagaaagagtgtaaaaaaaataaagactccgctcagccaaacctgtccaaatggaaagcctgcgtatttgtaaatgatctgcaggcaggtaaggaacggcggcttgaattgattattggtagtggaaagatcaaccgtaaaaacagaattgatcatggtcttttccttcactgcgtattcagcaatgacctctgcgccggaagtaagatctcttggcgtaggtggataataatagcaacgccacacacttacaaataccatgaacagtatgagaaataa

SEQ ID NO: 1302 - protein, 101 aa, Unknown
  Obtained from environmental sample
  misc_feature (1)..(101): Xaa is any amino acid
MKLFIQSTVKKECKKNKDSAQPNLSKWKACVFVNDLQAGKERRLELIIGSGKINRKNRIDHGLFLHCVFSNDLCAGSKISWRRWIIIATPHTYKYHEQYEK

SEQ ID NO: 1303 - DNA, 306 bp, Unknown
  Obtained from environmental sample
  misc_feature (1)..(306): n is a, c, g, or t
ttgatcggcgatgctccacagggttttaccaagttctttttggttatttgtttgattattgtttatcataatttattagtgaataacaaagttgtatttactcatgagagcaccgaatatctcattaaacaattttacgttgtcttcaaccagttctttagcttcataacgaaaaacattcttatgcgaaagtgtatttacaatacgagcaacttcatcagaatccgcaattccaatttgctcaaggacatacgcaattcttcccacacccagaaaggaactgatattttcaagggcttgccttaa

SEQ ID NO: 1304 - protein, 101 aa, Unknown
  Obtained from environmental sample
  misc_feature (1)..(101): Xaa is any amino acid
MIGDAPQGFTKFFLVICLIIVYHNLLVNNKVVFTHESTEYLIKQFYVVFNQFFSFITKNILMRKCIYNTSNFIRIRNSNLLKDIRNSSHTQKGTDIFKGLP

SEQ ID NO: 1305 - DNA, 315 bp, Unknown
  Obtained from environmental sample
  misc_feature (1)..(315): n is a, c, g, or t
atgggatccaggatggacaacaccacggcacgtcagtttttcaaaatacgtaaaatggatacactgcaatctattgcaagtgcacaaatagttgtccttggtattaaacaaaacttttggaagatgaaaagcagcaaacaaatgaacaatataattgctacaaccgttgctcatagtttagatgactcaactgttgatttttcaaacaatgcagacatcacatcgtgcaacttcatcaaacacctttctgagaactcctcttacatccctgaataccttgcaactgtttttccctatacaaaatcatatagctga

SEQ ID NO: 1306 - protein, 104 aa, Unknown
  Obtained from environmental sample
  misc_feature (1)..(104): Xaa is any amino acid
MGSRMDNTTARQFFKIRKMDTLQSIASAQIVVLGIKQNFWKMKSSKQMNNIIATTVAHSLDDSTVDFSNNADITSCNFIKHLSENSSYIPEYLATVFPYTKSYS

SEQ ID NO: 1307 - DNA, 1038 bp, Unknown
  Obtained from environmental sample
  misc_feature (1)..(1038): n is a, c, g, or t
ttgaagttatccatcatcatagttaactataatgtaaaatactttttagaacagtgtttatattctgttttaaaggcctgtaaagaaatagaatcagagatattggtagttgacaaccactctaccgatggcagccttgactaccttcagccgaaatttccgggtgtacaatttataaaaagtgaaaacaatcagggttttgggaaagcatgcaacaaagggttaggccttgcatccggcgactatattttattcctgaacccggatactatcgtaagcgaagatagttttaccacctgtatttctttttttgaaacccagcccgactgtggtgcggttggggtgaaaatgatcgatggctccggccggtttttaaaagaatccaaacgttcatttccttcaccagttacagctttgtataaattgtcaggacttgcgctattatttcctaaatcaaaggtgtttggtagatatcacctggggcatttaaatgaaaatgaaaatcatgaggtggatgtgctggccggggcttttatgatgatccctaaaaaagttttagaaaaaacgggtgcatttgatgaagcgttttttatgtatggtgaggacgtggacttgagttaccgtattcagaaaagcgggtataaaaatttttatgttgcagaaacaaacatcattcattttaaaggcgagagtacaaagaagggcagcctgaattatattcgcctgttttaccaggctatgagtctttttgtacgcaagcactacggggatagcaaagccggatttttcaacgcatctattcaactggcaatctgggtaagagcatcaataacggcactggcaaaatttataaaatggaatggcttaccggtgatagatgctttactgatcctgtttttcttttggattgtaaaaaaaatatggacttcaatttgtaagaccggatattttgtatcccggaaaattgctgccttatttcttttccggcttttacctgctaattattttgcctgggggcttaataacccctggttttaa

SEQ ID NO: 1308 - protein, 345 aa, Unknown
  Obtained from environmental sample
  DOMAIN (4)...(190): Glycosyl transferase
  misc_feature (1)..(345): Xaa is any amino acid
MKLSIIIVNYNVKYFLEQCLYSVLKACKEIESEILVVDNHSTDGSLDYLQPKFPGVQFIKSENNQGFGKACNKGLGLASGDYILFLNPDTIVSEDSFTTCISFFETQPDCGAVGVKMIDGSGRFLKESKRSFPSPVTALYKLSGLALLFPKSKVFGRYHLGHLNENENHEVDVLAGAFMMIPKKVLEKTGAFDEAFFMYGEDVDLSYRIQKSGYKNFYVAETNIIHFKGESTKKGSLNYIRLFYQAMSLFVRKHYGDSKAGFFNASIQLAIWVRASITALAKFIKWNGLPVIDALLILFFFWIVKKIWTSICKTGYFVSRKIAALFLFRLLPANYFAWGLNNPWF

SEQ ID NO: 1309 - DNA, 570 bp, Unknown
  Obtained from environmental sample
  misc_feature (1)..(570): n is a, c, g, or t
atgtttattgaacccaactataaaggcgagcgccgtggctggatagaagttatctgtggcagcatgttcagcggaaaaacagaagaactgatccgcaggctaaagcgtgttaaaattgccaatcttaaagtagaaatttttaaaccagcgatcgatgttcgctatgatgaagtaaaaattgtaagccacgataccaatttcatacactctacccctgtaaataattcaaaagagatcattccactgttaaaagacgttgatgtggtgggcattgatgaagcccagttttttgatgaaggaatcgcaaatgtatgcgagcagcttgcagccaacggcattcgtgttattgttgccgggcttgatatggattaccagggaaacccttttggccagatgcccaatcttctggcaaaagccgactatattacaaagctgcatgcgatatgtgtgaaatgcggaaatattgccaacatcagttaccggaaagtggcaaccggtggccaggttttgctgggagaaaaggatgtttatgagccgcgctgccgttattgcgcgcagatgaaagattaa

SEQ ID NO: 1310 - protein, 189 aa, Unknown
  Obtained from environmental sample
  DOMAIN (13)...(185): Thymidine kinase
  misc_feature (1)..(189): Xaa is any amino acid
MFIEPNYKGERRGWIEVICGSMFSGKTEELIRRLKRVKIANLKVEIFKPAIDVRYDEVKIVSHDTNFIHSTPVNNSKEIIPLLKDVDVVGIDEAQFFDEGIANVCEQLAANGIRVIVAGLDMDYQGNPFGQMPNLLAKADYITKLHAICVKCGNIANISYRKVATGGQVLLGEKDVYEPRCRYCAQMKD

SEQ ID NO: 1311 - DNA, 894 bp, Unknown
  Obtained from environmental sample
  misc_feature (1)..(894): n is a, c, g, or t
atggcgcatgccgcgganaaccatattctggaggggatctatttttcagttgtcggttcaggtttcagggaatctcgggaagaggaacttttgcagtgggaaaaggataaggctattgttgagacagagtggaaggaaagcgacgagggtttcttatttcaaatttatcttcaaaatcaccagagacctcttgaaaagaagttttttgtcaacaaggccaaaaagtcatcttttgcatatttgcagcagatgacaaaggtagtgctatttgcaccggagcatattttgattatttcgggatctccggacatacgtcgagattacttcaaccgcctgatttcccaagttgatattcaatacaaaaagaaactgaccaattacgagcatgccctgcgcaaaagaaacaaagtacttgaaaaccatcgcgatgaggaaaaccttaaggaggagctgaagttctgggacgaatacctggaggagcaggcgtcatacatcacagataaaaggcagaagtactgcgattatcttaacgaaaatcagcaggtcgaccacaggctgtttgaaataaactacatcaaaaacgagtttacaaaagaaagactgaaggaaaagtttgaccttgaaaggcggataagaaaaactctaatcggcccccaaaaagacgacttccagatttatcttcgtgaaggagaggttaccgaaaacgtacaccactatggatcccgaagcgagcaaaggcttgcggtattctggttgaagcttaacgagcttaaatattttgagagtttatttagcaagaagccggtgcttctactcgacgatatattctcagagctcgataacaaaaataaaaaacttgtgctggatctggtggaaaatatcagacagtactaa

SEQ ID NO: 1312 - protein, 297 aa, Unknown
  Obtained from environmental sample
  misc_feature (1)..(297): Xaa is any amino acid
MAHAAXNHILEGIYFSVVGSGFRESREEELLQWEKDKAIVETEWKESDEGFLFQIYLQNHQRPLEKKFFVNKAKKSSFAYLQQMTKVVLFAPEHILIISGSPDIRRDYFNRLISQVDIQYKKKLTNYEHALRKRNKVLENHRDEENLKEELKFWDEYLEEQASYITDKRQKYCDYLNENQQVDHRLFEINYIKNEFTKERLKEKFDLERRIRKTLIGPQKDDFQIYLREGEVTENVHHYGSRSEQRLAVFWLKLNELKYFESLFSKKPVLLLDDIFSELDNKNKKLVLDLVENIRQY

SEQ ID NO: 1313 - DNA, 846 bp, Unknown
  Obtained from environmental sample
  misc_feature (1)..(846): n is a, c, g, or t
ttggacgaaacgctggttaatctaacggataaaatacacaatgatcttgaaaactcagggaaaaaaggactgttgcaatcaattcaggaacgaatgcaaggagccgtaagttccagaaaaaatataatggttgcggtactcgacgatatgcggtggtacacccaagaagaagtgcctacggaaatctcgacggcttttgatatcaccttcatcgaatacgatgcgctcactcatgataataagataaagctggcctctctggccaaggacatcaattattatgaagcgcaagccctttccttccaggcagcgcatcaggattttgcaacgcttgcgtcggtattaagagatcagggtgagcgaattatcgacaatatccggatcaacagcccttatacaaccaatcagcttctcaaggaactgcaggaaaggctgctttccaaatatgaatttaccgtatttgctgccgataaagactatcacagcattaattttggcttgatgaacacctttcgccagaagtgggaaccgctttcttaccaggcgggtaagctggtaaaaaccataccgctttctccaaaagaagaaagaaagtattcggtgaaaacgacaatcaattccaagattactagaaaacaggctcaaaaatacaatacatcgctccagcaggaggtcaatacaacctctcgcgccgagtcggaaatcgtcgccaaagcgcacgataaatcctacttcaacatgagcgtgaaattggattactcgaaaataagttcccaggtcacattcggcaaggatgcggaaaaagaaatcctctcaagcccaaaaagattttcgggaaagccgtga

SEQ ID NO: 1314 - protein, 281 aa, Unknown
  Obtained from environmental sample
  misc_feature (1)..(281): Xaa is any amino acid
MDETLVNLTDKIHNDLENSGKKGLLQSIQERMQGAVSSRKNIMVAVLDDMRWYTQEEVPTEISTAFDITFIEYDALTHDNKIKLASLAKDINYYEAQALSFQAAHQDFATLASVLRDQGERIIDNIRINSPYTTNQLLKELQERLLSKYEFTVFAADKDYHSINFGLMNTFRQKWEPLSYQAGKLVKTIPLSPKEERKYSVKTTINSKITRKQAQKYNTSLQQEVNTTSRAESEIVAKAHDKSYFNMSVKLDYSKISSQVTFGKDAEKEILSSPKRFSGKP

SEQ ID NO: 1315 - DNA, 663 bp, Unknown
  Obtained from environmental sample
  misc_feature (1)..(663): n is a, c, g, or t
gtgaccgacgaaatcatcctgcaaaagttcttggagaaacccgaggacttccctgaatacctccaccgcacaaaagacttcaaggtgggcatcgaaatctacctgtacgtcacgaaggtaagcgttgccgcaagcaccatccagtccaccgtcctgtacgccatgctgaaagagtggagaccggaagaacacgacggggagccgtttcaggactacttcgtcagagtgacgggtcaggacatcgctaccatccagaacaaactcaaagtgggggagatgttggagaaggttcccgagaagtaccttcccgacattcaggcaaaggacacaaagacaaagaacgccattgccgacgttgttctagacgggtacgtcatcgaggacgagcagtgggacaggattgcgaggtctgaccactacaagcaagcggctgaggttgccagagaggtaaagaacgttgagccgcgctcgaactggatgagctttacgattgatgagcatgacattgtttcggttcatgtaacagggagaacggttgagttgtttcgcttcaacaacaacctcgaagacgctgatgtagtcgagagagccaagaaacgtttactgaggcaggcgaatatcctgcccggaagtgaggtactagatgtggcatacagtcgatga

SEQ ID NO: 1316 - protein, 220 aa, Unknown
  Obtained from environmental sample
  misc_feature (1)..(220): Xaa is any amino acid
MTDEIILQKFLEKPEDFPEYLHRTKDFKVGIEIYLYVTKVSVAASTIQSTVLYAMLKEWRPEEHDGEPFQDYFVRVTGQDIATIQNKLKVGEMLEKVPEKYLPDIQAKDTKTKNAIADVVLDGYVIEDEQWDRIARSDHYKQAAEVAREVKNVEPRSNWMSFTIDEHDIVSVHVTGRTVELFRFNNNLEDADVVERAKKRLLRQANILPGSEVLDVAYSR

SEQ ID NO: 1317 - DNA, 684 bp, Unknown
  Obtained from environmental sample
  misc_feature (1)..(684): n is a, c, g, or t
atgaacctatcagttgttatccctgtttataacgaagtcaacaatatcagtgaaatccttaagcgggtacaggcacaaaagctggccaacgagatcatagtggtcgacgatggctccacagatggaactcgtgacgtgcttaagggactggacggcaaaagcaaggtccgcatcattctccatgaacacaataaaggcaagggcgcggccgttgtgaccggtatgaatgcggcgaagggtgacatcctgttaatccaggatgccgacctggagtatgatccgcgcgactacccccagatcgtcaaaccgatcgaagaaggtatcgccgatgtggtctatggttcccggttcctgggcggaccacgacgcgtggccatgttctggcatatggtcgccaacaaactgctgactgccatgaccaatattctctacgatacgatcctgacagacatggaaaccggctacaaggttttccgccgcaacgtgatcgaagggatggttatccgctccaagcggtttgactttgaaccagagttcactgccaaggtgctcaagcgtcactaccgcatcttcgaagtgccgatcaccttcaatccccgtgattattcagagggcaaaaagatcaagctcaaggatgcatttgcagccgtttggaccttattgaaataccgttttgtagactaa

SEQ ID NO: 1318 - protein, 227 aa, Unknown
  Obtained from environmental sample
  DOMAIN (4)...(167): Glycosyl transferase
  misc_feature (1)..(227): Xaa is any amino acid
MNLSVVIPVYNEVNNISEILKRVQAQKLANEIIVVDDGSTDGTRDVLKGLDGKSKVRIILHEHNKGKGAAVVTGMNAAKGDILLIQDADLEYDPRDYPQIVKPIEEGIADVVYGSRFLGGPRRVAMFWHMVANKLLTAMTNILYDTILTDMETGYKVFRRNVIEGMVIRSKRFDFEPEFTAKVLKRHYRIFEVPITFNPRDYSEGKKIKLKDAFAAVWTLLKYRFVD

SEQ ID NO: 1319 - DNA, 465 bp, Unknown
  Obtained from environmental sample
  misc_feature (1)..(465): n is a, c, g, or t
atgacagagcgtctttcaatctattcaccgagtgctcccgaatatgttctccttgctgcacgatgccagcacatcgggcgctgggaaattcctcgcaagaattaccctatggatcgtaaaggatatcttcaatggcgcaatcaacagaagtttcatcactgcgagattgcggagcctatgctggtttcatgtggctacgatactcacacaatcgagatcgtgaagtttcttttgttaaaaagagagcttcagaaaaatccggagactcaattactggaagatgtgatctgccttgtattcattgaatactatctcgaagatttcggtgctcaacacgatgaagaaaaagtgatcgacatcattcgcaagacgatgaagaagatgacaaaccgagcgattaaggcagttggcgaattgaagctatctgaaaatgtgaaggcattgattgggaaagcagcggcttga

SEQ ID NO: 1320 - protein, 154 aa, Unknown
  Obtained from environmental sample
  misc_feature (1)..(154): Xaa is any amino acid
MTERLSIYSPSAPEYVLLAARCQHIGRWEIPRKNYPMDRKGYLQWRNQQKFHHCEIAEPMLVSCGYDTHTIEIVKFLLLKRELQKNPETQLLEDVICLVFIEYYLEDFGAQHDEEKVIDIIRKTMKKMTNRAIKAVGELKLSENVKALIGKAAA

SEQ ID NO: 1321 - DNA, 447 bp, Unknown
  Obtained from environmental sample
  misc_feature (1)..(447): n is a, c, g, or t
atggaaaaagaaatcattagcaacgtaaaaagattaatgaaaaaggttattattataggccctgagtcaactggcaaaagcacattgtctgccaaacttgcttcccattataagacagtttggtgccctgagtttgcaagggaatatttaaccggtaaaaacaataattatacctatgatgatcttttaaaaattgctattggtcaagtggagttggaagacatattgcttacatcagcaaaaaataatttgtacatcattgacacagacatgtatgtgatgaaagtgtggtgcgaagttgcttttcaaaattgtcataagtttatattgaaacaaatagctcaacgtaattatgatctgtatcttttgtgtaacgttgatttgccatgggtgcaggacgaactgagggaataccctgatataaaaacaaggaaggaagatctataa

SEQ ID NO: 1322 - protein, 148 aa, Unknown
  Obtained from environmental sample
  misc_feature (1)..(148): Xaa is any amino acid
MEKEIISNVKRLMKKVIIIGPESTGKSTLSAKLASHYKTVWCPEFAREYLTGKNNNYTYDDLLKIAIGQVELEDILLTSAKNNLYIIDTDMYVMKVWCEVAFQNCHKFILKQIAQRNYDLYLLCNVDLPWVQDELREYPDIKTRKEDL

SEQ ID NO: 1323 - DNA, 420 bp, Unknown
  Obtained from environmental sample
  misc_feature (1)..(420): n is a, c, g, or t
ttggatataggtagcacattccttatttctgttggcatctattttcttttttttaagcaggtcaaatcaaatgaagaaggcaagcagttattgaagtttaggaaaagagattatctgaagttgataataaccggatattttatgaatattctcaaccctgcaattataatattctggctgacaacctctactgcttttgcaggtcattcgattaatcaaagaattctcatttttaccattgctttgatcatggttttagtttctgattttgctaaagtgcttttcgcaaataagatccgtcagaagctcaccattaaaaatattcttctcataaatcgcgttaatggagtgatcctgataggcttcggtatagtcttgctgtggggtcttattttctatggagacaaactgcctcaatga

SEQ ID NO: 1324 - protein, 139 aa, Unknown
  Obtained from environmental sample
  misc_feature (1)..(139): Xaa is any amino acid
MDIGSTFLISVGIYFLFFKQVKSNEEGKQLLKFRKRDYLKLIITGYFMNILNPAIIIFWLTTSTAFAGHSINQRILIFTIALIMVLVSDFAKVLFANKIRQKLTIKNILLINRVNGVILIGFGIVLLWGLIFYGDKLPQ

SEQ ID NO: 1325 - DNA, 537 bp, Unknown
  Obtained from environmental sample
  misc_feature (1)..(537): n is a, c, g, or t
gtggggtcttattttctatggagacaaactgcctcaatgaaaacaactaagggatgtataccgaaaggattacgaattcttaaaaagatattcatcttccttttactttttcaactgatctatattattgggttaaagtggataaacccaccttttacacttacacaagtcggcagtttgattaaaggagaaggcttaaatcgggattacattagctatgaccagatttcttacaatatcaagcttgctgtaattgcttctgaggatcaactttttccagatcacacaggttttgattggaggaatatcaaaaaagctattgactataataaaaagaaaccgggaagagtcagaggagctagcacaatcagtcaacaggtagcaaaaaatgttttcctatggcaggggaggagttggatacgtaaagcgcttgaagtatattttactaaaatgatcgaatggatctggggtaaagaaagaattctggaagtttatttgaatgttattgagatgggagaaggaatctatggaaattga

SEQ ID NO: 1326 - protein, 178 aa, Unknown
  Obtained from environmental sample
  DOMAIN (53)...(178): Transglycosylase
  misc_feature (1)..(178): Xaa is any amino acid
MGSYFLWRQTASMKTTKGCIPKGLRILKKIFIFLLLFQLIYIIGLKWINPPFTLTQVGSLIKGEGLNRDYISYDQISYNIKLAVIASEDQLFPDHTGFDWRNIKKAIDYNKKKPGRVRGASTISQQVAKNVFLWQGRSWIRKALEVYFTKMIEWIWGKERILEVYLNVIEMGEGIYGN

SEQ ID NO: 1327 - DNA, 324 bp, Unknown
  Obtained from environmental sample
  misc_feature (1)..(324): n is a, c, g, or t
ttgatgggacctggtgatggattatacgtattaaagcgtctaaaacaatttaatgggattggagagaaagtcactgatgcggaaatcaaagatgctatattattgcttgctaaatcggaaggaatcttcactgaacctgcaggcggtgttgcagtcggtgttctaaagaagctaatagaggacaatagaattgaaaaggatgaaaatattgtttgttatgtcactggtaatggattaaaaactaccgaatctgtgatagatttgcttcctactcctaattctgtaaagcctgatattagacttgtgtcggcaatgatacattga

SEQ ID NO: 1328 - protein, 107 aa, Unknown
  Obtained from environmental sample
  misc_feature (1)..(107): Xaa is any amino acid
MMGPGDGLYVLKRLKQFNGIGEKVTDAEIKDAILLLAKSEGIFTEPAGGVAVGVLKKLIEDNRIEKDENIVCYVTGNGLKTTESVIDLLPTPNSVKPDIRLVSAMIH

SEQ ID NO: 1329 - DNA, 711 bp, Unknown
  Obtained from environmental sample
  misc_feature (1)..(711): n is a, c, g, or t
atgtatgtaataagagtgagaattatcaaaccatttttagcaggaagagatgtgaagcgatttgaaactccgcggagtaataagtatttgattttatttccgaaaggatttacaaattcaaaaggcaacaatccaaaaaatggttggaaatggctagaggaaaattattcttctatcgcagcctatctaaaaccatttgaagaaaaaggaaagaaaagatttgataaaggagaatattggtgggaattgagagcctgcgattattatgcggaatttgaaaaggacaagattatccttcctgacattgctctacaaatgcaagcaacttttgattccaggaaattttatttagtaaatacatgctatataattccaactgatgataaatttttattaggaattttaaattcatcattaatacaatttctttattccagaattagctcttcaataagaggcggatatttaagatttataaggcaatatttagaaatactcccgattcaaaccaataaatctttggagacccaaatcattcatttagtagaaacgatgttgcaattacaagaagaaaaacaacaaaccacccttccccataaactggatcaattaaatgcaagaatagaatacaccgatgaaaaaataaacaacctggtgtttgagttgtatggattggatgaagaagaaataaaaattataggaaaagaataa

SEQ ID NO: 1330 - protein, 236 aa, Unknown
  Obtained from environmental sample
  misc_feature (1)..(236): Xaa is any amino acid
MYVIRVRIIKPFLAGRDVKRFETPRSNKYLILFPKGFTNSKGNNPKNGWKWLEENYSSIAAYLKPFEEKGKKRFDKGEYWWELRACDYYAEFEKDKIILPDIALQMQATFDSRKFYLVNTCYIIPTDDKFLLGILNSSLIQFLYSRISSSIRGGYLRFIRQYLEILPIQTNKSLETQIIHLVETMLQLQEEKQQTTLPHKLDQLNARIEYTDEKINNLVFELYGLDEEEIKIIGKE

SEQ ID NO: 1331 - DNA, 573 bp, Unknown
  Obtained from environmental sample
  misc_feature (1)..(573): n is a, c, g, or t
atgggttggaaatggctagaggaaaattattcttctatcgcagcctatctaaaaccatttgaagaaaaaggaaagaaaagatttgataaaggagaatattggtgggaattgagagcctgcgattattatgcggaatttgaaaaggacaagattatccttcctgacattgctctacaaatgcaagcaacttttgattccaggaaattttatttagtaaatacatgctatataattccaactgatgataaatttttattaggaattttaaattcatcattaatacaatttctttattccagaattagctcttcaataagaggcggatatttaagatttataaggcaatatttagaaatactcccgattcaaaccaataaatctttggagacccaaatcattcatttagtagaaacgatgttgcaattacaagaagaaaaacaacaaaccacccttccccataaactggatcaattaaatgcaagaatagaatacaccgatgaaaaaataaacaacctggtgtttgagttgtatggattggatgaagaagaaataaaaattataggaaaagaataa

SEQ ID NO: 1332 - protein, 190 aa, Unknown
  Obtained from environmental sample
  misc_feature (1)..(190): Xaa is any amino acid
MGWKWLEENYSSIAAYLKPFEEKGKKRFDKGEYWWELRACDYYAEFEKDKIILPDIALQMQATFDSRKFYLVNTCYIIPTDDKFLLGILNSSLIQFLYSRISSSIRGGYLRFIRQYLEILPIQTNKSLETQIIHLVETMLQLQEEKQQTTLPHKLDQLNARIEYTDEKINNLVFELYGLDEEEIKIIGKE

SEQ ID NO: 1333 - DNA, 306 bp, Unknown
  Obtained from environmental sample
  misc_feature (1)..(306): n is a, c, g, or t
gtggggaggaagtgtaaagttttgatcgaaatggtttgcctggctgaaaatattggaacaaaaaataaaacaggcgaaaaggctaaaaaaaatgcatttattcatatggctgtgatttacccggtaatttttagagctggtttagcaagcaaaacaggtaacgattacaataaacaaaagataaaaaatcctggcctggtaaatatgaaaacacaaaggccaatttgttttttccaaaggaaaattaagtattctttgaaacaaaaggctccattaattcatcatttcacgaaaacgttctcgtaa

SEQ ID NO: 1334 - protein, 101 aa, Unknown
  Obtained from environmental sample
  misc_feature (1)..(101): Xaa is any amino acid
MGRKCKVLIEMVCLAENIGTKNKTGEKAKKNAFIHMAVIYPVIFRAGLASKTGNDYNKQKIKNPGLVNMKTQRPICFFQRKIKYSLKQKAPLIHHFTKTFS

SEQ ID NO: 1335 - DNA, 540 bp, Unknown
  Obtained from environmental sample
  misc_feature (1)..(540): n is a, c, g, or t
atgcaactgggaaaaagaaaaattctattaataaaattaggagaatatatgcttggcgaagaagcttcgtggttgcaggcaaaacaaaatgcgtttgaaaaaaacaggtggtttattcccgaatttattgatttgtctgtgaaaactattgctcaaagatatttacaaccctctgcgttggatacactgatcaatacttatcacctacctggtcaaatcaacattccaaaaaaagttggaattgtaatggcaggaaatatacccctcgtaggcttccacgatttcttatgtgtgtttctttcaggtcatattgcgcttataaaaccttcatccaaagatgatgtccttatcaaacacctggtggaaaaattaattgaatgggacgagatcttaaattcactggtacaatttagcgacatgctaaaaggttgcgatgcttacatagctacggggagcaataataccagccggtattttgaatattattttaaaaagtatcctcatataattcgaaaaaaccgtacatcagttgctatttaa

SEQ ID NO: 1336 - protein, 179 aa, Unknown
  Obtained from environmental sample
  misc_feature (1)..(179): Xaa is any amino acid
MQLGKRKILLIKLGEYMLGEEASWLQAKQNAFEKNRWFIPEFIDLSVKTIAQRYLQPSALDTLINTYHLPGQINIPKKVGIVMAGNIPLVGFHDFLCVFLSGHIALIKPSSKDDVLIKHLVEKLIEWDEILNSLVQFSDMLKGCDAYIATGSNNTSRYFEYYFKKYPHIIRKNRTSVAI

SEQ ID NO: 1337 - DNA, 849 bp, Unknown
  Obtained from environmental sample
  misc_feature (1)..(849): n is a, c, g, or t
ttgaacgttacaaaaatgaagtataatctagacgatttgcattggcaagagtttgaactccttgcgtttaaagtacttcaaattttagttagtcctaatgttcaatttattgagggaggaaatgataaagggagagatgttgtttttgaggggatttctgacttcaattccacatacaatggaaaatggatttttcaagtaaaacataaatccaaagcaagctctgattcagagattgcatatagtttggtttatgatttgaaaaatgaattggagaaagtatttctgatcaataagctacaatttgataattacatcttagtaacgaacaaaccggtcaatggtgaaatgtttgatcgtctgcatgacgaatttgagtctttcaaggacacacataaaatagaatgctcacactttagtttaattagttataggcatatagaatcgtgcatagatgacaatgacagtctaaagtggacttacccaaacattattagcagtcctgactttctaaatttattacaagaggcattgactcaacatatcgagaatagatcaaaaggatggttgaacactgtaaataagcacagacaaaagtttgtttttaccactttttttgagaaagccttcagaaaactcacagattaccctgcaataatcttatctggtcctccaaaaagcggaaaaacattcaacgcagagatattggctctaaacttttctttatttgaatactatcaacccatcttagtagatgagccagatgagatagagaaagtctataagcccgaaagaaaacaaatatttatttgtgatgatgcttttgggaagtacagtcttttcttttaa

SEQ ID NO: 1338 - protein, 282 aa, Unknown
  Obtained from environmental sample
  misc_feature (1)..(282): Xaa is any amino acid
MNVTKMKYNLDDLHWQEFELLAFKVLQILVSPNVQFIEGGNDKGRDVVFEGISDFNSTYNGKWIFQVKHKSKASSDSEIAYSLVYDLKNELEKVFLINKLQFDNYILVTNKPVNGEMFDRLHDEFESFKDTHKIECSHFSLISYRHIESCIDDNDSLKWTYPNIISSPDFLNLLQEALTQHIENRSKGWLNTVNKHRQKFVFTTFFEKAFRKLTDYPAIILSGPPKSGKTFNAEILALNFSLFEYYQPILVDEPDEIEKVYKPERKQIFICDDAFGKYSLFF

SEQ ID NO: 1339 - DNA, 381 bp, Unknown
  Obtained from environmental sample
  misc_feature (1)..(381): n is a, c, g, or t
ttgtcaccggcacccacgctggagcgcgtcaaaaagctcgagaaaagcggagtgatcaaaagctatcatgctgaagtagatccgctcatgctcggccttacggtgaagacctttattctcgtgaacattggctggcataagcagaatgcctctgaaaattttttacagaaagtcaatgagattgatgaagtgctcgaatgcaacatcatcacgggagatggcgactttttactgaaggtgatttgcaaggatttgcaggcttatcaaaacctgcttttcaacgtgctctctcaaattcctgaagtggaaaggctcaaaacactgatgaccctttccactgtcaagaatcgaaaagtgttgcccttagattacgggcaataa

SEQ ID NO: 1340 - protein, 126 aa, Unknown
  Obtained from environmental sample
  DOMAIN (1)...(100): AsnC family
  misc_feature (1)..(126): Xaa is any amino acid
MSPAPTLERVKKLEKSGVIKSYHAEVDPLMLGLTVKTFILVNIGWHKQNASENFLQKVNEIDEVLECNIITGDGDFLLKVICKDLQAYQNLLFNVLSQIPEVERLKTLMTLSTVKNRKVLPLDYGQ

SEQ ID NO: 1341 - DNA, 732 bp, Unknown
  Obtained from environmental sample
  misc_feature (1)..(732): n is a, c, g, or t
atgttagaccttaaatttgtccgtgagaaccccgaattagttaaacaaggcatagaaaataagaatgaaaagagcaggataaatgagatcattactcttgatgaaaaaagaagagcattaattatagagacggaggaattaaaatcaagaagaaataaagtttcggcgcagataccgcagatgaaaaaaagcggacaggatgttacagaagtgcttgccgaaatgaaacaggtatcagataagattacaactctcgattctgaactcagaggcatagaatcggaagttgaaaatataatgttgtacatccccaaccttgctcactcttctgtacctgtaggaagatccgctgaggaaaatgttgaggtccgcagatggcttcccgaaggcttttcatttgaactgaatgaagcagttatggatcatgtgcagcttgggaaaaagctgaacatacttgattttgaaagaggagctaaaatatctggatcaggtttccctttatatactggtaaaggggcaactcttgagagagccttaataaattttatgcttgatttccatattcagaagcataattataaagagatacttcccccatttttggtaaaccgtgaatcaatgcgagggacaggccagcttccgaaaatggctgatgatatgtatcatatagaaaaggatgatctgttcccgatccctactgccgaagtgccaatacaaatatttacaggatga

SEQ ID NO: 1342 - protein, 243 aa, Unknown
  Obtained from environmental sample
  DOMAIN (1)...(107): Seryl-tRNA synthetase N-terminal domain
  misc_feature (1)..(243): Xaa is any amino acid
MLDLKFVRENPELVKQGIENKNEKSRINEIITLDEKRRALIIETEELKSRRNKVSAQIPQMKKSGQDVTEVLAEMKQVSDKITTLDSELRGIESEVENIMLYIPNLAHSSVPVGRSAEENVEVRRWLPEGFSFELNEAVMDHVQLGKKLNILDFERGAKISGSGFPLYTGKGATLERALINFMLDFHIQKHNYKEILPPFLVNRESMRGTGQLPKMADDMYHIEKDDLFPIPTAEVPIQIFTG

SEQ ID NO: 1343 - DNA, 603 bp, Unknown
  Obtained from environmental sample
  misc_feature (1)..(603): n is a, c, g, or t
atgaaatctttaatcataatcttttcactcattttgttttttactgcctgtaaaaatcaaaagggaggagtgcaaactacaggtcaggtgattgaaaattccattacactcaccgacgcacaaatgaggaatgcaaaaattgaaaccgggaaaatagagcagaaggaaatttcatctgtgctaaaggtcaatggacggatagatgtgccaccacaaaatttagtatcggtaagtgtacctcttggaggttatctcagatcaactaaactcctcccgggtatgcacataaataaaaatcaggtgattgctataattgaagatcatcaatatattcagcttcagcaggattatctaacggctaaagcgcaattcggttatcatgaaagtgaatacaaaaggcagaaggaattgaacgaaagcaaagccaccagcgataaaatgtatgagcaggcaagatcaacttatcaaactcaaaaaatattgataagatcattagagganaagttgaagttgatccgtattaatccaacagccttaatgaaaataatatctccaaaagcattaacatctattcgcccattaatggatttgtttctaaagtaa

SEQ ID NO: 1344 - protein, 200 aa, Unknown
  Obtained from environmental sample
  SIGNAL (1)...(18)
  misc_feature (1)..(200): Xaa is any amino acid
MKSLIIIFSLILFFTACKNQKGGVQTTGQVIENSITLTDAQMRNAKIETGKIEQKEISSVLKVNGRIDVPPQNLVSVSVPLGGYLRSTKLLPGMHINKNQVIAIIEDHQYIQLQQDYLTAKAQFGYHESEYKRQKELNESKATSDKMYEQARSTYQTQKILIRSLEXKLKLIRINPTALMKIISPKALTSIRPLMDLFLK

SEQ ID NO: 1345 - DNA, 621 bp, Unknown
  Obtained from environmental sample
  misc_feature (1)..(621): n is a, c, g, or t
ttgcagcgcatggatattttacaaactttattttcagatcaacgcttaattgcagaaattaactcccgatcaaggaagaaaaagctggataaagaagaagttttaattgtaccgggagatacgttaatttttgttcccctcgtgctcagcggtgtgcttcggattattagagaagacgaagaagggcgtgaagtgtttctatatcatctgtacccttcgcaaacctgcgccatggctgtaaattgttgccagtcggggaaaaaaagtatggtaaaagcggtagcggaagacgaaacggaagtgttattgatacccgtcaacctaatagaccagttatttaaatatgatgaatggaaaatgtttatcaaccaaacctatagcagccgtttcgcagaactgattgaggtgatagacctgattgcctttaacaacctggataaaaaaattctcaattatttagaaaagaaaaaagaagcgcttaacaccgctagtttatccatcactcaccaacaaattgcagcagaattaaacacacaccgcgaagctgtcagtcgcctgttgcgaaccatggagcataaaggcatcgtaaagcttggtagaaataccattgagttattataa

SEQ ID NO: 1346 - protein, 206 aa, Unknown
  Obtained from environmental sample
  misc_feature (1)..(206): Xaa is any amino acid
MQRMDILQTLFSDQRLIAEINSRSRKKKLDKEEVLIVPGDTLIFVPLVLSGVLRIIREDEEGREVFLYHLYPSQTCAMAVNCCQSGKKSMVKAVAEDETEVLLIPVNLIDQLFKYDEWKMFINQTYSSRFAELIEVIDLIAFNNLDKKILNYLEKKKEALNTASLSITHQQIAAELNTHREAVSRLLRTMEHKGIVKLGRNTIELL

SEQ ID NO: 1347 - DNA, 570 bp, Unknown
  Obtained from environmental sample
  misc_feature (1)..(570): n is a, c, g, or t
ttgaaaggaactaacgaaggtacagtgatagaggtcctttactatcctaccgaatacagcatagaaaagagtgtttcatactcgggaagcaataatgaatctaagaggagaaataaaaccaaccagaacgctaaatccaaactggacaccccttttcttgagtataacggaggcaatcctggagttattagaatagaacttttttatgacacgtatgggcaggagatagatgatgtaagaacttatacagacaagatctcagatctcatgaagatagaccccaaacttcatgctccacccatattagaattcatatggggcatagaaaaacaaggatcttttgtttgtgtgctggaaagcctttcaaagaaatttactatgtttacactgaaaaaagactatcctattcctgtaagggcaaggcttagcttaacgcttaaagaattcaaactgaagttcgatgagggtgaaacaactaaaagttcacccgataaaacaaaagttcatgttacacagcgaggtgatagtctctggctgatgcccaataaagccaggaaacccaaaatatga

SEQ ID NO: 1348 - protein, 189 aa, Unknown
  Obtained from environmental sample
  misc_feature (1)..(189): Xaa is any amino acid
MKGTNEGTVIEVLYYPTEYSIEKSVSYSGSNNESKRRNKTNQNAKSKLDTPFLEYNGGNPGVIRIELFYDTYGQEIDDVRTYTDKISDLMKIDPKLHAPPILEFIWGIEKQGSFVCVLESLSKKFTMFTLKKDYPIPVRARLSLTLKEFKLKFDEGETTKSSPDKTKVHVTQRGDSLWLMPNKARKPKI

SEQ ID NO: 1349 - DNA, 1086 bp, Unknown
  Obtained from environmental sample
  misc_feature (1)..(1086): n is a, c, g, or t
atgagttctttcaatatcgacaagtttgttcgtccgcacttgaaagaccttgtgccctactcctccgcacgcgatgacttcaaaggcgcagccagcgtttatctagatgcgaacgaaaatccattcgacaatggtttgaatcgctacccagatccgcatcaatcagagttgaagaaagtattaagtcgcataaaaaatatcccagcacaaaacatttttattggaaacggaagtgatgaggcgattgatttgctctttcgtgctttttgcgaaccgggcaaagataacatcatcacgctgcctcccacttatggcatgtataaagtgtcggccaagatcaacaatgtggtcgtgaaagaagttttacttgatgaattctttgacatcgatgttgagaaaacgattgctgcgattgaccccagcacaaaattgatttttctgtgcagtccgaacaatccaacgggtaacagtttgagtcgcgctgcaatcaaaaaaatcctggcaagtttcaacggattggttgtggtggatgaagcgtatatcgatttctcatcgctaccaagtttaaccgaatggattcaagagtttcgaaatttggttgtgctccaaactttatcgaaagcgtggggacttgcctctgctcgcattggtttatgtttggcaagtgaacctgtagtcaatgttctcaacaagattaaaccgccatacaacatcagcggccctgaccagcagcaagccctgcaagcacttggaaatgaaatctcaatgaaagaacgagttgagcaaatcaaaacgcaacgagaatggttgaataacgagttgaaacaaaattccgaaagttgggttctcgggtctatccatcccgaagccaatttttctgttggcttaaggtcactgaatgctaaccgaaaccctatcaatttcctaagcgaatgctggcataaattgggcggaacccaatccaaaaaaaccaaattgccgaaaactgttttgccaaattacatttggcaccaaaaacggaaaaaacccccttcttcttttctaaaacctaaaagaaggttggcgaaaaaaattttttccctttaa

SEQ ID NO: 1350 - protein, 361 aa, Unknown
  Obtained from environmental sample
  DOMAIN (59)...(359): Aminotransferase class I and II
  misc_feature (1)..(361): Xaa is any amino acid
MSSFNIDKFVRPHLKDLVPYSSARDDFKGAASVYLDANENPFDNGLNRYPDPHQSELKKVLSRIKNIPAQNIFIGNGSDEAIDLLFRAFCEPGKDNIITLPPTYGMYKVSAKINNVVVKEVLLDEFFDIDVEKTIAAIDPSTKLIFLCSPNNPTGNSLSRAAIKKILASFNGLVVVDEAYIDFSSLPSLTEWIQEFRNLVVLQTLSKAWGLASARIGLCLASEPVVNVLNKIKPPYNISGPDQQQALQALGNEISMKERVEQIKTQREWLNNELKQNSESWVLGSIHPEANFSVGLRSLNANRNPINFLSECWHKLGGTQSKKTKLPKTVLPNYIWHQKRKKPPSSFLKPKRRLAKKIFSL

SEQ ID NO: 1351 - DNA, 621 bp, Unknown
  Obtained from environmental sample
  misc_feature (1)..(621): n is a, c, g, or t
atgttcacgatctataatgaagaagaaaataaatttcaattaatagaggaacccgatccttccctttcctatacctatgcggattatctgaaatgggaatttgaagaacaggtggaattgatacgcgggaagatctttaaaatgagccctgcgccggcgccaaggcatcagcaaatttcgataagcttatcatctgagatttataattttttgaagaaaaaatcctgtaaagtttttaacgcccccttcgatgttcgccttccggtaaaaaataaaaagaaggacaatgaaatcaccactgtagttcaacctgatatttgtgtgatttgcgacgaaggtaagattgatggtcgtggctgtttgggtgcgcctgatcttataattgaaatcctttctcccggcaatacggaaaaagaagtgaaactgaagtttgaattgtatgaagaagtcagcgttaaagaatactgggttgtgtatccatctgaagaaaatgtggctgtttttattttaaatgaaagtgaaaagtatgaaggtgccaaaatttatgcaggaaaggaccgcataaaaagcatcgctgtaaaaggattgatcattaacctcgaagacatttttaccaaataa

SEQ ID NO: 1352 - protein, 206 aa, Unknown
  Obtained from environmental sample
  DOMAIN (24)...(204): Protein of unknown function (DUF820)
  misc_feature (1)..(206): Xaa is any amino acid
MFTIYNEEENKFQLIEEPDPSLSYTYADYLKWEFEEQVELIRGKIFKMSPAPAPRHQQISISLSSEIYNFLKKKSCKVFNAPFDVRLPVKNKKKDNEITTVVQPDICVICDEGKIDGRGCLGAPDLIIEILSPGNTEKEVKLKFELYEEVSVKEYWVVYPSEENVAVFILNESEKYEGAKIYAGKDRIKSIAVKGLIINLEDIFTK

SEQ ID NO: 1353 - DNA, 432 bp, Unknown
  Obtained from environmental sample
  misc_feature (1)..(432): n is a, c, g, or t
atggaagaaataaaagttggtaacaaacgaaaaagtggctcagggataaggaaagtttttcgaacgttcgttattattctgatacttgcattggcaggatatatttactggaagtattattatccctacaccagcgatggcgtaaagtcaggctacctgaattatgctgtgcgtaaaggacagctatttaaaacatatgaaggaaagttgatacaggaaggtatccgcagcaaaacagctggcgccattcaatccaatgagtttgaattttctgtaaaggataaaaaaatattcgatgtactgaaagtaaatagcggaaaagtttttgatcttcattacaaagagtacaacggcgttttaccctggcggggaaactcaaggtatatagtggatagcattatttcaatgagaaatcctgatacaaggtattaa

SEQ ID NO: 1354 - protein, 143 aa, Unknown
  Obtained from environmental sample
  misc_feature (1)..(143): Xaa is any amino acid
MEEIKVGNKRKSGSGIRKVFRTFVIILILALAGYIYWKYYYPYTSDGVKSGYLNYAVRKGQLFKTYEGKLIQEGIRSKTAGAIQSNEFEFSVKDKKIFDVLKVNSGKVFDLHYKEYNGVLPWRGNSRYIVDSIISMRNPDTRY

SEQ ID NO: 1355 - DNA, 318 bp, Unknown
  Obtained from environmental sample
  misc_feature (1)..(318): n is a, c, g, or t
gtgatttcttggaacagtaatcagcatatcaatgtttttatctgcaacaaaggtttgggcggtttcaaccaggtcaaatgttccaataaagtaaaattcaggtctgtattctttaaacttctccagcaggcggcccctttcagccataaattcgggcgtaagcgaaacataatgttcgctgttaacgtttactatatgcagtgcaggcctgaaaaggttcaacacgtttttgatgggaacttccggcatactggtctcaacatctttaaaatccgaaagaagacaaacattttttatttcaaagtactgagcagttga

SEQ ID NO: 1356 - protein, 105 aa, Unknown
  Obtained from environmental sample
  misc_feature (1)..(105): Xaa is any amino acid
MISWNSNQHINVFICNKGLGGFNQVKCSNKVKFRSVFFKLLQQAAPFSHKFGRKRNIMFAVNVYYMQCRPEKVQHVFDGNFRHTGLNIFKIRKKTNIFYFKVLSS

SEQ ID NO: 1357 - DNA, 321 bp, Unknown
  Obtained from environmental sample
  misc_feature (1)..(321): n is a, c, g, or t
ttgggaaagcattttatacaaaatccagaaaataaactattcataaatcataaagacggtaataggtggaataatttaattggtaatcttgaatggtcaaccaatgcagaaaatcaaaaacattcctatgatgtgttagggaatgttgctgtaaaaggagaagaaaacggtcaatcaaaaattacaactgcacaagtaataaaaataagacaaagctataaaacaggaataactcaaaaacgattatctcaagaattcaaagtatctcaaagtaatataggatttattgtaaactacaaaagatggaagcacgttatttaa

SEQ ID NO: 1358 - protein, 106 aa, Unknown
  Obtained from environmental sample
  misc_feature (1)..(106): Xaa is any amino acid
MGKHFIQNPENKLFINHKDGNRWNNLIGNLEWSTNAENQKHSYDVLGNVAVKGEENGQSKITTAQVIKIRQSYKTGITQKRLSQEFKVSQSNIGFIVNYKRWKHVI

SEQ ID NO: 1359 - DNA, 330 bp, Unknown
  Obtained from environmental sample
  misc_feature (1)..(330): n is a, c, g, or t
ttggatggcaataagctaaacaacttttataagaatcttgaatatactactataaagcaaaacactagacacgcttttgaattagggcttatggacaataatataaagaggttcaaaaaatatataatcggcagatctggaaaattaaatccagcaagcataccagttattcaaatcgatagaaatagtggtgcaattataaaagaatacgaatctgcgacgtttgcttttaatgaaacaaatatttgcagacaagatatttctaagtgctgctgcggaacaaaaaagagtgctgggggttttatttggaaacacaaaattgcaaactaa

SEQ ID NO: 1360 - protein, 109 aa, Unknown
  Obtained from environmental sample
  misc_feature (1)..(109): Xaa is any amino acid
MDGNKLNNFYKNLEYTTIKQNTRHAFELGLMDNNIKRFKKYIIGRSGKLNPASIPVIQIDRNSGAIIKEYESATFAFNETNICRQDISKCCCGTKKSAGGFIWKHKIAN

SEQ ID NO: 1361 - DNA, 510 bp, Unknown
  Obtained from environmental sample
  misc_feature (1)..(510): n is a, c, g, or t
ttgggggcaatcgggaattttcggttgcccttcagcaaaattgtggcttacactaaaatccctaagggggttccatcgttggagcaggggtttcagcgcgagcccgaagtggatganctgatggaaatgctggggctgacgaaagaagagattgacgaatacttcagggtgaacacacatactatttctaccgaagcaaaagtgaccggtatcgagaatggaactttaaaggagatgctgtacgataaagatgctgtaagtgccgaggacaaagtaatggaagacaccgttaagaatcagttgaacgatgctatgtcgctgttaagcgagcgcgaatcggaaatcatcaacagctatttcgggttgaacggtgaggcgcctatgaccctcgaagaaatcggagtgcgctacgaccttaccagggagcgagtgcgccagataaaggaaaagtgcatcaagcaactgcgcgaaagcaccagccctactttaatgcaggcttataccaaataa

SEQ ID NO: 1362 - protein, 169 aa, Unknown
  Obtained from environmental sample
  DOMAIN (10)...(92): Sigma-70 region 3
  misc_feature (1)..(169): Xaa is any amino acid
MGAIGNFRLPFSKIVAYTKIPKGVPSLEQGFQREPEVDXLMEMLGLTKEEIDEYFRVNTHTISTEAKVTGIENGTLKEMLYDKDAVSAEDKVMEDTVKNQLNDAMSLLSERESEIINSYFGLNGEAPMTLEEIGVRYDLTRERVRQIKEKCIKQLRESTSPTLMQAYTK

SEQ ID NO: 1363 - DNA, 636 bp, Unknown
  Obtained from environmental sample
  misc_feature (1)..(636): n is a, c, g, or t
gtgaacaaaagaatattgtttttattaccctatccattgcacagggcgccgtctcaacgctttcgtgttgaggcttattttaatttattaagagaccacaatatttcttttacgacccgggaatttttggatgataaagcctgggaaattctttataaaaagggctccttaattaaaaaagccatagcagtcagtaaaggatatttaaaacgtataaagctattattcaaaacgggcagctatacgcacatttttatacaccgggaagctgcgccattaggacctcctgtatttgaatggtttttagcaaaagtgctgaaaaaaaagatcatttatgattttgacgatgccatatggataccaaatacttcaagggaaaacaaatttgcttcctggcttaaggcattttggaaagtgaaatatatatgcagatggtcgtataaaataactgcagggaatgaatacttatacaattatgcacgtaattacaaccccaaagtcatattgcttccgacctgtgtggatatggttcaccgtttcaataaactcaaacaacacacaacagggcaacccataatcggctggaccgggagccactccaccatgcactatttagatgagttactgcctgtatga

SEQ ID NO: 1364 - protein, 211 aa, Unknown
  Obtained from environmental sample
  misc_feature (1)..(211): Xaa is any amino acid
MNKRILFLLPYPLHRAPSQRFRVEAYFNLLRDHNISFTTREFLDDKAWEILYKKGSLIKKAIAVSKGYLKRIKLLFKTGSYTHIFIHREAAPLGPPVFEWFLAKVLKKKIIYDFDDAIWIPNTSRENKFASWLKAFWKVKYICRWSYKITAGNEYLYNYARNYNPKVILLPTCVDMVHRFNKLKQHTTGQPIIGWTGSHSTMHYLDELLPV

SEQ ID NO: 1365 - DNA, 546 bp, Unknown
  Obtained from environmental sample
  misc_feature (1)..(546): n is a, c, g, or t
atgaggccacagaaattaataaaaatagggatcagagcagcaattttgactattttgttaagtaccctaatctatttcgtttattatttcacttcctataatcttcttgtttacttagaatatattttcattttcctggcaggtgctgcatgttttattattgtactgcgcatcctgaaccatgtaaaaaaacataaaagataccggacacctttgcttttaaccagtgggtttattcttattgctggtattattgccctggtttattttcgcaaattgactggcctgttagatacgatgaggataaagtttgtaaacgagagcaggtatgcgttaaccaatattaaaattaccggttgtcaaaaaaagcagattggcaatataggcccaaaggaaaacactacagtttggattacggttacccgcgattgttctattaaccttagttatattgaaaatggtgtagaaaaaaacgaagtgatctctgcttatgtcactacttctatgggacaacagcttacgtttaagattggtgatgataaataa

SEQ ID NO: 1366 - protein, 181 aa, Unknown
  Obtained from environmental sample
  misc_feature (1)..(181): Xaa is any amino acid
MRPQKLIKIGIRAAILTILLSTLIYFVYYFTSYNLLVYLEYIFIFLAGAACFIIVLRILNHVKKHKRYRTPLLLTSGFILIAGIIALVYFRKLTGLLDTMRIKFVNESRYALTNIKITGCQKKQIGNIGPKENTTVWITVTRDCSINLSYIENGVEKNEVISAYVTTSMGQQLTFKIGDDK

SEQ ID NO: 1367 - DNA, 645 bp, Unknown
  Obtained from environmental sample
  misc_feature (1)..(645): n is a, c, g, or t
gtgcctgtggatattgtcaaaaaagtttttgatgacttgcgcaagtatggcatagttcagcaaagtttcgtaggaggttcagtcgtagagtataattatgagaatgcaaaaaaatatgacctcagcaccaatactaagacctttaacggtgtactgctggaaagcatcgaaagagacgggcctgcgatgaaggcgggattgaagccaggagatataattgtcaaaataaactctacggaaataaattcgcagagtgcctttgaggaggaattaagctatcattatccaggaaataagattagcgtgtcttatttgcgcgatggcaaattgaacacggttcccctgacattggtaaatctgaatgggacgactgaaattatcaagcgaaatatatacagtaacgatgcactgggcgctcaactggaagcgactcaatatggtgtcaaggtatttggaatgaaagaaaacagtgtcctgagaaagatcggggttcctgaaaattttacaattattgctatcaaccgggaacgcgtcaaagagccggaagaagtggttaactttttttcaaaattcaggggccgtggatacttgtatggaattaacagttcgaaacaacaggtagagataccgtttattgtgcgctag

SEQ ID NO: 1368 - protein, 214 aa, Unknown
  Obtained from environmental sample
  DOMAIN (12)...(105): PDZ domain (Also known as DHR or GLGF)
  misc_feature (1)..(214): Xaa is any amino acid
MPVDIVKKVFDDLRKYGIVQQSFVGGSVVEYNYENAKKYDLSTNTKTFNGVLLESIERDGPAMKAGLKPGDIIVKINSTEINSQSAFEEELSYHYPGNKISVSYLRDGKLNTVPLTLVNLNGTTEIIKRNIYSNDALGAQLEATQYGVKVFGMKENSVLRKIGVPENFTIIAINRERVKEPEEVVNFFSKFRGRGYLYGINSSKQQVEIPFIVR

SEQ ID NO: 1369 - DNA, 669 bp, Unknown
  Obtained from environmental sample
  misc_feature (1)..(669): n is a, c, g, or t
gtgaaaacatttctggttaataaagagaaaagaaatgattcgtttaaatgggttaaagatgaaatcctaaagaaagatcagcaagtttattggatatgtccattggttgaccagtccgataaaattcaagcaaaatctgtgaaggaaatttatgaagaactagttggtgtatttggtgaaaaacaagtcgcactattacatggaaaaatgaagtcaaaagcgaagcaagaaaccatgaaacagtttagtgagaataagtttaagattttggtttcaactacggtaattgaagtcggggttgatgtaccgaatgctacggtcatggttatagaaaatgccgagagattcggtttggcacaattacatcaaattcgaggtagagtggggcgaagtgatatccaaagttactgttttctttatactggagatgagattagtgagcaatcaaaggagagactgaaattttttgaaaaagaaagcaatggtttaaagattgctgaatttgatttacaacaaagaggacctggcgaagtttacggaacgatgcaatctggaatcccagatttgaagattgcgaagttgaatgatataaacttaattcaacatagtaaaaaaattgcagataagttatttgcaaagaaaattaagcatatagagatttttaaatga

SEQ ID NO: 1370 - protein, 222 aa, Unknown
  Obtained from environmental sample
  DOMAIN (57)...(132): Helicase conserved C-terminal domain
  misc_feature (1)..(222): Xaa is any amino acid
MKTFLVNKEKRNDSFKWVKDEILKKDQQVYWICPLVDQSDKIQAKSVKEIYEELVGVFGEKQVALLHGKMKSKAKQETMKQFSENKFKILVSTTVIEVGVDVPNATVMVIENAERFGLAQLHQIRGRVGRSDIQSYCFLYTGDEISEQSKERLKFFEKESNGLKIAEFDLQQRGPGEVYGTMQSGIPDLKIAKLNDINLIQHSKKIADKLFAKKIKHIEIFK

SEQ ID NO: 1371 - DNA, 459 bp, Unknown
  Obtained from environmental sample
  misc_feature (1)..(459): n is a, c, g, or t
atgaaagaaataatcgtaattctagacaacatcagatctgcgttaaatgtcggtgcaatatttcggacatgtgacggagtaggtgcaaaaaagctttaccttgttgggatcacaccatatccaccacatcccaaagtcctaaaaactgcacttggtgcgaatgaatccgtggtttatgagcatgtagaatccactgcaaatgttgttaataaatataaaaaagaaggttataaagtatactcattagaagaaaacaaaacagctaagaatttttttgatcaagatttaaaccataataaattaatttttataatgggaaatgaaatacttggtgtaccagaggaaattcaaaaaatgtctgacgaaacattatttttgccaatgataggtaagaagaattcgttgaatgtagctacaactacaggaatagttttatataatgcgcaatttgcaagatga

SEQ ID NO: 1372 - protein, 152 aa, Unknown
  Obtained from environmental sample
  DOMAIN (3)...(146): SpoU rRNA Methylase family
  misc_feature (1)..(152): Xaa is any amino acid
MKEIIVILDNIRSALNVGAIFRTCDGVGAKKLYLVGITPYPPHPKVLKTALGANESVVYEHVESTANVVNKYKKEGYKVYSLEENKTAKNFFDQDLNHNKLIFIMGNEILGVPEEIQKMSDETLFLPMIGKKNSLNVATTTGIVLYNAQFAR

SEQ ID NO: 1373 - DNA, 636 bp, Unknown
  Obtained from environmental sample
  misc_feature (1)..(636): n is a, c, g, or t
gtggccattgccgatgaccacaagatcttccgggacggcattaagatggctttaaaagacaaagattacctcaaaattttatgggaggctgaggatggaaaagatctcatgcacaaattgcgtatcaagcagcctgatgtattgttaatggatatccggatgccggaaatggatgggattaatgctatatcgcttatccgtaaagaatatgaagggattaagatcattgtgcttaccatgtatgatgaccaggaaatgatcaccaaaatgatggagatgggagcgaatgcttatctgaccaaaaccactgatcccgaagaaatctaccaggctatactaacctgtgtgaatgatgatttttattttaacgacctcgtcaataaggctgtacttttaaaactgcagcataaaaaaacagttcgacaattctaccccaatcccatcaagttttcagaaaaagaactgcgtatcctgaaacatattgctgaagacaaaaccacggaggaaatttccaaagaagtatttctaagcccgcgtaccatcgagactattaggcaaaaaatgaaagagaaggtaggagcaaagacaattgccgggttggttatgtatgccatgcgcaaccggctattagaataa

SEQ ID NO: 1374 - protein, 211 aa, Unknown
  Obtained from environmental sample
  DOMAIN (147)...(204): Bacterial regulatory proteins, luxR family
  misc_feature (1)..(211): Xaa is any amino acid
MAIADDHKIFRDGIKMALKDKDYLKILWEAEDGKDLMHKLRIKQPDVLLMDIRMPEMDGINAISLIRKEYEGIKIIVLTMYDDQEMITKMMEMGANAYLTKTTDPEEIYQAILTCVNDDFYFNDLVNKAVLLKLQHKKTVRQFYPNPIKFSEKELRILKHIAEDKTTEEISKEVFLSPRTIETIRQKMKEKVGAKTIAGLVMYAMRNRLLE

SEQ ID NO: 1375 - DNA, 762 bp, Unknown
  Obtained from environmental sample
  misc_feature (1)..(762): n is a, c, g, or t
gtgccattaaatacagccgccaagaattttaacggcaaaaaaatcccactcgttttagttcacccaggccaaggaagcattgaagtctataatgaaatggttactcgacttcccgaaaatctaccgatcttcggcattgattcttataattttcatcataaaaagcctattcgttccatgaaaaagttagcgacctattatgtgagggcgttgcatcagatgattccaagtgatgcatacattttaggcgggtggtctttaggaggatgtcttgcttttgcaatggcacagcaaatgacagaaagtttaactcgcattccactactgattatgatggattcatttacaaccgctcatatttctgatgtattggttcatgctttctttgaagctgctaaacaagctcgtgtttatgaatacaaaaaagaagactttcctgagattgaaattaaaaaacgtatcgatcttttagaacttgagaatcaaatgattcataatttcaaacctaagttgtatccaggcaaaaccctctttattaatgcaaccaaaactgattcttatactccgntcttccaagtatttcccgagcttgaaccgcactttatcgacttaaagcaaacctcaatggttggcaaaatatctccctcaagtaaaaatcattccgtcgcctttgaccttatgaattgtcaaatcgaaagattcggcagcacactatatcaacagtctactatcttctctcggcgatctatacagcttaaatga

SEQ ID NO: 1376 - protein, 253 aa, Unknown
  Obtained from environmental sample
  DOMAIN (15)...(252): Thioesterase domain
  misc_feature (1)..(253): Xaa is any amino acid
MPLNTAAKNFNGKKIPLVLVHPGQGSIEVYNEMVTRLPENLPIFGIDSYNFHHKKPIRSMKKLATYYVRALHQMIPSDAYILGGWSLGGCLAFAMAQQMTESLTRIPLLIMMDSFTTAHISDVLVHAFFEAAKQARVYEYKKEDFPEIEIKKRIDLLELENQMIHNFKPKLYPGKTLFINATKTDSYTPXFQVFPELEPHFIDLKQTSMVGKISPSSKNHSVAFDLMNCQIERFGSTLYQQSTIFSRRSIQLK

SEQ ID NO: 1377 - DNA, 732 bp, Unknown
  Obtained from environmental sample
  misc_feature (1)..(732): n is a, c, g, or t
ttgtttgatttcaagaatgttcttgtttcgaagaatgaaagatgtacaattcttgttcaaggaaattcaggaagtggaaaaacaatgttattgcattgtattgaaaattattttattgaaagattaatttcaaaatattcaaataactcaaaagcaccttcatttgcaaatagtgaagatgatggaacaataattccaattagaattgaattgggaagatatgaacaaacaagtgatttgttgaatagttttatgagattgaatggattgacttatgatgattttgatttctcagaaaatgtaaaatatttgattattttggatggagttgatgaaataaatcaaacaacagcaagattacttgaatcaaatccatttttaaaacaattaaattcagtgataatatttggatgtagaacagaacatcttattccaatgaaatcattttatcttgaattttttactccaaattacaattatagcaaaccttcttcagaatcaaaaatagaaaatatttcaataacacatcaaaatgaaaaagaagaaaatgaaaaagaaaaatgggaagaaataaatgaaaatgaaaaatgggaagataattgggaagatgatgaagaaaataatgaaaaaaatatttcaaaagatgcaaataaaaatgaaataattgattttcatctttctcaaaatccagaatcaaaaataaaaagaaacccagaaaatgaagacttttaa

SEQ ID NO: 1378 - protein, 243 aa, Unknown
  Obtained from environmental sample
  misc_feature (1)..(243): Xaa is any amino acid
MFDFKNVLVSKNERCTILVQGNSGSGKTMLLHCIENYFIERLISKYSNNSKAPSFANSEDDGTIIPIRIELGRYEQTSDLLNSFMRLNGLTYDDFDFSENVKYLIILDGVDEINQTTARLLESNPFLKQLNSVIIFGCRTEHLIPMKSFYLEFFTPNYNYSKPSSESKIENISITHQNEKEENEKEKWEEINENEKWEDNWEDDEENNEKNISKDANKNEIIDFHLSQNPESKIKRNPENEDF

SEQ ID NO: 1379 - DNA, 873 bp, Unknown
  Obtained from environmental sample
  misc_feature (1)..(873): n is a, c, g, or t
ttggacacaaacaaaagtgcgttatttcagtcacagattcagagagaaatggtttccgggattatctttcgttattccgctatggacagaagtccgggtggacttttccgaccgacaaataanaaactctattttgaaggtttcaggcttatacccggtgacaagaaaaacctgaaacgcctggagatagattccaataagcgtataatctgtggaaacatgtcatatttcgatgtccttgcatgtggttttaatgatacctataacgaatccactccttatgatatggaataccggattgatgatttggtcaagagtgtaaaccaatcattgcacaatgtaaaaaaaatcacgtcgccttttgcagggttcgatcataaaaccttttataacgctcaaagcaaaatttataacgataaatttaaacaggaaactctgaaggaaaaaacattactcatttataacagcgatctagaaaaaaaacaaatttccaaagtcagcaacagtccttccctgttattgaatggttctatgaatcccaatgaaaatatgtctacaatatggaaggattatccatatcccgtggaatttctttcacagcaagagttttcgcaaaaagttaacagtaaagataataaatatgcatatctgattcgctatacattgagaaataatcaatataccggctggtccgggggatcgggcattctcggcccatcagtaacttacctggcgccacattttacatgggttatttatgatgcctccaccggagacattatatacactgatgccaaaatgtgcgacaatacgataagctttacgccaacggtctttccctgcttcctgaaaaacctacttggtaaaaaatag

SEQ ID NO: 1380 - protein, 290 aa, Unknown
  Obtained from environmental sample
  misc_feature (1)..(290): Xaa is any amino acid
MDTNKSALFQSQIQREMVSGIIFRYSAMDRSPGGLFRPTNXKLYFEGFRLIPGDKKNLKRLEIDSNKRIICGNMSYFDVLACGFNDTYNESTPYDMEYRIDDLVKSVNQSLHNVKKITSPFAGFDHKTFYNAQSKIYNDKFKQETLKEKTLLIYNSDLEKKQISKVSNSPSLLLNGSMNPNENMSTIWKDYPYPVEFLSQQEFSQKVNSKDNKYAYLIRYTLRNNQYTGWSGGSGILGPSVTYLAPHFTWVIYDASTGDIIYTDAKMCDNTISFTPTVFPCFLKNLLGKK

SEQ ID NO: 1381 - DNA, 585 bp, Unknown
  Obtained from environmental sample
  misc_feature (1)..(585): n is a, c, g, or t
atgacgcaagattttaaagagggcaggcaaaatattatcagagagcaatcatgtttcaatgatgaaagtgaaaaaaagcaagatagaaaaattaaggagctaagaaaaaaatctcttacctatattttaaaagagaccagaaaaacagaagagatcactttttatacttggtcagatccaagagatcaatataaagatagcccagatcatcaaattacctataaagttaataattataccggtaaaattaatgtatgttacggtaaggaagttgaagcctatattattcttgatcctctagttatccaggataaggggatgcgtatttatgaattgtcagaaaaaggattgaatgattggggtgataaagataatggtaattttaagaatttctttccgattggagttgaacagttaaaagatcagcagccaatatctcttcaatccactcaaaatactgctaaacctagttcgataaaaccttattctgccaagtctttaatagataatagattagaaatagttggcaatttaaagcctttgattccaaaaagctattctccgagacttgcaactgagctatag

SEQ ID NO: 1382 - protein, 194 aa, Unknown
  Obtained from environmental sample
  misc_feature (1)..(194): Xaa is any amino acid
MTQDFKEGRQNIIREQSCFNDESEKKQDRKIKELRKKSLTYILKETRKTEEITFYTWSDPRDQYKDSPDHQITYKVNNYTGKINVCYGKEVEAYIILDPLVIQDKGMRIYELSEKGLNDWGDKDNGNFKNFFPIGVEQLKDQQPISLQSTQNTAKPSSIKPYSAKSLIDNRLEIVGNLKPLIPKSYSPRLATEL

SEQ ID NO: 1383 - DNA, 765 bp, Unknown
  Obtained from environmental sample
  misc_feature (1)..(765): n is a, c, g, or t
ttggatatatngggtaagcaattggaaggcttcggcagcgaaaaggcgtcgcaaggaaagggtgagttatacgattttttgcggcattataatggtggtgcttttgttatgtgggattacgaatacttaagagaaatgagcaaaggaattgaaaccatttataaatacggcactcatgatgcagatattattggaactgattccaccaacgacccatttttagaagtaaagtttacaaaaggttttcagggaaacattgcaacaaaacttgttggaaactataacctttcaaatgtattggctgctgtatctgtagggaaattttttaaagtagatgatcgcaaaataaaagaagcaatagaaagctattcgccatcaaatagccgctctcaattaattcaaaaaggaagtaacaagattatcctggacgcctataatgcaaatcccaacagcatgaagtttgccattgaaaatttttccaaagcctcaggagaaaacaagatattggtgttaggcgccatggccgaattaggaaaagacagcattgaagaacatcaacagattttaaacatcatcaaaaactatcaatgggaaaatgttttgttggtgggcgaagatttttctaaaatacaacacccccatatgcaattcgactctgctgatgaagccgcaaaatggttaagacaaaaaaatattaaaaattctttcctgctaataaaaggaagtcgtacaacgcaaatggaaaaagtattagattctttataa

SEQ ID NO: 1384 - protein, 254 aa, Unknown
  Obtained from environmental sample
  DOMAIN (126)...(212): Mur ligase family, glutamate ligase domain
  misc_feature (1)..(254): Xaa is any amino acid
MDIXGKQLEGFGSEKASQGKGELYDFLRHYNGGAFVMWDYEYLREMSKGIETIYKYGTHDADIIGTDSTNDPFLEVKFTKGFQGNIATKLVGNYNLSNVLAAVSVGKFFKVDDRKIKEAIESYSPSNSRSQLIQKGSNKIILDAYNANPNSMKFAIENFSKASGENKILVLGAMAELGKDSIEEHQQILNIIKNYQWENVLLVGEDFSKIQHPHMQFDSADEAAKWLRQKNIKNSFLLIKGSRTTQMEKVLDSL

SEQ ID NO: 1385 - DNA, 447 bp, Unknown
  Obtained from environmental sample
  misc_feature (1)..(447): n is a, c, g, or t
atgagcagggaaaaactttcaaggatcagcgactggcacgtgaaaagcaaaagtcctgtttacatccactattattttttaaacagggatattaaagatgccattgtaaattatgccaagggcgatttccttgatatggggtgcggcaacaaaccttatgagggtttgtataaaccatttactgcctctcaaatagggtgtgatattgtgcagagtgatcagaatagtgtagacgtaatttgtcctgcaactgacttaaaattcgaagacaacaaatttgacagcattctttgcacgcaggttcttgaacatgtattcgagcacgacaaattaatgagtgaagcttttcgtgtgctaaaacctggcgggcatttaattcttaccgtaccatttgcatgggacttcacgaagagccttatgattctttctgtaccaaagcacgcataa

SEQ ID NO: 1386 - protein, 148 aa, Unknown
  Obtained from environmental sample
  misc_feature (1)..(148): Xaa is any amino acid
MSREKLSRISDWHVKSKSPVYIHYYFLNRDIKDAIVNYAKGDFLDMGCGNKPYEGLYKPFTASQIGCDIVQSDQNSVDVICPATDLKFEDNKFDSILCTQVLEHVFEHDKLMSEAFRVLKPGGHLILTVPFAWDFTKSLMILSVPKHA

SEQ ID NO: 1387 - DNA, 348 bp, Unknown
  Obtained from environmental sample
  misc_feature (1)..(348): n is a, c, g, or t
ttgatttctttagacaattctctaccgctcatcgacccgaaatacaaacccgacgattacctcgtgcgcggctgtcaatcaaaagtgtggctgaacgcggagttgaacggagacagagtaattttcaaagccgacagtgatgcgattatcacgaaaggaattgtggcgttacttgtagaagtattgtccaacgaaacgccggatgaaattttaaacgccgatttatcgttcatcgataaagtaggattgaaagaacacttgtcaccaacccgttccaacggcttggtgtcgatgataaaagaaatgaagtcctacgcactgggatttaaagcattgcaaacaaaatga

SEQ ID NO: 1388 - protein, 115 aa, Unknown
  Obtained from environmental sample
  DOMAIN (1)...(107): Fe-S metabolism associated domain
  misc_feature (1)..(115): Xaa is any amino acid
MISLDNSLPLIDPKYKPDDYLVRGCQSKVWLNAELNGDRVIFKADSDAIITKGIVALLVEVLSNETPDEILNADLSFIDKVGLKEHLSPTRSNGLVSMIKEMKSYALGFKALQTK

SEQ ID NO: 1389 - DNA, 561 bp, Unknown
  Obtained from environmental sample
  misc_feature (1)..(561): n is a, c, g, or t
ttgccaggcattgaagnctggaaagtattagagcttaaagtattggcagacgtgggcttggtaggatttcccaatgccgggaaatcaacattactttcggtaattacgcctgcaaaaccaaagattgcagattatgcttttactaccatcactcccaatttaggtatcgtggaatacagggatggaaagagtttttgtattgcagatcttcctggaataattgaaggcgctgctgaaggcaaagggttagggcatcggtttcttcgccacattgaacgaaattctattttgctttttcttattccagccgacagccaggattataaaaaagaatttgacatcctaaaaaatgaattggcagaattcaatcctgagctattgcaaaaacaattcataatcgccatcagcaaatctgatatgctggatgaagagttgatcaaagacataaaaaaagaactgccaaaaacttacccgcatatttttatttcatcactaaccaataaaaatattgcccaactcaaagatttaatctggaagactttgaatgaagagatcgcttaa

SEQ ID NO: 1390 - protein, 186 aa, Unknown
  Obtained from environmental sample
  DOMAIN (1)...(141): GTP1/OBG family
  misc_feature (1)..(186): Xaa is any amino acid
MPGIEXWKVLELKVLADVGLVGFPNAGKSTLLSVITPAKPKIADYAFTTITPNLGIVEYRDGKSFCIADLPGIIEGAAEGKGLGHRFLRHIERNSILLFLIPADSQDYKKEFDILKNELAEFNPELLQKQFIIAISKSDMLDEELIKDIKKELPKTYPHIFISSLTNKNIAQLKDLIWKTLNEEIA

SEQ ID NO: 1391 - DNA, 714 bp, Unknown
  Obtained from environmental sample
  misc_feature (1)..(714): n is a, c, g, or t
atgagaataggtatagaagctcaacgaattttacgaccaaaaaaacatggaatggatgtggtggcattggaattgatcaagaagctccagcaaattgacgaagaaaacaaatattatgtttttgccagaaaagatgaggatgaatatgctattaatgagacaagtaattttaaagtcgaaaaattttcatccttatcttattttgactgggagcaaattaagcttagaaaagcagtaaggaatcagaatatagaacttttgcattgtaccgcgaatacagcaccgctgtcaatgcatatccctcttattgtcaccatacacgatataatctatcttgagaatcttgattttaagggaaccacctatcaaaatttggggaatttatacaggagattcttagtgccgagaattgcaaaaaaggctgatttagttttaacagtatcaaactatgaaagagaaaatattatagagcgtttaaagcttgcggaaaataaggtacaggttttatacaatggcgtgagtgaaaagtttagtgtaaagtttagcttggaagaactaaataaatttcgagaaaaacataatctaccgggaaagtatatcatgtcttcgggaaatactgcgcctaaaaagaataccgtaaatgttataaaagcctatgtcgactattgtctgtccgaaaacgatgctgtaccaatagtatcgttaaactcataa

SEQ ID NO: 1392 - protein, 237 aa, Unknown
  Obtained from environmental sample
  misc_feature (1)..(237): Xaa is any amino acid
MRIGIEAQRILRPKKHGMDVVALELIKKLQQIDEENKYYVFARKDEDEYAINETSNFKVEKFSSLSYFDWEQIKLRKAVRNQNIELLHCTANTAPLSMHIPLIVTIHDIIYLENLDFKGTTYQNLGNLYRRFLVPRIAKKADLVLTVSNYERENIIERLKLAENKVQVLYNGVSEKFSVKFSLEELNKFREKHNLPGKYIMSSGNTAPKKNTVNVIKAYVDYCLSENDAVPIVSLNS

SEQ ID NO: 1393 - DNA, 354 bp, Unknown
  Obtained from environmental sample
  misc_feature (1)..(354): n is a, c, g, or t
atggcgacactggccgttccccgntatttcctggggaaaatcatgaaaaaagtggtaaaaagcggtatcatcgattctacccgcggacagcagggtggattttttatcaacaagcagaccctgcaaacaccgcttagcaaattggttttactcatggagggaagggaatactttcaaacctgtattctcaactttggacactgcaatgccatcaacccctgtcccctgcattcccgtgtagaaagattcagaacggaaatccaggccatttatcatgacactacgatcggggacttactaaaaggcaataagccctcctttataaggagtattgccaccatcgaacataaataa

SEQ ID NO: 1394 - protein, 117 aa, Unknown
  Obtained from environmental sample
  misc_feature (1)..(117): Xaa is any amino acid
MATLAVPRYFLGKIMKKVVKSGIIDSTRGQQGGFFINKQTLQTPLSKLVLLMEGREYFQTCILNFGHCNAINPCPLHSRVERFRTEIQAIYHDTTIGDLLKGNKPSFIRSIATIEHK

SEQ ID NO: 1395 - DNA, 636 bp, Unknown
  Obtained from environmental sample
  misc_feature (1)..(636): n is a, c, g, or t
atgaaaaacggtctgctggtgctgaatatcattcttggggtagcagtaggctatttgctgatcacacattttacttctgataaaagcaataaaaccacaaccaggcactccggtaaggattcaacaggtaattcaaactcttttcggattgcttattttgaaatggattcggtagagggcaattttcaaatggtgaaagatgtcaaagcagaattgtccaaaaaagaaaatgagatcaataaccagatcgataaattggtaaagagttttcaggataaatataattattatcagaaccaggcacaaaccgggaagctatcccagatcgaatcagacgctgcaaaactggaactcgaaaacctggatgggcaaattaaaaatcgcaaacaggctcttgaccaggaatataatgatcttgtgatgcgaaaaatgaaggatgtgaaaacaaagatcgaggatttcctgaaggattataataaagacgggaagtattcctatatcgtttcctacgagcagggattgtcttattacaaggattctgcttataatattactgctgatgtagtaacaggattgaacgaactctataaaacgagaaagattaactccttatccatttttctttctgcttcctga

SEQ ID NO: 1396 - protein, 211 aa, Unknown
  Obtained from environmental sample
  DOMAIN (1)...(193): Outer membrane protein (OmpH-like)
  misc_feature (1)..(211): Xaa is any amino acid
MKNGLLVLNIILGVAVGYLLITHFTSDKSNKTTTRHSGKDSTGNSNSFRIAYFEMDSVEGNFQMVKDVKAELSKKENEINNQIDKLVKSFQDKYNYYQNQAQTGKLSQIESDAAKLELENLDGQIKNRKQALDQEYNDLVMRKMKDVKTKIEDFLKDYNKDGKYSYIVSYEQGLSYYKDSAYNITADVVTGLNELYKTRKINSLSIFLSAS

SEQ ID NO: 1397 - DNA, 900 bp, Unknown
  Obtained from environmental sample
  misc_feature (1)..(900): n is a, c, g, or t
ttgattgatgatctctctcagaatttacaaaagctggtagacttaaaaaatcaaggaaagaaccttttctccattatcgaaaaattagcacaggaaagttttagcaagatcatgcaacgatattggtggtgggatccttttgctagtgctacagcgctttaccgaaaaaacctaagacatcatattgctgaaaaaatgcattgttgcgctaaaacgtttgcagattttgctgtatgcctttctttaacaagcactcactattattctacaatccttttcagacatgcagatcaatggctttctaaaatccctaactggatcttcaatatagccaagcatactgagcccatctacaaaaaatctcaccttgtagcagaggcttacttaggatttagttccttagataaaatcgaccttcttctaatccaatattttgttgattcccaaaaagaacctaaaaaatggctttctgtatccacagataaaagattattatctgtgattttcccaaaaacacagatctcacataaacggttgcttacgctaattacaaacttacttaatatgaaaaaacacacaataaacgtctttgctatgctatgtaatatgcttgtttatcaaatacaaactcaagaaaaggttatagagagacaaaagtgtgtggaaagttttgctcaagaaaatcttataacattacgagagagcatcaactggaaaccggatgagttcaagaacattctcctgaaattttcgaaaaaagaattcaatctcgatatcgaaccatttaaaataatttctacagaaacagctacagaacaaaaagaggactttttcttgcnggttttcgcaaaagtgctctttcaagcacagatattagaaacaaaatgtgatctgnnctaa

SEQ ID NO: 1398 - protein, 299 aa, Unknown
  Obtained from environmental sample
  misc_feature (1)..(299): Xaa is any amino acid
MIDDLSQNLQKLVDLKNQGKNLFSIIEKLAQESFSKIMQRYWWWDPFASATALYRKNLRHHIAEKMHCCAKTFADFAVCLSLTSTHYYSTILFRHADQWLSKIPNWIFNIAKHTEPIYKKSHLVAEAYLGFSSLDKIDLLLIQYFVDSQKEPKKWLSVSTDKRLLSVIFPKTQISHKRLLTLITNLLNMKKHTINVFAMLCNMLVYQIQTQEKVIERQKCVESFAQENLITLRESINWKPDEFKNILLKFSKKEFNLDIEPFKIISTETATEQKEDFFLXVFAKVLFQAQILETKCDLX

SEQ ID NO: 1399 - DNA, 798 bp, Unknown
  Obtained from environmental sample
  misc_feature (1)..(798): n is a, c, g, or t
atgcagcaactcgagctgttagtcattgacgaaataagcatggtacgatgtgatacgctggatgccattgatgctatcctcagaaaagtaagaagcaaaccttcattaccgtatggtggtgtacaggtcttatacattggtgatatgtttcaacttccaccaataagaaatgaagaggactggaagtggttgcgagatcactatgctgaccagtactttttctcaagccatatcttaaaggaacagcctcctgtttatctcgaactaaaaaaggtctaccggcaaagcgatgcgtctttcatagaaattctgaataaggtccggcacaatgaaattgatcgtgttacgctggagatgttgcacagcagatataatccgtcatttaagatacctgaaaatgaaaattatattacacttacaacacacaatagcagcgccaacgaaattaatctgcaatctctttcaaaactaaagggcaacttgttttcattcaaagcaattatagaaggagagttttctgaaaaatcgtatccggncgatccttcattgcagttgaaggtgggtgcacaagtaatgttcattaagaatgacaccgagaaagtcaggcgatattataatggcaagatcggaatcgtagacaagatcgccgaggataagatctgggtgcgaacaaacggagatccggataccttaatcgaagtgacccacgaaacatggaacactcttaagtatacactcaataaagcaaccggccaactggacgagaatgaagcaggctctttcatcaatgtccgttaa

SEQ ID NO: 1400 - protein, 265 aa, Unknown
  Obtained from environmental sample
  misc_feature (1)..(265): Xaa is any amino acid
MQQLELLVIDEISMVRCDTLDAIDAILRKVRSKPSLPYGGVQVLYIGDMFQLPPIRNEEDWKWLRDHYADQYFFSSHILKEQPPVYLELKKVYRQSDASFIEILNKVRHNEIDRVTLEMLHSRYNPSFKIPENENYITLTTHNSSANEINLQSLSKLKGNLFSFKAIIEGEFSEKSYPXDPSLQLKVGAQVMFIKNDTEKVRRYYNGKIGIVDKIAEDKIWVRTNGDPDTLIEVTHETWNTLKYTLNKATGQLDENEAGSFINVR

SEQ ID NO: 1401 - DNA, 744 bp, Unknown
  Obtained from environmental sample
  misc_feature (1)..(744): n is a, c, g, or t
ttggatactaataggccttacagttggactgactctcgttggtgtagtgctatggggaacattaagcggttccatgttaccattgattctgaaaagagccggcgtggaccccgcggtttcttctgccccatttattgcaacgctggtggacgtaacaggactaattatttatttcagtatcgcattttttctgctgcgaggtacgttattataaacatgcggaaatacacagtcataaaaatcctgctcattttcattggtatattttgttttcacctcgcaaatgcacaggattctgataaggagcaggagaacctgcagctatgttaccagtattcaaagctgctgaattgcgaagttgaatcgctgccgtatcctgacatgtaccaaacaatttatgaatggcttggtacaccttaccggtattccggcgattgcaaggaaggagttgattgttcaggatttgtctgtatgctttacaaggagtcttttggagttacgcttgcaaatagttcagcagagatattcaaagaaaccaagcctgtgaaaaaatctgcgctgaaagaaggcgaccttgtattcttcaaaatcaaaaagaaaaagatttcacatgtgggcgtctatatcggccataacaagttcgcacatgcttcggtgcagaatggtgtgatcattagtgatctggatgaaccgtattataagaagtatttttataaagggggtagagtgaagaaaggtaattag

SEQ ID NO: 1402 - protein, 247 aa, Unknown
  Obtained from environmental sample
  DOMAIN (137)...(242): NlpC/P60 family
  misc_feature (1)..(247): Xaa is any amino acid
MDTNRPYSWTDSRWCSAMGNIKRFHVTIDSEKSRRGPRGFFCPIYCNAGGRNRTNYLFQYRIFSAARYVIINMRKYTVIKILLIFIGIFCFHLANAQDSDKEQENLQLCYQYSKLLNCEVESLPYPDMYQTIYEWLGTPYRYSGDCKEGVDCSGFVCMLYKESFGVTLANSSAEIFKETKPVKKSALKEGDLVFFKIKKKKISHVGVYIGHNKFAHASVQNGVIISDLDEPYYKKYFYKGGRVKKGN

SEQ ID NO: 1403 - DNA, 468 bp, Unknown
  Obtained from environmental sample
  misc_feature (1)..(468): n is a, c, g, or t
atgaaaaaaagtgccggaattttgctatatcgttataaaaacagtggtcccgaagttctgctggttcatcccggcggtccgttttatgtaaataaggatgaacatacatggacaattccaaagggagaaataaacgataatgaggatgtgtttaaagctgccctcagagaattcgaagaggaaaccgggattcagcccgatggaaattttattgagctccgcactgtaaaacagaacgggggcaaacaggtgttcagttgggctgttgaacaagatttaaatgcagataaaatcgaaagcaataccttttccatggaatggcctccaaaatcgggaaaaatgaaagatttccctgaaattgacaaggctgaatggtttgattatgaaaatgcagtaaagaaaattctgaaaggtcagattcccatactcgaagatcttttcgagaagataaatccgaagatcaaataa

SEQ ID NO: 1404 - protein, 155 aa, Unknown
  Obtained from environmental sample
  DOMAIN (1)...(149): NUDIX domain
  misc_feature (1)..(155): Xaa is any amino acid
MKKSAGILLYRYKNSGPEVLLVHPGGPFYVNKDEHTWTIPKGEINDNEDVFKAALREFEEETGIQPDGNFIELRTVKQNGGKQVFSWAVEQDLNADKIESNTFSMEWPPKSGKMKDFPEIDKAEWFDYENAVKKILKGQIPILEDLFEKINPKIK

SEQ ID NO: 1405 - DNA, 756 bp, Unknown
  Obtained from environmental sample
  misc_feature (1)..(756): n is a, c, g, or t
gtggctaataaacaagtaaaatttaatgataaaatgcaaaaagagtttattaatattgcaagtcacgaattgaagacccctactcaagctattctagtattttcacaactattacgaacatatcctgaaagaagagatgaaatgataaatgctatagaaagaaacgccgttagacttaaaaaccttacaaatagtatattggatgtttcaagaattgagagccaaagtttaagcctcaacaaggagaagtttaacattaacgaaaagataagaaatgtaatagacgatttaaaattaagacaccaagtagaaataacatttgctgatccaaaagtggatcctatagttgtagaagcagataaaattagaatttatgaggttatatcaaacctcttagttaacgccattaaatttacacagaaaagtagtagtagtagcgataatggtaatagtctaggtgagggcagaataacagtctttacagccataaaatccaaccaagattataagaaaggtaatacgggtagcagcgttgaggaggttattattagtataagagatagaggagtgggtattgaccctgatatacaggacaggttattttccaaattcgttaccaaatctgagacaggcacaggattggggttgtatatatcaaagggcattgtagaagcacatggtggaaggatatgggctgagaataatgctgaaggtaaaggagcaacattttactttagcctaccgttaagcaaatag

SEQ ID NO: 1406 - protein, 251 aa, Unknown
  Obtained from environmental sample
  DOMAIN (12)...(75): His Kinase A (phosphoacceptor) domain
  misc_feature (1)..(251): Xaa is any amino acid
MANKQVKFNDKMQKEFINIASHELKTPTQAILVFSQLLRTYPERRDEMINAIERNAVRLKNLTNSILDVSRIESQSLSLNKEKFNINEKIRNVIDDLKLRHQVEITFADPKVDPIVVEADKIRIYEVISNLLVNAIKFTQKSSSSSDNGNSLGEGRITVFTAIKSNQDYKKGNTGSSVEEVIISIRDRGVGIDPDIQDRLFSKFVTKSETGTGLGLYISKGIVEAHGGRIWAENNAEGKGATFYFSLPLSK

SEQ ID NO: 1407 - DNA, 735 bp, Unknown
  Obtained from environmental sample
  misc_feature (1)..(735): n is a, c, g, or t
gtggctaataaacaattaaaatttaatgataaaatgcaaaaagagtttattaatattgcaagtcacgaattgaagacccctactcaagctattctagtattttcacaactattacgaacatatcctgaaagaagagatgaaatgataaatgctatagaaagaaacgccgttagacttaaaaaccttacaaatagtatattggatgtttcaagaattgagagccaaagtttaagcctcaacaaggagaagtttaacattaacgaaaagataagaaatgtaatagacgatttaaaattaagacaccaagtagaaataacatttgctgatccaaaagtggatcctatagttgtagaagcagataaaattagaatttatgaggttatatcaaacctcttagttaacgccattaaatttacacagaaaagtagtagtagtagcgataatggtaatagtctaggtgagggcagaataacagtctttacagccataaaatccaaccaagattataagaaaggtaatacgggtagcagcgttgaggaggttattattagtataagagatagaggagtgggtattgaccctgatatacaggacaggttattttccaaattcgttaccaaatctgagacaggcacaggattggggttgtatatatcaaagggcattgtagaagcacatggtggaaggatatgggctgagaatatgctgaaggtaaaggagcacattttactttag

SEQ ID NO: 1408 - protein, 244 aa, Unknown
  Obtained from environmental sample
  DOMAIN (12)...(75): His Kinase A (phosphoacceptor) domain
  misc_feature (1)..(244): Xaa is any amino acid
MANKQLKFNDKMQKEFINIASHELKTPTQAILVFSQLLRTYPERRDEMINAIERNAVRLKNLTNSILDVSRIESQSLSLNKEKFNINEKIRNVIDDLKLRHQVEITFADPKVDPIVVEADKIRIYEVISNLLVNAIKFTQKSSSSSDNGNSLGEGRITVFTAIKSNQDYKKGNTGSSVEEVIISIRDRGVGIDPDIQDRLFSKFVTKSETGTGLGLYISKGIVEAHGGRIWAENMLKVKEHILL

SEQ ID NO: 1409 - DNA, 522 bp, Unknown
  Obtained from environmental sample
  misc_feature (1)..(522): n is a, c, g, or t
ttgatggtaaggaatgcaagatgtcatatcatcctctgttttcaggttgattttaatcaggacttagtgaatgctatattagtattagcagaacgcgggccggaagtgcaaaacagttcaacggttgtgcgcgcacgcgtgttttctgtgttagtggagtgtatgcaaaatatccgtaagtatggttcacctacaagttcgagtgatcttaaacccgggatcgtaattgtttgtcttgatgaaaaaggctatctgctgaaaacaggaaattttattgagaataaagaaattccaaatttaaaagacaggttagatactgttatcaaattgggtaaagaagaattgaaagatctgcataaaaaggttttaggagaaacaaaactttctgagaaatccggcgcgggtcttggtttaattagcattgcccgtaaatcggatggaatggggtatatgtttaaaacgatcgatgctgaaacttcgttttacgcattagatgttcatatttctaatacaacaaaataa

SEQ ID NO: 1410 - protein, 173 aa, Unknown
  Obtained from environmental sample
  misc_feature (1)..(173): Xaa is any amino acid
MMVRNARCHIILCFQVDFNQDLVNAILVLAERGPEVQNSSTVVRARVFSVLVECMQNIRKYGSPTSSSDLKPGIVIVCLDEKGYLLKTGNFIENKEIPNLKDRLDTVIKLGKEELKDLHKKVLGETKLSEKSGAGLGLISIARKSDGMGYMFKTIDAETSFYALDVHISNTTK

SEQ ID NO: 1411 - DNA, 306 bp, Unknown
  Obtained from environmental sample
  misc_feature (1)..(306): n is a, c, g, or t
atgttcatatttctaatacaacaaaataattgtatggaagctctgaaaattgaagccactgtagatactccaggaattattttagacccgaataacaactcgttcgaaatttccgggaaatcttatccggaagatactaaagagttttatcagagtgtactgctttggatggattcgtatgtggcttcccctaatcctaaaactaatttcgttttcaaattaaaatatttcaactcctcatcttacaaacctatttttgatatcctggcaaaactcgaagctatcaaaattaaacacgtgatgtaa

SEQ ID NO: 1412 - protein, 101 aa, Unknown
  Obtained from environmental sample
  misc_feature (1)..(101): Xaa is any amino acid
MFIFLIQQNNCMEALKIEATVDTPGIILDPNNNSFEISGKSYPEDTKEFYQSVLLWMDSYVASPNPKTNFVFKLKYFNSSSYKPIFDILAKLEAIKIKHVM

SEQ ID NO: 1413 - DNA, 585 bp, Unknown
  Obtained from environmental sample
  misc_feature (1)..(585): n is a, c, g, or t
ttgctgatattttcttttttcaaagcccgtatcaaccgtttaagaaaaacacaagcaaaattagaagcgcaggtagctgctaaaacaagagaattgcgtgaagaaaaagaattagtagatgaacaaaataaattaatcgaaaagaaaaattcgagtatcacatcttccatccgttatgcgaaacgtatccaggaatctattttgcctattaaagaaaagctgaatgatctgatcccggaatcatttattttctttaaaccaaaagatattgttagcggtgatttttattggtttacgaattacaaaggcacgatcttgattgcagcggccgattgcacaggtcatggcgtgcccggagcattcatgagtctgatcggaaatagtttgttgaatgatattgtgaagagtcagggtataattgatccattggaaatcctgaaaaaaatgcatgaaggtttggtggctgctttaaagaaaggggaacaggaaagtgacaccgtggatggaatggatattacgctttgtgcgatcaaccaaaaaaataaacatttgaagtatcctcatcaggaagaagtttattgttga

SEQ ID NO: 1414 - protein, 194 aa, Unknown
  Obtained from environmental sample
  misc_feature (1)..(194): Xaa is any amino acid
MLIFSFFKARINRLRKTQAKLEAQVAAKTRELREEKELVDEQNKLIEKKNSSITSSIRYAKRIQESILPIKEKLNDLIPESFIFFKPKDIVSGDFYWFTNYKGTILIAAADCTGHGVPGAFMSLIGNSLLNDIVKSQGIIDPLEILKKMHEGLVAALKKGEQESDTVDGMDITLCAINQKNKHLKYPHQEEVYC

SEQ ID NO: 1415 - DNA, 804 bp, Unknown
  Obtained from environmental sample
  misc_feature (1)..(804): n is a, c, g, or t
atggcaaaaaaagatcaaaagaaaaattctcgccttaagaaagctgtagagaataaaaagaagaaaccaataaaaaaggatgagcagaaaaaaccattgcaagttccaaaagaaatttgtaacagcagcaaacctgtaagcaatactacagctaatattgtacctgttccagaagagaagaaagagcataaggaaaataagataattaactttgaccatctgacaggcaacagttcaataatgaattcgctcgaacaacaaatgcgtcagatctggccttttgcttcgataagaaacaataatacattcgacttatttgaagataatggtgcagcaactccgatattaaaaagcgaggatggaatgccaagcgtttcaactaccgttaatgaaattgcacgtgataagacaaccgagtttagcgctgtgtttagtgagccatatatgtactttttgaaatggcaaccagtatgcgtaaataatgcagttatcggaatgcaggtaagcaaactatttttccatacatactacaagaataaaaagaagtgggcagactttttgcagcgtcttattgatgtaaaagatatttacatttcgccaattcatgacattgcacatttaggtttaagtgtttttgacattggctgctttgatcctttattacttcagcaaattgatatgacgattagagatttgacaaatgatgaaaataaagagcatttacaaaaaatgatagagagcaacgaaacagatccgtttggagatatgtttacagatctaccgccggatgatattgatatgtaa

SEQ ID NO: 1416 - protein, 267 aa, Unknown
  Obtained from environmental sample
  misc_feature (1)..(267): Xaa is any amino acid
MAKKDQKKNSRLKKAVENKKKKPIKKDEQKKPLQVPKEICNSSKPVSNTTANIVPVPEEKKEHKENKIINFDHLTGNSSIMNSLEQQMRQIWPFASIRNNNTFDLFEDNGAATPILKSEDGMPSVSTTVNEIARDKTTEFSAVFSEPYMYFLKWQPVCVNNAVIGMQVSKLFFHTYYKNKKKWADFLQRLIDVKDIYISPIHDIAHLGLSVFDIGCFDPLLLQQIDMTIRDLTNDENKEHLQKMIESNETDPFGDMFTDLPPDDIDM

SEQ ID NO: 1417 - DNA, 471 bp, Unknown
  Obtained from environmental sample
  misc_feature (1)..(471): n is a, c, g, or t
atggatggttatactgcacttccggaaataaaaaaattatatccggatatgaaagttatcatgctttcaatgaataacgatccgtctattattacaagaatgatggagataggagccaattcatatctcacgaaagaatcggattctgaaactatttatcatgccatccgcacctgctttgaacaggaatttttctttaatgatcttaccaacaaagcactgttgaatggtttacggatgaaaaagccaaccgaggcctcattgcccgaagtaaacttgaatgaaaaagaagtaactattcttaaattgatgtgcgaggaaaagagtacaaaagaaattgctgatatcgttgacctaagcccacgtacagtagaggcgattcgtgataaactcaagacaaagacaggagtgaaatcaatggctggtttagtaatgtatgctgttaaagcaggcattgttgaacaagcgtag

SEQ ID NO: 1418 - protein, 156 aa, Unknown
  Obtained from environmental sample
  DOMAIN (90)...(147): Bacterial regulatory proteins, luxR family
  misc_feature (1)..(156): Xaa is any amino acid
MDGYTALPEIKKLYPDMKVIMLSMNNDPSIITRMMEIGANSYLTKESDSETIYHAIRTCFEQEFFFNDLTNKALLNGLRMKKPTEASLPEVNLNEKEVTILKLMCEEKSTKEIADIVDLSPRTVEAIRDKLKTKTGVKSMAGLVMYAVKAGIVEQA

SEQ ID NO: 1419 - DNA, 372 bp, Unknown
  Obtained from environmental sample
  misc_feature (1)..(372): n is a, c, g, or t
atgtctgtatcagattataaattgacagctagttccaacaatgaaacctctaggaacaggacattgaggtacgcattaagaacaatcagatatcagaattcactgatggtgaatgtttgtgatctttcgttaatagataagcaaattcaacatggagatattacgattgacataaaaaagaattactggatggataaggtagcagacgagagcgaaatagaatcgtatttaaaaaaatcatctatttcaaacttggccggaaaagctacagttgataaggcgattgaattgaatcttgcaaagagatcaagtgtcaagtatttttcaaatgttccatttctgatgatatatagattcaggcagtcatattga

SEQ ID NO: 1420 - protein, 123 aa, Unknown
  Obtained from environmental sample
  DOMAIN (26)...(119): Protein of unknown function (DUF424)
  misc_feature (1)..(123): Xaa is any amino acid
MSVSDYKLTASSNNETSRNRTLRYALRTIRYQNSLMVNVCDLSLIDKQIQHGDITIDIKKNYWMDKVADESEIESYLKKSSISNLAGKATVDKAIELNLAKRSSVKYFSNVPFLMIYRFRQSY

SEQ ID NO: 1421 - DNA, 750 bp, Unknown
  Obtained from environmental sample
  misc_feature (1)..(750): n is a, c, g, or t
atgattttccagaatcgtattacaaatttnaaaggaccccttgatatcagaggaatgaccatcagtcaaaccgaaaaaacttttcattatgattcctcttttggttatgatctagcaaagagaacaactaacaagactgaactaaatgtaattgcgaattaccaatatacggtaccagaagaatacattgattcggagttcatttatcttgcaaataatgacccagtgcagaatatgaatatactaaagttattttcaggtccaaagttggtaatctgtgatacgatggatttttggattatcaataagagagacgatgtgatgaagctaataaataaagtagatggaataatgttaaatgaatcagaagccaaattactgttcaaagagaccagcattttaaagtgtgctcgattgctagtatccaatggaccatcttttgcagtaataaataagggagaaaatggatctcttctttttcataacaatgaattctatcctcttccagcatttcctacagaaataataaaggatcctacgggagcaggagattcatttggtggcgcatttatggggtacgtatcgcagcaagaaaaatgggattctatgacattgaagaatgcgatgatacgcgggaacattatgggttctttcacaatagaggattatggaattcagagacttgtcagcataaatgcagaggacatcaacaaaagacatcagaaatataaagaaatatttacattttaa

SEQ ID NO: 1422 - protein, 249 aa, Unknown
  Obtained from environmental sample
  misc_feature (1)..(249): Xaa is any amino acid
MIFQNRITNXKGPLDIRGMTISQTEKTFHYDSSFGYDLAKRTTNKTELNVIANYQYTVPEEYIDSEFIYLANNDPVQNMNILKLFSGPKLVICDTMDFWIINKRDDVMKLINKVDGIMLNESEAKLLFKETSILKCARLLVSNGPSFAVINKGENGSLLFHNNEFYPLPAFPTEIIKDPTGAGDSFGGAFMGYVSQQEKWDSMTLKNAMIRGNIMGSFTIEDYGIQRLVSINAEDINKRHQKYKEIFTF

SEQ ID NO: 1423 - DNA, 366 bp, Unknown
  Obtained from environmental sample
  misc_feature (1)..(366): n is a, c, g, or t
ttgagttattgtaattttgaagtttatattttgcgcggcaacggttcagaattaaaattattaatgaagaatttcccggaatatatcattttcctcactcttatattcttacacttacaggtatctgcccaaaaaaatattgcgcaatacgaagacagtatttttaaagagaacgtcgatcctaatattcatcagtatactgacagcaggccatactatattggccaatggcagaaatcaattccaggtcaatttaaggttataaaaaagattgatgaaagaattgctattattaaagtaaatagtaaaaacgaatttgatcttctcaagcaaaacattaaaatttctcctgcaaataattcgtga

SEQ ID NO: 1424 - protein, 121 aa, Unknown
  Obtained from environmental sample
  misc_feature (1)..(121): Xaa is any amino acid
MSYCNFEVYILRGNGSELKLLMKNFPEYIIFLTLIFLHLQVSAQKNIAQYEDSIFKENVDPNIHQYTDSRPYYIGQWQKSIPGQFKVIKKIDERIAIIKVNSKNEFDLLKQNIKISPANNS

SEQ ID NO: 1425 - DNA, 456 bp, Unknown
  Obtained from environmental sample
  misc_feature (1)..(456): n is a, c, g, or t
atggaaattgccggtaaatataccttcgaagtcccccagcaaatgctctgggaagtgttgcagaatcccaaagcgttgtcgctcatcattccaatggcaatggatatgaaacaagtcgccgacaaccagtacacgggtatgcttttcttcaaagtcggcagcatcgcggggttatttcgtggcaagattgaattgttcaatctgcaagcgccgacaagctatgagatcaaagttcacggcagcagccaggcgggtcgcgttgacatcacaggcggcatacgcctcgaagctgatgacaacaaaacgaccatgtactataagggtgaaatcagctttggtggtcctatcgtttcagtagggtcacgcgtgatcgaagtcgctgttcgctcgattattgagcagagctttgacactctcaatcgctacatgaaattgaagtacaaagcgaaaagctaa

SEQ ID NO: 1426 - protein, 151 aa, Unknown
  Obtained from environmental sample
  DOMAIN (5)...(144): Carbon monoxide dehydrogenase subunit G (CoxG)
  misc_feature (1)..(151): Xaa is any amino acid
MEIAGKYTFEVPQQMLWEVLQNPKALSLIIPMAMDMKQVADNQYTGMLFFKVGSIAGLFRGKIELFNLQAPTSYEIKVHGSSQAGRVDITGGIRLEADDNKTTMYYKGEISFGGPIVSVGSRVIEVAVRSIIEQSFDTLNRYMKLKYKAKS

SEQ ID NO: 1427 - DNA, 552 bp, Unknown
  Obtained from environmental sample
  misc_feature (1)..(552): n is a, c, g, or t
atgccgttgaaggttgtaaattgccgattattgaatatggctgaacgcaacattttaatagtagaggatgagcaaaaaatcgctgacacgttaaaattaggtttaactgagaacggctatcatgtagatgttgcctacgatggatcaataggattaaaattatttgaagcatatccatttaatcttgcggtattggatataaatttaccgggcattaatggctacgaattatgccggcgtataagagctaaaaatgcccacgttccggttatcctgctaacagcgcttagttccctggatgataaaattgaaggatacgattcgggtgctgatgattatattatcaaaccttttgaatttaaagagcttttaatgaaaataagagtgttactgaaacgctcgactcatcaaaacataccaacggggaatgtattaaaagcaggcgacctagaaatgaatcttgatagtaaggaggtaaagcgaaataatgtgatcatccaggttacagcaaaagattccaggtttagaatatctcttacgcaacaaaattaa

SEQ ID NO: 1428 - protein, 183 aa, Unknown
  Obtained from environmental sample
  DOMAIN (16)...(135): Response regulator receiver domain
  misc_feature (1)..(183): Xaa is any amino acid
MPLKVVNCRLLNMAERNILIVEDEQKIADTLKLGLTENGYHVDVAYDGSIGLKLFEAYPFNLAVLDINLPGINGYELCRRIRAKNAHVPVILLTALSSLDDKIEGYDSGADDYIIKPFEFKELLMKIRVLLKRSTHQNIPTGNVLKAGDLEMNLDSKEVKRNNVIIQVTAKDSRFRISLTQQN

SEQ ID NO: 1429 - DNA, 375 bp, Unknown
  Obtained from environmental sample
  misc_feature (1)..(375): n is a, c, g, or t
atgtggaataatcagctgagtcttgaaggttggaagtcgaaaggctgtcagtcaaatattacggttttgaacactgaggaagctcgtaaatttatgcaagggcacagaattaagtctggctgcgttatatttgttgagaaatatgaaagttttttcgagcgcgactcaaaaaatgaaaatctcatcacatcaacaagaaaagcagaaaattcagtcgataacctcaattttcttgttgtagctggtcatgttgtgccgggagtaaaaactacaatcgaagattttttttaccacaaaaacaacgagatgtatggagacatgctagctgatatcaagatcatgacaccattattgaagaaattgatagaaggctaa

SEQ ID NO: 1430 - protein, 124 aa, Unknown
  Obtained from environmental sample
  misc_feature (1)..(124): Xaa is any amino acid
MWNNQLSLEGWKSKGCQSNITVLNTEEARKFMQGHRIKSGCVIFVEKYESFFERDSKNENLITSTRKAENSVDNLNFLVVAGHVVPGVKTTIEDFFYHKNNEMYGDMLADIKIMTPLLKKLIEG

SEQ ID NO: 1431 - DNA, 603 bp, Unknown
  Obtained from environmental sample
  misc_feature (1)..(603): n is a, c, g, or t
atggtaaaattttgtacagcaaagcctttggtacttatgaattcggaccatcatcccccgtcaatgcagaaagtatctttgactggcatctgtcacaagatctctgccacgacgatcgcgatcatgaaattatatgaagaaggtaagcttgacctggaaaaaaaattaggcaactacttgccggtagtaagaggaacgaacaaagcctctttgcttatagatgatatactactccaccaggcgggcctggttccttttatttccttttatagagaaacgattgatacggctaccggtcttcctaaacccggtatttatagcgataagccaaaacccggatttaccatccgggtggcggaacagctttatttgagaaatgattgggaggacaccatcatgaaccgtatactgaaaagcccattaagcgcccgacacaaatacgtttatagcgataacgatcttattttctcgggaacgatcgtcgacgaaatttcaggaatgacattgaaccagtacgtagagaaaaacttctacaggaaaatgggtatgcccactaccgggttcaaaccgaggactcattttgcctcggataaactagtgcnc

SEQ ID NO: 1432 - protein, 201 aa, Unknown
  Obtained from environmental sample
  misc_feature (1)..(201): Xaa is any amino acid
MVKFCTAKPLVLMNSDHHPPSMQKVSLTGICHKISATTIAIMKLYEEGKLDLEKKLGNYLPVVRGTNKASLLIDDILLHQAGLVPFISFYRETIDTATGLPKPGIYSDKPKPGFTIRVAEQLYLRNDWEDTIMNRILKSPLSARHKYVYSDNDLIFSGTIVDEISGMTLNQYVEKNFYRKMGMPTTGFKPRTHFASDKLVX

SEQ ID NO: 1433 - DNA, 774 bp, Unknown
  Obtained from environmental sample
  misc_feature (1)..(774): n is a, c, g, or t
gtgtttttcaattatttgaaaaatgtaaaactaatctcaactggagattattttaaagatttctatgtgataaaggaggaaattccaatcattactcttacttacgagcagttgcaactactaatttttgacacaaaatttagggcatcattgcctaaattcttagaatcatcattggatatttttataataggatgcactgttgcattaagagtctcggatctttttaatctatatcaaaaggatattgaaaaagttggagactattattatcttcaaaatcgttctataaaaacagaaacgaatacaagagttaggctcccagattatgctattacaataattgaaaaatacaataagaaacagggtgcaaaaattaaattgtttcctcaactctcattaaatcaattcaacaataatataaaaataatcgctgagtatgcagggtggactaattctgttggtaaaacacgtagtaagcgtgggaaaatgaatgaggtttacatttcagatgacaagagcagctaccgtttttgtgatttgatttcttctcatgttatgcgccgaactgcggttacaacaatgcttatccttggtatgcctgaacatttggtgagaaagtattccggacatagtaataatagtaaggcattctaccggtatgttaactatgcccaagatttcttagataatgagataaataaggttcatcaaaaaatatcatcaggcaaaatggcaattaattaccaaaatgagttgtctctacacaaataa

SEQ ID NO: 1434 - protein, 257 aa, Unknown
  Obtained from environmental sample
  DOMAIN (33)...(231): Phage integrase family
  misc_feature (1)..(257): Xaa is any amino acid
MFFNYLKNVKLISTGDYFKDFYVIKEEIPIITLTYEQLQLLIFDTKFRASLPKFLESSLDIFIIGCTVALRVSDLFNLYQKDIEKVGDYYYLQNRSIKTETNTRVRLPDYAITIIEKYNKKQGAKIKLFPQLSLNQFNNNIKIIAEYAGWTNSVGKTRSKRGKMNEVYISDDKSSYRFCDLISSHVMRRTAVTTMLILGMPEHLVRKYSGHSNNSKAFYRYVNYAQDFLDNEINKVHQKISSGKMAINYQNELSLHK

SEQ ID NO: 1435 - DNA, 489 bp, Unknown
  Obtained from environmental sample
  misc_feature (1)..(489): n is a, c, g, or t
atggcaaaagccggtcaaaaagaagaaatgcctgtgctcgataaaaccgacctggccatactcaaactcctgcagcaaaatgccaggatcaccatcaaggaaatttccgataaggtccacctcagcactactcctgttcacgagcggatccgtcgaatggaggagcagggcgtgatccgtcaatatgccaccctgctcaacggggccaaggtaaaaaaaggactgatggtgatctgttatgtatccctgaagcaacacagtaaaaatgcaggggataaattcattaaatccatcatggagctgaacgaagtggtggaatgcctgaccatttcaggtgagttcgatttcatgctcaaggtggttacggagaatatggatgcctattacgattttcatgtaaacaggctgagtcagatcgagaacatgggaaatatccagagtgtgttcgtgatgggagtgatcaaacaaacgcaccagctggtgttttag

SEQ ID NO: 1436 - protein, 162 aa, Unknown
  Obtained from environmental sample
  DOMAIN (37)...(140): AsnC family
  misc_feature (1)..(162): Xaa is any amino acid
MAKAGQKEEMPVLDKTDLAILKLLQQNARITIKEISDKVHLSTTPVHERIRRMEEQGVIRQYATLLNGAKVKKGLMVICYVSLKQHSKNAGDKFIKSIMELNEVVECLTISGEFDFMLKVVTENMDAYYDFHVNRLSQIENMGNIQSVFVMGVIKQTHQLVF

SEQ ID NO: 1437 - DNA, 339 bp, Unknown
  Obtained from environmental sample
  misc_feature (1)..(339): n is a, c, g, or t
gtgaatatattattggataggtattttgattatgaaggaatatctgaagaatatacacagaaggctattaaggatgatgaaggaattttgaaatatcttaaagtagatacccatataacaagatctgtaagacaggatataaatcttataacagaatttttccaaaaacagaaaacagaacctagtaagaaaatgacagttccagaatttatagaaaccgctattagagtttatttaatggaaaatcccgaaatagaggaatatgtaaataatgaaaagaaaaatatggtgcagaaaatagctatacgtgaaataaaaagaagaaaaacgggttattga

SEQ ID NO: 1438 - protein, 112 aa, Unknown
  Obtained from environmental sample
  misc_feature (1)..(112): Xaa is any amino acid
MNILLDRYFDYEGISEEYTQKAIKDDEGILKYLKVDTHITRSVRQDINLITEFFQKQKTEPSKKMTVPEFIETAIRVYLMENPEIEEYVNNEKKNMVQKIAIREIKRRKTGY

SEQ ID NO: 1439 - DNA, 348 bp, Unknown
  Obtained from environmental sample
  misc_feature (1)..(348): n is a, c, g, or t
ttgaattgtattaccagaacgtggcatacgtttatcggatcaaaacaaactattaggnatatgttttgcgtgggccacgactggctgaaggtgtacaatgaggccagtaaggagaacctgattgagcgtctcccgaaagtgaattgtcctgtttatttttttgccggacgaaaagattatcaaacgaattccaccattacggagctttattacaacaagctgatcgcccctaagaaaggatttttctggtttgaaaaatcagcgcatgcagtgccaaccaccgagcctgagcttttacaggagacggttattaataaagttttggctgagactttttcgggattgtaa

SEQ ID NO: 1440 - protein, 115 aa, Unknown
  Obtained from environmental sample
  misc_feature (1)..(115): Xaa is any amino acid
MNCITRTWHTFIGSKQTIRXMFCVGHDWLKVYNEASKENLIERLPKVNCPVYFFAGRKDYQTNSTITELYYNKLIAPKKGFFWFEKSAHAVPTTEPELLQETVINKVLAETFSGL

SEQ ID NO: 1441 - DNA, 366 bp, Unknown
  Obtained from environmental sample
  misc_feature (1)..(366): n is a, c, g, or t
ttgtttgtgattaccattctctctgcaattattagtggtattgtgattgatgcttttaatgccattcgcgataaacactctgatattcaagaagatatgaagaataaatgctttatctgtagtcttgataattctgtttttgatcgacatgctgaaggatttacaaaacatattgaagtagaacataatatgtggcattatttattcttttggctttatttggcaattaaagaagagtctgaatataattcccaagaagcttatatttcaacaatggtgaaagatcgagacatggcgttttttccagtgtcaagggcaatgtgtttggaaagtaaaggaattgatcttaaaaaagaaaaagattaa

SEQ ID NO: 1442 - protein, 121 aa, Unknown
  Obtained from environmental sample
  misc_feature (1)..(121): Xaa is any amino acid
MFVITILSAIISGIVIDAFNAIRDKHSDIQEDMKNKCFICSLDNSVFDRHAEGFTKHIEVEHNMWHYLFFWLYLAIKEESEYNSQEAYISTMVKDRDMAFFPVSRAMCLESKGIDLKKEKD

SEQ ID NO: 1443 - DNA, 594 bp, Unknown
  Obtained from environmental sample
  misc_feature (1)..(594): n is a, c, g, or t
ttggttcaattagaacctgatgaaagagagcagtatttgaaagagcatccttatgaaaagatttctaaagagtccaggtacttgcataaatatgtttctcggcttataacctctcgtacatacttcatgttgggcattcaggaggaagcaagactttataataaaatcacagttccttataaatgtaatacagctcaattgtcaaaaacattgcaccggctttgcctagataaattaattgagttcattggtgagtttcagataaaagagctaccggaggaagataaggttaagaaccttattgaccaatacaatgccattcataatactaagcttcctgaaatagagatgacgaggttttatacaaagcttaaagaggtcggatcatttaaagagacggcaaggttttataactattcaagagcgtctctttacaggtataaagcatggtttaagaaagttggaataacagaaactaatgttttaccagtgacagatgtaggcgttccaagtgcaccaattgacatggttcaatatcattccattgttagttacaatcccagttttataaaatcaaattcattaatcttctaa

SEQ ID NO: 1444 - protein, 197 aa, Unknown
  Obtained from environmental sample
  misc_feature (1)..(197): Xaa is any amino acid
MVQLEPDEREQYLKEHPYEKISKESRYLHKYVSRLITSRTYFMLGIQEEARLYNKITVPYKCNTAQLSKTLHRLCLDKLIEFIGEFQIKELPEEDKVKNLIDQYNAIHNTKLPEIEMTRFYTKLKEVGSFKETARFYNYSRASLYRYKAWFKKVGITETNVLPVTDVGVPSAPIDMVQYHSIVSYNPSFIKSNSLIF

SEQ ID NO: 1445 - DNA, 435 bp, Unknown
  Obtained from environmental sample
  misc_feature (1)..(435): n is a, c, g, or t
atgaaatttaactggggtaaagggatatcgctcgtaatagttctcttcataatgggaatggcactgatggtatatatttccgttacgaagaacattgacctggttactccaaactattacgataaagagatcaaataccaggaacagatcaataaaataaacaatacaaacggtctgaaagagcagcttaagattcagtactccgaaggaaacctgctgttttcttttccttcagaaggcagtcccgaaggcagtatctcattctacaggccttctgatgcaaagaaagattttcacatgcccataaagataaatgaggaatttaaacagcaaattggtactgataaacttcaaaaagggctttggcgtgtgcaggttgagtggagtatgaacgggaaagaatatttcaacgaagaaaaaataatgatccagtaa

SEQ ID NO: 1446 - protein, 144 aa, Unknown
  Obtained from environmental sample
  misc_feature (1)..(144): Xaa is any amino acid
MKFNWGKGISLVIVLFIMGMALMVYISVTKNIDLVTPNYYDKEIKYQEQINKINNTNGLKEQLKIQYSEGNLLFSFPSEGSPEGSISFYRPSDAKKDFHMPIKINEEFKQQIGTDKLQKGLWRVQVEWSMNGKEYFNEEKIMIQ

SEQ ID NO: 1447 - DNA, 336 bp, Unknown
  Obtained from environmental sample
  misc_feature (1)..(336): n is a, c, g, or t
ttgaagaccccgcccattagggtaattcggccgttaatctcagttgaaattaaagaccccctggcatcgtgggaatgggacattatttgcaccatgcaaccgttaactttaacactgtgcccattgaacttgacgaagcattgttttaaatcggaaaatatggtgtcccttatgtgttcaaaacgtgttggaaaacgttggaccttcaaaacgttcctgaggtatcggtttaaatggaacgtattgaccctttgggacgaaattattagtgtcgggttatgcgtacacttagagggttcacagaaacttggaacatatatgtgtttccccaactga

SEQ ID NO: 1448 - protein, 111 aa, Unknown
  Obtained from environmental sample
  misc_feature (1)..(111): Xaa is any amino acid
MKTPPIRVIRPLISVEIKDPLASWEWDIICTMQPLTLTLCPLNLTKHCFKSENMVSLMCSKRVGKRWTFKTFLRYRFKWNVLTLWDEIISVGLCVHLEGSQKLGTYMCFPN

SEQ ID NO: 1449 - DNA, 471 bp, Unknown
  Obtained from environmental sample
  misc_feature (1)..(471): n is a, c, g, or t
ttgtatagtcatacaatggcaattaacatgaatagaagtacatttctaaaagcatctgccgccatgggaataacaagcgttgctttaccatcattgcttaaagcatatcacataagtgacgattacgaagatatgaagtgtaagaagattctaaaatctttcgatgcttcacttgaaaatatgtcggtaaatgatgtgataattgaagtaggtaaatcatttttagcagtgccatatgtagcgggaacgcttgatacaaatccgaataaggaaagattaattgtgtatgtatccggacttgactgcgttaccttctgcgaaaatgctctcacaatgtcgcgcataataaagcagggtgatacgagcttcgataactataaaaaggagctgactaagataagatacagagacggagtacttgacggatatccgtcgcggctccagtatttctcggactggatttacggataa

SEQ ID NO: 1450 - protein, 156 aa, Unknown
  Obtained from environmental sample
  misc_feature (1)..(156): Xaa is any amino acid
MYSHTMAINMNRSTFLKASAAMGITSVALPSLLKAYHISDDYEDMKCKKILKSFDASLENMSVNDVIIEVGKSFLAVPYVAGTLDTNPNKERLIVYVSGLDCVTFCENALTMSRIIKQGDTSFDNYKKELTKIRYRDGVLDGYPSRLQYFSDWIYG

SEQ ID NO: 1451 - DNA, 510 bp, Unknown
  Obtained from environmental sample
  misc_feature (1)..(510): n is a, c, g, or t
atgagagtcctatttatatcaagagcaacattgttttccaacaaaggaggtgatacaatccaggtaaccaatacagcaaaacatttaattgcaacaggagtaactgtggatgtcaggttatgtaatgaagaaatcaagtatgaaggttatgacctaattcacttttttaatattattcgcccttcagatattttgtttcacattaaaaaatcaaatcttccttttgtcatttcaactatctacgtggattatactgattatgaaaaaaggagccgaaaaggaattgcgggattggctttcaaactactctcgcaggattttattgaatattgtaaagttattgcacgggcattggtaaataaagaaagaattatcagtccttcctatttacttatgggccataaggcggccgttaaacaaatcatcagaaagtcgcattgcttcttcccaactctgaaaatgatatcagcgactgtcaaaccattttcagatccatctacacatcagtag

SEQ ID NO: 1452 - protein, 169 aa, Unknown
  Obtained from environmental sample
  misc_feature (1)..(169): Xaa is any amino acid
MRVLFISRATLFSNKGGDTIQVTNTAKHLIATGVTVDVRLCNEEIKYEGYDLIHFFNIIRPSDILFHIKKSNLPFVISTIYVDYTDYEKRSRKGIAGLAFKLLSQDFIEYCKVIARALVNKERIISPSYLLMGHKAAVKQIIRKSHCFFPTLKMISATVKPFSDPSTHQ

SEQ ID NO: 1453 - DNA, 690 bp, Unknown
  Obtained from environmental sample
  misc_feature (1)..(690): n is a, c, g, or t
gtggacaagaatgcctgtaagaagttagaagacgaagaattattaagaataacatcttccaggtcggcagcggaatattgctggacgtgcacgccttcggtcattgcattttgtattgaaaaatacaacctgccttcctgtacttatgtggatgctgacatgatcttctattcagatcctcttgtgcttattgaagaaatgaaagacagacctattttgattagtgaacatcgctatacaaaagactatgatcagtctaaaaaaagtggtctttattgtgtacagttcatgtgtttcaagaacgatgtgcaaggcttgaaggcattacattggtggagggaacgttgtattgaatggtgctatgcacggtatgagaatgggaagtttggcgatcaaaaatacctggatgattggttaacacgttttgaaggagtgcatgttttacaacatccaggtggaggcattgctccatggaatttgcaacaatttcgatttattaaaaaagatagttccatatttattgaggaaaagaaatcaggtgtaatgtatccccttatattttttcattttcatggagtaaagttctacaacgacaattacatatcctgttgtgaagcattgtatcaaattgatgaaaaaacaaaaagaaattatctatttaccttacttcaaaaatttaatacacattga

SEQ ID NO: 1454 - protein, 229 aa, Unknown
  Obtained from environmental sample
  misc_feature (1)..(229): Xaa is any amino acid
MDKNACKKLEDEELLRITSSRSAAEYCWTCTPSVIAFCIEKYNLPSCTYVDADMIFYSDPLVLIEEMKDRPILISEHRYTKDYDQSKKSGLYCVQFMCFKNDVQGLKALHWWRERCIEWCYARYENGKFGDQKYLDDWLTRFEGVHVLQHPGGGIAPWNLQQFRFIKKDSSIFIEEKKSGVMYPLIFFHFHGVKFYNDNYISCCEALYQIDEKTKRNYLFTLLQKFNTH

SEQ ID NO: 1455 - DNA, 582 bp, Unknown
  Obtained from environmental sample
  misc_feature (1)..(582): n is a, c, g, or t
atgaatatctatgcttacttagccatagcttttatcgtagtaactatcgtttattttgtttttatttataataatttggttaccctcaaaaacaatgtatttaaatctttttccaacatagatgttttgttaaagcaacgtcatgaagaattgccaaaacttgttgaaacatgcaaacaatatatgggctttgaaaaagataccctcattaaaataactgaagctcgaggttctgttatgtcggcattacaggcaggtgatatcgcggcacttggcaaagctgaaggcaccttacggaaaggcttaatgaacctatttgctgtcgctgaaaattaccccgatttaaaaacgaatacgacttttattcacttacaagacagaatttctatgcttgaaaatagcattgccgatcggagagaagtatataatgatgcaaccacactgaataatattcgaatagagcaatttccagacgtgcttgttgctaaattaacgggctttaaaaaacaaattctactagagttttcagaagaagaaactggtccaatagacntaaagaaattatttgaacaaccatgctaa

SEQ ID NO: 1456 - protein, 193 aa, Unknown
  Obtained from environmental sample
  DOMAIN (3)...(189): LemA family
  misc_feature (1)..(193): Xaa is any amino acid
MNIYAYLAIAFIVVTIVYFVFIYNNLVTLKNNVFKSFSNIDVLLKQRHEELPKLVETCKQYMGFEKDTLIKITEARGSVMSALQAGDIAALGKAEGTLRKGLMNLFAVAENYPDLKTNTTFIHLQDRISMLENSIADRREVYNDATTLNNIRIEQFPDVLVAKLTGFKKQILLEFSEEETGPIDXKKLFEQPC

SEQ ID NO: 1457 - DNA, 438 bp, Unknown
  Obtained from environmental sample
  misc_feature (1)..(438): n is a, c, g, or t
gtgcttaataataacctggtttcagatcagaagttgggaatcgaattctctgaaaaggacaaattccaatccttgcttaatacccttaagggatgtgaggagtttgttttggattcatcaggggtaattgtaagcagtaacctggaagctgttaccattactggttatgaagaatgggaagtaattggtaaacatatctcatttctgtactcaatagaagaccaacaaattaataaagcagaggccgacttgcttaagaccgctaaacttggcaagtatatcagtagtggatttagaattaaaaaaagaggcgaccggttttgggctaagatgaaattttttgcccttgcaaacaacggtgaagtggccgcgtatcgggtaacactcaccgactctacacatcgtgccatgtataccatgagcacgaaaacgaattaa

SEQ ID NO: 1458 - protein, 145 aa, Unknown
  Obtained from environmental sample
  misc_feature (1)..(145): Xaa is any amino acid
MLNNNLVSDQKLGIEFSEKDKFQSLLNTLKGCEEFVLDSSGVIVSSNLEAVTITGYEEWEVIGKHISFLYSIEDQQINKAEADLLKTAKLGKYISSGFRIKKRGDRFWAKMKFFALANNGEVAAYRVTLTDSTHRAMYTMSTKTN

SEQ ID NO: 1459 - DNA, 660 bp, Unknown
  Obtained from environmental sample
  misc_feature (1)..(660): n is a, c, g, or t
ttgaagagcgcgttggctgtcgatttaaggcagtgggaagtagcaaaaacaatcattaatcatttatataaaacaaatgcaaacaacccatatatatttgatctgctttttctgctataccgaaagatggaaaaatcgcaagatttactggctttgctacccaagttaaaaaaccagaaaataatacttgaaaaaaaatatttaaaaaaaattaaagaaatatacatctctaatgtttatgacatgatgaaactacataaaacaacttgcgcaccaccgaaagcactactagaagattcagcagtaataaatgtttattgtcaatttctaatacagcaaaaacaatatacgaaagcagaatccttgttaagaaaaattttgcaaaaaaaaatggatgacgagagcataatgctatatggactaattccttattatagaaaacaattcgaatttgttgaatcccttattaagaaaaacccactatcttcaaccttatatctttgtttaggtaagttaagtatgtctaatgaattgtggggaaaagcaaaaaaatacttgaagaaaagtttattaattgaaaaaaatacagttacttttgcctgcttaggcaaactttatgaacaacttaatgataacaagactgcctaccatttattatag

SEQ ID NO: 1460 - protein, 219 aa, Unknown
  Obtained from environmental sample
  misc_feature (1)..(219): Xaa is any amino acid
MKSALAVDLRQWEVAKTIINHLYKTNANNPYIFDLLFLLYRKMEKSQDLLALLPKLKNQKIILEKKYLKKIKEIYISNVYDMMKLHKTTCAPPKALLEDSAVINVYCQFLIQQKQYTKAESLLRKILQKKMDDESIMLYGLIPYYRKQFEFVESLIKKNPLSSTLYLCLGKLSMSNELWGKAKKYLKKSLLIEKNTVTFACLGKLYEQLNDNKTAYHLL

SEQ ID NO: 1461 - DNA, 810 bp, Unknown
  Obtained from environmental sample
  misc_feature (1)..(810): n is a, c, g, or t
atgaaaaagtttcttatattctgtctatttttgttcctgaataaaccgctcatttcgcaggataatatctatgttaaagatttcgtctttttctgggaaacctttagggataattacggatattttgaaaacaaacagaccgactggaacaaagtaaaggagatttaccttcccgaagctcaaaaaatcagtaacaagaatgatttcatttcattgcttgaaaatgttattggcgagctctacgataatcacactcatcttcttactaatctttcatcttcataccggctttcaccttcagggctggatatctggccagagcttgaaaacaacaaatacatagttaaagaagtacgtgccggctcaggtagtgagctatgcggaataaaacccggaatggaaattactcatataaatgatctggcaatcaatgatgcaatattgcagattacggggaaaacaataatcaatccgggcaaagaagttaaggaatgggcaataagaacattgcttgccggtaattataaaactaaaagggtcttgaagttgaattataacggtgaggagttaaccaaagagccggatacagaaaaagatacttacagttattttacgtacgattcaaatatcagatcaaaaattctggaaaacaatatcggttatattgcaataaataactccctgggtgatgaaaacacggtgcaaatgtttgatagtgtgctgaactcaatgcggggtacccggggactgataatcgatctcagggaaacaccgggtggagggcattcagtagttgcaaggggattatga

SEQ ID NO: 1462 - protein, 269 aa, Unknown
  Obtained from environmental sample
  SIGNAL (1)...(19)
  misc_feature (1)..(269): Xaa is any amino acid
MKKFLIFCLFLFLNKPLISQDNIYVKDFVFFWETFRDNYGYFENKQTDWNKVKEIYLPEAQKISNKNDFISLLENVIGELYDNHTHLLTNLSSSYRLSPSGLDIWPELENNKYIVKEVRAGSGSELCGIKPGMEITHINDLAINDAILQITGKTIINPGKEVKEWAIRTLLAGNYKTKRVLKLNYNGEELTKEPDTEKDTYSYFTYDSNIRSKILENNIGYIAINNSLGDENTVQMFDSVLNSMRGTRGLIIDLRETPGGGHSVVARGL

SEQ ID NO: 1463 - DNA, 723 bp, Unknown
  Obtained from environmental sample
  misc_feature (1)..(723): n is a, c, g, or t
atgtttaaccctgccgatatggttgacaacaaagacaagccaaaagtatacattactgacttcaaagtttttaataagccagttcccatcggggagaacgagttgctgaagacaaatatcctcctcacaaaagaagtaacattgagttattctcagaatattttttcattcgagtttactgcgctcaactatcgacagtccgaaaaaaatcgatacaaatacatgatggagggttttcaggacgaatggattgacgctggatcagagcgaaaagtgtcctatacaaacctgagtcccggtgagtatgttttccgcgttgttgcctccaataatgatggtttgtggaacatggaaggagcatctataaagattactattgtaccgccattctggcgaacgtggtggtttatcacaatcgttacatgcgccctttgctttggatcaatctattatttccgtcatcaaaagaaaaaagctgaccgtcaggaggaagaattaaaggcgatcatcgaggcacggaccagtgaagtgcaaaaacaaagtgaagcgatcttgaaaaagaatgaacaggagaaatttcaaaactggatcacacaaggactggcaacgttcggggaaattattagcaagcataaaggcagcctggacgaattgtccagggagatcttgcggcattttagtccgctatgttcatgcggaccagggtacgatttctatagctaa

SEQ ID NO: 1464 - protein, 240 aa, Unknown
  Obtained from environmental sample
  DOMAIN (72)...(110): Two component regulator three Y motif
  misc_feature (1)..(240): Xaa is any amino acid
MFNPADMVDNKDKPKVYITDFKVFNKPVPIGENELLKTNILLTKEVTLSYSQNIFSFEFTALNYRQSEKNRYKYMMEGFQDEWIDAGSERKVSYTNLSPGEYVFRVVASNNDGLWNMEGASIKITIVPPFWRTWWFITIVTCALCFGSIYYFRHQKKKADRQEEELKAIIEARTSEVQKQSEAILKKNEQEKFQNWITQGLATFGEIISKHKGSLDELSREILRHFSPLCSCGPGYDFYS

SEQ ID NO: 1465 - DNA, 561 bp, Unknown
  Obtained from environmental sample
  misc_feature (1)..(561): n is a, c, g, or t
ttgcctgcgttcccaatttttattaattgttgtaacccggcaattaaagcctacgtcaaaataataaacacacccaaaatgaaatgtttattgttttgcctcctgttattgaattctttgtttgtcttcgctaaaaaaaatgctgattcattatatattacaacaacggatagcgttcggctatttgtaaaaaaagccggtaaaggaacaccagtcctttttattcatggtggaccaggctctaattcagcttactttgaaaaagaaggcggaaacgtttttgaaaaagatgtacagataatctacctcgatcagcgtggttgtggccgttcaggaaatgctgtaaacaaagattattcattaaaaagaatgatccttgattttgaagaagtacgtaaagcgctgggttttaaaagctggatcatcatgcctcattcttttgggggtatccttgggaatgaatatgctcttcggcatccaaaaaaaattaaagcaatggttatgctaaatggcacattgcatgttgcttcatcagcaaacagtgggattgaaaaaccatag

SEQ ID NO: 1466 - protein, 186 aa, Unknown
  Obtained from environmental sample
  misc_feature (1)..(186): Xaa is any amino acid
MPAFPIFINCCNPAIKAYVKIINTPKMKCLLFCLLLLNSLFVFAKKNADSLYITTTDSVRLFVKKAGKGTPVLFIHGGPGSNSAYFEKEGGNVFEKDVQIIYLDQRGCGRSGNAVNKDYSLKRMILDFEEVRKALGFKSWIIMPHSFGGILGNEYALRHPKKIKAMVMLNGTLHVASSANSGIEKP

SEQ ID NO: 1467 - DNA, 309 bp, Unknown
  Obtained from environmental sample
  misc_feature (1)..(309): n is a, c, g, or t
ttgtgggccagcaccagcactaaagacccatcatttagtgatgtgaaatatgtagaagctttgataggccctgaaacaatcaataccattccgttagaaacactggaagcttttaatgatcatggaaagccaggaaataacctggagagcgatatggataaggcaacgagtgtgttggcacaattaaataccagaggtattgacatcaatattattactcaaaagctggaagatgagggcattgaaaaatttaataaagcttatgataagcttttagaagctattgaaaaaaagcaagtggtccattaa

SEQ ID NO: 1468 - protein, 102 aa, Unknown
  Obtained from environmental sample
  misc_feature (1)..(102): Xaa is any amino acid
MWASTSTKDPSFSDVKYVEALIGPETINTIPLETLEAFNDHGKPGNNLESDMDKATSVLAQLNTRGIDINIITQKLEDEGIEKFNKAYDKLLEAIEKKQVVH

SEQ ID NO: 1469 - DNA, 360 bp, Unknown
  Obtained from environmental sample
  misc_feature (1)..(360): n is a, c, g, or t
atgattttttcaaaatcctttggttatgcagttcgcggggtgctatatatagcactgatgcaggatgagaaaaaatttgtccatgtggaggagatcgcgcggaaactttcagttccgaggcatttcatgggaaaaattttgaagcgactggtaaaagagaatgttatcaattcatccaaaggtccaatgggaggttttacgattaatgaacgaaccctgaatgtgccgctgatggagctgattactattattgatggaatggagagcttcaaaagttgtgtattaagacttaaagaatgcaatccagataatccatgtccgcttcacaaacagatggtgccatttccaggacgagcttaa

SEQ ID NO: 1470 - protein, 119 aa, Unknown
  Obtained from environmental sample
  DOMAIN (1)...(116): Transcriptional regulator
  misc_feature (1)..(119): Xaa is any amino acid
MIFSKSFGYAVRGVLYIALMQDEKKFVHVEEIARKLSVPRHFMGKILKRLVKENVINSSKGPMGGFTINERTLNVPLMELITIIDGMESFKSCVLRLKECNPDNPCPLHKQMVPFPGRA

SEQ ID NO: 1471 - DNA, 381 bp, Unknown
  Obtained from environmental sample
  misc_feature (1)..(381): n is a, c, g, or t
atgttaagtgccaggaacattgaaaagtattacggtaagcttcatgtgctgaaatccgtgaatattgatattaaaaaaggagagatcgttagcattgttggctcctccggggcaggtaaaagcacttttttgcacatccttggcacactggataagcccgggaaaggagaggtcatgctgcacgagcagcgtgtagaccgattgtcgggaaacgccttatctaaattccgaaacaaaaatatcgggttcattttccagtttcatcatttattacctgaatttacggcgctggaaaatgtttgtatcccgggttggatcgcgggaagcaggaagaaggaaaccgaacaacgggcgattgaattactgacaaccctcggttga

SEQ ID NO: 1472 - protein, 126 aa, Unknown
  Obtained from environmental sample
  misc_feature (1)..(126): Xaa is any amino acid
MLSARNIEKYYGKLHVLKSVNIDIKKGEIVSIVGSSGAGKSTFLHILGTLDKPGKGEVMLHEQRVDRLSGNALSKFRNKNIGFIFQFHHLLPEFTALENVCIPGWIAGSRKKETEQRAIELLTTLG

SEQ ID NO: 1473 - DNA, 333 bp, Unknown
  Obtained from environmental sample
  misc_feature (1)..(333): n is a, c, g, or t
gtgaatatttctcatcctcaatatgaggagcaatacggagttgtgaacaagactttgcaggaactacattcatttgacaagcccacaataaccatttttaataagatggatctgtacgaaaaaaacacttttgatgaatggctgcctggtaatattaaggaagaaattttagatgaattgaaagataaatggcaaagggaaacaaacggaaattgtgtatttgtttctgcaactgaaagaaaaaatatcgaatcacttcgacaggtaattctaaacaaagtaagaggtatttaccaggaaaggtatccttacaaagccgagttttacttttaa

SEQ ID NO: 1474 - protein, 110 aa, Unknown
  Obtained from environmental sample
  misc_feature (1)..(110): Xaa is any amino acid
MNISHPQYEEQYGVVNKTLQELHSFDKPTITIFNKMDLYEKNTFDEWLPGNIKEEILDELKDKWQRETNGNCVFVSATERKNIESLRQVILNKVRGIYQERYPYKAEFYF

SEQ ID NO: 1475 - DNA, 348 bp, Unknown
  Obtained from environmental sample
  misc_feature (1)..(348): n is a, c, g, or t
ttgcaaccgcgcgtggttctgctttgcctcggcggaaacgacggcttgcagcaacttccaatggacaaaacgttcgccaacctttccgccatcatcgaccgctttcatgagagcggaagttttgtggtgttgattggcgtccgcagtgcatctgtgcgggataaatacagcaagtcgttcaagaaactggccggtgagaaaaaagttttgtacgtgccgaacattttaagcggtgtcctcggctcgcccaatttaatgtccgattacattcatccgaatgacgacggttacaaagccattgcggatcggttggagaaaattttgaaaccggttttgccgcaactttga

SEQ ID NO: 1476 - protein, 115 aa, Unknown
  Obtained from environmental sample
  misc_feature (1)..(115): Xaa is any amino acid
MQPRVVLLCLGGNDGLQQLPMDKTFANLSAIIDRFHESGSFVVLIGVRSASVRDKYSKSFKKLAGEKKVLYVPNILSGVLGSPNLMSDYIHPNDDGYKAIADRLEKILKPVLPQL

SEQ ID NO: 1477 - DNA, 348 bp, Unknown
  Obtained from environmental sample
  misc_feature (1)..(348): n is a, c, g, or t
atggaaaagcgccttgcttgttatatttttcggctagttcttcatttcttttcacctggtcctttggcaactggtgtatttttaacctgggaaaatcagcatggagtaacaccaggtgatcttttgcataattggcgaaactttctttttcaagaaatttctttttccattttaatgcatggaatacaccagtccgaaccactgaaaacaagcaaaatgtatttatggttctctttggcatgcaactcagctaacgttaaatcgggtgattgcgaatttgctaaaaaagagcaaaagctaattattgataaaagtaaaatcttcctcattttaatatttgaaacttga

SEQ ID NO: 1478 - protein, 115 aa, Unknown
  Obtained from environmental sample
  misc_feature (1)..(115): Xaa is any amino acid
MEKRLACYIFRLVLHFFSPGPLATGVFLTWENQHGVTPGDLLHNWRNFLFQEISFSILMHGIHQSEPLKTSKMYLWFSLACNSANVKSGDCEFAKKEQKLIIDKSKIFLILIFET

SEQ ID NO: 1479 - DNA, 411 bp, Unknown
  Obtained from environmental sample
  misc_feature (1)..(411): n is a, c, g, or t
atgcaagctatgacagaacagagaaagtctgagttgctggattatacattaagaaatactcccattcacattttcaatgcctcaatcaaaagcttcgatcataagagcatatactattataaccgcaatatgatgttatcagctataccggattttgacaattcaaaactttggttttcggtaatcatgtccgatgtatttcgcccatttgcgattgattatatccgctgtgaagaactatcaagtcaaatctccaaacttaaacgtgtgtatacgctttacaataagtatcatccgaaaagagctgaagtgattcaaaaacacaacgaattggtgattgagtttaataccctaatcgcgccacaaaaaaaacttattaaaacatatcgaaagattttgagagaaaattaa

SEQ ID NO: 1480 - protein, 136 aa, Unknown
  Obtained from environmental sample
  misc_feature (1)..(136): Xaa is any amino acid
MQAMTEQRKSELLDYTLRNTPIHIFNASIKSFDHKSIYYYNRNMMLSAIPDFDNSKLWFSVIMSDVFRPFAIDYIRCEELSSQISKLKRVYTLYNKYHPKRAEVIQKHNELVIEFNTLIAPQKKLIKTYRKILREN

SEQ ID NO: 1481 - DNA, 693 bp, Unknown
  Obtained from environmental sample
  misc_feature (1)..(693): n is a, c, g, or t
atgaatcccggcttgcttgatcttatcctgttttcagagaagagaaaagattttctcctgctcctgaaagaaggccctaagaatattgaagagatacttgagaagcttcaggtgcctaggacagctcttcttccacaggtaaagaagttgaaagaagaggatctggtaatacgtgaagaaggaatataccggctcagcacgataggggaaattgttgtagaaaaaatgcagcccctgcttgatactttgtcagtatttgagacaaatgaagagttttgggccgatagaaagcttgcccctattccaccccacctcataaaaaggattagtgagcttggagattatcgcgttatagaaccggacctcagccacacttttgacctgaacgaagaatttgtaaaaaatctttccagttcaagctatgtgcacatgttttgttcttatttccatcctcattttccgactctttttctcaaccttgcaagaaaaggtattgaagtttcccttattttgagtgaagctgtatacttacggctcgtagaagatttcanagaagagggaaaagaactcctcagtacaaaaaattcaagcctttatattctggaaaaaaaagaagtgaacactcctgcgctcgttgctgccgctaacagggtaataagtctgggaatatttaacgagagcggaaagatttga

SEQ ID NO: 1482 - protein, 230 aa, Unknown
  Obtained from environmental sample
  misc_feature (1)..(230): Xaa is any amino acid
MNPGLLDLILFSEKRKDFLLLLKEGPKNIEEILEKLQVPRTALLPQVKKLKEEDLVIREEGIYRLSTIGEIVVEKMQPLLDTLSVFETNEEFWADRKLAPIPPHLIKRISELGDYRVIEPDLSHTFDLNEEFVKNLSSSSYVHMFCSYFHPHFPTLFLNLARKGIEVSLILSEAVYLRLVEDFXEEGKELLSTKNSSLYILEKKEVNTPALVAAANRVISLGIFNESGKI

SEQ ID NO: 1483 - DNA, 852 bp, Unknown
  Obtained from environmental sample
  misc_feature (1)..(852): n is a, c, g, or t
ttgcaatttcgggggtttatccctggagacgatacgcaaaaattcgattacggcacagaaattgagccatccatcgaagtaattgaagatttacttggtcctgtaaaagaagtcggaatctcaaaaagagctatttcactcctgctgctccaggaagacaggacagcccttgaatacctgtcaagggctgaaaaatccttcaaatgtgagaacgaaggtcacaaaaacagctacgaagaaatccagaaacttgcagaagcagcctcaaggatatctgcagttcctctttcctacctgttcaccctgaaacgccaggagcgtgtaaacggaattgtagaacaggtaatgaagatgcctgagaggatagagagaaaaagcagtgggaacgccggaatattcggaataaagaaaggcaatgtaaatgccggaacactgggaacaaaggaaggcaatgggaaaccctggatgacaggggcagataaaggcactgggaaaaaagaaaattatacctgcatttcgcgggagaaaacaaaatccgaactgagaacaaaccgagctggaagtagcgagaatataaaaaaacaaaagagaaggatcgatttctccgataaaatcgacagtattctcatccatcctgtgcttgggatacctgtgctgtttttagtcctgtattttgggctctatctattcgtgggtgtgtttgcagcaggaacgattgttgattttctggaaaatacgatctttggagcatatataaatccctttgtaactgcaaagtttatctcgtttgtaccctacccggttttgcaggatctttttggggagaatacgggattttaccccaggccgtga

SEQ ID NO: 1484 - protein, 283 aa, Unknown
  Obtained from environmental sample
  misc_feature (1)..(283): Xaa is any amino acid
MQFRGFIPGDDTQKFDYGTEIEPSIEVIEDLLGPVKEVGISKRAISLLLLQEDRTALEYLSRAEKSFKCENEGHKNSYEEIQKLAEAASRISAVPLSYLFTLKRQERVNGIVEQVMKMPERIERKSSGNAGIFGIKKGNVNAGTLGTKEGNGKPWMTGADKGTGKKENYTCISREKTKSELRTNRAGSSENIKKQKRRIDFSDKIDSILIHPVLGIPVLFLVLYFGLYLFVGVFAAGTIVDFLENTIFGAYINPFVTAKFISFVPYPVLQDLFGENTGFYPRP

SEQ ID NO: 1485 - DNA, 744 bp, Unknown
  Obtained from environmental sample
  misc_feature (1)..(744): n is a, c, g, or t
atggagttctcacctttcaacaatgttgttaaactctgtcttcaagggataaacatggaagaacaaggtaaccctgaagaagccagcaaactatttctgcaaggttggaacgaagcaataaacgactttgaaaaatttcttgcagctcattatatatcccgacatcaaaaaactatttccgataaattaaattggcttcaaatcactttacagcttgcaataaatgtgaatgacaatactgttaagagtgctttcccgtctttgtatctgaacattgccaaatgttacgaagacttaaatgaccctattaaagcaaaagaatattctgtcttagcaatttcttttaagaacaatccttctgacaagggaccattttatcacgggacgaaagcagatttgcagattggtgatttactgacagcaggcagcaattccaattacaaatctgaactcaaaatgaatcacatttatttcaccgcattagttaacggagcaggacttgcggcagaattagcaaaaggaaaagtggaaccaagagtttatgtagtagaaccgacaggtggttttgaaaatgacccaaatgtaacggacaaaaaatttccaggaaatccgacacgttcataccgcagcaaagagccgttgaaaatcgttggtgaaataacagattgggtaagactaccaccccaggaacttcaaaattggcaagaaagactggcgaatactaaaggagaaattatcaactaa

SEQ ID NO: 1486 - protein, 247 aa, Unknown
  Obtained from environmental sample
  misc_feature (1)..(247): Xaa is any amino acid
MEFSPFNNVVKLCLQGINMEEQGNPEEASKLFLQGWNEAINDFEKFLAAHYISRHQKTISDKLNWLQITLQLAINVNDNTVKSAFPSLYLNIAKCYEDLNDPIKAKEYSVLAISFKNNPSDKGPFYHGTKADLQIGDLLTAGSNSNYKSELKMNHIYFTALVNGAGLAAELAKGKVEPRVYVVEPTGGFENDPNVTDKKFPGNPTRSYRSKEPLKIVGEITDWVRLPPQELQNWQERLANTKGEIIN

SEQ ID NO: 1487 - DNA, 684 bp, Unknown
  Obtained from environmental sample
  misc_feature (1)..(684): n is a, c, g, or t
ttgcatatatcgcaagtcatgatttgcaggagccgctgcgcaaaatcaaaaacgtcttctgcgttactgcaaataaaattaacattaaatgaggatcagaacgattactttaataaaataatactttcttctgatcgtatgtcaaagctcataaatgatgttcttaattattcaaagctgtcttactccaagaaagattacactgaaattgatcttaataaagtatttgaagccgtaacgaatgattttgaattgatgattcaggaaaaaaatgcaactatcagatccggtaatctcccaactgtctccggtattcctttgcagttaacccagctcttttataatttgatgagtaacgcattaaagttttgtgataagtcaccgctcatcgatatttcatcgaaaaagcttctgccagatgaagtgaatagtattccgcagctcaaccattctcttaattattatcagatattattcagcgataacggaattggattcgaccagaaatacgcaacccagatttttacaattttcaagcgtcttaactggaatcattcatcgtatgaaggtactggcatcggcctggcactttgcaataaaattgtggaaaatcataatggatttatttgtgcaaaaggcgaagaaaacaaaggtgcaacatttgaaatatatttaccggaataa

SEQ ID NO: 1488 - protein, 227 aa, Unknown
  Obtained from environmental sample
  DOMAIN (104)...(227): Histidine kinase-, DNA gyrase B-, and HSP90-like ATPase
  misc_feature (1)..(227): Xaa is any amino acid
MHISQVMICRSRCAKSKTSSALLQIKLTLNEDQNDYFNKIILSSDRMSKLINDVLNYSKLSYSKKDYTEIDLNKVFEAVTNDFELMIQEKNATIRSGNLPTVSGIPLQLTQLFYNLMSNALKFCDKSPLIDISSKKLLPDEVNSIPQLNHSLNYYQILFSDNGIGFDQKYATQIFTIFKRLNWNHSSYEGTGIGLALCNKIVENHNGFICAKGEENKGATFEIYLPE

SEQ ID NO: 1489 - DNA, 630 bp, Unknown
  Obtained from environmental sample
  misc_feature (1)..(630): n is a, c, g, or t
ttggaaaagaagtttattgattttttaaatacattcacttttgatcaaacccatttcaaaagattaaaagaacttttaaaaagaagtcttggcaaggcaaccaaaaataacggtcaggaaattgaacgcttaaaaaaacaaatacaaaacctcaatgaaaggcaaaccggaataatagaaaagaatcttcaaggcattatctcggacaaggtgttatctctacaaattgagatcattgaaaaggaattagaaaaaaattatctgtcattatctaaaatacctgaacctacattcgattatagggaatgcctggcctttcttaataattacctgaaaaaccctggtaaaatatggcgaaatgcgagtttagaaattaaaactaaattacaatggttccaattcccccaagggttaacctttgaaaataatatttttggaaccaccaaaatatgcttgctatttaagcttagaaataaaattttagctcaaaattcctctatggtggactcaaagaatcactttcagaacaatgcaaacctaacaaaatctaaagttattttctggcaggaaatcggcaaagaaattgaatcacttgctggaatcttaaaagaagtaggtggatatccttaa

SEQ ID NO: 1490 - protein, 209 aa, Unknown
  Obtained from environmental sample
  misc_feature (1)..(209): Xaa is any amino acid
MEKKFIDFLNTFTFDQTHFKRLKELLKRSLGKATKNNGQEIERLKKQIQNLNERQTGIIEKNLQGIISDKVLSLQIEIIEKELEKNYLSLSKIPEPTFDYRECLAFLNNYLKNPGKIWRNASLEIKTKLQWFQFPQGLTFENNIFGTTKICLLFKLRNKILAQNSSMVDSKNHFQNNANLTKSKVIFWQEIGKEIESLAGILKEVGGYP

SEQ ID NO: 1491 - DNA, 519 bp, Unknown
  Obtained from environmental sample
  misc_feature (1)..(519): n is a, c, g, or t
ttgaccggccaagcaaaaattgataatggaaaccaaaactcaatacatgaaactttgagtaataagttaaccgaggataaatatgatgttttaatatatgatcatggtagcggagaagtagctgattttattagctttaaagagtatcccgataaaattgaaatcaccctttaccatgttaaaggttcttcaggcaataagcctggtgacagagtaaatgatgtttacgatgtttgcatgcaagcaattaaatctcaggtttgggcaataaacaaagttacctttaaaaataaaatcatgagtaggacgaataaatataatgagaaatttatcgcgggcgatatcggtttggttaatactctaatgaataaggttaaaagagcggacttcatattctccattgtacagccaggaatttctcaagatacgttttctccaaaattgagttatacacttgcggctacagatgattccttgcggagtaatggttatgccccgctaattgccataggttcttaa

SEQ ID NO: 1492 - protein, 172 aa, Unknown
  Obtained from environmental sample
  misc_feature (1)..(172): Xaa is any amino acid
MTGQAKIDNGNQNSIHETLSNKLTEDKYDVLIYDHGSGEVADFISFKEYPDKIEITLYHVKGSSGNKPGDRVNDVYDVCMQAIKSQVWAINKVTFKNKIMSRTNKYNEKFIAGDIGLVNTLMNKVKRADFIFSIVQPGISQDTFSPKLSYTLAATDDSLRSNGYAPLIAIGS

SEQ ID NO: 1493 - DNA, 789 bp, Unknown
  Obtained from environmental sample
  misc_feature (1)..(789): n is a, c, g, or t
atgtatcccctacttcgggacggggatattttgcaaatttccaaaactaaaaaaaacttgcagattggcgatattgtaacttttaaaaagggcataaattacaccacccatcgcttaatttatcaaagcccggatggcaaaacatatttaaccaaaggcgacaacaacttctcccccgataagaagatccttaaaaaagatattcttggcaaagttaagacagtcgaaagatatggagctgttttcaacccggaagatgtttataatttacagtcttcgctttatttggatgagatccgccggctatttaaggctttcagaaggcaaaaaattgacgctttaattttaaaagggctaccgctgcacctttttatcgagcataaaataccaaaaagagtttattccgattgcgatattttagttttaaaaaatcattttttaaatgtttacaaaatatttaagaaaatgggatatagctgctcaaatgacaaatttgttaccaattcatcttttaacatcaattctctgcctcctgaggtacaattcagcaagagaaaanaaggcgtaccacccatcacttttgatttacaccttgagcctgtctttatgatgacaaaattgggcaggttggaagcactttaccctcagaaaaaagtaatgaacttggtaaaaagttttgtcggaaaaacatctgtgatctggaggcgatcatatcccctgcatcagcaaaatctgggtgttaactgcgctgccacctatcatcaaactttaaagcctacaccgctttaa

SEQ ID NO: 1494 - protein, 262 aa, Unknown
  Obtained from environmental sample
  misc_feature (1)..(262): Xaa is any amino acid
MYPLLRDGDILQISKTKKNLQIGDIVTFKKGINYTTHRLIYQSPDGKTYLTKGDNNFSPDKKILKKDILGKVKTVERYGAVFNPEDVYNLQSSLYLDEIRRLFKAFRRQKIDALILKGLPLHLFIEHKIPKRVYSDCDILVLKNHFLNVYKIFKKMGYSCSNDKFVTNSSFNINSLPPEVQFSKRKXGVPPITFDLHLEPVFMMTKLGRLEALYPQKKVMNLVKSFVGKTSVIWRRSYPLHQQNLGVNCAATYHQTLKPTPL

SEQ ID NO: 1495 - DNA, 588 bp, Unknown
  Obtained from environmental sample
  misc_feature (1)..(588): n is a, c, g, or t
ttgacgaaatgtgcgaattgtttcgtacttttaaaaaaaactgctatgtataccttttcaccagggaattatctgggtactaaggtggatacttacatacttcctaaaataatcatctcgaaggctgaatatggctcagttgcaaatagagactggcactgccatcaaaatgcattctttgcttattttttaaaagggggaaactgtgagtatcgtaaaacaaaggaaataaaatgtacttcgggctcattgttattttacaaagccttggagccacattgtaataaagattatgttgatggaagtaaaatatttcatgttgaaattgataatgcctggctaagtgaatatggtgtgaaggatggagagattagagcagatgttattgataatatgacaataaagaatgctttcataaatatcttaaatgaattttcaatcagggatgaattgtcgccatcttcagtcgaacacattctcatctacttacttaatttactacaacgcaatcaaacgaacggaaattttgttggcgcatggctcaaaagattcaatacaataattaaggataacttaactgattcataa

SEQ ID NO: 1496 - protein, 195 aa, Unknown
  Obtained from environmental sample
  misc_feature (1)..(195): Xaa is any amino acid
MTKCANCFVLLKKTAMYTFSPGNYLGTKVDTYILPKIIISKAEYGSVANRDWHCHQNAFFAYFLKGGNCEYRKTKEIKCTSGSLLFYKALEPHCNKDYVDGSKIFHVEIDNAWLSEYGVKDGEIRADVIDNMTIKNAFINILNEFSIRDELSPSSVEHILIYLLNLLQRNQTNGNFVGAWLKRFNTIIKDNLTDS

SEQ ID NO: 1497 - DNA, 348 bp, Unknown
  Obtained from environmental sample
  misc_feature (1)..(348): n is a, c, g, or t
atgaaaagattcatcaaaatagtaactggaactaagctgcggtccatgactaagcagaataccacgcttctcaaaaaataccgcgtaatcacaggattaatattattaaatttattcgtggcacataacctgcttcagcattataacctcttcctatgtaagattcctggaggaggatggtccattttcggctgctgtaatgtagatgaacagcatgcacgttgtcattggtttttataccgggtggtgaaagatttaaaaaatatgctttgcccgtccataaattatttgttgatgcaagattatatcccatccctatattccgttgtattaattgtaacccgctaa

SEQ ID NO: 1498 - protein, 115 aa, Unknown
  Obtained from environmental sample
  misc_feature (1)..(115): Xaa is any amino acid
MKRFIKIVTGTKLRSMTKQNTTLLKKYRVITGLILLNLFVAHNLLQHYNLFLCKIPGGGWSIFGCCNVDEQHARCHWFLYRVVKDLKNMLCPSINYLLMQDYIPSLYSVVLIVTR

SEQ ID NO: 1499 - DNA, 351 bp, Unknown
  Obtained from environmental sample
  misc_feature (1)..(351): n is a, c, g, or t
ttggaaaacattgaagcatataactcagatgagacggaaaatggaattgctcctatattagcagcaacaaatattaagcgtgaatttggttataccaacaggtatctttctgattacatgcgagaaataggtaaagagtactggttattcaagaaacctatcagaggggacaaattccagtggacgtttttactcggaagcaactcagacatttttaaggactataagaaaatagatttcttgcgccttgattctgatgatgcacagaaattctttccggtattagaacttaccgctaaacaaagacaagaattgcttcaaccaacgctcccaaacattgacgacaaatga

SEQ ID NO: 1500 - protein, 116 aa, Unknown
  Obtained from environmental sample
  misc_feature (1)..(116): Xaa is any amino acid
MENIEAYNSDETENGIAPILAATNIKREFGYTNRYLSDYMREIGKEYWLFKKPIRGDKFQWTFLLGSNSDIFKDYKKIDFLRLDSDDAQKFFPVLELTAKQRQELLQPTLPNIDDK

SEQ ID NO: 1501 - DNA, 627 bp, Unknown
  Obtained from environmental sample
  misc_feature (1)..(627): n is a, c, g, or t
atggagattaaaacatctgacaggcaaacggctgttcaacatctttatcttccgtactacctttacagcacacgacctttggataaatcagattttaataaaattattntcctggaagactcgcaaactattcatccgcgatattattttaccgattctattcatacacaaatcaatatcgagcatccatggaaaaacagagggaagtattctattttcattccgcctgctacatttaccgacatctatggaaaatggaatgatacggttaaaattgaattcacctctcattctgaaatggattatggatctgtgaaaattaaatttcaaaaggaaattgataccccatacatcatccagctaattgacgtaactgagggaactgtatataaagaattcaaagcaacagaaagtataacatttgattttatgaatcttgatccgcgactttataaaatcaaactcataagagatagtaacaacaatggaaaatgggatacaggtgattacctgaaacatattcagccggaagtagtggaattttatccggaagacattaccgtaagagctaactgggacgtggaggttgcaattaaagttccactgaaatcagttaagaaacagtaa

SEQ ID NO: 1502 - protein, 208 aa, Unknown
  Obtained from environmental sample
  misc_feature (1)..(208): Xaa is any amino acid
MEIKTSDRQTAVQHLYLPYYLYSTRPLDKSDFNKIIXLEDSQTIHPRYYFTDSIHTQINIEHPWKNRGKYSIFIPPATFTDIYGKWNDTVKIEFTSHSEMDYGSVKIKFQKEIDTPYIIQLIDVTEGTVYKEFKATESITFDFMNLDPRLYKIKLIRDSNNNGKWDTGDYLKHIQPEVVEFYPEDITVRANWDVEVAIKVPLKSVKKQ

SEQ ID NO: 1503 - DNA, 540 bp, Unknown
  Obtained from environmental sample
  misc_feature (1)..(540): n is a, c, g, or t
atggaaatattagaagatcgtgatcttgcaaaatacctgtttgataaatattcttcaaatcagagaaaatggaattttattatctcaacctctcccgtaaaggacgctttttttgatgccattgtttctaatcctgatgaagtttggcaattaaaaattgattctctttacaaacctaatccattagtaatgggtacaaaaacaacaaccgattctactataattgaaaagaaactcgaaaatacttcacaatttggatatagaaaattggaatcagatgtgctcaggaacttgagaactctttctgaagaggaaaatagcaattctagtaatactatggatgttaattttcgccttaattcccttctttcgtctctcgatccagtgaaaccaattaaaggacacaattacctatatgggccttttatatttaccaaaaaaagaatggccaagttccataataaacaagatgaaatatctgaaaaattatcatatcgaatgcatgaaaatattcgaagaaaatattcgtcatacggataa

SEQ ID NO: 1504 - protein, 179 aa, Unknown
  Obtained from environmental sample
  misc_feature (1)..(179): Xaa is any amino acid
MEILEDRDLAKYLFDKYSSNQRKWNFIISTSPVKDAFFDAIVSNPDEVWQLKIDSLYKPNPLVMGTKTTTDSTIIEKKLENTSQFGYRKLESDVLRNLRTLSEEENSNSSNTMDVNFRLNSLLSSLDPVKPIKGHNYLYGPFIFTKKRMAKFHNKQDEISEKLSYRMHENIRRKYSSYG

SEQ ID NO: 1505 - DNA, 573 bp, Unknown
  Obtained from environmental sample
  misc_feature (1)..(573): n is a, c, g, or t
atgccgatgaacgaagtgctgttgaaccggctgaataaaaatgatgataaaggattggcgattttttatggcaagcctggaaccggaaaaacttcttacatccgttacctggctgcgcacatcgacaaacaaaaattatttgtccctgccagcctttcaaaaaaaatcggcagcccggaattcctgaccctgctgaaggattacagaaattctgtgttgattatcgaagatgctgataccattcttaaaaagagaatcaacgatgacgatcatgtaatatccaatttgctgaacctgactgatggattgctttccgattttttccatatgcagatcatttgcactttcaacagtgacattgctttggtggatccggcgcttctaaggaaaggcaggttaatagccaagtataacttcaaagagctcacggtggaaaagacacagaacctttgccatacgcttggctataaatttattccggatcatgaaatgacgctcgccgatatattccatcttgaagaagtggagtttcaacagacctactcgaagagaggcattatcggcttcaagtga

SEQ ID NO: 1506 - protein, 190 aa, Unknown
  Obtained from environmental sample
  DOMAIN (19)...(190): ATPase family associated with various cellular activities (AAA)
  misc_feature (1)..(190): Xaa is any amino acid
MPMNEVLLNRLNKNDDKGLAIFYGKPGTGKTSYIRYLAAHIDKQKLFVPASLSKKIGSPEFLTLLKDYRNSVLIIEDADTILKKRINDDDHVISNLLNLTDGLLSDFFHMQIICTFNSDIALVDPALLRKGRLIAKYNFKELTVEKTQNLCHTLGYKFIPDHEMTLADIFHLEEVEFQQTYSKRGIIGFK

SEQ ID NO: 1507 - DNA, 579 bp, Unknown
  Obtained from environmental sample
  misc_feature (1)..(579): n is a, c, g, or t
ttgatatgtaatgcaggatggggaagattatcttctctccccaaaccaatttcacatacagtgatggtagtacaatcgaatggaaagaacgagtgcgtttatttgattggtggcagaaagaaaaatgtaaatagcccaagcgatctttattcttctgcatttcaatttgatttaaaaacgaaagaatggaaagaaaaaagatccctgccttatacttcgtctgcaggcactggcgttgccgttggaacacattccattttattatttggtggcgataacggcgcaacttttcacaaaaccgaagaactcatttttgctatcaacaaggaaaaggacgaaacaagaaggaaacaacttgatgcagaaaaaataaaactgcaatcaacgcatcccgggttttgcaaacaagtgctttcgtacgatacaagaaaagatgaatggcaagctgctggctgtatttcgtatgattcgccggttacaacaacagcagttaaatggaacaataaaatcattatcccgggtggagaaataaaagcaggagtaagaacgccgcaaattctttcagctaaaattttttga

SEQ ID NO: 1508 - protein, 192 aa, Unknown
  Obtained from environmental sample
  misc_feature (1)..(192): Xaa is any amino acid
MICNAGWGRLSSLPKPISHTVMVVQSNGKNECVYLIGGRKKNVNSPSDLYSSAFQFDLKTKEWKEKRSLPYTSSAGTGVAVGTHSILLFGGDNGATFHKTEELIFAINKEKDETRRKQLDAEKIKLQSTHPGFCKQVLSYDTRKDEWQAAGCISYDSPVTTTAVKWNNKIIIPGGEIKAGVRTPQILSAKIF

SEQ ID NO: 1509 - DNA, 339 bp, Unknown
  Obtained from environmental sample
  misc_feature (1)..(339): n is a, c, g, or t
ttgatagccaaaaggagctgtcaattttacaagagtgtctgtggggcaataactggcgccgatnaaactattactgcattcagaatttacatctatataagcataaccaaaatgccttctaaatgtgcaatcccctgttttaaaaaaaagacgtatggtttttgccggcctttcccgatagatctactgaaaacagctgaaccagtttttatacaaaatagaaaatggtgtctgttacatcagaacgntcaaacccagggcataaagaaacttattgcaataaaaggtaaagaactgccactgaatacagctttatctcgtaacatttggaacttctaa

SEQ ID NO: 1510 - protein, 112 aa, Unknown
  Obtained from environmental sample
  misc_feature (1)..(112): Xaa is any amino acid
MIAKRSCQFYKSVCGAITGADXTITAFRIYIYISITKMPSKCAIPCFKKKTYGFCRPFPIDLLKTAEPVFIQNRKWCLLHQNXQTQGIKKLIAIKGKELPLNTALSRNIWNF

SEQ ID NO: 1511 - DNA, 648 bp, Unknown
  Obtained from environmental sample
  misc_feature (1)..(648): n is a, c, g, or t
atggacatttgggagcggctcaagaaaataaaatttgtcaggaagattgtgtatgcattggtagggttgatttcctatcctggtctaataatgctaaatcgcttgaagatatccggtactgagcatgtaaaaaatcttcccaggaaaaatgttctgtttgttagcaatcaccaaacctatttcgctgatgtcatcactttcctgcatatcttttgcgctataaaatggggtaaaatgaatcgcctgggaatcccctattacctgttaaacccttttacaaacgtatattatgttgcggcagaggaaacaatgaagggcagttttattagtcgcctgtttactcttgcaggtgcattaacggtcaaacgcacttggcggagtgaagggactgaagtacgtaagggactggatccctctgatacccggaagatcacgcgggcattggaaaacaattgggtgattacatttccgcagggtactacaaaaccctttgcccctggtcgtaaaggaacggcccatgttattaaactttccaagccagttgtaatacccgttgtcattaatggattctggcgtgcattcaataaaaaaggtttgaaaataaaaaaaacagcactctgcttacaggtcaatttaaggaacccatga

SEQ ID NO: 1512 - protein, 215 aa, Unknown
  Obtained from environmental sample
  DOMAIN (34)...(188): Acyltransferase
  misc_feature (1)..(215): Xaa is any amino acid
MDIWERLKKIKFVRKIVYALVGLISYPGLIMLNRLKISGTEHVKNLPRKNVLFVSNHQTYFADVITFLHIFCAIKWGKMNRLGIPYYLLNPFTNVYYVAAEETMKGSFISRLFTLAGALTVKRTWRSEGTEVRKGLDPSDTRKITRALENNWVITFPQGTTKPFAPGRKGTAHVIKLSKPVVIPVVINGFWRAFNKKGLKIKKTALCLQVNLRNP

SEQ ID NO: 1513 - DNA, 456 bp, Unknown
  Obtained from environmental sample
  misc_feature (1)..(456): n is a, c, g, or t
atggaagaagaacagctttattattttaagaagaatgtttcttaccctgtaggggttagattttatgttaaggaccctgttggaaaaaccctgacagataatgatccttatgtagttgttgaaaagaaaaagcttagagattttaagcgggccaataagattcacataatgggtggattgatagtagaaactacagagcccgatctagatgaggaaactccgaacgtcataacagacgaacaagctgaaacaatagtgaagaatattccaatattaaagaaaactctttcacaattaacatcagatgctcctgtagtcaagttactagaagaagctaaactacaaggacgctcatctaagactatagcattgatacaagaaaaattaattgaattagttggagaaacaccagcagaaatgcggggagtttcttgggacacccaaggagaagtgtaa

SEQ ID NO: 1514 - protein, 151 aa, Unknown
  Obtained from environmental sample
  misc_feature (1)..(151): Xaa is any amino acid
MEEEQLYYFKKNVSYPVGVRFYVKDPVGKTLTDNDPYVVVEKKKLRDFKRANKIHIMGGLIVETTEPDLDEETPNVITDEQAETIVKNIPILKKTLSQLTSDAPVVKLLEEAKLQGRSSKTIALIQEKLIELVGETPAEMRGVSWDTQGEV

SEQ ID NO: 1515 - DNA, 888 bp, Unknown
  Obtained from environmental sample
  misc_feature (1)..(888): n is a, c, g, or t
atgtcttcgcagtcaaaaacctcccctctgcaacacgattacaaatacaagctcggattttcactgcaggacctgggttggataaaatacctcaagccgcaaaatgcacgcgacttcaccatggaaatagaccaaacgcttgattttgattctttccagggatcgggagatacccctcttgcggatgtagataaatcgctcaatgacaaatacccgatggatgccggagacgataaattccgcatgaacctgcctaccgttgcaagcatccagggagattattatgccggcaagaacatccatataaattccacgttcaattacgcatttcagttcagaaaaaatgagaacaaaattcatgaggtaacaactttcagcattagtccgcgctgggactggaaatggctgggtttctatatgcctttctcctacaacaaatactctcatacccgtgtaggtatgagtatgcgcataggtccgctgatcgtaggaatggccgatatccttccgctcgtttcaaaacgcgatgtatacggggttgattttcacatgatgctgaaagtgcctcatattcagttaaaaaagaaaaacaagaaccccaggaccaagagcaaatttgacacaaacaaagaaatttctccaaaaaagaagaaagaacgcaatacccctaatgcaaaccgtgaacagaaatcacgcaagcacattttccctaaaatacgtatctttaaaaagaagaaaagacgtgcttccgtagatgataaagagcacacaatttattttaactataaattatgtctttttttgtttggatatttagcacggattttgtttaaagcccaattaaataccctttttataataaaaaaatcccctaattaccgcatttaa

SEQ ID NO: 1516 - protein, 295 aa, Unknown
  Obtained from environmental sample
  misc_feature (1)..(295): Xaa is any amino acid
MSSQSKTSPLQHDYKYKLGFSLQDLGWIKYLKPQNARDFTMEIDQTLDFDSFQGSGDTPLADVDKSLNDKYPMDAGDDKFRMNLPTVASIQGDYYAGKNIHINSTFNYAFQFRKNENKIHEVTTFSISPRWDWKWLGFYMPFSYNKYSHTRVGMSMRIGPLIVGMADILPLVSKRDVYGVDFHMMLKVPHIQLKKKNKNPRTKSKFDTNKEISPKKKKERNTPNANREQKSRKHIFPKIRIFKKKKRRASVDDKEHTIYFNYKLCLFLFGYLARILFKAQLNTLFIIKKSPNYRI

SEQ ID NO: 1517 - DNA, 603 bp, Unknown
  Obtained from environmental sample
  misc_feature (1)..(603): n is a, c, g, or t
ttgtctgacgaattaacttctgatcatgtgatcgtgacggatatgggactttcctttcaaggcacgcaccagggttttaaagttaaaaaaggccaaaagttttttaccaattgcggttttgccgcgatgggatggggcttgccagcggcaatcggcgcgtgtatcggcagcgggaaaaaaccaacaatttgtatcaccggtgagggcggcctcatgatgaatatccaggaactcgccaccatcatgttaaacaaactccctattaagatttttatctacaataacggcggctaccttacgattaagcaaacccaagaaatcgggtttgagtctcgtctcatgggcgtcaacgccgaaaccggtttatcgtttcctgattttaaaaaaattaccgaagctcatgggttttcttatttgcaaatcgcagagcatgcgagcttagagaaaaacctatctgcgtttttaaaagctccaggacctgccgtatgcgaactcatgatgagccacgatcagctgcaatcgcctcgttatatggtcaagaaaaaagccgacggcacaacggaaattccaaaatttgagaccttcatccttttgatccactag

SEQ ID NO: 1518 - protein, 200 aa, Unknown
  Obtained from environmental sample
  misc_feature (1)..(200): Xaa is any amino acid
MSDELTSDHVIVTDMGLSFQGTHQGFKVKKGQKFFTNCGFAAMGWGLPAAIGACIGSGKKPTICITGEGGLMMNIQELATIMLNKLPIKIFIYNNGGYLTIKQTQEIGFESRLMGVNAETGLSFPDFKKITEAHGFSYLQIAEHASLEKNLSAFLKAPGPAVCELMMSHDQLQSPRYMVKKKADGTTEIPKFETFILLIH

SEQ ID NO: 1519 - DNA, 957 bp, Unknown
  Obtained from environmental sample
  misc_feature (1)..(957): n is a, c, g, or t
atgttgtttttagtgtacagttttctgttggcgcaggatgatttgccaacagactacttaagcaaagattttcacaccggtcggcgtgaagcgctgcgtaaactgatgcccgataactctgttgttgttgtcatggcctatcccacccgcacattcagcaatgacgttgaatacatctatcatcaaaatcctgatatgtattatttcagcggatacaaagaaccacactcggtattgctgatctttaaagaagaacaaaaaggcgccgatggcgccgtttacaaagaaataatttttgtacagaagaaaaatgcgctggctgaacaatggacgggaagaagactaggtattgaaggcgctaaagaaaaacttggtttttcctacgcatacaatggtgaggattttaaagatgcccggatcgatttttcaaaatttgataaaataatttttgacaggtttcccgatgatgcgggtaatgacccccgtgagaaggcagatctttcagacctgatagagcaatttaaatcgttggcaaaaataccagtcgaattgaataaggatgccagatttgacacccgcctcttccgggaacttacaggcaagcttcgtgaaattaaaacccctgaggaaatggatcttattcgcaaagcagttgaaatttcctgtcgtggacaaaatgaagtgatgaaggcagtgcacccgggaatgagcgaattagaaatacagggcttgcatgaatttattcataaaaaatacggagctgaagcagtgggttatggatcgatcgttggcgccggtgcaaatggctgtgtattgccttatatggaaaactccaaaacgaggatcgggaacgaattgttgctgatggatgttggagcgaataccatgttatacggtgatgtaccagaacattctgccatggaaatttccgagaacaacattttacatctcgtatga

SEQ ID NO: 1520 - protein, 318 aa, Unknown
  Obtained from environmental sample
  DOMAIN (20)...(160): Aminopeptidase P, N-terminal domain
  misc_feature (1)..(318): Xaa is any amino acid
MLFLVYSFLLAQDDLPTDYLSKDFHTGRREALRKLMPDNSVVVVMAYPTRTFSNDVEYIYHQNPDMYYFSGYKEPHSVLLIFKEEQKGADGAVYKEIIFVQKKNALAEQWTGRRLGIEGAKEKLGFSYAYNGEDFKDARIDFSKFDKIIFDRFPDDAGNDPREKADLSDLIEQFKSLAKIPVELNKDARFDTRLFRELTGKLREIKTPEEMDLIRKAVEISCRGQNEVMKAVHPGMSELEIQGLHEFIHKKYGAEAVGYGSIVGAGANGCVLPYMENSKTRIGNELLLMDVGANTMLYGDVPEHSAMEISENNILHLV

SEQ ID NO: 1521 - DNA, 858 bp, Unknown
  Obtained from environmental sample
  misc_feature (1)..(858): n is a, c, g, or t
atggattggaatttttcgacgctttttcaaatgcagttacaagagttcaggagctatttgaaaacgatattcgacagaattcaccnggaaaatgagtttattcatttttttgataacgatacaaatgtcaagaaacttgttggaggtttaactggttcatcagatttaaaggcaatccgtgaaatatcaaaaatatcgtctgaagaagttatacagcttgcttcacttgaaaataatctaattagcctcaagaaagtggatattgcaaaaaaagttaagtctttgaaaagaattcaagggcaattaaaagacttaaaggatcaatttgaggccgttaatgatttgttttctgaagcatctattagtaaatatgggaaattaattcaggaatatatacacaacaagaaactttcgatcagtgaaggattgaccaaatttgaaacggaaaatattggaagcatcggaagtgatgaatggaaggatttgatcgtggcagccaaggtgtttgccgagattcaatacgaagatgccgatttgtatcctgccaaagaggatttttgtttgttgtgtcatcaacccttgagtaaagaggccaaagctctaattgaagcatattggaaatacttatcaagcacagccgagaaaaaattcaaggacattgcagaagacattgaggaattacagaccagtttgaaagaattggaactaaccgtgtcgattgaaaattccgatttgtatgattggcttactgaaaattccgaaaccaattactggtttggaatactgaataaaagccttgagggtttaagaaacaattctggctacttcaggccaaaagctgagtctgacatacggtaa

SEQ ID NO: 1522 - protein, 285 aa, Unknown
  Obtained from environmental sample
  misc_feature (1)..(285): Xaa is any amino acid
MDWNFSTLFQMQLQEFRSYLKTIFDRIHXENEFIHFFDNDTNVKKLVGGLTGSSDLKAIREISKISSEEVIQLASLENNLISLKKVDIAKKVKSLKRIQGQLKDLKDQFEAVNDLFSEASISKYGKLIQEYIHNKKLSISEGLTKFETENIGSIGSDEWKDLIVAAKVFAEIQYEDADLYPAKEDFCLLCHQPLSKEAKALIEAYWKYLSSTAEKKFKDIAEDIEELQTSLKELELTVSIENSDLYDWLTENSETNYWFGILNKSLEGLRNNSGYFRPKAESDIR

SEQ ID NO: 1523 - DNA, 453 bp, Unknown
  Obtained from environmental sample
  misc_feature (1)..(453): n is a, c, g, or t
gtgcagttaattctaattgtaaaggagcggctgaattatatagtcgaagaaatacttgcctttgcaaaagacaagatagcaatgattatcctctttggttcttatgcgagaggaacatgggtgcaggacgtatacaaggaggggcatataacatactcatatagtagcgaccttgacattatgcttgttttaaggaaaagcaagtataacaggtacacagcttcaacgatggaacatgatataataaaaaggctggagaataaggggcttgcttggccaccgatgacgttgcctacctctccgagtattgaagaggtaagagagcatataaaaattccaagtgtntcattgatagtcgagtctataacaagggctaataaagaactggagaaaaggccatatttttttaccgacataaaaaacgaaggcctcttattatatgataaccgttga

SEQ ID NO: 1524 - protein, 150 aa, Unknown
  Obtained from environmental sample
  DOMAIN (7)...(112): Nucleotidyltransferase domain
  misc_feature (1)..(150): Xaa is any amino acid
MQLILIVKERLNYIVEEILAFAKDKIAMIILFGSYARGTWVQDVYKEGHITYSYSSDLDIMLVLRKSKYNRYTASTMEHDIIKRLENKGLAWPPMTLPTSPSIEEVREHIKIPSVSLIVESITRANKELEKRPYFFTDIKNEGLLLYDNR

SEQ ID NO: 1525 - DNA, 537 bp, Unknown
  Obtained from environmental sample
  misc_feature (1)..(537): n is a, c, g, or t
atgacagataatttttttactcttcgaaaaaagctgaatagatataggcaagaactctatattcactataaaagtgctaatgaaattttacttatgaatattgttagtactgcaaaaatacatgtaaaagagggaattattcttgacgaagtggggtggacgagtaatgggcatggtctaatattttacttagaagaagatatctatagccatattaatagtatcgaaggaagaaacgatataggtgaaagaataaaacaagatctaaacaaaatatcgcgtgatgagatttacccggaatacattggttttgtatctataggattatttcaccctgaagatcaagattgtcaaaaggtaatcgaaccactagacacttaccagctagataaggcttcctcaaatgacaaaaatttagaattttggaagccaggttatttaaaattatttattagccatcaatcaaaatataaagaagaagttagtgatttggcaaattttttattggactacgcattcttctttcatagctcatga

SEQ ID NO: 1526 - protein, 178 aa, Unknown
  Obtained from environmental sample
  misc_feature (1)..(178): Xaa is any amino acid
MTDNFFTLRKKLNRYRQELYIHYKSANEILLMNIVSTAKIHVKEGIILDEVGWTSNGHGLIFYLEEDIYSHINSIEGRNDIGERIKQDLNKISRDEIYPEYIGFVSIGLFHPEDQDCQKVIEPLDTYQLDKASSNDKNLEFWKPGYLKLFISHQSKYKEEVSDLANFLLDYAFFFHSS

SEQ ID NO: 1527 - DNA, 498 bp, Unknown
  Obtained from environmental sample
  misc_feature (1)..(498): n is a, c, g, or t
atgcctagtgatactgccttattgaagacgattacattctttgaatatgcagcggaatcaaatttactttcaatggacattgatggaatcaatttgcaagatttgatttcaatgatgaatagcaggatagaatttttacttgacaaagaccacatgttgggtcatgcatattttatcggagtaaaaaccaaagacgatttatgttcagtttttagaaacaaagtcattccattactagaagaatatttttatggtgactatactaaaattcaacttgttcttggagataacaaggaatttggaaaatcagatgagaatatcatagtaattaaaaaaccagcaacagaacagaagaagatgtttggcgtaaatgaaatagagggatttgaagaaaaaaatatctatactatcaatgaaaaaatcatcaatgaagattacgtttcaataacacctgaattcttcacttccatttacgcaaaaaaaacaacgggatcgtaa

SEQ ID NO: 1528 - protein, 165 aa, Unknown
  Obtained from environmental sample
  misc_feature (1)..(165): Xaa is any amino acid
MPSDTALLKTITFFEYAAESNLLSMDIDGINLQDLISMMNSRIEFLLDKDHMLGHAYFIGVKTKDDLCSVFRNKVIPLLEEYFYGDYTKIQLVLGDNKEFGKSDENIIVIKKPATEQKKMFGVNEIEGFEEKNIYTINEKIINEDYVSITPEFFTSIYAKKTTGS

SEQ ID NO: 1529 - DNA, 375 bp, Unknown
  Obtained from environmental sample
  misc_feature (1)..(375): n is a, c, g, or t
ttgaaaaagcaatcttaccatatttgtgaatatggagtaattcgttccatgaatgactacggcaacgaagctgaaagttcattggaagaattataccttcccgaaaatcattttgaaagtattcacaaatacatttctcaaaatcaagatgactcaagcgaaaatgaaaagccctttacattattttcaaaaggtaaacgaaagcaaatcaaagtcaaaaactatgttggcataattgaaactaaagaaggtttacatttagaaattttgccgaaaattcatttggacaaaactgaagatgagctaaatgacacaaaacgtatattctttaaagatgctaaaagctctgaaagattcaccctttgtcaatattag

SEQ ID NO: 1530 - protein, 124 aa, Unknown
  Obtained from environmental sample
  misc_feature (1)..(124): Xaa is any amino acid
MKKQSYHICEYGVIRSMNDYGNEAESSLEELYLPENHFESIHKYISQNQDDSSENEKPFTLFSKGKRKQIKVKNYVGIIETKEGLHLEILPKIHLDKTEDELNDTKRIFFKDAKSSERFTLCQY

SEQ ID NO: 1531 - DNA, 588 bp, Unknown
  Obtained from environmental sample
  misc_feature (1)..(588): n is a, c, g, or t
atgaaagatcaagttttggttatagatgacgaagaatcaatccgatttggattaacccggctgttacagcaaggtggctattcttgcttaacagcgggaacagcagcagaaggatttcaacttttcacaactcatagtccgtccgtagttttgttggacttaaggcttcctgatatggaaggtctggagttcatgaagaaactgaaagaaaccgacaagtatgtttcgatcatcatcatgacagcctatggcacgatcgaaactgcggtgaatgcattgaaatcaggcgccgaaaatttcttaaccaaaccgatcgatccggatggcttacttgttctgttgcgaaaaacgttggagatcaatgaaatcaaacgtcgcaacgattacatgaaagttcaagaagatgcaaaggctgcggattactacgttggtaaaagtgaaaagcttcggaaaattcatgagatcattcaaattcttgcacaaaatgacactaccgttttagttcttggcgaaaccggaacaggcaaaggtttgtacgcccggttaattcacaatttgagtgcgcgttcgaaccataattttgttgaa

SEQ ID NO: 1532 - protein, 196 aa, Unknown
  Obtained from environmental sample
  DOMAIN (3)...(122): Response regulator receiver domain
  misc_feature (1)..(196): Xaa is any amino acid
MKDQVLVIDDEESIRFGLTRLLQQGGYSCLTAGTAAEGFQLFTTHSPSVVLLDLRLPDMEGLEFMKKLKETDKYVSIIIMTAYGTIETAVNALKSGAENFLTKPIDPDGLLVLLRKTLEINEIKRRNDYMKVQEDAKAADYYVGKSEKLRKIHEIIQILAQNDTTVLVLGETGTGKGLYARLIHNLSARSNHNFVE

SEQ ID NO: 1533 - DNA, 618 bp, Unknown
  Obtained from environmental sample
  misc_feature (1)..(618): n is a, c, g, or t
atgacaacattctggactgaaaatagcatacttacaaatcaaaacgagaccactccacctggcgaaattttcgatgaattttgtcaggccattggttactattaccaacagaaaggttataagtatacaagaagccgtcctaaagttaaaatagaaacgcgcgacctttttgtggagatcaacttttggagcagccgtagtaatatggcaggcagtagtgttgggttggaaattctgccgtacgttggttcaaaaaaattaaagaaatggatcaagacaaataaaaccggacgtaacgaatacatttacggccctacaaaatatgatttccggtttcagaatatttatggggccagcgttgatttcttcctcgacctgatcttaaagattgataaatacattgccgaacacctaaatatcgccgataacaaaaatttcctcgaccaactaattactgataacagcagcgagatcatcaccgataattttgcctgttaccttgccatgaataacgatccacgtttgcaggcatttattgaatcgcatccggatggagtgagtactgaactggcagctaaattaaaagagatcattcaggacccacagcaaccagcttag

SEQ ID NO: 1534 - protein, 205 aa, Unknown
  Obtained from environmental sample
  misc_feature (1)..(205): Xaa is any amino acid
MTTFWTENSILTNQNETTPPGEIFDEFCQAIGYYYQQKGYKYTRSRPKVKIETRDLFVEINFWSSRSNMAGSSVGLEILPYVGSKKLKKWIKTNKTGRNEYIYGPTKYDFRFQNIYGASVDFFLDLILKIDKYIAEHLNIADNKNFLDQLITDNSSEIITDNFACYLAMNNDPRLQAFIESHPDGVSTELAAKLKEIIQDPQQPA

SEQ ID NO: 1535 - DNA, 306 bp, Unknown
  Obtained from environmental sample
  misc_feature (1)..(306): n is a, c, g, or t
atgctttcgtatacgcttatttgtttgtcaggtattacaagatcaggatcaatgccaagcacnctgggaaaagccctcacaaaccgggcatgcaccatatggattattaaaggagaaaagatttggaacaggttcttcaaaacgaattccatcgagttcaaatttattggagaactccagcagcgctttcccatttacttcaagcacaagttctccttcaccttcataaaacgcagttcccacagaatcagcgatacgatgacgatcatcttcatcaaaatcttttacaacgagccggtcaattaa

SEQ ID NO: 1536 - protein, 101 aa, Unknown
  Obtained from environmental sample
  misc_feature (1)..(101): Xaa is any amino acid
MLSYTLICLSGITRSGSMPSTLGKALTNRACTIWIIKGEKIWNRFFKTNSIEFKFIGELQQRFPIYFKHKFSFTFIKRSSHRISDTMTIIFIKIFYNEPVN

SEQ ID NO: 1537 - DNA, 795 bp, Unknown
  Obtained from environmental sample
  misc_feature (1)..(795): n is a, c, g, or t
atgttcaaaaattatttagtcactgtttttagaaatatggttcgcaataaagtgaacaccgtgatcaacattacaggcctggctataagtattgcctgttgtattgttatttacgtatttgtaaaacatgaaaagacttttgacagttttcatgcaaaagccgatcgtatttatcgcctggtagcagactccaaaggcactgagggtgttttttttcaagggtacacaaattttgctgtcgcctcagctttgcgcaatgattttcctgatcttgaaactgtaacacaggtgtacacaaacaataacgctattgttgccattacggaacctggagctgaaagaaaaatgtttgaagaaaaggaaatgacctttgtggacgaggagtttttgaaaacttttgattttacattcctcgcaggtaacgaggaatcagttttaaaatctcccgacgaagtagtgcttaccaaaaagcttgctgataaattttttggcagtagttataataacaggtacaatgaattgatcggcaaaagcattgtggtgaataaagccccttataaaatttcaggcataataaaagacgttccccgcaataccaatattactttcagaatgctgttgcctatgaaggtattcttcagggaaaataaaaacctggtaaacaactggaaggaaacctattctgcgagctatacatttattacactggcaaaaaattttcacctgcccgatttgatgcagccctggttccatttaagaataaataccttgagaaagaggatgcagcacaactga

SEQ ID NO: 1538 - protein, 264 aa, Unknown
  Obtained from environmental sample
  misc_feature (1)..(264): Xaa is any amino acid
MFKNYLVTVFRNMVRNKVNTVINITGLAISIACCIVIYVFVKHEKTFDSFHAKADRIYRLVADSKGTEGVFFQGYTNFAVASALRNDFPDLETVTQVYTNNNAIVAITEPGAERKMFEEKEMTFVDEEFLKTFDFTFLAGNEESVLKSPDEVVLTKKLADKFFGSSYNNRYNELIGKSIVVNKAPYKISGIIKDVPRNTNITFRMLLPMKVFFRENKNLVNNWKETYSASYTFITLAKNFHLPDLMQPWFHLRINTLRKRMQHN

SEQ ID NO: 1539 - DNA, 420 bp, Unknown
  Obtained from environmental sample
  misc_feature (1)..(420): n is a, c, g, or t
ttgagtactggccaattgttagaaggaaatgcggaaatcgcaacgcttgttaagaagattgaagatcaaggacaactggtcaatcgtaatgttgtgaaggctgttgtttcgaaagaaaagaatgcgctatattttagtcgctcgcctattccacacatccgtaacacgaaggagaatgagtggcttagcaaacaaattttctttaagcacatcggtatgtatgcttaccgcagagatattcttaaactagtaacggctctgccaatctcaagtcttgaaaaagcagaatcacttgaacaacttcggtggctggaaaatggttttaagatttcagtagccgaaactcaaacggaaacaattggaattgacacgccagatgatttacaaaaagcgctatcctatttgaagactattggctga

SEQ ID NO: 1540 - protein, 139 aa, Unknown
  Obtained from environmental sample
  misc_feature (1)..(139): Xaa is any amino acid
MSTGQLLEGNAEIATLVKKIEDQGQLVNRNVVKAVVSKEKNALYFSRSPIPHIRNTKENEWLSKQIFFKHIGMYAYRRDILKLVTALPISSLEKAESLEQLRWLENGFKISVAETQTETIGIDTPDDLQKALSYLKTIG

SEQ ID NO: 1541 - DNA, 597 bp, Unknown
  Obtained from environmental sample
  misc_feature (1)..(597): n is a, c, g, or t
atgaaaagaaatagtttattgctggttttgcttgccttatctctttttactgccgcacaaacaccagcttttatctccgacagtatcgacacctatattcaaaaaggaatgaaagactgggccgtcccgggcctttcgattgttttggtaaaagacggcaaggtagtgctcatgaaagggtatggcgtgcgaaacctcaaaagcaacgtaccggtagacgagcatactctctttatgattgccagtaatacaaagctctttaccggcaccgccctggcgttgctggaatcaagaaacaagatttcactgaatgacaagatcaccaaatacttccctgattaccgtctgtatgaccccattaccaccaaattggtaaccattcgcgatttattaacacaccgcattggcaccaaaaccttccagggcgatttcaccttttggaacacaaagctgagccgcgaagagatcatgaagcgtatgcgcttgctgaagccttcacagatcttcaggcaggactatgggtatcgtaatagttgttttcttaccgcagggcaggtgatcccgaaggtgacaggaacccaatgggaggatttataa

SEQ ID NO: 1542 - protein, 198 aa, Unknown
  Obtained from environmental sample
  SIGNAL (1)...(19)
  DOMAIN (29)...(192): Beta-lactamase
  misc_feature (1)..(198): Xaa is any amino acid
MKRNSLLLVLLALSLFTAAQTPAFISDSIDTYIQKGMKDWAVPGLSIVLVKDGKVVLMKGYGVRNLKSNVPVDEHTLFMIASNTKLFTGTALALLESRNKISLNDKITKYFPDYRLYDPITTKLVTIRDLLTHRIGTKTFQGDFTFWNTKLSREEIMKRMRLLKPSQIFRQDYGYRNSCFLTAGQVIPKVTGTQWEDL

SEQ ID NO: 1543 - DNA, 807 bp, Unknown
  Obtained from environmental sample
  misc_feature (1)..(807): n is a, c, g, or t
ttgcgtcacaacatgggcagcagcagcaaaccacctgttgaattattacggaataaagcatgggtagaagcaaatggccataccgcttctattatggattatgcccgtttcaattatgtagctcaacctgaagatggcattactgaaaaaggtttatttccccgcattggcgattatgacaaatgggctattaaatggggttatacattaacagatacaaaagatgaagcagctgatgaaaagcttaccaacaaatggatcatagacagccttgccgcaaattcccgtctttggtttggttcagaaataaatccttacgacccccgttcacaaacagaagaccttggcgataatgccatgaaagcaagtgaatatggcattaaaaacctgaaacgcattattacaggtttgcctgaatggacaaaagaagaagctgacaaatatgagaaccttgatgatatgtacggccaggtaatgatacagttcaaccgctacatgtttcatgttacaaaaaacatcggtggtatttatgaaacgccaaaaagtatagaacagagcggcgatgtgtatgagccaacgccgaaagctatacagaaagaagccatctcttttttgcagaaacaattatttgaaacacccacatggttgtttgacaaacatattcttaacaagatcagtaaccctacatcatcagaaatgctgggcaatgtgcagacaaatgtattaaacagtttattcaggccttcgcgattgagcattaaggctatcagcagcaacaggtttggagcagccaatacataccagtag

SEQ ID NO: 1544 - protein, 268 aa, Unknown
  Obtained from environmental sample
  misc_feature (1)..(268): Xaa is any amino acid
MRHNMGSSSKPPVELLRNKAWVEANGHTASIMDYARFNYVAQPEDGITEKGLFPRIGDYDKWAIKWGYTLTDTKDEAADEKLTNKWIIDSLAANSRLWFGSEINPYDPRSQTEDLGDNAMKASEYGIKNLKRIITGLPEWTKEEADKYENLDDMYGQVMIQFNRYMFHVTKNIGGIYETPKSIEQSGDVYEPTPKAIQKEAISFLQKQLFETPTWLFDKHILNKISNPTSSEMLGNVQTNVLNSLFRPSRLSIKAISSNRFGAANTYQ

SEQ ID NO: 1545 - DNA, 633 bp, Unknown
  Obtained from environmental sample
  misc_feature (1)..(633): n is a, c, g, or t
atgaataaaaagaactgcaataaaagcagcctgatattcgacgaatttccgaccatttattttaatggaattgataacctgattgcgacagcacgttcgaataaagttgctacgactttggccgttcaggacgccagccaattaaaacttcattatggaaaagaacaagcagatgtgatcatgaacattgtgggcaatacaattagcggccaggtaagcggcgatacagctaaacaactttcagaaaagttcggaaagattctgcaagaccgtcagagtgttgccatcaatcgaaatgatacgtcaattacgaaatctaagcaattagagttagccataccagtcagcaaaatatcctcgttatccagtggcgaattcgttggcatggtagctgataatccagaccaaaagattgaactaaaggcattctgtgctgagataattaatgaccatgaagcacttggtcgtgagcaggctcgatataaagagttaccgattttctcagaggtggagccgagcgatgtcgtgaagaactatttgcagataaagaaagacgtggcaacgattcttcggacggaaattgaccggatgctggatacaccggaattggaaacgatgataatcaaaaagtaa

SEQ ID NO: 1546 - protein, 210 aa, Unknown
  Obtained from environmental sample
  misc_feature (1)..(210): Xaa is any amino acid
MNKKNCNKSSLIFDEFPTIYFNGIDNLIATARSNKVATTLAVQDASQLKLHYGKEQADVIMNIVGNTISGQVSGDTAKQLSEKFGKILQDRQSVAINRNDTSITKSKQLELAIPVSKISSLSSGEFVGMVADNPDQKIELKAFCAEIINDHEALGREQARYKELPIFSEVEPSDVVKNYLQIKKDVATILRTEIDRMLDTPELETMIIKK

SEQ ID NO: 1547 - DNA, 588 bp, Unknown
  Obtained from environmental sample
  misc_feature (1)..(588): n is a, c, g, or t
atgccgaactcgttcaaacgctccctcgtaaccgccgctttgccttatgctaatggtccagtacacattggacatttagccggatgctatttaccggcggatatttacgtgcgttatttacgaagcattggcagcgatgtgaaatttatttgcggtagcgatgaacatggtgttccaattaccatcaaagcaaaaaaagaaggaattacgccgcaacaggtagtagataaataccacaaaataatgggcgatgcgttcaaagagtttggaatttcctttgatatttattcgcgcacaagtaataaagtacatcacgaaacagcgtccgatttttttaaaacgctttacgataagggagtttttactgagcaagttacggaacagtattacgacgaggaagcgaaacagtttttggctgatcgttatattacgggaacttgtcctaagtgcgcaaacccgaatgcttatggcgatcagtgtgaaaaatgcggttcatctttgaatgcaaccgatcttattgatccaaaatctacgttgagcggaaacaaacccgttttaaacaaacaaagaactggttcttgcctttag

SEQ ID NO: 1548 - protein, 195 aa, Unknown
  Obtained from environmental sample
  misc_feature (1)..(195): Xaa is any amino acid
MPNSFKRSLVTAALPYANGPVHIGHLAGCYLPADIYVRYLRSIGSDVKFICGSDEHGVPITIKAKKEGITPQQVVDKYHKIMGDAFKEFGISFDIYSRTSNKVHHETASDFFKTLYDKGVFTEQVTEQYYDEEAKQFLADRYITGTCPKCANPNAYGDQCEKCGSSLNATDLIDPKSTLSGNKPVLNKQRTGSCL

SEQ ID NO: 1549 - DNA, 459 bp, Unknown
  Obtained from environmental sample
  misc_feature (1)..(459): n is a, c, g, or t
atgaatttttataatctttttgctttcgtttttacgggaatttgttgtgattgtcttgaacccggatcggttaaaagtgcggtcaagagttcggaactcgttgtgttagcgacagcaatttctcaagaaactgtaatcgtggactcctcatctgacagtttaaaaaccgaattatcatattcttactggcgctttaaatttgtggtaaaaaataaatttaaagggacaataacttccgacacaatagtcgttttgacgccagatgctgaggaggcatgcggaatttcattcgctttaggtaaagactacatagtttacggaagttcctggacaattaatcagcgaactcgaaaacccgttaaattgcgagaaaatagtttcaagacaatctcctgtacgaggactcgcgaatttgacgcatttgaaattgacgaaatcaaaaaaactttgggactctga

SEQ ID NO: 1550 - protein, 152 aa, Unknown
  Obtained from environmental sample
  misc_feature (1)..(152): Xaa is any amino acid
MNFYNLFAFVFTGICCDCLEPGSVKSAVKSSELVVLATAISQETVIVDSSSDSLKTELSYSYWRFKFVVKNKFKGTITSDTIVVLTPDAEEACGISFALGKDYIVYGSSWTINQRTRKPVKLRENSFKTISCTRTREFDAFEIDEIKKTLGL

SEQ ID NO: 1551 - DNA, 741 bp, Unknown
  Obtained from environmental sample
  misc_feature (1)..(741): n is a, c, g, or t
ttgaaattactggcaggttctataaggaaaatcctttatcttagtttaaccggaggtgagcctnttatacgggatgacctggaagatatcataaaattatttacagccggaaataaagtttaccgatatcaaatgccaacttcaggttacaaaacatctttgattttggaaaaaactcaaagaatactccgggaaaatccacgtatcccattcagaattcatgtttctcttgacgggaataaggctgtttataaaaaagtaaggggtaaagatgcatttgataatgcagtagatacaattaaagagctgaataaattaaaattatattatcctcactttgatattagtattgtaactactgtttgcagttataaccaggatatcctggaagaattgaatgaaattgttgaaagtatccatcctcatggtgagtggtgcataaattttatcagaggtgaaccaacaaacccaaaagcaaaggatgttgacctggagaactatgcaaaagtcaacagcctgattgataaaagaataacaaacggttcgtatagaggatactccggacatatgacctctggctggctttcagcaaaaaatgccgcgaggagaaaaataatcttcaaaatactgaaaaatgagtataaaggcggaggctgttcggcgggttctttaggaggtgtagtttatcctgatggttcagtttacccctgtgagattttaaacaaatcagtggaaaactga

SEQ ID NO: 1552 - protein, 246 aa, Unknown
  Obtained from environmental sample
  misc_feature (1)..(246): Xaa is any amino acid
MKLLAGSIRKILYLSLTGGEPXIRDDLEDIIKLFTAGNKVYRYQMPTSGYKTSLILEKTQRILRENPRIPFRIHVSLDGNKAVYKKVRGKDAFDNAVDTIKELNKLKLYYPHFDISIVTTVCSYNQDILEELNEIVESIHPHGEWCINFIRGEPTNPKAKDVDLENYAKVNSLIDKRITNGSYRGYSGHMTSGWLSAKNAARRKIIFKILKNEYKGGGCSAGSLGGVVYPDGSVYPCEILNKSVEN

SEQ ID NO: 1553 - DNA, 804 bp, Unknown
  Obtained from environmental sample
  misc_feature (1)..(804): n is a, c, g, or t
ttgatccgttttaatgtttatatatcagtgtgtttaaataaaataagaattatgaatatcttaaaaaatcaaacaagctttaagccttttttgtaccttaagatcgggctgattttattagttatcggagttgtaataggcggatgttccggtatgaatcactatgagaaggggaaggatttcatggcaaaaaagcaatacaccgaagcaatttcagaatttcagaaaattgatccgggtgaaaaagatttcaggctgggacaatcaaaaataagctatatacagggactgcttgcattcaacgatagtctattacaggcagcagaaatgaacctgcgcaaagtggaagctgatgatgagttctatcatgattcacagttaatgcttgaaaagatccggcagaaaaatgaaaggtttgtatctcagccgaaagatactgtaataatcagggaagaaattaccggcacaaaaggaatagagaaggaaaaagaagccgagactgcgccaagtgatgcggaattaacgggaagatatgtatcacagatggaagatattataaacaaatttgaatcactctaccaatcagcgcatgttgctgccgttgattcaaagaaaaattatctttcaaatatgagatcatctctaagccagtttaactctttgaattacagggcaaaagagaaagatgccggtgctcttgagctgaaacagaaaacgaatgactggatgaataaaaggatttcatttatcagtaaattaatagcagataataccatctccgaaacaaacacatcacgatcctaa

SEQ ID NO: 1554 - protein, 267 aa, Unknown
  Obtained from environmental sample
  misc_feature (1)..(267): Xaa is any amino acid
MIRFNVYISVCLNKIRIMNILKNQTSFKPFLYLKIGLILLVIGVVIGGCSGMNHYEKGKDFMAKKQYTEAISEFQKIDPGEKDFRLGQSKISYIQGLLAFNDSLLQAAEMNLRKVEADDEFYHDSQLMLEKIRQKNERFVSQPKDTVIIREEITGTKGIEKEKEAETAPSDAELTGRYVSQMEDIINKFESLYQSAHVAAVDSKKNYLSNMRSSLSQFNSLNYRAKEKDAGALELKQKTNDWMNKRISFISKLIADNTISETNTSRS

SEQ ID NO: 1555 - DNA, 414 bp, Unknown
  Obtained from environmental sample
  misc_feature (1)..(414): n is a, c, g, or t
atgggatcaggaccaggaaaatccattaaacataaaacgaaggccaatccaatgaacaaaactcagatgctaatggactggattgtgaaaaaaattttcccaattactattggtatctttatcctgatatatatctggtggtttcgattgactccttggagcttccaagatgattgctgtcctaacatcaattataaatcgggtctatttttgctgtcttcttatattggttcaggaatattttggcagcttactaaaaaatacacatggttctttggtatgacgtcggtagttttcttcatcttcaatagcttatacgcgctggtttttatgccgagcataattgaaacagcaaattacaacggggcaaaatattatttggtatcgtactccatctggcccgattcgccatga

SEQ ID NO: 1556 - protein, 137 aa, Unknown
  Obtained from environmental sample
  misc_feature (1)..(137): Xaa is any amino acid
MGSGPGKSIKHKTKANPMNKTQMLMDWIVKKIFPITIGIFILIYIWWFRLTPWSFQDDCCPNINYKSGLFLLSSYIGSGIFWQLTKKYTWFFGMTSVVFFIFNSLYALVFMPSIIETANYNGAKYYLVSYSIWPDSP

SEQ ID NO: 1557 - DNA, 765 bp, Unknown
  Obtained from environmental sample
  misc_feature (1)..(765): n is a, c, g, or t
atggataaatttttaagttgcgattggggtacttcttattttcgtattcgccttatctcgttaccaggtttaattgttttggcagaggaaaattcgggccagggaattgcatcagtttttaatttattgaaagaaaaaaaattaatcaaagaagatcattttgatttttatttatccattttaaataaggggattaaaaatttagaacaacaattacaaaccgggttaaaaaatattccagttattatttcgggaatggcttcatccagtattggtatgatagagataccatacaaatttttgccttttcatgtggacggttcggatctaatcgcaaaaaaaattgctgtcacagagagattccccaacgatatttttattatttcaggaataagaacagaaaatgatgtaatacgcggagaagaaacgcagttaatgggttgttcagaagaagatggattatacctctttcccggtacccattcaaaacatataacggtaaaaaacggagcagcggttgattttaaaacctatatgactggtgaagttttcgggctgcttgcccggcaaagtattttgtcatcttccatagttaaggctaaagctacaggtcaatcattaccagcattcgataaaggagtacatgatgcggcaataaatttattacatgcttcctttttggacgtacaaatcaactctccgattttatccaaagagaaaactattatacttagcgggtgcttattgccgcgattaaaagattaa

SEQ ID NO: 1558 - protein, 254 aa, Unknown
  Obtained from environmental sample
  DOMAIN (8)...(251): 2-keto-3-deoxy-galactonokinase
  misc_feature (1)..(254): Xaa is any amino acid
MDKFLSCDWGTSYFRIRLISLPGLIVLAEENSGQGIASVFNLLKEKKLIKEDHFDFYLSILNKGIKNLEQQLQTGLKNIPVIISGMASSSIGMIEIPYKFLPFHVDGSDLIAKKIAVTERFPNDIFIISGIRTENDVIRGEETQLMGCSEEDGLYLFPGTHSKHITVKNGAAVDFKTYMTGEVFGLLARQSILSSSIVKAKATGQSLPAFDKGVHDAAINLLHASFLDVQINSPILSKEKTIILSGCLLPRLKD

SEQ ID NO: 1559 - DNA, 834 bp, Unknown
  Obtained from environmental sample
  misc_feature (1)..(834): n is a, c, g, or t
ttgtttgatgaagtaaaaggttattttacttcaaggtttaaaattgaaaggacaccgaggaaggctattggccctaagctgaattattatcctctaagtcattttaaggagaaagatttagtcgaagtagtaagtaagagagataaagtcctaaaggtagaaacatcatttgaaattaatcaaaagattgctaccaatctcctagaaatttgctttggacatcctaaatgtgtttcaatgatccttgatatcgaaagcccttctccaagattagagaagggaagacttgtaaatgagaaaaagttatttgtaaatatagttgataaagtaatcaattcggagatactcaataacatcaccggttatatttctgttgatgcattaataagcttgtgtacgtttagatatattagccctgacttgatatatttgatacgagatgaggaaagtctaaaaaagtatgacctgtctactgttttaaagtgccgagaatttgtccgtacgcatctttcacccaccggtttattctccagtcctgcatccaaacgcagtaatggaccgcttcaaatgtatggaactgatccagttgtaagaaattttcttggaatgaagctaaagtgtgataacttgcaaaggtacatttatttgcaaaacgaagctgagaattactggctgagcatcttcaatggcaataatgtaagagacgattataaaccaagagggtcacaacaaatcgcgattatttcagaaatgctttacccattatgtagaattcttgctgcanatcatttcgatgaaaatgacgctcagaaagcattggaaacgaaactttaa

SEQ ID NO: 1560 - protein, 277 aa, Unknown
  Obtained from environmental sample
  misc_feature (1)..(277): Xaa is any amino acid
MFDEVKGYFTSRFKIERTPRKAIGPKLNYYPLSHFKEKDLVEVVSKRDKVLKVETSFEINQKIATNLLEICFGHPKCVSMILDIESPSPRLEKGRLVNEKKLFVNIVDKVINSEILNNITGYISVDALISLCTFRYISPDLIYLIRDEESLKKYDLSTVLKCREFVRTHLSPTGLFSSPASKRSNGPLQMYGTDPVVRNFLGMKLKCDNLQRYIYLQNEAENYWLSIFNGNNVRDDYKPRGSQQIAIISEMLYPLCRILAAXHFDENDAQKALETKL

SEQ ID NO: 1561 - DNA, 657 bp, Unknown
  Obtained from environmental sample
  misc_feature (1)..(657): n is a, c, g, or t
ttggagtaccaactattgaaattctatagtacaattattgtcttatgcgaacccgactacgaaatattacgaaacgatctgaaggataaaaatattattctttgcccgcacccttctaatttgaaataccaaaaaattcggaaagaagttacaaacgtttgtttcatcggaagtaattatcagccaaactcagatggaattaatagcttcatagagtgctgttggcctataatctctgatacgcataatgtcacgcttaccgttttcggaactgtatgtaattctgtatcattaaaaggacaaaaacaaattctgctaaaggggatcgtggaagatttaaacgagatatattcttatgcagacataatcataaatcctgttcgctttggatcaggtttaaaaataaaaactgttgaagcgttagccagtggattgccactagtatctacaagtcattcagttcgagggtttgaaaagctacaaggtaaaggatttttagtagctaatactacagcggaattttgctcgacaatatcttcccttatttgtgatttcaagacacgtaaaagtttagggaaaagcgcatatacgtttattcaagaaaactattcacaggatgcatgctttgctcctttactgggagcaatatataaatga

SEQ ID NO: 1562 - protein, 218 aa, Unknown
  Obtained from environmental sample
  DOMAIN (37)...(198): Glycosyl transferases group 1
  misc_feature (1)..(218): Xaa is any amino acid
MEYQLLKFYSTIIVLCEPDYEILRNDLKDKNIILCPHPSNLKYQKIRKEVTNVCFIGSNYQPNSDGINSFIECCWPIISDTHNVTLTVFGTVCNSVSLKGQKQILLKGIVEDLNEIYSYADIIINPVRFGSGLKIKTVEALASGLPLVSTSHSVRGFEKLQGKGFLVANTTAEFCSTISSLICDFKTRKSLGKSAYTFIQENYSQDACFAPLLGAIYK

SEQ ID NO: 1563 - DNA, 702 bp, Unknown
  Obtained from environmental sample
  misc_feature (1)..(702): n is a, c, g, or t
ttgtctatcatcaaaaccacgttgcttacggaaccaaaaagcaacttcactttagtttatggcaaccgcaacaaagcttccatcatttttaaagaagaattggaagcgctgaaagataaatttattgagcgctttcgcatctatcatatccttagcagggagcaaatggactcgcccattaatgaaggaagaattgatgccgcaaaatgcgaacagctgtttacaaaattgatcaacataaaagctaccgatgagttctttatatgcggaccagagcaaatgattttttgcgtcaaagaactattggaagtaaacgatgtagccaaagacaatatacattttgagttgtttaccattcccggacaaaaacaaactttaattgccggaaaagaaacagcttcagaaaaaattgtaggacaaacagcgcaagtcagtataaagttggatggaagcagtttcgaatttgagttgccttataatggtcaaacaattttaaacgccgcacttgatctgggagcagacttgccttacgcttgtaaaggtggcgtttgcaccacgtgtaaagcgaaactccaggaaggcaaagttgaaatggacactaattggggattagaacaagatgaggtagataaaggttttattctcacttgtcagtcgcacccgcttacagaaaaggtggtcgttgattttgatgctcgctaa

SEQ ID NO: 1564 - protein, 233 aa, Unknown
  Obtained from environmental sample
  DOMAIN (2)...(101): Oxidoreductase NAD-binding domain
  misc_feature (1)..(233): Xaa is any amino acid
MSIIKTTLLTEPKSNFTLVYGNRNKASIIFKEELEALKDKFIERFRIYHILSREQMDSPINEGRIDAAKCEQLFTKLINIKATDEFFICGPEQMIFCVKELLEVNDVAKDNIHFELFTIPGQKQTLIAGKETASEKIVGQTAQVSIKLDGSSFEFELPYNGQTILNAALDLGADLPYACKGGVCTTCKAKLQEGKVEMDTNWGLEQDEVDKGFILTCQSHPLTEKVVVDFDAR

SEQ ID NO: 1565 - DNA, 681 bp, Unknown
  Obtained from environmental sample
  misc_feature (1)..(681): n is a, c, g, or t
gtgatcattactgtagcaaaaggcgcattggaggaatatttcagcttcttaaaaattaacccatacaaagcatattcactttacacttttgtagatgtgaagatcttcaatgaaaaggctgaaagaaaaaatgagataagcgatgtctttaaattggtatcggtaggcgccctgcgaaaacaaaagaaccataagtttttactggaagctttccgccaacttaataaaaagaaataccaactggacctgtatggagcgggcccgttacaaggcgagcttgaagaagagatcagggaacacaaattaaatgtgaatcttaaaggcgaggtaagaaatattgaaaagataataaaccaatatgaggtatttgtgatgtcttctacatttgaaggattttcactcagcgtgctggaggcaatggcaatgggcatcccgttattgttgagcgatatcccatccttccgtgaacaatgcgaagacaccgcggtatattttaaactcaatgatgtgatcgatttcaagagcaaacttgagataatggcatccggccctgcggttacgatcgatatagcaaaaagagcacaggaaagagcagttaaaaacttttctcttgaacatcatatggatgggctaagaaaaatttatacagaagtattggaattatatgcccgcgaaaaataa

SEQ ID NO: 1566 - protein, 226 aa, Unknown
  Obtained from environmental sample
  DOMAIN (37)...(197): Glycosyl transferases group 1
  misc_feature (1)..(226): Xaa is any amino acid
MIITVAKGALEEYFSFLKINPYKAYSLYTFVDVKIFNEKAERKNEISDVFKLVSVGALRKQKNHKFLLEAFRQLNKKKYQLDLYGAGPLQGELEEEIREHKLNVNLKGEVRNIEKIINQYEVFVMSSTFEGFSLSVLEAMAMGIPLLLSDIPSFREQCEDTAVYFKLNDVIDFKSKLEIMASGPAVTIDIAKRAQERAVKNFSLEHHMDGLRKIYTEVLELYAREK

SEQ ID NO: 1567 - DNA, 819 bp, Unknown
  Obtained from environmental sample
  misc_feature (1)..(819): n is a, c, g, or t
ttgtatcaactatgcaatatactgggtggcaattattattatcaacaaaaaacaatttgtataacaaggtttaatagtatgaatattcgcaaagtgctgctactggaagattatagctcatttcatctgaatttgcgcgacgggctgcgtgaattgggtgttgatgccaaagtagcatcctcaggggatatttataaaaattttgcaagggatatcgacctgtcgtttaaagcctccggcaaccgtattgtaaattattcaaggatggcaaaaacatacctgtcatcctggaaacatttttcgggaaatgatgtggttcagatgataaccccgcggatattatatggtaaatggagtgataattttttctttggccacatacaaaaaaataatggcaaagtgttttatgccgcatgcgccgcagatgtaacatactttgaagcctatagaaaaggggttacggctaaatatggatactctgttcaggaaaacatgctgcgtgattttaaggtatcagacagtactggaaaaatattgtgggaacaggatgattttatagaaagggaaaaactttatctaaacaaatttgatggcatcatacccgtgttgtacgattatttaattgcttacaggcatatgggccaaaaaaatgtaaggcgtatgatcccgctgccccttaactgtaacagcctttcttatagtgagaatatagtgacgggtaaaataaaaataattcatggcgtttcggaaaccgggaatattttaagggacttatataattttagacgcataaataaaatgaaaaaaaatatccgatga

SEQ ID NO: 1568 - protein, 272 aa, Unknown
  Obtained from environmental sample
  misc_feature (1)..(272): Xaa is any amino acid
MYQLCNILGGNYYYQQKTICITRFNSMNIRKVLLLEDYSSFHLNLRDGLRELGVDAKVASSGDIYKNFARDIDLSFKASGNRIVNYSRMAKTYLSSWKHFSGNDVVQMITPRILYGKWSDNFFFGHIQKNNGKVFYAACAADVTYFEAYRKGVTAKYGYSVQENMLRDFKVSDSTGKILWEQDDFIEREKLYLNKFDGIIPVLYDYLIAYRHMGQKNVRRMIPLPLNCNSLSYSENIVTGKIKIIHGVSETGNILRDLYNFRRINKMKKNIR

SEQ ID NO: 1569 - DNA, 783 bp, Unknown
  Obtained from environmental sample
  misc_feature (1)..(783): n is a, c, g, or t
gtgacagaacatttggcacactttaatattaaaacacttctactgatttttttattgttctctaattttgagaacttcggacaggtgtatcctgatacaactgttcatagaatattaaaaacaggcatcaacttaataattgatcaaaagtatgataaagcggaaaaactttttgatcaactggataaatcgcgtaaagatcttccatttggaaaaatttatcttgccgcagtcagcattgcaagatcgtacgattatggtgaaccttacaatgaggaattgattaataactatcttgaaagcgcaaaaaatatatcggaaaagcttattgaaaaagatcccaagaatatctggaataactattttcttgcattaaccgaagggtatattgcatactatgatgctcttctcgaaagctggctgcaggcattctcaacaggtttaagttcagtttcaacttttgaaaactgtcttgatataaataataatttttacgaggcgtttattgcaataggcagctacaagttttggaaaagcaaaaaaacagaatttataagttggcttccgttttttgatgatgaaaaggaacttgggattaaatatttacaaaatgcaattaaatattctggatacaattcgcatttagctatccattctttaatatggatatacattgaacagaaagattttgataatgcaataatagttgcggaatcagcacttaaagatcatccaaactcaagaatatttaaatggggttggcgcgatcttacgagaatatga

SEQ ID NO: 1570 - protein, 260 aa, Unknown
  Obtained from environmental sample
  misc_feature (1)..(260): Xaa is any amino acid
MTEHLAHFNIKTLLLIFLLFSNFENFGQVYPDTTVHRILKTGINLIIDQKYDKAEKLFDQLDKSRKDLPFGKIYLAAVSIARSYDYGEPYNEELINNYLESAKNISEKLIEKDPKNIWNNYFLALTEGYIAYYDALLESWLQAFSTGLSSVSTFENCLDINNNFYEAFIAIGSYKFWKSKKTEFISWLPFFDDEKELGIKYLQNAIKYSGYNSHLAIHSLIWIYIEQKDFDNAIIVAESALKDHPNSRIFKWGWRDLTRI

SEQ ID NO: 1571 - DNA, 729 bp, Unknown
  Obtained from environmental sample
  misc_feature (1)..(729): n is a, c, g, or t
atgctgggagaggaaagaagcattgttactgatattccgggaacaacacgtgatagtcttgactcaattttgaaatattatggagaagaaattattctggtcgataccgcaggtcttcgaaaaaaaaagaaagttgaagaaagtatagaatttttttctaacataagaacgtttaaggcaatcagcgaaagcgacgttacagttttaatgcttgatgttcagactggatttgaaaaacaggatcagaaaataattgatgaagttgtgcgatggagaaaagggttggttatcgcaattaataaatgggacttgatggaaaaggaaacaaatacagcacgggattatgagaacgcaattaaagaaaaattaggtacaatcgattttgctccggtcatttttatctctgcacttactaaacagagaatttacaagcttgtcgatttatgcaaaaaagttcaagcagagagaacgaaaaaaataccgacatcagagttgaatgatgcgattcttcctttgatagaaatgaatccgccaccttcatcaccaacgggaaaagaagttaagataaaatttataaatcaggtcggcgattactatccaatctttcttttttttagtaattatccaaataatattccggatcattacagaagatttctggaaagaacaatcaggaaggtttacggattcgagggagttcctattactgttagtttcagacaaaaataa

SEQ ID NO: 1572 - protein, 242 aa, Unknown
  Obtained from environmental sample
  misc_feature (1)..(242): Xaa is any amino acid
MLGEERSIVTDIPGTTRDSLDSILKYYGEEIILVDTAGLRKKKKVEESIEFFSNIRTFKAISESDVTVLMLDVQTGFEKQDQKIIDEVVRWRKGLVIAINKWDLMEKETNTARDYENAIKEKLGTIDFAPVIFISALTKQRIYKLVDLCKKVQAERTKKIPTSELNDAILPLIEMNPPPSSPTGKEVKIKFINQVGDYYPIFLFFSNYPNNIPDHYRRFLERTIRKVYGFEGVPITVSFRQK

SEQ ID NO: 1573 - DNA, 576 bp, Unknown
  Obtained from environmental sample
  misc_feature (1)..(576): n is a, c, g, or t
ttgtcgcatccaaaaaaaatgccggatagcccggtaagatatattggttggctatcgcgttttggaattacggaaaaaaaagaaggggaatatatattgatactactttcaggtcccgaaccgcaaaggagcattttagaaaaaataatgctggatgaattagaaaattattttgaaccagttttaatagtaagaggtttacccggcagcaacagtttgctttctgtcaaaaacaatacaaggtatctaaatcatttacctgcaaaacaaatggaagaagcaattttaaatgcatcatttattatcgcacgaagcgggtacagtactataatggatttattaaaattaaaaaagaaggcgatactaattcctactccgggacagacagaacaagaatacctggccaatcatcttttgcaaaacaaaatggctttttgcacagtgcaacaaggatttaatttacctgaaactttgaaagcagcttgcgtttttaattatactttttacgatagggatacaatttttcaagaagcactcttgtttgaaaaatattacaaaagcaaagcctccaaataa

SEQ ID NO: 1574 - protein, 191 aa, Unknown
  Obtained from environmental sample
  DOMAIN (33)...(184): Glycosyltransferase family 28 C-terminal domain
  misc_feature (1)..(191): Xaa is any amino acid
MSHPKKMPDSPVRYIGWLSRFGITEKKEGEYILILLSGPEPQRSILEKIMLDELENYFEPVLIVRGLPGSNSLLSVKNNTRYLNHLPAKQMEEAILNASFIIARSGYSTIMDLLKLKKKAILIPTPGQTEQEYLANHLLQNKMAFCTVQQGFNLPETLKAACVFNYTFYDRDTIFQEALLFEKYYKSKASK

SEQ ID NO: 1575 - DNA, 678 bp, Unknown
  Obtained from environmental sample
  misc_feature (1)..(678): n is a, c, g, or t
ttgcagtatcaacgtctatataaaaacgcatcagacactatatacaataaagaaaaagtaagtagcctaaataaactggaagttttgtatgaaacgggaagaaaagagaaacagatacttgctctgcaggcggaccaggcaagaaaacagttgttactacttaagcaaaaaaggtggctacttataatagccatatctcttggattcatcacaatgggttttgttctattctacaaaagcagtattaagaatagggtaattgcccaacaaagacagcaattacaggataagaaaattaattcccttgaacaggagcagaaggtaattgcactgaaaaacatgcttgcaggccaggaagctgaacgttcccgcatagcgaaggatttgcatgatgggcttagtggattattctcaactattaaaatgcatctcagcacacttcagcatcaaaatgaggaacttaaacaaaatgaactgttcaggaaaagctataccctggttgatactgcatcagaagatttgaggcgaatagctcataatatgatgccggaagttttaatgaaacttggcttgatacacgcgcttaatgacttttgtaatacgatcaatcaaaaaaaatccttccatgtatcactgcttaattatggtatggagaaaagggctgaatataaatattga

SEQ ID NO: 1576 - protein, 225 aa, Unknown
  Obtained from environmental sample
  misc_feature (1)..(225): Xaa is any amino acid
MQYQRLYKNASDTIYNKEKVSSLNKLEVLYETGRKEKQILALQADQARKQLLLLKQKRWLLIIAISLGFITMGFVLFYKSSIKNRVIAQQRQQLQDKKINSLEQEQKVIALKNMLAGQEAERSRIAKDLHDGLSGLFSTIKMHLSTLQHQNEELKQNELFRKSYTLVDTASEDLRRIAHNMMPEVLMKLGLIHALNDFCNTINQKKSFHVSLLNYGMEKRAEYKY

SEQ ID NO: 1577 - DNA, 387 bp, Unknown
  Obtained from environmental sample
  misc_feature (1)..(387): n is a, c, g, or t
ttgtgcgtcgcggcagatcaacccacattatcaactgaaacgcttaaaaatcttattaagggagtgtttgaaagtaaaatgcctgaaaatataatatcaatccttgcaagaggaaaaacaggatacctggactctgcagagggtcttggaatgccatttacatgtcataaaatgcttttagagacatatttaaggggaaatagtgataatttaaacccaattttaagaaaaatgattgataatggagttattttttacggagttccagcgagggatgatatggaacttataaatattaatagatacgaagattatctacgtcttgtaaaagaaagtaataaacaaacttattttttaaatgaatcaaaaattagaaaaatgaaataa

SEQ ID NO: 1578 - protein, 128 aa, Unknown
  Obtained from environmental sample
  misc_feature (1)..(128): Xaa is any amino acid
MCVAADQPTLSTETLKNLIKGVFESKMPENIISILARGKTGYLDSAEGLGMPFTCHKMLLETYLRGNSDNLNPILRKMIDNGVIFYGVPARDDMELININRYEDYLRLVKESNKQTYFLNESKIRKMK

SEQ ID NO: 1579 - DNA, 1125 bp, Unknown
  Obtained from environmental sample
  misc_feature (1)..(1125): n is a, c, g, or t
ttgacacatatcctttgccattggcaattaaagggattggggaaaagttggggaattaaaaaaggtttgccaataaagggggtttttcctatagggttttataggaattgttgcaatgcatgttcccatgctgactattttaacatggatcaacagcccgaagttccgcctgatgattttgcagtaaagggccagaactggggatttcctacttacaactggcagaaaatgcaggaagatcattttgaatgtnggcaacagaagtttaaacaaatgagtcattattttgatgcttttcgcattgaccatattcttggtttttttagaatatggaccatacccattgattcagtggaaggcattatgggacgatttgttccggctatttcaatagacatacaagagttttcagaaaatggtatctggtttgattacgacaggttttgcaaaccttttattaatgataaactactagaagaacattttcgtgaacaaacacattttgcaaaaaattctttctttcaaccaaatgaaaaaggcttttacgaattaaaagaagaatttaatacacaacggaaagtagaaaactatttttcgctgcaggacggtaacgaagaaaataaaaagatcaaagaaactttgtttgatattttatctaatgtcatactttttgaagaacctagttcaaacaaagaaaaatttcattttcgtatttccatagaccaaacttcctcctataatcaccttgacgattattttaaaagaaaactttgggatttatacattcattatttctattaccgccatgatgcgttttgggaaaaagaagcaatgcgcaaattgcctgcattaaaggaggcaacaaacatgcttgtgtgtggtgaagacctgggaatggttcctgcttctgttccgggtgtaatgcaacaattaggaatactaagcctggatgtgcaaagaatgcctaaaaaaacaaattcagattttttccgtccgcacacagcgtcttacttatctgtaattactccatcaacacatgacatgagcacaataagagcatggtgggaggaagacagaattaaaacacaacaattttacaatcgcattttggatgaacaagngtga

SEQ ID NO: 1580 - protein, 374 aa, Unknown
  Obtained from environmental sample
  misc_feature (1)..(374): Xaa is any amino acid
MTHILCHWQLKGLGKSWGIKKGLPIKGVFPIGFYRNCCNACSHADYFNMDQQPEVPPDDFAVKGQNWGFPTYNWQKMQEDHFECXQQKFKQMSHYFDAFRIDHILGFFRIWTIPIDSVEGIMGRFVPAISIDIQEFSENGIWFDYDRFCKPFINDKLLEEHFREQTHFAKNSFFQPNEKGFYELKEEFNTQRKVENYFSLQDGNEENKKIKETLFDILSNVILFEEPSSNKEKFHFRISIDQTSSYNHLDDYFKRKLWDLYIHYFYYRHDAFWEKEAMRKLPALKEATNMLVCGEDLGMVPASVPGVMQQLGILSLDVQRMPKKTNSDFFRPHTASYLSVITPSTHDMSTIRAWWEEDRIKTQQFYNRILDEQX

SEQ ID NO: 1581 - DNA, 807 bp, Unknown
  Obtained from environmental sample
  misc_feature (1)..(807): n is a, c, g, or t
atggctatggaagttttaagttttcttaaaaggcaattcaatcactttaacgctaaaagagaattaataagacatgcaccggatttaaggaacgacgcaaagttgttagatgcggttggattggtcgatttgatttacggcgataaatggaagagatttttctggataaaacaggttcgttcggaaatttcagctctctgtcaaatcgttgaagaacttaagccaaagataattctggagattggtacagccaatggaggatccttgtttttattgacgaagttggcttcaaaagacgctacgatcctatcgattgatttacctttcggcaaatttggtggcgggtatccctcatatcgtaccgcattctacaagaccttttgcactgataaccagcaaatgcatctattacgaggtgactctcatagtgttcagaatttcgagattacgaagaaattgctcggcacacgcaaggttgattttctttttatagatggtgaccatacgtatgagggcgtcaaaaaagattttgaaatgtattccaaacttgtctctgagaatgggatcgttgcctttcacgacatcgcatttcacggccttgacagcgattgtaaggttaacaagttttggaatgaaattaggaaagagtatagtgattcgagagagtttgtcgaagacgataaccaattatgggcaggaattggtgtgctatctcaaaaaataaaattaccggctaatgatcaaagtaggattttgtgtttgctaccaattgggaactgtttaaggaactccctgcctcctatttaa

SEQ ID NO: 1582 - protein, 268 aa, Unknown
  Obtained from environmental sample
  misc_feature (1)..(268): Xaa is any amino acid
MAMEVLSFLKRQFNHFNAKRELIRHAPDLRNDAKLLDAVGLVDLIYGDKWKRFFWIKQVRSEISALCQIVEELKPKIILEIGTANGGSLFLLTKLASKDATILSIDLPFGKFGGGYPSYRTAFYKTFCTDNQQMHLLRGDSHSVQNFEITKKLLGTRKVDFLFIDGDHTYEGVKKDFEMYSKLVSENGIVAFHDIAFHGLDSDCKVNKFWNEIRKEYSDSREFVEDDNQLWAGIGVLSQKIKLPANDQSRILCLLPIGNCLRNSLPPI

SEQ ID NO: 1583 - DNA, 738 bp, Unknown
  Obtained from environmental sample
  misc_feature (1)..(738): n is a, c, g, or t
atggctatggaagttttaagttttcttaaaaggcaattcaatcactttaacgctaaaagagaattaataagacatgcaccggatttaaggaacgacgcaaagttgttagatgcggttggattggtcgatttgatttacggcgataaatggaagagatttttctggataaaacaggttcgttcggaaatttcagctctctgtcaaatcgttgaagaacttaagccaaagataattctggagattggtacagccaatggaggatccttgtttttattgacgaagttggcttcaaaagacgctacgatcctatcgattgatttacctttcggcaaatttggtggcgggtatccctcatatcgtaccgcattctacaagaccttttgcactgataaccagcaaatgcatctattacgaggtgactctcatagtgttcagaatttcgagattacgaagaaattgctcggcacacgcaaggttgattttctttttatagatggtgaccatacgtatgagggcgtcaaaaaagattttgaaatgtattccaaacttgtctctgagaatgggatcgttgcctttcacgacatcgcatttcacggccttgacagcgattgtaaggttaacaagttttggaatgaaattaggaaagagtatagtgattcgagagagtttgtcgaagacgataaccaattatgggcaggaattggtgtgctatctcaaaaagataaaattaccggctaa

SEQ ID NO: 1584 - protein, 245 aa, Unknown
  Obtained from environmental sample
  misc_feature (1)..(245): Xaa is any amino acid
MAMEVLSFLKRQFNHFNAKRELIRHAPDLRNDAKLLDAVGLVDLIYGDKWKRFFWIKQVRSEISALCQIVEELKPKIILEIGTANGGSLFLLTKLASKDATILSIDLPFGKFGGGYPSYRTAFYKTFCTDNQQMHLLRGDSHSVQNFEITKKLLGTRKVDFLFIDGDHTYEGVKKDFEMYSKLVSENGIVAFHDIAFHGLDSDCKVNKFWNEIRKEYSDSREFVEDDNQLWAGIGVLSQKDKITG

SEQ ID NO: 1585 - DNA, 924 bp, Unknown
  Obtained from environmental sample
  misc_feature (1)..(924): n is a, c, g, or t
gtgatgtttttcacaagtataagcattnactcctngtttccanatattantttanctcanggtaacaatggcattataataacccatgctcctgctggcgatactttgcctgcaggtaaaaccatgcaacaagtgttgtttgccacaaatgaagattgcaatttcagtattgccggcgagttcaatgggagcctgacaaaaacagaacatcttcaactgcgacttgcacccggcaattatacatataaagccgcaagcaaaataagcgctggtgagttggaagaaagttttacagtaacagatgccgggctaaatgaaatttttatagacctgttatatgtgagcgaccaacaacaacaagccgaaacagaaaagaagaaaatagaaagaccggttgtaaacaggggccggggcaaggaaataagccaggaaacaaacatcaaacctgctaatgaacccgcagcagtagttagtgtgatcctggaaaatatggatactataaatggcggaagttttattatggggaataacaaagcttcaacaaaagatgaagcagaacatactgtgtctattaattcaattctgtttagtaaatacgaagtaacccaggggcagtggcaggttataatgggcaataatccgagcagtaataagggctgcagtacttgccctgtagaaaatgtcagctgggaagaagtaatgaagtttataaagaaactaaatgtaattggcaatgaaaaatttcgcttgcctaccgaagcagaatgggaatatgtggcgaggtaccggaggaaaagaaaaattagaaaaaagcagggggggccggaaaaatttataaaattatctgcatggtattttgcaaattccaaaaaaaaaaccatccgggtagggaaaaacaggcaaattgcgggcgggaatttttga

SEQ ID NO: 1586 - protein, 307 aa, Unknown
  Obtained from environmental sample
  SIGNAL (1)...(19)
  DOMAIN (160)...(307): Domain of unknown function (DUF323)
  misc_feature (1)..(307): Xaa is any amino acid
MMFFTSISIXSXFPXIXLXXGNNGIIITHAPAGDTLPAGKTMQQVLFATNEDCNFSIAGEFNGSLTKTEHLQLRLAPGNYTYKAASKISAGELEESFTVTDAGLNEIFIDLLYVSDQQQQAETEKKKIERPVVNRGRGKEISQETNIKPANEPAAVVSVILENMDTINGGSFIMGNNKASTKDEAEHTVSINSILFSKYEVTQGQWQVIMGNNPSSNKGCSTCPVENVSWEEVMKFIKKLNVIGNEKFRLPTEAEWEYVARYRRKRKIRKKQGGPEKFIKLSAWYFANSKKKTIRVGKNRQIAGGNF

SEQ ID NO: 1587 - DNA, 336 bp, Unknown
  Obtained from environmental sample
  misc_feature (1)..(336): n is a, c, g, or t
atgaaaaagactgttctctcaacgattgccaacagcggcaacaaaaagttcaaaatacccaaatccaaagataaaaacaaagaaatagatgccgatattgagattctgggcaatgatccagataacgacttcgtggttgaaaaattaagtgtcgatgatgtcgatgaggctgggttgcccgtgctacccgccaaatacggtaaagatgacaatgtttggttcaccaatttcgcgatcagaaaaacctcttacaaagaatatatcacccaactttataagggaaagatcgcggggacttttctgccgcaaagggctgcccggcaaaaaaaattttga

SEQ ID NO: 1588 - protein, 111 aa, Unknown
  Obtained from environmental sample
  misc_feature (1)..(111): Xaa is any amino acid
MKKTVLSTIANSGNKKFKIPKSKDKNKEIDADIEILGNDPDNDFVVEKLSVDDVDEAGLPVLPAKYGKDDNVWFTNFAIRKTSYKEYITQLYKGKIAGTFLPQRAARQKKF

SEQ ID NO: 1589 - DNA, 678 bp, Unknown
  Obtained from environmental sample
  misc_feature (1)..(678): n is a, c, g, or t
ttggggataatgggtttagccaattattacatggctagagaaatagcatatggatcaagtaaggctttatcagaattagatgaaatattgaaattcatgtatgagacagcaaagaacgaatctgaaattatgggagaggaatttggagttcccgaatggtgtcagaaacttccagaaccaagaagaaacataacattggttagtatagcaccaactggaactataagtttattagctggttgtaactctggcattgaacccttcttttctgaaataacagaaagacgcgataaaacaggagaatatataatcgacgttccttcagataaggaatattttagatgtgccgtatcttctaatggagctaaagaggtgacatggaaagaacatatagacacacaagcagtaactcaaaaatggtctgatagtggagtatcaaaaactataaatttcccaaatcatactcaaaaagaaacaatagccaaagcatatgtgttggcgtggaaattaggatgtaagggaattacagtttacagaaacgggtcaagaaacgttgaagttctttctccaaaaaacttatctaaaaacaaatgtcctatgtgtggagaagacactgttaagtttgatggttgcacaaaatgtagcaagtgcgactggtctatctgtactgtcggataa

SEQ ID NO: 1590 - protein, 225 aa, Unknown
  Obtained from environmental sample
  misc_feature (1)..(225): Xaa is any amino acid
MGIMGLANYYMAREIAYGSSKALSELDEILKFMYETAKNESEIMGEEFGVPEWCQKLPEPRRNITLVSIAPTGTISLLAGCNSGIEPFFSEITERRDKTGEYIIDVPSDKEYFRCAVSSNGAKEVTWKEHIDTQAVTQKWSDSGVSKTINFPNHTQKETIAKAYVLAWKLGCKGITVYRNGSRNVEVLSPKNLSKNKCPMCGEDTVKFDGCTKCSKCDWSICTVG

SEQ ID NO: 1591 - DNA, 303 bp, Unknown
  Obtained from environmental sample
  misc_feature (1)..(303): n is a, c, g, or t
ttggatgtcacattttcccgcggttcgtnagggtgttattccntaccnngcacttcttgtagtccgcgtctgaaaatattcaaaantcnnnnnnncgtatgttggcntnnnnnnncnntcntnnnnnnncttttcnnnaatttattttacattcttctnanaacacnncatctcaaaaatacattcaaaaaattttacaaaataaactttataaacaagtttctaccaaacttagtggatcacaagagtttacgtccttatataaactcaataaatttgttgaatcgggtcagtatgatttag

SEQ ID NO: 1592 - protein, 100 aa, Unknown
  Obtained from environmental sample
  misc_feature (1)..(100): Xaa is any amino acid
MDVTFSRGSXGCYSXPXTSCSPRLKIFKXXXXVCWXXXXXXXXLFXNLFYILLXTXHLKNTFKKFYKINFINKFLPNLVDHKSLRPYINSINLLNRVSMI

SEQ ID NO: 1593 - DNA, 831 bp, Unknown
  Obtained from environmental sample
  misc_feature (1)..(831): n is a, c, g, or t
atgttggcntnnnnnnncnntcntnnnnnnncttttcnnnaatttattttacattcttctnanaacacnncatctcaaaaatacattcaaaaaattttacaaaataaactttataaacaagtttctaccaaacttagtggatcacaagagtttacgtccttatataaactcaataaatttgttgaatcgggtcagtatgatttagtgattttagatacgccacctgctcagcacacgtggcattttttacatgcgccagaaaaaatcgcgcaactctttaacgaaggagttgctaagtggtttcgcgatccccatcaagctgatctcagttttatgaaaaaagtttttaatttaggaacgcaacaagttcttaaagcgctggaagttttaacaggtgctgaatttattaaagagctttcgttattttttaaagccattcaaaattggcagggtccgcttgagcgacaagttcataattgccaacgcttattgtcggcgccacaaactgagtttattttagtgaccatggcagatcccagtcggattaccgaaagtcaaaaaatcagtcaggaaataactaaagagggttttaatttaacttcgcttgttattaataaaattccaaattggctggacgagtcagaccaaataacgaacctaaaggtccaggaatatcaaaaatatttcacagaaattcagtcacagcttgggaaaaacaaagcgcgttttttacagaatctacttgtgtacaaatcatttgaagtcagtcaaaataatttgcatgtcgatgggcttgaaaagatttataaaaatattcagcgtcttagttag

SEQ ID NO: 1594 - protein, 276 aa, Unknown
  Obtained from environmental sample
  misc_feature (1)..(276): Xaa is any amino acid
MLAXXXXXXXXFXXFILHSSXNTXSQKYIQKILQNKLYKQVSTKLSGSQEFTSLYKLNKFVESGQYDLVILDTPPAQHTWHFLHAPEKIAQLFNEGVAKWFRDPHQADLSFMKKVFNLGTQQVLKALEVLTGAEFIKELSLFFKAIQNWQGPLERQVHNCQRLLSAPQTEFILVTMADPSRITESQKISQEITKEGFNLTSLVINKIPNWLDESDQITNLKVQEYQKYFTEIQSQLGKNKARFLQNLLVYKSFEVSQNNLHVDGLEKIYKNIQRLS

SEQ ID NO: 1595 - DNA, 627 bp, Unknown
  Obtained from environmental sample
  misc_feature (1)..(627): n is a, c, g, or t
atggagattaaaacatctgacaggcaaacggctgttcaacatctttatcttccgtactacctttacagcacacgacctttggataaatcagattttaataaaattattttcctggaagactcgcaaactattcatccgcgatattattttaccgattctattcatacacaaatcaatatcgagcatccatggaaaaacagagggaagtattctattttcattccgcctgctacatttaccgacatctatggaaaatggaatgatacggttaaaattgaattcacctctcattctgaaatggattatggatctgtgaaaattaaatttcaaaaggaaattgataccccatacatcatccagctaattgacgtaactgagggaactgtatataaagaattcaaagcaacagaaagtataacatttgattttatgaatcttgatccgcgactttataaaatcaaactcataagagatagtaacaacaatggaaaatgggatacaggtgattacctgaaacatattcagccggaagtagtggaattttatccggaagacattaccgtaagagctaactgggacgtggaggttgcaattaaagttccactgaaatcagttaagaaacagtaa

SEQ ID NO: 1596 - protein, 208 aa, Unknown
  Obtained from environmental sample
  misc_feature (1)..(208): Xaa is any amino acid
MEIKTSDRQTAVQHLYLPYYLYSTRPLDKSDFNKIIFLEDSQTIHPRYYFTDSIHTQINIEHPWKNRGKYSIFIPPATFTDIYGKWNDTVKIEFTSHSEMDYGSVKIKFQKEIDTPYIIQLIDVTEGTVYKEFKATESITFDFMNLDPRLYKIKLIRDSNNNGKWDTGDYLKHIQPEVVEFYPEDITVRANWDVEVAIKVPLKSVKKQ

SEQ ID NO: 1597 - DNA, 306 bp, Unknown; identical to SEQ ID NO: 1333
  Obtained from environmental sample
  misc_feature (1)..(306): n is a, c, g, or t

SEQ ID NO: 1598 - protein, 101 aa, Unknown; identical to SEQ ID NO: 1334
  Obtained from environmental sample
  misc_feature (1)..(101): Xaa is any amino acid

SEQ ID NO: 1599 - DNA, 759 bp, Unknown
  Obtained from environmental sample
  misc_feature (1)..(759): n is a, c, g, or t
atggaaaagataatattggcattaaacagtaaccaactaaattattcagttgttgaatttgcttactatacagccaaacttactggttcaaaactgacaggtattttcatggaagctcctgtttatgagcctgtaacagaaagtgaggaaatacaggataactcgggtaaacttaataagcctgttttaattaaagcaaaacaagtgactctggatacagaaaaaggtatgcactactttaaggaagcttgtaccaaagaaaaagttcgttatgaagttttccaaagtgaaggctcctctgctgaagatgtcatttttgaaagccgttttgccgacctgctgatcattgatgtcgaaactgctgtaggtaacaataacgaaagttctcaatttgcaaaagagatacttgccagggcagagtgcccggtcatccttcctccaatatcatttaaaggaattgatgaaattattttttgctatgatggaagccggtcttcagtgtttgcaatgaagcaatttacttatctatttcctcaatatgaagataaaaaagtaactgttctcgaagtgaatgaagaaggagtttcatctatttatgaaaaagataaagttcgcgacttgttgaaaggtcattattctcaaattggcttttatgtagtaaatggtgatcctaccattgaattatttacatacctgcttcagaaaaagaactcatttgttgtgatgggagcttatggccgtaaaatgcttttcacctga

SEQ ID NO: 1600 - protein, 252 aa, Unknown
  Obtained from environmental sample
  misc_feature (1)..(252): Xaa is any amino acid
MEKIILALNSNQLNYSVVEFAYYTAKLTGSKLTGIFMEAPVYEPVTESEEIQDNSGKLNKPVLIKAKQVTLDTEKGMHYFKEACTKEKVRYEVFQSEGSSAEDVIFESRFADLLIIDVETAVGNNNESSQFAKEILARAECPVILPPISFKGIDEIIFCYDGSRSSVFAMKQFTYLFPQYEDKKVTVLEVNEEGVSSIYEKDKVRDLLKGHYSQIGFYVVNGDPTIELFTYLLQKKNSFVVMGAYGRKMLFT

SEQ ID NO: 1601 - DNA, 336 bp, Unknown
  Obtained from environmental sample
  misc_feature (1)..(336): n is a, c, g, or t
ttgaaaagtgggaagggagatgacagcaaagcatatatccgctggcactttattggttcggttatccgaaaaaaagaaattaatgtattgtggaaagccgcttctccattgagttacgtgagttctaaaacaccgccaacattattcatcaacagcagtgtggcacgaatgcatgccggacgacaggattatattcatgtgctggacagcaatggaatttattccgaagtacatagttttgaaaatgcaccgcattcattctgcttattcaatccctggtttgaaccaacagtaaaatacatcaatgattttcttaaaaaagtttttcaaaaataa

SEQ ID NO: 1602 - protein, 111 aa, Unknown
  Obtained from environmental sample
  misc_feature (1)..(111): Xaa is any amino acid
MKSGKGDDSKAYIRWHFIGSVIRKKEINVLWKAASPLSYVSSKTPPTLFINSSVARMHAGRQDYIHVLDSNGIYSEVHSFENAPHSFCLFNPWFEPTVKYINDFLKKVFQK

SEQ ID NO: 1603 - DNA, 438 bp, Unknown
  Obtained from environmental sample
  misc_feature (1)..(438): n is a, c, g, or t
atgatcagtcaatttgaaaacttaaccatcgaagaaagagaacttttatttaaagctccggttttgttgtcagtacttgcttcctgttctaataaagagatcaataagaaccagaaggcagacgctattaagctatcgcacctgaaaccttttacggccgatccttcacttgttcctttctatgtggaagtagaaaaaaattttgagcgggagtttgaatccatttcaaagcaatacaatcttttcgacgaagcaggtcgcgggcaattaaaggatcagattaaaagaatcactgtggttttgaagaaactcaatagagactatgcttcaaaattgatcaaaagttttgaaaaatatgaacgtcatgtaaaaagggcggcacacaatgttgttgaagattttatttttcctgtgccaatccccgggttaaatgcatag

SEQ ID NO: 1604 - protein, 145 aa, Unknown
  Obtained from environmental sample
  misc_feature (1)..(145): Xaa is any amino acid
MISQFENLTIEERELLFKAPVLLSVLASCSNKEINKNQKADAIKLSHLKPFTADPSLVPFYVEVEKNFEREFESISKQYNLFDEAGRGQLKDQIKRITVVLKKLNRDYASKLIKSFEKYERHVKRAAHNVVEDFIFPVPIPGLNA

SEQ ID NO: 1605 - DNA, 402 bp, Unknown
  Obtained from environmental sample
  misc_feature (1)..(402): n is a, c, g, or t
atgcaaaagacagacagcagattggtgcttgcaaaacaggattacgagatcatcatgttctatataaggagaggactgcccacaattactttcaacaggcaggacgctgaagaactggaaagcgaattaaaaagagcaaaggtggttgataaggaagaactgcccgatgatgttgtgcgccttaattccaaagtcaccgtcaaagaggaaaacgaaaataaaataatggagctgacagtagttaccccggaaaaagcaaacatcaaacaaagatttatttcaattatgtcgccgataggtacggcgttgatcggttttcgaaaaggacaacaggtgagatggaaagtgccatccggtaaaaaaacatttaccatcatggatgtgcagaatctgtatggctaa

SEQ ID NO: 1606 - protein, 133 aa, Unknown
  Obtained from environmental sample
  DOMAIN (54)...(130): Prokaryotic transcription elongation factor, GreA/GreB, C-terminal domain
  misc_feature (1)..(133): Xaa is any amino acid
MQKTDSRLVLAKQDYEIIMFYIRRGLPTITFNRQDAEELESELKRAKVVDKEELPDDVVRLNSKVTVKEENENKIMELTVVTPEKANIKQRFISIMSPIGTALIGFRKGQQVRWKVPSGKKTFTIMDVQNLYG

SEQ ID NO: 1607 - DNA, 648 bp, Unknown
  Obtained from environmental sample
  misc_feature (1)..(648): n is a, c, g, or t
atgaatccatggactagatgcgttatatattcattcaaattaaatacagacctgattgcaaaaagagaaaaagatgagaatgaatattacacactcatttatgatgaattgctgcaaggtgacaatttttccatacaaatcggacctgatgctttagttgaaaacaaaatccgctcatcggccatttatttaacaagctttttatacgatgtagaatacattttaaataaggacgtgaatgtaagaggcatccgcatttgcttaaataaattatggatgcggcagtacctgcaagtaccaaaaatagaagatgttttggaaaaatatatcagtatgaaaactgagaacatctggtataaaccggttgatgctatttcaaaacaattattggaagagatattaaataatcaaaatgaaagtctgctttattatcaaaacaggatcatgcacatggttgaaatatttttcaactggttgcaaaaggagtctgcttattcctcagtcaggtctaatgtaagtcgtgaagatatttacgccgctcaacgcgtagaaagtattttaactgacgatgcagttgctattcccccaaccattaaagaactttcaagacaggtggccatgagtgattctaaattaaaaaaggtttaa

SEQ ID NO: 1608 - protein, 215 aa, Unknown
  Obtained from environmental sample
  misc_feature (1)..(215): Xaa is any amino acid
MNPWTRCVIYSFKLNTDLIAKREKDENEYYTLIYDELLQGDNFSIQIGPDALVENKIRSSAIYLTSFLYDVEYILNKDVNVRGIRICLNKLWMRQYLQVPKIEDVLEKYISMKTENIWYKPVDAISKQLLEEILNNQNESLLYYQNRIMHMVEIFFNWLQKESAYSSVRSNVSREDIYAAQRVESILTDDAVAIPPTIKELSRQVAMSDSKLKKV

SEQ ID NO: 1609 - DNA, 303 bp, Unknown
  Obtained from environmental sample
  misc_feature (1)..(303): n is a, c, g, or t
gtgtttgtgggaagtgcgccgaccctanggatcaagaatgctaccactagcttaaaggggaagaatataaatcgtttcgttgtatctatgactttgcaagctttgcttattgtttcattgttgaaactcaaaaatattcttaaaaattccgggaaaagtaaaccaatttttaagggtcttagggtcgttgaatatcaaatttcttcaggctcagtctgcagtctgaggctggaactcctgagttttgaatacaggactgctaaaagagaaaatacattgttctctaatatagactcaggctaa

SEQ ID NO: 1610 - protein, 100 aa, Unknown
  Obtained from environmental sample
  misc_feature (1)..(100): Xaa is any amino acid
MFVGSAPTLXIKNATTSLKGKNINRFVVSMTLQALLIVSLLKLKNILKNSGKSKPIFKGLRVVEYQISSGSVCSLRLELLSFEYRTAKRENTLFSNIDSG

SEQ ID NO: 1611 - DNA, 564 bp, Unknown
  Obtained from environmental sample
  misc_feature (1)..(564): n is a, c, g, or t
gtgataaataataaagaacagcttttattggagggactggcagctaataaagcggaagcaatagaaacaatttacagggaaaattacggtattatacagtcttttatattaaaaaataatggctatcccgaagatgcaagagatgtttttcaggaagcgatgattgtactgtaccagaaagcgatatcagactcgtttgaactcagttgccaggtaaaaacatacttatattcagtttgcagaaggttgtggcttaaaaaactacaacaactacagcgttccggctcttcatatgaaataggagaagaaacaataccggtcgaagaagatattgaggaccacgaaaagaaaaatgaagattttacgttaatggagcatgcactggataaaataggtgagccttgcaaaagtttattagaagcatattattttcagaaaaaaagtatgccggaaattgccgatttttttggttatactaacgcagataatgctaaaacacagaagtacaaatgcctcgtgaggttaaaaaaaatattttttgctcaatataaaaatggagaataa

SEQ ID NO: 1612 - protein, 187 aa, Unknown
  Obtained from environmental sample
  DOMAIN (24)...(94): Sigma-70 region 2
  misc_feature (1)..(187): Xaa is any amino acid
MINNKEQLLLEGLAANKAEAIETIYRENYGIIQSFILKNNGYPEDARDVFQEAMIVLYQKAISDSFELSCQVKTYLYSVCRRLWLKKLQQLQRSGSSYEIGEETIPVEEDIEDHEKKNEDFTLMEHALDKIGEPCKSLLEAYYFQKKSMPEIADFFGYTNADNAKTQKYKCLVRLKKIFFAQYKNGE

SEQ ID NO: 1613 - DNA, 300 bp, Unknown; identical to SEQ ID NO: 73
  Obtained from environmental sample
  misc_feature (1)..(300): n is a, c, g, or t

SEQ ID NO: 1614 - protein, 99 aa, Unknown; identical to SEQ ID NO: 74
  Obtained from environmental sample
  misc_feature (1)..(99): Xaa is any amino acid

SEQ ID NO: 1615 - DNA, 333 bp, Unknown; identical to SEQ ID NO: 165
  Obtained from environmental sample
  misc_feature (1)..(333): n is a, c, g, or t

SEQ ID NO: 1616 - protein, 110 aa, Unknown; identical to SEQ ID NO: 166
  Obtained from environmental sample
  misc_feature (1)..(110): Xaa is any amino acid

SEQ ID NO: 1617 - DNA, 771 bp, Unknown
  Obtained from environmental sample
  misc_feature (1)..(771): n is a, c, g, or t
ttgcaggactatgatcgggcagttctcgttgggcagcggacatttggaaagggtctggtccagaccaccaggccacttgcctataactcccagttgaaagtcaccactgcgaaatatcatattccaagtggacggtgcattcaggcgatggactatacacaccggaagaacgatggaactgtagaacgtttcgctgattcagtgaagatggaattcaagacgaagggtggaagaaaagtgtatgatggtggcggactggatcccgatataaaagtagaggaagaatatgtagggtcgattacctccgcgttgattaacgccggcttaatttttgaattcgcttcgaagtattgcgccgagcaccctgtgaaacccgacctaaagtcgtttcaaatttcagacagggattttgaaaatttcgtgtcgtacgttaagagtcagaagttctcgtattcaggtcccttggaggatgacgtagataaattagttgaagcagcaaagaaggaccgatactacgaacaaatcggcaacgaacttgaagggctgaggaacagactaaaaacaggtgagtcaaccgaggttaaaacctacaaagcggaaataattgaaattctaagcgaacaaattggttttcattatgatctgtataaaggtcaggcagaaatatttttgaaaaacgataacgcaataattgaagcgcgcaaggtcctgagtgactcgttaacctacaataaattgctttctgttaataattcggatgccaatatttaa

SEQ ID NO: 1618 - protein, 256 aa, Unknown
  Obtained from environmental sample
  misc_feature (1)..(256): Xaa is any amino acid
MQDYDRAVLVGQRTFGKGLVQTTRPLAYNSQLKVTTAKYHIPSGRCIQAMDYTHRKNDGTVERFADSVKMEFKTKGGRKVYDGGGLDPDIKVEEEYVGSITSALINAGLIFEFASKYCAEHPVKPDLKSFQISDRDFENFVSYVKSQKFSYSGPLEDDVDKLVEAAKKDRYYEQIGNELEGLRNRLKTGESTEVKTYKAEIIEILSEQIGFHYDLYKGQAEIFLKNDNAIIEARKVLSDSLTYNKLLSVNNSDANI

SEQ ID NO: 1619 - DNA, 312 bp, Unknown
  Obtained from environmental sample
  misc_feature (1)..(312): n is a, c, g, or t
gtgcgtgtttctttgctggcgtggtatgtagacaaaaagaattatgttgaattgctcctcattcccgcaaaggacaaagtcttattaaaacaacgtttgaatggtgcaatagttcttaagtcaaaagcaactgcaatgattgattcaaatacttcatatcaaatcctattgggattcgatggaaccaatttttctgtatcgattaacggttcttcagttctgacaattccacctgctggatcaccgaatggcactgtaggattccgggttaagaaaggcaccggaagattcgaccagattgcagtgaattga

SEQ ID NO: 1620 - protein, 103 aa, Unknown
  Obtained from environmental sample
  misc_feature (1)..(103): Xaa is any amino acid
MRVSLLAWYVDKKNYVELLLIPAKDKVLLKQRLNGAIVLKSKATAMIDSNTSYQILLGFDGTNFSVSINGSSVLTIPPAGSPNGTVGFRVKKGTGRFDQIAVN

SEQ ID NO: 1621 - DNA, 369 bp, Unknown
  Obtained from environmental sample
  misc_feature (1)..(369): n is a, c, g, or t
ttggttcagacgtcaatgatgaagcgcgacttgaggcaatacacagctaattgtagtttaggcataagcatggacaaagacaccaatttgaattacaaattcagtttacccgataagctatttgatttcatgcattccggaattccggttttagcaagtgacttgcccgaaatttcggccattgttaaacgatatgaaacgggtataattttgaattcacatgcccccaatgaaatatccaaacaaataaaagatctgaaagaaaacccggtacttcaacgaaaattgcatgaaaattgtaaaaaggcaagcgttgttctaaattgggaaaatgaaaaaaaggttttggaagagatttatcttcgttag

SEQ ID NO: 1622 - protein, 122 aa, Unknown
  Obtained from environmental sample
  misc_feature (1)..(122): Xaa is any amino acid
MVQTSMMKRDLRQYTANCSLGISMDKDTNLNYKFSLPDKLFDFMHSGIPVLASDLPEISAIVKRYETGIILNSHAPNEISKQIKDLKENPVLQRKLHENCKKASVVLNWENEKKVLEEIYLR

SEQ ID NO: 1623 - DNA, 1038 bp, Unknown
  Obtained from environmental sample
  misc_feature (1)..(1038): n is a, c, g, or t
ttgacacctgtttgctatgcgcatgctgttattgatgcctctgataaaaagagcgtaggggcttataaatttaatattacaatttttgatgaaaaaggccgcttacttgttagcattcgcaattttaataaaaaattgcttcataacacggctcagcataatgttgtagccccaatccagaaaactaaaacacaagagcataaaatgcttaatcttacttctaacgctctcggctattatcacaccacttggcagacacgcttaataaaaaatgctaagcaaggcaaaacagggtggatattattattcgataatagcaatgaattatttaaaaattttaaaaagcaatataaaaatttatacaaaattataacagtaaaaataggtaaatcgtttggctgcttagaggtgaaagaatctcatattgtttatactataaatccagaaaatattgaaaattataaacttttatttgatgatttgcttgcaaaagatataacacttataggcattgttcatgcttggaatttattagattatagtatttctttggctgatgggaagcgagttaatacttttttaaatcaaggtatctatgtgttgctaaagctaacgcaaacgttgattcgcaataaaagatttcaagccattaaattactttatttgcacaatgataattcaataattgataacccgcttgttgctttagtaactgggtttgctcgaacacttaaatatgagaatccacattatagttatttcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaaaaggccgaccatcgccttccaaaagtgccagctgaagggaaggcgacccttaactgttaa

SEQ ID NO: 1624 - protein, 345 aa, Unknown
  Obtained from environmental sample
  misc_feature (1)..(345): Xaa is any amino acid
MTPVCYAHAVIDASDKKSVGAYKFNITIFDEKGRLLVSIRNFNKKLLHNTAQHNVVAPIQKTKTQEHKMLNLTSNALGYYHTTWQTRLIKNAKQGKTGWILLFDNSNELFKNFKKQYKNLYKIITVKIGKSFGCLEVKESHIVYTINPENIENYKLLFDDLLAKDITLIGIVHAWNLLDYSISLADGKRVNTFLNQGIYVLLKLTQTLIRNKRFQAIKLLYLHNDNSIIDNPLVALVTGFARTLKYENPHYSYFTXXXXXXXXXXXXXXXXXXXXXXXXXXXXXXXXXXXXXXXXXXXXXXXXXXXXXXXXXXXXXXXXXXXXXXEKADHRLPKVPAEGKATLNC

SEQ ID NO: 1625 - DNA, 780 bp, Unknown
  Obtained from environmental sample
  misc_feature (1)..(780): n is a, c, g, or t
atgacggacattgattcatttgaatacgttattccagatcttaagtttttatcatttgaactgatttcagaaaaaaaatcaatagcgagtgattttagagatgagattctaaagataaaaattctagtttttaataacactgccacagttgaggaaaaattttctatacatgaagaaaacgagttggaaacattattagaatttgcatacgagattaacaggattgatcctgatataattctgaccacaggaggcgatcaatttctatttccacatctactattcagagcaaaagcaaacaaagtcgaaaatcaattactagtaaatctaaatagagaaactaatattgaatatattttaaaaaagaacaagttatttctacattctgttactatgaataattccaattcttcaatttcctatatcgcatatggcaaagtgtactttaaacctaagcccttcttcttatatggcagaattcatattgatatcaataactcattcatatacaaagataatggtctagacggattggcagagttatgcagagtatgtagaatgcctatgcaaatagcatcaagatctacaataggtaaatgtcttagcagtctatatttttacaatgctcaaaaaagtgatgttttaattccatggaagcccacgacatcagaagttttcaaatcgttctctgatttattgaaagctgacaaaggcggatctatttttgaatcaaagccaggagcatatgataatgtggcagaatttgattttgtttcataa

SEQ ID NO: 1626 - protein, 259 aa, Unknown
  Obtained from environmental sample
  misc_feature (1)..(259): Xaa is any amino acid
MTDIDSFEYVIPDLKFLSFELISEKKSIASDFRDEILKIKILVFNNTATVEEKFSIHEENELETLLEFAYEINRIDPDIILTTGGDQFLFPHLLFRAKANKVENQLLVNLNRETNIEYILKKNKLFLHSVTMNNSNSSISYIAYGKVYFKPKPFFLYGRIHIDINNSFIYKDNGLDGLAELCRVCRMPMQIASRSTIGKCLSSLYFYNAQKSDVLIPWKPTTSEVFKSFSDLLKADKGGSIFESKPGAYDNVAEFDFVS

SEQ ID NO: 1627 - DNA, 771 bp, Unknown
  Obtained from environmental sample
  misc_feature (1)..(771): n is a, c, g, or t
ttgcaggaagcaaaaaagaagatcgacaaggaacttttggagaaccttacctatgcaaagcacatacatagttccttcctaaccaacgaagacgtcagctcctgccaagactcatttctggtctacaaagctcagaaattgatcagcggtgatttttacaagatcgagcggaccggtgaaaaactggttgtggcaattggtgacagcaccggtcatgggatttccgcttcttatatatcggtggtgacgctcaatatccttgcccggacgatgcgcttctgttgtgggaacccagcgaagatgcttaagttgatcaattcggagctaaacagaattacccatctgaacctgaaaaagcaactgaacgaaacggcagatatgatcgtatgctgcatcgataggaagtgcatgaaaatgaggtacgcctcggcaagaatgcgtggttttattttaagggacgaagaggttattctgcttgaaaaggacaagtgtacgatcggtgaattgtccgtaaatagattcagtataacaaacagagaagtccgtttacgtaaaaatgattgtatctatataatttcagacggaattatcgatcagtttgggggagcatttgataaacgaatgggcttcaagcaattcctggcgatcattaaacaaatgaaagacttgcccatgaccgaacagaaggcgaaaattgaagaagcactagcggattggcaagggggactggaacagaccgacgacattacggtatacggtcttaagatataa

SEQ ID NO: 1628 - protein, 256 aa, Unknown
  Obtained from environmental sample
  DOMAIN (58)...(252): Stage II sporulation protein E (SpoIIE)
  misc_feature (1)..(256): Xaa is any amino acid
MQEAKKKIDKELLENLTYAKHIHSSFLTNEDVSSCQDSFLVYKAQKLISGDFYKIERTGEKLVVAIGDSTGHGISASYISVVTLNILARTMRFCCGNPAKMLKLINSELNRITHLNLKKQLNETADMIVCCIDRKCMKMRYASARMRGFILRDEEVILLEKDKCTIGELSVNRFSITNREVRLRKNDCIYIISDGIIDQFGGAFDKRMGFKQFLAIIKQMKDLPMTEQKAKIEEALADWQGGLEQTDDITVYGLKI

SEQ ID NO: 1629 - DNA, 615 bp, Unknown
  Obtained from environmental sample
  misc_feature (1)..(615): n is a, c, g, or t
atgcttagttatttccatcatgataggatgaaggtgaaccggaatattcctcctgttgtgattacggaattcaggatcttcaacaagcctgtatcagtgaaaagaaaagatggaaagattcagcctatacatctgaagtacagcgacaatatgataagctttgattttgcagcgcttaatttcaccaatcccggtaaaaacaattatgcatataagcttgaagggtttgatcatgaatggatgcacagtggcaatcagcacacagcaacctatacaaaccttgatggtggccaatatatatttaaagtaattgctgccaacaacgatggatattggagcagtgaaggtgcttcagtgaacataacggttgagccgcctttctggaaaacctggtggttttatactgcagctgcatgtttagttgctttatttctttatttcatatacaggctgagaataaaacagatcatgaagcttcagggcatcaggcagcgtatttcccgtgatttgcacgatgatattggttccacattaagtagtattaatatgatgagtgcaatggctaataagggaagcgatgagagaaaaaaagaactatttaaatccatacgataa

SEQ ID NO: 1630 - protein, 204 aa, Unknown
  Obtained from environmental sample
  DOMAIN (69)...(107): Two component regulator three Y motif
  misc_feature (1)..(204): Xaa is any amino acid
MLSYFHHDRMKVNRNIPPVVITEFRIFNKPVSVKRKDGKIQPIHLKYSDNMISFDFAALNFTNPGKNNYAYKLEGFDHEWMHSGNQHTATYTNLDGGQYIFKVIAANNDGYWSSEGASVNITVEPPFWKTWWFYTAAACLVALFLYFIYRLRIKQIMKLQGIRQRISRDLHDDIGSTLSSINMMSAMANKGSDERKKELFKSIR

SEQ ID NO: 1631 - DNA, 639 bp, Unknown
  Obtained from environmental sample
  misc_feature (1)..(639): n is a, c, g, or t
atggagaaggtgatcgacgggccgatcggcgacgaggtcctgaagaagctgtcggatcaccccaccgccaacctggtcgggctgtgctggatgaacgccggcacacgcaacgtctacaacaacaagaaaccgatccggagcgtggaggatctcaaggggctgaagatccgcatgatgggcaacccggtgttcgtcgacaccatgaatgcgctcggcggcaacggcatctcgatggggatggaccagctcatcagcgcgatgcagaccggcgtcgtcgacggggcggaaaacaacgagccgacctacgcgaccggccagcattatcgctatgccaagtactattccatgaccgggcacctgatgatcccggaggtgctggtgttctccaagcggatcttccagtcgctcggcaaggaggaccaggacctgatccgtcggctggccaaggaggcgcagatcgaggagcgcaccctgtggtacgagatggagaagaagtcactcgagcagatgaagcaggccggcgccgagatcgtcgaagtgtccgacaagaagtcgttccaggccgccgtgaagccggtgtgggacaagtacggcgcccagctctcggggctgatcgagcggatccagaatgtgaagtga

SEQ ID NO: 1632 - protein, 212 aa, Unknown
  Obtained from environmental sample
  DOMAIN (1)...(201): Bacterial extracellular solute-binding protein, family 7
  misc_feature (1)..(212): Xaa is any amino acid
MEKVIDGPIGDEVLKKLSDHPTANLVGLCWMNAGTRNVYNNKKPIRSVEDLKGLKIRMMGNPVFVDTMNALGGNGISMGMDQLISAMQTGVVDGAENNEPTYATGQHYRYAKYYSMTGHLMIPEVLVFSKRIFQSLGKEDQDLIRRLAKEAQIEERTLWYEMEKKSLEQMKQAGAEIVEVSDKKSFQAAVKPVWDKYGAQLSGLIERIQNVK

SEQ ID NO: 1633 - DNA, 783 bp, Unknown
  Obtained from environmental sample
  misc_feature (1)..(783): n is a, c, g, or t
atgaaaatatacgtaatacttgccctgctaatattttcaagcaggagcatttactctcaaaatctattgttcaaaaaggtgaaactgactgatagtttaagattaatttgcgtgacagaccacttggacagtttgcaacttaataaaagatttaccttctactgtaaagaccaaacggaagtggctgacattttcaagacatttacagttgggaaaaaggcatcacaggtaggagaagcaaatgaagttcatgtttatattttaaaagggaaagaaatacagccaattcaaattgttattaacccaaaacatcagaacgtgaacacagatgtactgggtgattatgagtattattctttcgatactgcacaattaggtagcgcacatcggaaatatcctctttcatataaggcaaagtggttgaccttcaatacaaagaaagaatttgatgattttataaaagcacatcaaaatgacgcgaggctattatgttacgaagacaacaccctcgagtatggtgggacagggaagatattaattcagcaagataacgttgtgaaagacggatttaagggtgtgtcctacatagaaagtgtgcttagaaaattgaccaacaacagtgacgagtattctgttggtttcttacctacagagaacagacaattatttgcttttgaagtacaatgcagcaaagagctttacgataaaataaaagatacaagttgtataaaaaagggatggcaaatgaataagttcgaacttcttacttattggaaagaataa

SEQ ID NO: 1634 - protein, 260 aa, Unknown
  Obtained from environmental sample
  SIGNAL (1)...(19)
  misc_feature (1)..(260): Xaa is any amino acid
MKIYVILALLIFSSRSIYSQNLLFKKVKLTDSLRLICVTDHLDSLQLNKRFTFYCKDQTEVADIFKTFTVGKKASQVGEANEVHVYILKGKEIQPIQIVINPKHQNVNTDVLGDYEYYSFDTAQLGSAHRKYPLSYKAKWLTFNTKKEFDDFIKAHQNDARLLCYEDNTLEYGGTGKILIQQDNVVKDGFKGVSYIESVLRKLTNNSDEYSVGFLPTENRQLFAFEVQCSKELYDKIKDTSCIKKGWQMNKFELLTYWKE

SEQ ID NO: 1635 - DNA, 549 bp, Unknown
  Obtained from environmental sample
  misc_feature (1)..(549): n is a, c, g, or t
atgaggacaagtactttacttgaaacgccttcattatttacaaccattggaaaaacaacaatggaaattcttcgtcttcgtccttccaactttccaactattcgccttgcacaacttgcagcactgatgagtaaagaggtaaagcttttctctgcaatcaagaatacaaaagacattaaatcgctgcatcagtttatggatgtgactatttcaccctattgggaaacgcattacctgttcgataaaaaatcgaaagctaccaaatcacacatcggctcgtctatgaaaaatacgcttctcatcaatgctgttgcatctgtgttgtttgcctatggaaaatataaagacgatgattcgtattgcgaacgagccgctaagctcttggaaagttgtaaacccgaaaccaactggattatcacgggatggaaaagtcgtgggcagcatccctcaaatgcctgtgacacacaatcgctcttacatcttaaaaatgaatactgcaataaattccgttgtttggaatgcggcataggtgtaaaaattttacaatga

SEQ ID NO: 1636 - protein, 182 aa, Unknown
  Obtained from environmental sample
  misc_feature (1)..(182): Xaa is any amino acid
MRTSTLLETPSLFTTIGKTTMEILRLRPSNFPTIRLAQLAALMSKEVKLFSAIKNTKDIKSLHQFMDVTISPYWETHYLFDKKSKATKSHIGSSMKNTLLINAVASVLFAYGKYKDDDSYCERAAKLLESCKPETNWIITGWKSRGQHPSNACDTQSLLHLKNEYCNKFRCLECGIGVKILQ

SEQ ID NO: 1637 - DNA, 573 bp, Unknown
  Obtained from environmental sample
  misc_feature (1)..(573): n is a, c, g, or t
atggccgaggtcctgtcttggacacatgcgatagaggccagtatctattattacaagtataaagatttcaaaatctcgctaaaaatggagcgacaatcgggaaatgattttgaccctgctggatttggaaatgctttccaacacagccacttactgggaaccgtattgcaggccccctcagatattatagatggccaaaacttgcttcggaaagaaaatcggaataaaaccgtgacattcgatgttgcatttcgaatcgaaaacgcagtagtccaagggaaagtaatagaagaatttagagtaaaaggaaaagcgtgtttagaagaaaggaaattggaaataccgactattttaacgtatggaccgccgagtataagcggtaaatttagagacgtctatatccaaaaatacaatctaggtaatactcaaattatccaccataaagactctatttcaatcctattggatatttcaaatatggaatccctccttactgccaattcagattcttttcagtcaattcaaaaacaatccgaaaccatgatccttcgaataatgggtgcggaaaaatga

SEQ ID NO: 1638 - protein, 190 aa, Unknown
  Obtained from environmental sample
  misc_feature (1)..(190): Xaa is any amino acid
MAEVLSWTHAIEASIYYYKYKDFKISLKMERQSGNDFDPAGFGNAFQHSHLLGTVLQAPSDIIDGQNLLRKENRNKTVTFDVAFRIENAVVQGKVIEEFRVKGKACLEERKLEIPTILTYGPPSISGKFRDVYIQKYNLGNTQIIHHKDSISILLDISNMESLLTANSDSFQSIQKQSETMILRIMGAEK

SEQ ID NO: 1639 - DNA, 354 bp, Unknown
  Obtained from environmental sample
  misc_feature (1)..(354): n is a, c, g, or t
ttgccaaacaaaggtcaactattatatttgacaaaaattgtcaaatgcatggctatacaaaaattaggggttaaactccaggaccttcgtcataaaaaggggttattgttacgtgaagtagctgataaactttcagtggacccggcaatagtatcaaaaattgaaaactgcaaacgccggccaacaaagaatcaggtggagcaattcgcaaatctgtatcaaataaataagcgcgaattgttagttgatttctatagtgatgaagtttgcttggtcctggaaaaggaggaattcgcctatgaagctatattacaagcttccaaaaaaattaaactatacagaaaatcaaaataa

SEQ ID NO: 1640 - protein, 117 aa, Unknown
  Obtained from environmental sample
  DOMAIN (26)...(80): Helix-turn-helix
  misc_feature (1)..(117): Xaa is any amino acid
MPNKGQLLYLTKIVKCMAIQKLGVKLQDLRHKKGLLLREVADKLSVDPAIVSKIENCKRRPTKNQVEQFANLYQINKRELLVDFYSDEVCLVLEKEEFAYEAILQASKKIKLYRKSK

SEQ ID NO: 1641 - DNA, 567 bp, Unknown
  Obtained from environmental sample
  misc_feature (1)..(567): n is a, c, g, or t
atgaaaaagttcattttatttttaggatttttttatcttatttctttttttgcttgccaggaaaaaaactgtaaagagtcgttcgctgatattattaaaaacgattcatcacgcaaacaagaattactggatgtagcggctacattaaaagatacccgaattcaaaaagatgactccatgaatctaataaatattgatccaaaggacgaacttagcccaaaagaattagaagattttagagcaaaaattagaccccgccctgatcgaaatgataaaaaagaccaaaccataattgtttcttcccaaaccatacaggaactaatagggaagaatcctggggtaaaagattctttgattttttatctcggtaaatattgggaatccaacagaatcggaaggtataatgtaagaaatagcattccaggcaatcctcatgatgataatgtgttaaaacatcgtatcacttttgcaatccaatcaaaaagtgaaacagataaaacaatcacaatgtctaaagtttatgatgtaggaagactatgccctcccccatcaacaggttgtttttga

SEQ ID NO: 1642 - protein, 188 aa, Unknown
  Obtained from environmental sample
  SIGNAL (1)...(18)
  misc_feature (1)..(188): Xaa is any amino acid
MKKFILFLGFFYLISFFACQEKNCKESFADIIKNDSSRKQELLDVAATLKDTRIQKDDSMNLINIDPKDELSPKELEDFRAKIRPRPDRNDKKDQTIIVSSQTIQELIGKNPGVKDSLIFYLGKYWESNRIGRYNVRNSIPGNPHDDNVLKHRITFAIQSKSETDKTITMSKVYDVGRLCPPPSTGCF

SEQ ID NO: 1643 - DNA, 843 bp, Unknown
  Obtained from environmental sample
  misc_feature (1)..(843): n is a, c, g, or t
atgagttttatgaaaaccttgctcattaaacggttggaaagcagtttctatgcatttaacaaatctatagacagatttattttttcttatgaagcatttctgaaagcccacgggaagggatttgtttacctcagtaaaaaacactcaggtaaagtattggaatacctgatgaatagcgactttgaagctattgaaaggctgatagaaaatgacaaagcagaatcttataagtcaagcgagttcactgctgctttcaagaaggatttagaaaaggatctaaagacacttaaacttattaaatcgctttgggctgaggtagatagggatccaaagcttgatgaatttgtccgtgttctgaaaacagacaaagtgttaagcaaaagcaaaataatagtatttaccgaatctaaagagaccgctgaatacctcgcaggcgaattgcaatacaacctcaaagagaaacctttgttatatcacggcagttccggcacctcagaattaaaaattgtaatttcaaattttgacaacaaggcaaaaaataaagcaactgatttccgcattcttattgctaccgaagttctttcagaaggggtaaaccttcaccagtctaatgtggtaatcaactatgacatcccctggaatccaacacgaatgatccagcgtgtcggacgcatcaacaggcttgatacaccacataaaaaaattttacttacaatttctttcccaatacacagtcaaacaatatcatcaagctgcaagaagccgttattgccaaaatcaactattttattgaagatgttgcgtaatgatgcaaaagttactgaccgacggagaagaaattag

SEQ ID NO: 1644 - protein, 280 aa, Unknown
  Obtained from environmental sample
  DOMAIN (147)...(229): Helicase conserved C-terminal domain
  misc_feature (1)..(280): Xaa is any amino acid
MSFMKTLLIKRLESSFYAFNKSIDRFIFSYEAFLKAHGKGFVYLSKKHSGKVLEYLMNSDFEAIERLIENDKAESYKSSEFTAAFKKDLEKDLKTLKLIKSLWAEVDRDPKLDEFVRVLKTDKVLSKSKIIVFTESKETAEYLAGELQYNLKEKPLLYHGSSGTSELKIVISNFDNKAKNKATDFRILIATEVLSEGVNLHQSNVVINYDIPWNPTRMIQRVGRINRLDTPHKKILLTISFPIHSQTISSSCKKPLLPKSTILLKMLRNDAKVTDRRRRN

SEQ ID NO: 1645 - DNA, 642 bp, Unknown
  Obtained from environmental sample
  misc_feature (1)..(642): n is a, c, g, or t
atgctggaacaaaatccgaaagtagatgtgggtattcatttggtactgaccagcgaatgggataatgtaaagtggcggcccttaaccgaggctaaatcattaagagatggtgacggctatttttttcctatgatctggccaaacaaaaactatccaaataaagcattgctgcaaaaccaatggaagatagatgacattgaaaaagaatggagggcacaaatagaatcagcaaagaaatacattccacgccttagccatatttcgggccacatgggttgcacgggtattaatgatgaagtaaaagcacttgcaaaaaaattggccaaagaatataatcttcttgttgacccatctgaatttggcgtaaaaggaattggttatgatgggccaacaaaaacatcggaagaaaaaaagaaaagttttatcagcatgcttaacaaactggagcctggaaatacttatctctttgtcgatcaccccggtttaaatacggcggaattacaggcaatacatcatataggttatgaaaatgtggctgtagaccggcaaggtgtaaccgatacctggacggacccggaagtaaaagggacaatcaggaaaaaagaaattcagttaatcacctataaagacctgttgaaataa

SEQ ID NO: 1646 - protein, 213 aa, Unknown
  Obtained from environmental sample
  DOMAIN (1)...(201): YdjC-like protein
  misc_feature (1)..(213): Xaa is any amino acid
MLEQNPKVDVGIHLVLTSEWDNVKWRPLTEAKSLRDGDGYFFPMIWPNKNYPNKALLQNQWKIDDIEKEWRAQIESAKKYIPRLSHISGHMGCTGINDEVKALAKKLAKEYNLLVDPSEFGVKGIGYDGPTKTSEEKKKSFISMLNKLEPGNTYLFVDHPGLNTAELQAIHHIGYENVAVDRQGVTDTWTDPEVKGTIRKKEIQLITYKDLLK

SEQ ID NO: 1647 - DNA, 822 bp, Unknown
  Obtained from environmental sample
  misc_feature (1)..(822): n is a, c, g, or t
atgcgcttaaaattatctctattaattctgcttcttttttccggcattaatggaattgctcaatgcgattgtctgaaggaattctcatttgtacaggattatatggaaaagaatcatccgggtttaaactcaggcactaaggataccagggcttacatcaaaggagtgaagaaattaaagaaggaaataagaaaagctaagcctgggaataactgcaacctgtatttaaatgcatacatgctgctggcgaaggaccaccacatcagtctgggtttcacgatgccggaaataaagcgttttgatacaaaatccgccttatcactggatagcttttatgatagcgtttcctataagagtgcattaagaataaaactggatacaacggagaccattgcccgccttaaaaattctacagagaagattgaaggactataccaggacggggcagggaatcttattgcatttgtaaaagaacccggtaaaggttggaattataaaggcattgccttgcgtacaaaatccttaatattcccggttggaacggttaagtatgaaatccaggagaggccaaccggcagtatttggggaatgatattactgcccgattatcagcggctatacgcaccagttactgtaacgaaagatggaattccaactattggacttacccgggttaaagaaaacaataatgaagccggtaactcagagccgtttacattcagcatattgaatgacagcacggcatatttgcgtctcagcagttttgacggtaagtattanatcagctcgaagctttttctaatcaatagcaccaattcttga

SEQ ID NO: 1648 - protein, 273 aa, Unknown
  Obtained from environmental sample
  SIGNAL (1)...(20)
  misc_feature (1)..(273): Xaa is any amino acid
MRLKLSLLILLLFSGINGIAQCDCLKEFSFVQDYMEKNHPGLNSGTKDTRAYIKGVKKLKKEIRKAKPGNNCNLYLNAYMLLAKDHHISLGFTMPEIKRFDTKSALSLDSFYDSVSYKSALRIKLDTTETIARLKNSTEKIEGLYQDGAGNLIAFVKEPGKGWNYKGIALRTKSLIFPVGTVKYEIQERPTGSIWGMILLPDYQRLYAPVTVTKDGIPTIGLTRVKENNNEAGNSEPFTFSILNDSTAYLRLSSFDGKYXISSKLFLINSTNS

SEQ ID NO: 1649 - DNA, 894 bp, Unknown
  Obtained from environmental sample
  misc_feature (1)..(894): n is a, c, g, or t
gtgccacttaagacatccgtcaagcgaaagttggacttggatgagttcccagagaatgagaagggtttgggggaaagtgagaatcagggaattgagattaggatccagaggtcacctaatgtcaagagtgaagacattctctttgatccgagcatgttggatgactcgtttttggatttaccactcttatcccctgttgcgaagaaatccaatggttctcattctcaatttgtcaatttgactgaagatgaagatgtcaaaggtgtcaatgatgtcaaagatgtcaataatgtgacaagatccaacatgaaggaagaagtcgatgatgtgtttgaagaagtgaaggaatccaatgttatccattctaaatttgtcaatttgactgaagatgaagatatcaaaagtgtcaaagatgtcaaaagtgtcaaagatgtagtagaatctaacaggactgaatacattggaatggaagatgatgttattgatttgaagtccaacgggaaggaagaaaagaatgaagaagaggaagaagaaattttcctttccaaggatcctgtgtcatccaaacctaccgaagaaatctccatctcttccgatgaggaaaacgagttctatgacgaatacgaatacgaaatttctgacgaagatgacgtcatagaaatcatcgacgacgactcacaaaatgctgagacccttcgaatcaacatcagtgattcctcaaaagaaatggaagcagaagcatccggttctcaatcaacaggacggaagtcatccagggtagggaaaagtttacgaattgcgaagtgtgaagtggtggggtgcggattgggagccgaaaaagcgaagccagggcacgtggtgggcaaattgcgagggacctacgcgacccggngn

SEQ ID NO: 1650 - protein, 298 aa, Unknown
  Obtained from environmental sample
  misc_feature (1)..(298): Xaa is any amino acid
MPLKTSVKRKLDLDEFPENEKGLGESENQGIEIRIQRSPNVKSEDILFDPSMLDDSFLDLPLLSPVAKKSNGSHSQFVNLTEDEDVKGVNDVKDVNNVTRSNMKEEVDDVFEEVKESNVIHSKFVNLTEDEDIKSVKDVKSVKDVVESNRTEYIGMEDDVIDLKSNGKEEKNEEEEEEIFLSKDPVSSKPTEEISISSDEENEFYDEYEYEISDEDDVIEIIDDDSQNAETLRINISDSSKEMEAEASGSQSTGRKSSRVGKSLRIAKCEVVGCGLGAEKAKPGHVVGKLRGTYATRX

SEQ ID NO: 1651 - DNA, 738 bp, Unknown
  Obtained from environmental sample
  misc_feature (1)..(738): n is a, c, g, or t
ttgcatggaactcttgctaatgatatagttcaggacctggtttctgcagctcacccatacgccccccttgtcgttagaagccttgccaaagcaagcggaataattagcgcccaacctcaattcttttttgtgccggatgatccggcgttgggatactaccgcaaaatgtttgcaaatacagtttgctccttagaagagagggagcctgtaacagatagtacagacaccaaaagcactgcaaaagtcatttctaaaatgattgatgataatgatcaccaggttgaacagcctgaagtgctgaaggctcgcctgttagacaatttaattggcgattgggaaaggcactttgaccaatggaaatggggcataaaagatacggggaagggaaaattatattatcccgtacccagggacagggaccaggctttttttaattctgatggattattgctaaagtttgtttcaaaaaattatttgaaatttttacagggattcaaaaaaaatattcctgacatagattggttaaactggtcggcccgtgattttgatcgcttttttttaaataagctaactaaaaatgaatggataaatattgctgatagcttcgttatgaatttgcctgatgatgtaattgaaaatgcggcaaaaaagttgcctcccgaaatttatccattcagcagtaaacctataattgacaaacttgagagccgcaggaacattctaaagaaagaggcttga

SEQ ID NO: 1652 - protein, 245 aa, Unknown
  Obtained from environmental sample
  misc_feature (1)..(245): Xaa is any amino acid
MHGTLANDIVQDLVSAAHPYAPLVVRSLAKASGIISAQPQFFFVPDDPALGYYRKMFANTVCSLEEREPVTDSTDTKSTAKVISKMIDDNDHQVEQPEVLKARLLDNLIGDWERHFDQWKWGIKDTGKGKLYYPVPRDRDQAFFNSDGLLLKFVSKNYLKFLQGFKKNIPDIDWLNWSARDFDRFFLNKLTKNEWINIADSFVMNLPDDVIENAAKKLPPEIYPFSSKPIIDKLESRRNILKKEA

SEQ ID NO: 1653 - DNA, 810 bp, Unknown
  Obtained from environmental sample
  misc_feature (1)..(810): n is a, c, g, or t
atggtcctgaactttacaagtatccgatatcgcagttcaaatcgaagcttactcttaagtaatacaagagtagcgaaattgaacatgtacacggttgcagtcgatacattggaaattgtatgtcagggtatacctgccatagatactaatgaactgcatccgtctatcaaagttgaaccaaatgaagatattgtcaaatcgttattctataaccagtcattcaacataattgtatcagatgaggaaacagcaacattatacacaaatccaacatcacgactcagatattcaatacgagaccattgcttgttaattattaagaacgaaatattatattccaaggatgccggcaccaaaatccagaacttggttgacatgttaaaattgaagttttacagttataaaacaatacacgtggctatggatgggattggtatgatggaacggcagttgtattttaaaggtcaggagatatttgaacgttcacaaaaggtgcagtatgctgccattgaaaatgaagtaaacaaaaccattatagaaatccggctcggtagcaggataagcgataagtatgtggtgttttacaaaaagtataaagaagcagtttcaaaaggtaaacattacattattgaatactggaaagcagccgggtttacaaaggcagaatgtgaggatatggaacgtgttgaggttcgattgaaaaagtcagaattaaaactgataagcaggaattttacagagttgcttacttccacatacctcatgagtttgtttcgtaacaaatcagaaaaagtgttactgttcttataa

SEQ ID NO: 1654 - protein, 269 aa, Unknown
  Obtained from environmental sample
  misc_feature (1)..(269): Xaa is any amino acid
MVLNFTSIRYRSSNRSLLLSNTRVAKLNMYTVAVDTLEIVCQGIPAIDTNELHPSIKVEPNEDIVKSLFYNQSFNIIVSDEETATLYTNPTSRLRYSIRDHCLLIIKNEILYSKDAGTKIQNLVDMLKLKFYSYKTIHVAMDGIGMMERQLYFKGQEIFERSQKVQYAAIENEVNKTIIEIRLGSRISDKYVVFYKKYKEAVSKGKHYIIEYWKAAGFTKAECEDMERVEVRLKKSELKLISRNFTELLTSTYLMSLFRNKSEKVLLFL

SEQ ID NO: 1655 - DNA, 906 bp, Unknown
  Obtained from environmental sample
  misc_feature (1)..(906): n is a, c, g, or t
gtgttcacttcctacgcgattcttaaacatagattatttgatatccgtataataatcgccagatctatctcttacaccttactggtaattattctggctataagctatataagcggactactaattataagttccaaatttattagattagatacttccgcggaaaatctggcaatacttaccctcatgtcactaatcatggcctacaccttccagcctcttcgtaaaatactggaaaaaatgacagataagatattttttaaggtgggttacaacaccgaagagcttttaaacaaactcagtaaaacaatggcaacttcacttacattaagtgaattaaccagacaggttatgtctgtaataactcaagaccttaaagtttcgaacacctcattcgtaatcattgaaggagaatacctacacattatcgaagatgtttataccgaaaagcatattactataactaaattcgatttaagcaatatggcacgattgcaaaaaatattaattttggacgaaatggaagaatgcccaattaaagtttatatgcgtagtaacgaaataaatttggcaatccccctttctaccaaacaattttttatcggttttatgtttttgggtccaaagtcctctggcgacatattctttgaccaagatataaacttattctctattcttggccctcaactttcaatagctatgcaaaacgcacaaagttacgaaaaaataagtactttcaatactactttgcaaaacgaaattaaaaaagctacccgagaacttgaagatgcaaatattaaacttaaaaaactggacgttgttaaagatgaatttatatcaatagccagtcatgatttacgaagtccaattggcacagtcaaaaattactatgggtggcaaaaatga

SEQ ID NO: 1656 - protein, 301 aa, Unknown
  Obtained from environmental sample
  misc_feature (1)..(301): Xaa is any amino acid
MFTSYAILKHRLFDIRIIIARSISYTLLVIILAISYISGLLIISSKFIRLDTSAENLAILTLMSLIMAYTFQPLRKILEKMTDKIFFKVGYNTEELLNKLSKTMATSLTLSELTRQVMSVITQDLKVSNTSFVIIEGEYLHIIEDVYTEKHITITKFDLSNMARLQKILILDEMEECPIKVYMRSNEINLAIPLSTKQFFIGFMFLGPKSSGDIFFDQDINLFSILGPQLSIAMQNAQSYEKISTFNTTLQNEIKKATRELEDANIKLKKLDVVKDEFISIASHDLRSPIGTVKNYYGWQK

SEQ ID NO: 1657 - DNA, 372 bp, Unknown
  Obtained from environmental sample
  misc_feature (1)..(372): n is a, c, g, or t
ttgcctgtagaatacaaagaatatttacgttatccggttgaagcacaaattattcacattggaaaaagaacaatcattccgaacgaacaatcaacaagtgaagttaattacgattatatccattatccaataactataaacatcggcaaaaataaaaaacttcaaaaagatatgaacttttttgtcgaagatttaggtgaatggattcaaataacaaaggtttttcaacaaaactctgttggatttatcagaagagattttgacgaaaataatcaagagcaatgtcgggacagcgaaggtggaagcggtgaaattattctttgtaaagaaattaaagttggaatgaccgcaaaaactaaaggcagtttataa

SEQ ID NO: 1658 - protein, 123 aa, Unknown
  Obtained from environmental sample
  misc_feature (1)..(123): Xaa is any amino acid
MPVEYKEYLRYPVEAQIIHIGKRTIIPNEQSTSEVNYDYIHYPITINIGKNKKLQKDMNFFVEDLGEWIQITKVFQQNSVGFIRRDFDENNQEQCRDSEGGSGEIILCKEIKVGMTAKTKGSL

SEQ ID NO: 1659 - DNA, 558 bp, Unknown
  Obtained from environmental sample
  misc_feature (1)..(558): n is a, c, g, or t
ttgggatttgtcgagttaacttatgaaaaaacaccattttctcaagaaaataaaaagactgtttctaaatcaaaattaatcaaggtcaaaattggagaaaggcgttttcttgttcctgaaagccgcttacaggatttttgcgaccgtgctgcaggcttaagcacgagtttatccgatttcaattattactggataaaggaagaagatataaataaaaaaagtgtcggttttccgattttgcctgtagaatacaaagaatatttacgttatccggttgaagcacaaattattcacattggaaaaagaacaatcattccgaacgaacaatcaacaagtgaagttaattacgattatatccattatccaataactataaacatcggccaaaataaaaaacttcaaaaagatatgaacttttttgtcgaagatttaggtgaatggattcaaataacaaaggtttttcaacaaaactctgttggatttatcagaagagatttgacgaaaataatcaagagcatgtcgggacaggaaggtggaagcggtgaaatattcttgtaa

SEQ ID NO: 1660 - protein, 185 aa, Unknown
  Obtained from environmental sample
  misc_feature (1)..(185): Xaa is any amino acid
MGFVELTYEKTPFSQENKKTVSKSKLIKVKIGERRFLVPESRLQDFCDRAAGLSTSLSDFNYYWIKEEDINKKSVGFPILPVEYKEYLRYPVEAQIIHIGKRTIIPNEQSTSEVNYDYIHYPITINIGQNKKLQKDMNFFVEDLGEWIQITKVFQQNSVGFIRRDLTKIIKSMSGQEGGSGEIFL

SEQ ID NO: 1661 - DNA, 477 bp, Unknown
  Obtained from environmental sample
  misc_feature (1)..(477): n is a, c, g, or t
atgaagtttactccaatgccaataataagagttgataaaaattacttgggaggttattcaggtttgcagtacaaagaatggagattgtttttcctttcattgatttggagaatgagtatatccaatcaaagttttttcagggaagtaaaactccatccagaggttgaggagcaaatgaggaagatgattaggaaatctgatccgggtaacaatgaatttccaataatcatttttcaaatgcacgctaatagtactcctgataaagcaatgttagccaacccaaggtttcatattagtggagagtttgttcagtttctttttgggagatgggtaattttattttatgctgttcactatactagaacttacgtttatcagtttgcagcaaggaagaacggaaaacaaccagtgtttatgttggataaagaccaaacatttaaacttatgggaggatacattcaagagtttttcaaatag

SEQ ID NO: 1662 - protein, 158 aa, Unknown
  Obtained from environmental sample
  misc_feature (1)..(158): Xaa is any amino acid
MKFTPMPIIRVDKNYLGGYSGLQYKEWRLFFLSLIWRMSISNQSFFREVKLHPEVEEQMRKMIRKSDPGNNEFPIIIFQMHANSTPDKAMLANPRFHISGEFVQFLFGRWVILFYAVHYTRTYVYQFAARKNGKQPVFMLDKDQTFKLMGGYIQEFFK

SEQ ID NO: 1663 - DNA, 429 bp, Unknown
  Obtained from environmental sample
  misc_feature (1)..(429): n is a, c, g, or t
atgaaattttttaaacacgaatctaaaaaatcagttctatttgtctgcgtacaaaatgcaggaagaagtcaaatggctgaaggattcttcaaaaaatatgctccaatagaatatgaaggaattagtgctggtactatgcctgtatcagaaattaatccacttgcagttgaggtcatgagagaggtcggcatagatattggcggtcaaaaatcaaaggaaattacagaagatatgattcgcaattcctcaaaaatagtaaacatgggttgtatggacagggcatcatgtcccacgctttttttgcagaatttattagactggaatattgaagatccgaaggataaacagattgaaaaagtgagggagataagagacgaaattcaacagcgagtaaaagaacttgtcgcagatattaaaaattaccaataa

SEQ ID NO: 1664 - protein, 142 aa, Unknown
  Obtained from environmental sample
  DOMAIN (10)...(137): Low molecular weight phosphotyrosine protein phosphatase
  misc_feature (1)..(142): Xaa is any amino acid
MKFFKHESKKSVLFVCVQNAGRSQMAEGFFKKYAPIEYEGISAGTMPVSEINPLAVEVMREVGIDIGGQKSKEITEDMIRNSSKIVNMGCMDRASCPTLFLQNLLDWNIEDPKDKQIEKVREIRDEIQQRVKELVADIKNYQ

SEQ ID NO: 1665 - DNA, 714 bp, Unknown
  Obtained from environmental sample
  misc_feature (1)..(714): n is a, c, g, or t
ttgcaaccgcttgatacttcagcaaaagaactattgaagagttaccgaacattacttaatgacaagacgcaggaaatacttaaagaactgaaggataaaaggtctaatctaattcatatgatctcgccgattgaaacaaatattattatacatcagccgacttttggagttgatgaaagccaaaatccaaagcaaccagaagaaattatcgaatacaacaggattctaactgaattaaaaaagacttttgtcactaataaagttactgcaggatctacttttgtttttaactatcacaaatacattacattcttatttggtatacgcgaaaacattataagatctttagcggctaaggttgaggcgctttccaatcttgctacgcttgaagcagctttaaagaaggagattacggaactgaatgacagaaaattgctttcaggaaaagtgagtgacgtgaaaaaagcaatcataaatcataaaattgtaaatacacttaatgctaattcaaataactttaatacaagtgctattagtcgtaaaacttcagcggcaagggacgaattagttaaacaagattttgaagacctgttcaaaaaggaattaattgcgtttcgaaaatctaatttgcagattgatctaaatttcggaacagatngaggtaatttcagggtaacacaatctatattacntcatgggcttnctgaatattaa

SEQ ID NO: 1666 - protein, 237 aa, Unknown
  Obtained from environmental sample
  misc_feature (1)..(237): Xaa is any amino acid
MQPLDTSAKELLKSYRTLLNDKTQEILKELKDKRSNLIHMISPIETNIIIHQPTFGVDESQNPKQPEEIIEYNRILTELKKTFVTNKVTAGSTFVFNYHKYITFLFGIRENIIRSLAAKVEALSNLATLEAALKKEITELNDRKLLSGKVSDVKKAIINHKIVNTLNANSNNFNTSAISRKTSAARDELVKQDFEDLFKKELIAFRKSNLQIDLNFGTDXGNFRVTQSILXHGLXEY

SEQ ID NO: 1667 - DNA, 471 bp, Unknown
  Obtained from environmental sample
  misc_feature (1)..(471): n is a, c, g, or t
ttgcacacctttatgcgtattatacttgtattattatcggctatttttctcagcagctgtggaaaaagtatcaataaagtgcttaaaagccctgatcctgaatacaaacttcgtgttgctgaaaagtattttgtacaaaaaaaatacagcaaagcacaggtgctttatgaagatgtgatgcctttttataaaacccgggccgagttccaggatatttattacaaatacgcctattgtgcctataaccaggcggattatctgaatgctgaaaatttgtttaagacttttttggaaatatttcctaacagtccaaaagcggaggagatggattacatgagggcttatagctattttaaacaatccccaaagcctgaattggatncaaccaatacaataaaagcaatggggatgatgcaggttttattaatacgcatcccgggtccgaaagaaataaggaagcttctgaaataa

SEQ ID NO: 1668 - protein, 156 aa, Unknown
  Obtained from environmental sample
  misc_feature (1)..(156): Xaa is any amino acid
MHTFMRIILVLLSAIFLSSCGKSINKVLKSPDPEYKLRVAEKYFVQKKYSKAQVLYEDVMPFYKTRAEFQDIYYKYAYCAYNQADYLNAENLFKTFLEIFPNSPKAEEMDYMRAYSYFKQSPKPELDXTNTIKAMGMMQVLLIRIPGPKEIRKLLK

SEQ ID NO: 1669 - DNA, 888 bp, Unknown
  Obtained from environmental sample
  misc_feature (1)..(888): n is a, c, g, or t
atgcgagctacttttattgttctttcggtattgctgacatcttcagttatgagcgcacaaactaacttcgatatacaaggtcaccgcggatgccgtgggttatatcctgaaaataccattatcggatttattgaagcggtaaagctgggagtgaacaccttggaaatggatgtggtagtatcgaaagatggcaaattgatactatctcacgacccggtgatgaatacagatatctgttccactcctgacggcaaacctgttacttcttccaactacaggatatacgatttgacttatgaagagataaagaagttcgattgcggcctgcgcgtgcatccgaagtttccggaacaaaaaaaagttgccgccttcaaaccatcccttgatgaggtgattgattcagtagaaaaatatatccagcagaataacctcgctcccgttcaatacaatatcgaaacaaaatcaacgcctgaaggagatgatatagaacatcctaagccggctgctttttccaaactactttatgatttgcttaagcaaaagaacgtgttgtcaaaaagcattattcaatccttcgatcctcgtacgttgcaggaaattaaaaagatagatgccaatgtaaagctcgccttacttggttttaatgccgatgggtttgaaaaggatattcagcacttgggattaaggccgatatctaaagtccaaatttattcttgtgaaccggaatttgttccagaagtttgtatttatggaaaattttacagagtttattctcgtggnaagtgtgggattganggaaacggaaagttggagagaaattgtaatttttttgggcttttagaaggggaatttttttatcggagttattctggagaagaaggggtataa

SEQ ID NO: 1670 - protein, 295 aa, Unknown
  Obtained from environmental sample
  SIGNAL (1)...(18)
  DOMAIN (28)...(271): Glycerophosphoryl diester phosphodiesterase family
  misc_feature (1)..(295): Xaa is any amino acid
MRATFIVLSVLLTSSVMSAQTNFDIQGHRGCRGLYPENTIIGFIEAVKLGVNTLEMDVVVSKDGKLILSHDPVMNTDICSTPDGKPVTSSNYRIYDLTYEEIKKFDCGLRVHPKFPEQKKVAAFKPSLDEVIDSVEKYIQQNNLAPVQYNIETKSTPEGDDIEHPKPAAFSKLLYDLLKQKNVLSKSIIQSFDPRTLQEIKKIDANVKLALLGFNADGFEKDIQHLGLRPISKVQIYSCEPEFVPEVCIYGKFYRVYSRGKCGIXGNGKLERNCNFFGLLEGEFFYRSYSGEEGV

SEQ ID NO: 1671 - DNA, 570 bp, Unknown
  Obtained from environmental sample
  misc_feature (1)..(570): n is a, c, g, or t
atggaaaaggaaaaatacaaggtaggaattacattaggtgattataacgggataggcccagaggttattatcaaaacattggctgacgacaggatttacagattttgttcagtggtcgtttatggtcagaaaggggtcattgctttttacgccaagcatctcaagattcaaaactttaatatccaggaagtaaaggatgtgcaaagcttaaatcccaaaatcccgaaacattatttaattgctggagttgaacaaacgcaggtgttgccgggacaaatgacttccgatagcggtgcgcgtgcactactttgtctgaatgcgggggtaaaagatttgatcgaccaaaagattgatgtgttcgttacgggtccggtaaataaaaagtcatcaggcagatcaggcggatttaacgggcagacggacattttcgttggtgcggaaatgaaatcgatgagctgtgtaatgaggattgcgttggttgtacatttgttcgtgaagaatgcggaaaatcgttcttgttgccgcatgaaggcaaaaagtgagcggttcttagaagcgatagggaggtaa

SEQ ID NO: 1672 - protein, 189 aa, Unknown
  Obtained from environmental sample
  misc_feature (1)..(189): Xaa is any amino acid
MEKEKYKVGITLGDYNGIGPEVIIKTLADDRIYRFCSVVVYGQKGVIAFYAKHLKIQNFNIQEVKDVQSLNPKIPKHYLIAGVEQTQVLPGQMTSDSGARALLCLNAGVKDLIDQKIDVFVTGPVNKKSSGRSGGFNGQTDIFVGAEMKSMSCVMRIALVVHLFVKNAENRSCCRMKAKSERFLEAIGR

SEQ ID NO: 1673 - DNA, 597 bp, Unknown
  Obtained from environmental sample
  misc_feature (1)..(597): n is a, c, g, or t
ttgattgatttgcngaacagtacgttagcgattaaagaagataaaaattcgatcggcgcgattctgggactttgcgaagtcggacaaacggaagatctggcggtatttgaaaaatacatcgataatccgaaagtaaaagtaaaaattgcgtgcctgtcagctataaacaatataaacaaagagattgcaaaaaattactcgttaaaatttctttcacattccggctctaaagtgagaaataaatgcgctgaaatcctggtgccgatgatggataatgagctgctggaaaaggcaagaaaaatctatcaaaacggagattatcgacaaaagaaaacgattctgagaatgttcggcataaccggcggctggaagattgtcggcgattttatattagccttaaacgatcgagatgaaaaaatccgggagtcaggctggttatatctctataaatggcggaataaacaggttttcggcaaagcgccttccgatgatcttgaaagaatttaccggcaatacaacgaattcgataaagtaaaacccgagttaaacgataatcaagcaaggctttggaaagaacttcctttttattttcgctaa

SEQ ID NO: 1674 - protein, 198 aa, Unknown
  Obtained from environmental sample
  misc_feature (1)..(198): Xaa is any amino acid
MIDLXNSTLAIKEDKNSIGAILGLCEVGQTEDLAVFEKYIDNPKVKVKIACLSAINNINKEIAKNYSLKFLSHSGSKVRNKCAEILVPMMDNELLEKARKIYQNGDYRQKKTILRMFGITGGWKIVGDFILALNDRDEKIRESGWLYLYKWRNKQVFGKAPSDDLERIYRQYNEFDKVKPELNDNQARLWKELPFYFR

SEQ ID NO: 1675 - DNA, 519 bp, Unknown
  Obtained from environmental sample
  misc_feature (1)..(519): n is a, c, g, or t
ttgaccaggcacattctgaaatcagtttccaaagcaagacacatgatgatctctacgatcacaggtgagtttaccaattacgacgtaacgattgaagcggaagatgacgatctcacaactgctagaattcattacacagcagatgtcgcttccatcgaaacaggaaacgaacgacgcgacggacaccttcgcaacaacgactttttcagtccggaacaatttccgaagatcacctttgcatcaacggaaatgaaaaagaaagaaaacggtaagtacattctaaccggcgatctgaccatccgtgatgttacaaaatcgatatcactcaacgtcgaattcgaaggaaaggtgatcgatccatggggaaatacaaaatatggtttcacagtagacggtatcatcaaccgcaaagatttcgggcttaactggaatgtaattaccgaagcaggaggaattcttgtcggggaagaaatcaagattcacgcgagcgtgcagattgcgaaagtgccgcaaagctaa

SEQ ID NO: 1676 - protein, 172 aa, Unknown
  Obtained from environmental sample
  DOMAIN (1)...(169): YceI like family
  misc_feature (1)..(172): Xaa is any amino acid
MTRHILKSVSKARHMMISTITGEFTNYDVTIEAEDDDLTTARIHYTADVASIETGNERRDGHLRNNDFFSPEQFPKITFASTEMKKKENGKYILTGDLTIRDVTKSISLNVEFEGKVIDPWGNTKYGFTVDGIINRKDFGLNWNVITEAGGILVGEEIKIHASVQIAKVPQS

SEQ ID NO: 1677 - DNA, 801 bp, Unknown
  Obtained from environmental sample
  misc_feature (1)..(801): n is a, c, g, or t
atgcccgataactctgttgttgttgtcatggcctatcccacccgcacattcagcaatgacgttgaatacatctatcatcaaaatcctgatatgtattatttcagcggatacaaagaaccacactcggtattgctgatctttaaagaagaacaaaaaggcgcctatggcgccgtttacaaagaaataatttttgtacagaagaaaaatgcgctggctgaacaatggacgggaagaagactaggtattgaaggcgctaaagaaaaacttggtttttcctacgcatacaatggtgaggattttaaagatgcccggatcgatttttcaaaatttgataaaataatttttgacaggtttcccgatgatgcgggtaatgacccccgtgagaaggcagatctttcagacctgatagagcaatttaaatcgttggcaaaaataccagtcgaattgaataaggatgccagatttgacacccgcctcttccgggaacttacaggcaagcttcgtgaaattaaaacccctgaggaaatggatcttattcgcaaagcagttgaaatttcctgtcgtggacaaaatgaagtgatgaaggcagtgcacccgggaatgagcgaattagaaatacagggcttgcatgaatttattcataaaaaatacggagctgaagcagtgggttatggatcgatcgttggcgccggtgccaatggctgtgtattgctttatatggaaaactccaaaacgaggatcgggaacgaattgttgctgatggatgttggcgcggaataccagggtatactggtgatgtaa

SEQ ID NO: 1678 - protein, 266 aa, Unknown
  Obtained from environmental sample
  DOMAIN (1)...(125): Aminopeptidase P, N-terminal domain
  misc_feature (1)..(266): Xaa is any amino acid
MPDNSVVVVMAYPTRTFSNDVEYIYHQNPDMYYFSGYKEPHSVLLIFKEEQKGAYGAVYKEIIFVQKKNALAEQWTGRRLGIEGAKEKLGFSYAYNGEDFKDARIDFSKFDKIIFDRFPDDAGNDPREKADLSDLIEQFKSLAKIPVELNKDARFDTRLFRELTGKLREIKTPEEMDLIRKAVEISCRGQNEVMKAVHPGMSELEIQGLHEFIHKKYGAEAVGYGSIVGAGANGCVLLYMENSKTRIGNELLLMDVGAEYQGILVM

SEQ ID NO: 1679 - DNA, 324 bp, Unknown
  Obtained from environmental sample
  misc_feature (1)..(324): n is a, c, g, or t
ttgaacgacattgatgatgtgaagtatacggcgtttgcaaaattaataatcgaatcagaacaagatcaaataaaaaagatgcagttcggttttagcgattacatcaaagtttattttaatgaccgcttaatctatggaggcagtgatccttatcaatcccgtgattatagattcctgggaacaataggttattttgatgaattgtatctgccgctgaaaaaaggagtgaacgaactgtggatggcagtttcagaagactttggaggttggggggtcaaagctctttttgaagacatgaatgggattacgataaaaggctcataa

SEQ ID NO: 1680 - protein, 107 aa, Unknown
  Obtained from environmental sample
  misc_feature (1)..(107): Xaa is any amino acid
MNDIDDVKYTAFAKLIIESEQDQIKKMQFGFSDYIKVYFNDRLIYGGSDPYQSRDYRFLGTIGYFDELYLPLKKGVNELWMAVSEDFGGWGVKALFEDMNGITIKGS

SEQ ID NO: 1681 - DNA, 669 bp, Unknown
  Obtained from environmental sample
  misc_feature (1)..(669): n is a, c, g, or t
ttgaaatgggtgttggcaatactgatcattccattttttatttatttatttaaggcgaatgcacttaaaaaacaaatcagtgctgtcaatgaaaaaattgaagcttaccggcaggatcacaactcaattttcaggaattacaaagtaaataaacttggtgttgcctatgttccggtggcaaaccaaatcaagtatgatgataaaagtttcatcatcgacctcacagggagtgtacccgattctgaagtgaagttgcagttgtcgcgacagaatgatttgctgattgaaaatatcgccaccctcgaccagcttacatcagaggcgcctctggtggaaacatcacttcacacagaagaactaacaacgcaggattattcgcgttcgatgcagcagatccggcagcatgactatttaggcaaactcgacagaaccctgcgttccatttccttttgcatgaatgatcttgaagtcaactctgtgtcattgccattgattaccatgggaagcccatatttaaaatttgcacaggaatttgcgacaacccaggtaccggaagggaaacctgtaattgacgtatttaatagcaagaaatatgacagtgaaatttcaaaatttcgcgacctgaacaaactgagagattcattatcaagcgacaccgcacaactttga

SEQ ID NO: 1682 - protein, 222 aa, Unknown
  Obtained from environmental sample
  misc_feature (1)..(222): Xaa is any amino acid
MKWVLAILIIPFFIYLFKANALKKQISAVNEKIEAYRQDHNSIFRNYKVNKLGVAYVPVANQIKYDDKSFIIDLTGSVPDSEVKLQLSRQNDLLIENIATLDQLTSEAPLVETSLHTEELTTQDYSRSMQQIRQHDYLGKLDRTLRSISFCMNDLEVNSVSLPLITMGSPYLKFAQEFATTQVPEGKPVIDVFNSKKYDSEISKFRDLNKLRDSLSSDTAQL

SEQ ID NO: 1683 - DNA, 786 bp, Unknown
  Obtained from environmental sample
  misc_feature (1)..(786): n is a, c, g, or t
ttgattactaatagtattatatcacaacccacacaagctattgaaaaagtattatctggagaggaattaacatttaatgatggtttacaattatttgacgaaaatcttttcttattaggttcagttgctgatcaagttagaagaaaatcgaaaggaaatacagtgacttttgtttcatcatattatttaaattatactaatgtttgtgcagcaagttgttctttatgtgctttctatagaaaagggtatgaagaggatgcttatacattaactaatgaacagattgttgaaagagctagaatagctatagaacaactaggtgcttcagaattacacatagttggaggatttcatccaaagcttggcttggaatattatgaaaacatgataaagaatataaaaaaagaattcccgtttgtaaaagttaaagcacttactcctgcagaaatttttttcatatctaaattaaccaaaaactcagttaaagaaattttattaagattaaaagattctggtttggatgctcttcctggaggaggagcagaaatttttagctcagatataagaaatattattgtaagaggaaaatgctcaggagaagaatggcttgatacagctaaacaagctcatgaaattggtctgaaaactaattctactatgctttttggaccttttgagaagccagaacctattatcgatcatattattacaatcagagagcttaataaaaaaactcatggcttcaatacttttataccacttaaagttagtctagaaaacacttga

SEQ ID NO: 1684 - protein, 261 aa, Unknown
  Obtained from environmental sample
  DOMAIN (63)...(238): Radical SAM superfamily
  misc_feature (1)..(261): Xaa is any amino acid
MITNSIISQPTQAIEKVLSGEELTFNDGLQLFDENLFLLGSVADQVRRKSKGNTVTFVSSYYLNYTNVCAASCSLCAFYRKGYEEDAYTLTNEQIVERARIAIEQLGASELHIVGGFHPKLGLEYYENMIKNIKKEFPFVKVKALTPAEIFFISKLTKNSVKEILLRLKDSGLDALPGGGAEIFSSDIRNIIVRGKCSGEEWLDTAKQAHEIGLKTNSTMLFGPFEKPEPIIDHIITIRELNKKTHGFNTFIPLKVSLENT

SEQ ID NO: 1685 - DNA, 447 bp, Unknown
  Obtained from environmental sample
  misc_feature (1)..(447): n is a, c, g, or t
atgctttttggacatattgagaagccagaacatattatcgatcatattataaaaatcagagagcttaataaaaaaactcatggcttcaatacttttataccacttaagtttagtctagaaaacactgaattagagaagaaaaaattgattgttagagaaagttcttctacttatgacttaagaataatagccattgctaaattattattaaaagatgtgttagacaacatatcagtttattgggtttctctaggtaaaaaaatagcccaggtagcattgacatatggaggtaatgatttagttggtacagctttttcagaagaaatatttcgtgctgcaggaaaaactagtggtatatcgatacaggaacttgtaaatttgatcaaagaaataaaaagagaacctgctcaacgagatacattttttaaaataatagaaaaatactaa

SEQ ID NO: 1686 - protein, 148 aa, Unknown
  Obtained from environmental sample
  misc_feature (1)..(148): Xaa is any amino acid
MLFGHIEKPEHIIDHIIKIRELNKKTHGFNTFIPLKFSLENTELEKKKLIVRESSSTYDLRIIAIAKLLLKDVLDNISVYWVSLGKKIAQVALTYGGNDLVGTAFSEEIFRAAGKTSGISIQELVNLIKEIKREPAQRDTFFKIIEKY

SEQ ID NO: 1687 - DNA, 675 bp, Unknown
  Obtained from environmental sample
  misc_feature (1)..(675): n is a, c, g, or t
ttgtttaaaacaaatccactgccttcttttatttatgaagtagatagcctccggatacttgaagtaaacgatgctgctttaagatattacggctatagtagcaaggaattcttaaaaatgactttgttgcaccttcatttgcccgaagatggagaaacattaaaaaatgcgataacaaaaaatgatacccatacaatttctatcgttccaaactggaaacaggtaaataaattaggtgaaaaacttgtaggggatgtttctgccagctcattactttacaatggcataaatgcatgcctggttgtagtgaatgacacgacagaaagagttaaagcagaacaggaactaaaagaaacaaacagaaggtttgaatttgtttcccaggctacttccgatgttatctgggaccttaatatcacagacaataaactggatatatcggataattattataaagtgtttggttgggaacctttaaaagacaggtctttgggattggaagaagcattttcaaaatgccaccccaatgatgtaaaaagaatgaggaggagattaaaggctgtaataaataatcccggcattactatatgggaagaagaattcgatatctcaggtctgatggtacttatgcatttgtcagagattaaggttttatttcaagaaatgaaaaggtga

SEQ ID NO: 1688 - protein, 224 aa, Unknown
  Obtained from environmental sample
  misc_feature (1)..(224): Xaa is any amino acid
MFKTNPLPSFIYEVDSLRILEVNDAALRYYGYSSKEFLKMTLLHLHLPEDGETLKNAITKNDTHTISIVPNWKQVNKLGEKLVGDVSASSLLYNGINACLVVVNDTTERVKAEQELKETNRRFEFVSQATSDVIWDLNITDNKLDISDNYYKVFGWEPLKDRSLGLEEAFSKCHPNDVKRMRRRLKAVINNPGITIWEEEFDISGLMVLMHLSEIKVLFQEMKR

SEQ ID NO: 1689 - DNA, 594 bp, Unknown
  Obtained from environmental sample
  misc_feature (1)..(594): n is a, c, g, or t
ttgtttttttttaaaaaagtcctgcaaatgcgggacttttttgtttgtcaatttttttcaaaaccttcctcaccttgtctcgaaaccagcagaaggtcattgcttcacggtcctaaaaaccgaaaacatatatccattatttattccaatattttaactattaatcctgctaaacgttttcatcttatcttaactgcttctatgaataatctacagccaatagctatttacgaagcagagaaaaagaaatatgaagaagaactaagaaggcttaaaaaaaagcaaacgcttttaggctggcttagattggccattataatttttgcagcagtaatagctttctatttgtttaactattctcttttatggggatggatagcagttgttaccggtattggtttttttctggctattgttagtgttgatatagaaaacaacaaaaagatttcccatctcaaattgcttattcaaattaaccaggaagaaatagatagcctgaatggcatttttgaaaccaaatattccgggattgatttattacctgaattacacgattatgcttatgactttgatgtttttggaaatcttcactga

SEQ ID NO: 1690 - protein, 197 aa, Unknown
  Obtained from environmental sample
  misc_feature (1)..(197): Xaa is any amino acid
MFFFKKVLQMRDFFVCQFFSKPSSPCLETSRRSLLHGPKNRKHISIIYSNILTINPAKRFHLILTASMNNLQPIAIYEAEKKKYEEELRRLKKKQTLLGWLRLAIIIFAAVIAFYLFNYSLLWGWIAVVTGIGFFLAIVSVDIENNKKISHLKLLIQINQEEIDSLNGIFETKYSGIDLLPELHDYAYDFDVFGNLH

SEQ ID NO: 1691 - DNA, 615 bp, Unknown
  Obtained from environmental sample
  misc_feature (1)..(615): n is a, c, g, or t
ttgatcagtgagtattcaagtgacgtgaaagtattgttattactagcgcttttcaatgattatccagttgatatggctcatacgcgttttagtgctttttctattatggcgattcagaaactatggggaagcaactttgatgatgctcaatcgttgttattcggctatttgattttcaagccaaaatacgatgctattcgaaaaagactttttagtgaaaatcataaaaaggggatttatgaggtccctgggcatgacgtgacaaaggcatttctggaagaaaatgaaacagaattagaaaaggtagtcgaaaacaaattacctatagatgatttagaaggcataagtaaaattgacctagagattctaagaacagctttccagttaattccgcaaaaaacaaacagcgaagtacacaaaaaacttgcaaaaggaattatttctgcttttgctgaagaattgctttcaaaggacagggataggaatgataaagtcgaatatatggttaggcatgattttctggaaaaattcgcctggtttgttctgagttccccaaaagaagaaattgcaggctatttaactccggtgctcagtaaattcaataattcagagtaa

SEQ ID NO: 1692 - protein, 204 aa, Unknown
  Obtained from environmental sample
  misc_feature (1)..(204): Xaa is any amino acid
MISEYSSDVKVLLLLALFNDYPVDMAHTRFSAFSIMAIQKLWGSNFDDAQSLLFGYLIFKPKYDAIRKRLFSENHKKGIYEVPGHDVTKAFLEENETELEKVVENKLPIDDLEGISKIDLEILRTAFQLIPQKTNSEVHKKLAKGIISAFAEELLSKDRDRNDKVEYMVRHDFLEKFAWFVLSSPKEEIAGYLTPVLSKFNNSE

SEQ ID NO: 1693 - DNA, 342 bp, Unknown
  Obtained from environmental sample
  misc_feature (1)..(342): n is a, c, g, or t
atggatcaagaatggctgcatagaacatgcacaatgagggttgacatgagaagaatcgtaacaagcctggcagttttggttctggtgatgtttagctgttcacaaatgattttggcgcaaacaacacaagatcaaaaatcaaatggaaaagttgtcaacatcaacactgcgaatcagagtgaattggaatcgcttcctggaattggaccatctttagcaaaaaagattattgattttagaacgaaaaatggtggattcaaaaatccaagcgatttaatggctgttcaaggaatcggtgaaaagaaattcgaacagctgaaaactttgatttcagtcaaataa

SEQ ID NO: 1694 - protein, 113 aa, Unknown
  Obtained from environmental sample
  DOMAIN (50)...(79): Helix-hairpin-helix motif
  misc_feature (1)..(113): Xaa is any amino acid
MDQEWLHRTCTMRVDMRRIVTSLAVLVLVMFSCSQMILAQTTQDQKSNGKVVNINTANQSELESLPGIGPSLAKKIIDFRTKNGGFKNPSDLMAVQGIGEKKFEQLKTLISVK

SEQ ID NO: 1695 - DNA, 474 bp, Unknown
  Obtained from environmental sample
  misc_feature (1)..(474): n is a, c, g, or t
atggcagaaaaagttttaaaaaaatcagaaacggaagaaattatccgcaacaaccagcagtatacattgttctcatggagcaagcaaaaaggcaccaatcctattgcggttaaatatggtgaaggagtttatttatatgattacgatggcaagcgatacatcgatttttcttctggattaatgaatgtgaacattgggcacggcgatcaacgaattactgccgcagtaataaaacaaatgcaggaagtgagttatgttacgccaagttgtgtaacaaaagtccgcggagagttgggaaaaaaattagcccaaatttgccccggtgatctgaacaaggctttctttactgtatgtggcgcctcctcgatagaaaatgccataaagcttgcaagactttatacaggtcggcataaagtttatcccgttatcagtcatatcatgggccttctattggcgctatctccgcaggtgtga

SEQ ID NO: 1696 - protein, 157 aa, Unknown
  Obtained from environmental sample
  misc_feature (1)..(157): Xaa is any amino acid
MAEKVLKKSETEEIIRNNQQYTLFSWSKQKGTNPIAVKYGEGVYLYDYDGKRYIDFSSGLMNVNIGHGDQRITAAVIKQMQEVSYVTPSCVTKVRGELGKKLAQICPGDLNKAFFTVCGASSIENAIKLARLYTGRHKVYPVISHIMGLLLALSPQV

SEQ ID NO: 1697 - DNA, 750 bp, Unknown
  Obtained from environmental sample
  misc_feature (1)..(750): n is a, c, g, or t
ttgattgttctttcagnaacgtcacatattataaattggatgtctggagcaaaatatagaattggagcgcggaccattgatagtaaagaaaacaattctcataaatatctaaatataaaatctgattttttctggaaaggaaagcatcaatcattccgcaaccttgaagtaattgaacaaataaattgccatttaacaaaagaggaaatcgattcaattagaataaacttaagcgttacagatgtttcttttgcaaaagattttctggcatctacattttctgataaaaaaagaaaattgattgcaatacatcccggagctggaaaagaagctaatatttgggcgacaaaaaattttattgagctcgtaaaaaaacttcacaatagttatagtatttatgttttaataacttccggctggactgacgataaaatagttcagccaatttgtaagagtttagaggataataagattgaacatacaattctaaataatcttccggtgaagaagcttggtgctattttatcaatgattgatctttatattacaaatgatactggcactatgcatattgccggttattccaacgcaaaaatgatttcgctttttggtccaacgaatccaaatgaatgggccccaaccggaaataatcagaagtaccttaagtctacggacagtaatattaataatataaaagttgaggaagtttttttgttggctgaaacatttttatcaaatacaaaaagttaa

SEQ ID NO: 1698 - protein, 249 aa, Unknown
  Obtained from environmental sample
  DOMAIN (4)...(241): Glycosyltransferase family 9 (heptosyltransferase)
  misc_feature (1)..(249): Xaa is any amino acid
MIVLSXTSHIINWMSGAKYRIGARTIDSKENNSHKYLNIKSDFFWKGKHQSFRNLEVIEQINCHLTKEEIDSIRINLSVTDVSFAKDFLASTFSDKKRKLIAIHPGAGKEANIWATKNFIELVKKLHNSYSIYVLITSGWTDDKIVQPICKSLEDNKIEHTILNNLPVKKLGAILSMIDLYITNDTGTMHIAGYSNAKMISLFGPTNPNEWAPTGNNQKYLKSTDSNINNIKVEEVFLLAETFLSNTKS

SEQ ID NO: 1699 - DNA, 789 bp, Unknown
  Obtained from environmental sample
  misc_feature (1)..(789): n is a, c, g, or t
ttgaggaagtttttttgttggctgaaacatttttatcaaatacaaaaagttaatgagtattttatgtggataattgttcgtgttctaattggtattgttgttctggttttattagaatattactttaccagaaagattaacagggtttttaaaactctttttcctgagtttcctgcaaagaacaagagattaattatctatttatttctcattttgcttaatctttatcccgctctattaatctttaatgcggtttatgctgcaataacaaaacaatcggtttcctttcctcaaaatatttttgccgattatttgcttctttatccattctggattttaataatcttaatattacaagtaagcgcgcttttcttttttattgatttgcttaaactgattttttatcccctttataaaaagcacaaagaaaagctttatcggattcaggttaaaatatttttagcgttaactgtattttttcttttttatatccccgccagaattatttatgactactacaaagttgatgtaagagctactgagtataaaaagaaagatcttccggatgcattatccggatttaaaattgcattcatttctgatattcaggcagatagatataccgatgaaaacagactttcgaactatgttaataaaatcaataaagaaaatcctgatttggttttaattgcgggagatgtgataacttcttctccagattatattgagactgccgcaaagtttattggtaagataaaagcaaaatacggtgttattcttgcgttgtga

SEQ ID NO: 1700 - protein, 262 aa, Unknown
  Obtained from environmental sample
  misc_feature (1)..(262): Xaa is any amino acid
MRKFFCWLKHFYQIQKVNEYFMWIIVRVLIGIVVLVLLEYYFTRKINRVFKTLFPEFPAKNKRLIIYLFLILLNLYPALLIFNAVYAAITKQSVSFPQNIFADYLLLYPFWILIILILQVSALFFFIDLLKLIFYPLYKKHKEKLYRIQVKIFLALTVFFLFYIPARIIYDYYKVDVRATEYKKKDLPDALSGFKIAFISDIQADRYTDENRLSNYVNKINKENPDLVLIAGDVITSSPDYIETAAKFIGKIKAKYGVILAL

SEQ ID NO: 1701 - DNA, 702 bp, Unknown
  Obtained from environmental sample
  misc_feature (1)..(702): n is a, c, g, or t
ttggagattatgtacaaatttgccatcattggttgtggacgaattgcgcaacgacatgcagaaaatattagtagggttggaaaacttgttgcggtttgcgatatagaaaaacaaaaagcagatgaatttgcaggcaaatatcaatgtaaagcctggtactctatagacgaacttttaaaaaaggaaaaagaaatagatgtaatcagtgtttgcactccaaatggacttcatgcagaacatacaataaaatctttacaggaaggcaaacatgttctttgcgaaaaaccaatgtgtattacgagtgctgctgcatggcaaatgatcaacacagaaaaatttagccgtaaaaaattgtttgttgtaaaatcagccaggtttaattctttacttaaacatttaaatgatttaattgaaaagggcagtttaggaaatctgtatagctttcagttaagttgtttctggagccggccaaaaaactactatgaagactggcatggaaaattgtttccggacggaggcacattatatacccaattcagtcattacattgatgctatgatttggttgtttggtgaaatagatgacgtgaagggttatcgtgaaaataaagcacataagaacgttatagaatttgaagatacgggcaccattgctgtaaaaatgaaaactcagtgctgggaacaatcattcttgatccactag

SEQ ID NO: 1702 - protein, 233 aa, Unknown
  Obtained from environmental sample
  DOMAIN (5)...(122): Oxidoreductase family, NAD-binding Rossmann fold
  misc_feature (1)..(233): Xaa is any amino acid
MEIMYKFAIIGCGRIAQRHAENISRVGKLVAVCDIEKQKADEFAGKYQCKAWYSIDELLKKEKEIDVISVCTPNGLHAEHTIKSLQEGKHVLCEKPMCITSAAAWQMINTEKFSRKKLFVVKSARFNSLLKHLNDLIEKGSLGNLYSFQLSCFWSRPKNYYEDWHGKLFPDGGTLYTQFSHYIDAMIWLFGEIDDVKGYRENKAHKNVIEFEDTGTIAVKMKTQCWEQSFLIH

SEQ ID NO: 1703 - DNA, 378 bp, Unknown
  Obtained from environmental sample
  misc_feature (1)..(378): n is a, c, g, or t
ttgagtgtaatgtgcaagaaaagtaaattagatgatttcaaaaaagctatcgatacagtagaaattatacgaataaattacgatcttgatattgatgaaagttgcaaattcttttatagtttgtatcggctctcttctgaattttcctcgaaagaatatctccccgagttagacaatattatagtctggcttgaaaagttaccattgcatccaaaagatgttgcccagataatcattaaatctagaccgttgtttaagaaacacaatctgacacttaatcagtattttaagaagctccaagaggctgcctcagaggaatttgacgttgaatcaatctttttagtcttgaagactaaatttgataccacggaagtttaa

SEQ ID NO: 1704 - protein, 125 aa, Unknown
  Obtained from environmental sample
  misc_feature (1)..(125): Xaa is any amino acid
MSVMCKKSKLDDFKKAIDTVEIIRINYDLDIDESCKFFYSLYRLSSEFSSKEYLPELDNIIVWLEKLPLHPKDVAQIIIKSRPLFKKHNLTLNQYFKKLQEAASEEFDVESIFLVLKTKFDTTEV

SEQ ID NO: 1705 - DNA, 900 bp, Unknown
  Obtained from environmental sample
  misc_feature (1)..(900): n is a, c, g, or t
gtgcatctgatttatttaggcaaatgtgacgaacagagagcggttaaagaaattgaatttgaaagagacaaggtaaaaggaaatccgagatcatatcaggcaattaagaggcaatatgctaacaataaaaaagaagcatgggtgagcggtggcgtgggaagcgtattagataatatccggctaactgatatattgactgatattgaagaggaagaaagaatttcaccagttccgccatatacaaacgggaagctaaaatggacgaatgaactttggaatatcaatccaaatctgcgaagaaagggagaattttcaccagtcaaatttgttccgcttacggctgatgaaatttctcgcggcgaagaaggtaaattaagagaatatttccctattcctaaaaatcagcaaaacattgctcttaaatcagggaaagatgaatggggttgtctgatagcgccagatcattttatgtcaatattgggagccgatcccactcaacacgcggcggccagcgaaattattgagggttcaaaaaactcataccatgtgatgaacagggcaaacgaggcgcatgattcattgtatggcaaagtagtttcaaaaataattacgcacgagtatttccacaggcccgaaagccccgacgaggcatttgaagatttattaaaattgattatttatactggttcgttgtgcgccgtggaaagcaatgcgccgtattcagcaacaaggctgatggaagacggaataggtaatttcatgattgttaaagacgaaaatggagtaatgtgtatctggaaaagatttttgggactggcgaatgaggaagatacaaagtatcacttactacgtactgttgttggcgccaatacgaaagatctacgagagaagatttggtag

SEQ ID NO: 1706 - protein, 299 aa, Unknown
  Obtained from environmental sample
  misc_feature (1)..(299): Xaa is any amino acid
MHLIYLGKCDEQRAVKEIEFERDKVKGNPRSYQAIKRQYANNKKEAWVSGGVGSVLDNIRLTDILTDIEEEERISPVPPYTNGKLKWTNELWNINPNLRRKGEFSPVKFVPLTADEISRGEEGKLREYFPIPKNQQNIALKSGKDEWGCLIAPDHFMSILGADPTQHAAASEIIEGSKNSYHVMNRANEAHDSLYGKVVSKIITHEYFHRPESPDEAFEDLLKLIIYTGSLCAVESNAPYSATRLMEDGIGNFMIVKDENGVMCIWKRFLGLANEEDTKYHLLRTVVGANTKDLREKIW

SEQ ID NO: 1707 - DNA, 372 bp, Unknown
  Obtained from environmental sample
  misc_feature (1)..(372): n is a, c, g, or t
ttgtcatcaaagacactgtatgtattgatcattagtagatatattatcttacttaaatccaatatcgagtcgaaagtaaatgaatttgtgagtaacgaccatttgattcaatcctttgaggatttaatgaatgcttgtgtgtacgaattatattttggtgagcatatgaaggaaaaggatattgatgttttacaatttgcaaaagaattaatcaagccagtaaataaaactaataaggttaaagaacagatggagattattaattcggtttattcaaaattaaaagaaccgggtaacgaaatccgtaatagaatgttactatttgcaacccggagcgaaaatatcattttgcctattcaaaagatttattga

SEQ ID NO: 1708 - protein, 123 aa, Unknown
  Obtained from environmental sample
  misc_feature (1)..(123): Xaa is any amino acid
MSSKTLYVLIISRYIILLKSNIESKVNEFVSNDHLIQSFEDLMNACVYELYFGEHMKEKDIDVLQFAKELIKPVNKTNKVKEQMEIINSVYSKLKEPGNEIRNRMLLFATRSENIILPIQKIY

SEQ ID NO: 1709 - DNA, 627 bp, Unknown
  Obtained from environmental sample
  misc_feature (1)..(627): n is a, c, g, or t
ttgaagatgtttatctcctttatgattaccagaaataaaacaccttcaaagtatattttctatggactacatctatacttttcaggtctttctcttagaaaagcctcagaaagactatctcaactgttcaaacgaaatcatgtttccatatggaattggatacaaaagtacaaaccgttaaagatacaggctaaggaaaagaaaattctagagtatattgtagatgaaactttgatcaagattggttctgaatacatctggatttgggttgcgattgagcctaaaaataagcaaattctcgcactatccatatccaaggaaaggaacatgctgatagcagagagatttctgtcaactattatcagagactatggaaaacatccagtttcaacagacggtggaacatggtacccaatggcttgtcgatttcttggattaaaacaccatcttcattcttctttagagaaaagcttgattgaaagaaccatgcagtacataaaggataggactgaatgctttgatgattattttccttgcagaataaaaaattgcaaacttaaacatgtgaggaactggttgaatctatttgttgattatcataataatgaattaaaagtgcttaagtga

SEQ ID NO: 1710 - protein, 208 aa, Unknown
  Obtained from environmental sample
  DOMAIN (65)...(208): Integrase core domain
  misc_feature (1)..(208): Xaa is any amino acid
MKMFISFMITRNKTPSKYIFYGLHLYFSGLSLRKASERLSQLFKRNHVSIWNWIQKYKPLKIQAKEKKILEYIVDETLIKIGSEYIWIWVAIEPKNKQILALSISKERNMLIAERFLSTIIRDYGKHPVSTDGGTWYPMACRFLGLKHHLHSSLEKSLIERTMQYIKDRTECFDDYFPCRIKNCKLKHVRNWLNLFVDYHNNELKVLK

SEQ ID NO: 1711 - DNA, 402 bp, Unknown
  Obtained from environmental sample
  misc_feature (1)..(402): n is a, c, g, or t
ttggaccttttcggtggtacgggaagtatcagttacgaactggcatcacggggcgtaaatgatcttaccattgttgaaaaggatcagaagatgttttcattcattaaaaaaacggcggagagtttaggcctgcaaaattttagagttgtaaaatcagacgtgtttcgtttcattgaacaatgctatgaaaagttcgacttcattttcgccggccctccttatgctttgcaaaacatcgacgatcttccagagctgatttttgaaaaacgattattgaaagaggatggctggtttattttagagcatacacctagaaataattatgagagctttcctttttttaagtcggtaagaaattatggaaccacagtgttctcaatttttgtgaacgaaaaaaaatga

SEQ ID NO: 1712 - protein, 133 aa, Unknown
  Obtained from environmental sample
  DOMAIN (1)...(129): Conserved hypothetical protein 95
  misc_feature (1)..(133): Xaa is any amino acid
MDLFGGTGSISYELASRGVNDLTIVEKDQKMFSFIKKTAESLGLQNFRVVKSDVFRFIEQCYEKFDFIFAGPPYALQNIDDLPELIFEKRLLKEDGWFILEHTPRNNYESFPFFKSVRNYGTTVFSIFVNEKK

SEQ ID NO: 1713 - DNA, 402 bp, Unknown; identical to SEQ ID NO: 1711
  Obtained from environmental sample
  misc_feature (1)..(402): n is a, c, g, or t

SEQ ID NO: 1714 - protein, 133 aa, Unknown; identical to SEQ ID NO: 1712
  Obtained from environmental sample
  DOMAIN (1)...(129): Conserved hypothetical protein 95
  misc_feature (1)..(133): Xaa is any amino acid

SEQ ID NO: 1715 - DNA, 375 bp, Unknown
  Obtained from environmental sample
  misc_feature (1)..(375): n is a, c, g, or t
atgtcaaacgttgatgaaacaatagcaagaatttatacaataaatttcagtaaagcatggttaacaccaaaacacaagagaacagatcgtgtgataaatatgattaaggaatttgcaattaaacatatgaagagttctcaaattaaattagatcaagagttaaaccggtatatttggcagaaagggaagaccaatcctcctcgaaaagtaagagtgaggatagttaaagatgaagacgaccaagttatcgtttcactttatgaggatgttcaaattgagtcagaatctcaacaaaaattctctgaagctgatgtcagtactgcagaagaaacctcaaccaaagaactcgcgacggaggataaaaccaagggttaa

SEQ ID NO: 1716 - protein, 124 aa, Unknown
  Obtained from environmental sample
  DOMAIN (3)...(91): Ribosomal protein L31e
  misc_feature (1)..(124): Xaa is any amino acid
MSNVDETIARIYTINFSKAWLTPKHKRTDRVINMIKEFAIKHMKSSQIKLDQELNRYIWQKGKTNPPRKVRVRIVKDEDDQVIVSLYEDVQIESESQQKFSEADVSTAEETSTKELATEDKTKG

SEQ ID NO: 1717 - DNA, 627 bp, Unknown
  Obtained from environmental sample
  misc_feature (1)..(627): n is a, c, g, or t
atggaaaaaataacaattctaattgctgacgaccacacactggtaagagaaacatggagctttattctaaatacagatccaagatttaaagtgattgcagagagtggcagtggagaagatgccgttgaactggccaaacaacttcgccccaacgttgtgatcatggatatcaacctgcccggcatgaatggtattgaggccacacaactgatccgtaaattttctccgggatccaaaattcttggagtatcacttcacactcaaccaacctatgcccgcaaaatgatacagaaaggtgccatgggctatgtaacaaaaaattcttcaagggaagaaatgttcaaagccattatggaagtgcagaacggcagaaaatacatctgcgatgagatcaaaaatattttgtctgagcaagtgatcagtggcgaagaccagcaaagcggtttaaactctttatcccaaagggaaattgaaattattgcattcatcaaaaaaggattttcatcaaaagaaattgcggacagcctgaatatctctgttaaaactgtcgaggttcaccgctataatattctgaaaaaattgaatctcaaaaatgcggcagctctgtcaattcacaacacaccataa

SEQ ID NO: 1718 - protein, 208 aa, Unknown
  Obtained from environmental sample
  DOMAIN (149)...(206): Bacterial regulatory proteins, luxR family
  misc_feature (1)..(208): Xaa is any amino acid
MEKITILIADDHTLVRETWSFILNTDPRFKVIAESGSGEDAVELAKQLRPNVVIMDINLPGMNGIEATQLIRKFSPGSKILGVSLHTQPTYARKMIQKGAMGYVTKNSSREEMFKAIMEVQNGRKYICDEIKNILSEQVISGEDQQSGLNSLSQREIEIIAFIKKGFSSKEIADSLNISVKTVEVHRYNILKKLNLKNAAALSIHNTP

SEQ ID NO: 1719 - DNA, 345 bp, Unknown
  Obtained from environmental sample
  misc_feature (1)..(345): n is a, c, g, or t
ttgaccagcaaggaattaaaatacaataaaatggaaaacattagtaaagaacaacaggagtttttagaaaagatgaaaaagctttttcgtgattacaaggatccggaaaaaagaaaaacggtaattgaagaccattttcaattggttaaaaccggttcgctttatgccacaattataaaagacgttatgcaagaaaagaacctggaaaaatgggataaagatattggtgaagcaattgaagaaattgattcacttataaagcaaacagatggtcccgtggcagggtatgaaaaattaaaaaatgaactctggtttttgaaatatctaatctctgaaatacaataa

SEQ ID NO: 1720 - protein, 114 aa, Unknown
  Obtained from environmental sample
  misc_feature (1)..(114): Xaa is any amino acid
MTSKELKYNKMENISKEQQEFLEKMKKLFRDYKDPEKRKTVIEDHFQLVKTGSLYATIIKDVMQEKNLEKWDKDIGEAIEEIDSLIKQTDGPVAGYEKLKNELWFLKYLISEIQ

SEQ ID NO: 1721 - DNA, 483 bp, Unknown
  Obtained from environmental sample
  misc_feature (1)..(483): n is a, c, g, or t
ttgccgataaaggataaaatgtttggtacgggcgccagcggaatacttccggtgatcaaaaccgggatccatgaaaagggacgggacgcacaggataaacctattggaacttattcgcccaggtacatgaaagtgcgtacgggaaattacggtaactcggacaggttttcacggggcaagagtaaaggaaaaaataagactgcgggcacatttacccgtggcaaaaataaaggtaaggcccggccccagtacaaccgcacaggtgataccaaagtggttctatccttaacacgccagcttgagaatgactgggcggtaatacccactgaaaccggttacggacttggattcaacagtccggcaaaccgtaaaaaagcggagtacaacgaggccacctataaaaagaaaatttacaaaaccaccgattcagagaataagctgatagttcagattgcaaaggactttatagctgaaaaccagtaa

SEQ ID NO: 1722 - protein, 160 aa, Unknown
  Obtained from environmental sample
  misc_feature (1)..(160): Xaa is any amino acid
MPIKDKMFGTGASGILPVIKTGIHEKGRDAQDKPIGTYSPRYMKVRTGNYGNSDRFSRGKSKGKNKTAGTFTRGKNKGKARPQYNRTGDTKVVLSLTRQLENDWAVIPTETGYGLGFNSPANRKKAEYNEATYKKKIYKTTDSENKLIVQIAKDFIAENQ

SEQ ID NO: 1723 - DNA, 843 bp, Unknown
  Obtained from environmental sample
  misc_feature (1)..(843): n is a, c, g, or t
gtgattttaattcaaacgctttttcttggccttgtaaaaatgttatttaaaggaattattgatgcaagtaattttttggatataaataaagaaaggcaaaataaatggaaacatatttacgagcacttaagccaattttcagtaggagaaggagatggcaggataagtttaaagaacatggaaaggggacccgaaaataaagaggttatgccatcagggttgaacagagtttctattcatggtttgattattccgggtggtgttgcaggcccaaagactgattcttcactcaacaaaattttattgagtgatgttgaaaggtggagcaaacgtatgcaggcaaaaggaggttggggcaatactttcggcaacggtattgaaacctgttttcctggtgctgtccgtgttgggtttaattccgactccatcttgaattatctgaaagaccggatagctacgcaatcgtatttaaatcttttcattgtacaggatggtggtggaatcgaaactttaacggcagttccgcttaccattaatgaaatgcttttgcagagctatgaaggtattgttcgcatcttccccaattggaatcattcaaagaatgccagtttttataacctgcgtgcatatggtgcatttcttattagcagcagtttaaaaaacagcgatatagaatacgtgaaaattttgagtgaaaaagggcgtccttgtgtttttgaaaatccctggcccggaaaacaggtgcagttgtttcgcaatggaaagaaagcagagatgctcaaaggtatccatctcatatttaagactgtgcaaaacgaaacaatagaattcagaaaacgatga

SEQ ID NO: 1724 - protein, 280 aa, Unknown
  Obtained from environmental sample
  misc_feature (1)..(280): Xaa is any amino acid
MILIQTLFLGLVKMLFKGIIDASNFLDINKERQNKWKHIYEHLSQFSVGEGDGRISLKNMERGPENKEVMPSGLNRVSIHGLIIPGGVAGPKTDSSLNKILLSDVERWSKRMQAKGGWGNTFGNGIETCFPGAVRVGFNSDSILNYLKDRIATQSYLNLFIVQDGGGIETLTAVPLTINEMLLQSYEGIVRIFPNWNHSKNASFYNLRAYGAFLISSSLKNSDIEYVKILSEKGRPCVFENPWPGKQVQLFRNGKKAEMLKGIHLIFKTVQNETIEFRKR

SEQ ID NO: 1725 - DNA, 309 bp, Unknown
  Obtained from environmental sample
  misc_feature (1)..(309): n is a, c, g, or t
atgaaattggctatcgaaaattttgctaagaaaccagtcgaaaacaagatcatgctgcttggcgcgatgcccgagttaggggtggaaagcctgcacgaacaccaggaaataattgatcttatcaacaactattcctggaaggaagttattcttgttggtggcgatttcctgaaactctcccaccctttcctttcatttgaaaattctttgaaagcaaaagaatggtttgctcaacaggatttccaaaacagttatatacttgtaaaaggaagtcgtagtacgcagatggaaaaggttttagaatcttaa

SEQ ID NO: 1726 - protein, 102 aa, Unknown
  Obtained from environmental sample
  misc_feature (1)..(102): Xaa is any amino acid
MKLAIENFAKKPVENKIMLLGAMPELGVESLHEHQEIIDLINNYSWKEVILVGGDFLKLSHPFLSFENSLKAKEWFAQQDFQNSYILVKGSRSTQMEKVLES

SEQ ID NO: 1727 - DNA, 942 bp, Unknown
  Obtained from environmental sample
  misc_feature (1)..(942): n is a, c, g, or t
ttggaaaagtcaggacatgaagagcaatcagagatattattaaaagaaatggaaaccttattgtcttcagatgactttgatggattaaagcgcctgatcgaatcaaataaaattgtctgttctgtgagtggaacttccaactggacagatgtgcgccagtttaacctgatgttctcaacacaaattggaagcgtaagtgaggaagcaaatgaaatttatttaaggccggaaactgcacagggcatttttgtaaactttttgaatgtgcaaaaaacaggaaggatgaaaattccttttggcattgcacaaataggtaaggcttttagaaatgaaattgttgcccgtcaatttatttttcggatgcgggagtttgaacaaatggaaatgcagtttttcattcgtcccggcacgcaaaaacaatggtatgaacattggaaagaagagcggttaaaatggcatttgagtttaggcatttcatcagatcaataccgttttcatgaccatgccaagctcgcccattacgccgatgctgcctgtgatattgaatataatttcccaataggttttaaagaagtggaaggcatccattcccgtactgatttcgatctgcgtaatcaccagcaatacagcaaaaagaaaatgcaatattttgataatgatattgatgaatctaccgggaaggcttacggaaattatattccctatgtagttgaaacttcgataggtgttgacagaacatttatgatgttgataagcgaagcctatgaagaacaggatttgagtacagacgaaaagaaagacagcagggtgttgttaaaacttccgccaaaactggcgcccgttaaattagccattttgcccttgggtaaaaaagatgggctgcctgaaattgcccgcagcatcatggacgaatgcaaatctcaattccggttgtttttatga

SEQ ID NO: 1728 - protein, 313 aa, Unknown
  Obtained from environmental sample
  DOMAIN (1)...(160): tRNA synthetase class II core domain (G, H, P, S and T)
  misc_feature (1)..(313): Xaa is any amino acid
MEKSGHEEQSEILLKEMETLLSSDDFDGLKRLIESNKIVCSVSGTSNWTDVRQFNLMFSTQIGSVSEEANEIYLRPETAQGIFVNFLNVQKTGRMKIPFGIAQIGKAFRNEIVARQFIFRMREFEQMEMQFFIRPGTQKQWYEHWKEERLKWHLSLGISSDQYRFHDHAKLAHYADAACDIEYNFPIGFKEVEGIHSRTDFDLRNHQQYSKKKMQYFDNDIDESTGKAYGNYIPYVVETSIGVDRTFMMLISEAYEEQDLSTDEKKDSRVLLKLPPKLAPVKLAILPLGKKDGLPEIARSIMDECKSQFRLFL

SEQ ID NO: 1729 - DNA, 843 bp, Unknown
  Obtained from environmental sample
  misc_feature (1)..(843): n is a, c, g, or t
atgatcgatgcatgtgaatatattgtagacctcatcgttgatcgaaattttaaaaccctaaccaaggattctattcccgaaggtgaatctgttccaaatgagaatgatcacactcattttatagcgtttgattttggcatttgcgaaaatgcaagtggcgaacttgagccacagcttatcgaaatgcagggttttccaacattatttgcttaccagatatattatccggaagttttggagaagcattttcatattcctgaaaattatagtcagtatctcaatggctataataaagaaaagtacatcgagcttttgaaagagataattcttggaaatcatcaagctgaaaatgtgatcttattggagatcaaacctcatgaacaaaagacaagggtggatttttattgtacagaagaatatcttggggttaagccagtttgcttaacagaacttataaaagaaggcgataaattattttacattaatgatggaaaaaaaacccggattaatcggatatataacagggtgatctttgatgaacttcaacaaaaaaaggaagaactagggcagatagtagatatcacccagccacttgatgtggaatgggttccgcatccaaattggttttacaggatctcaaaatatacgcttccgtttatacgccacccttatgttcccgaaactttttttctcaatgagattaaacaaattccgcaagacctggaaaattttgttcttaaacctttattctccttcgccgggcaaggtgtgatcattgatctgaaaaaagatgacattgataaaatagaagatcctcaaaactggatctttcaagaaaagtaa

SEQ ID NO: 1730 - protein, 280 aa, Unknown
  Obtained from environmental sample
  misc_feature (1)..(280): Xaa is any amino acid
MIDACEYIVDLIVDRNFKTLTKDSIPEGESVPNENDHTHFIAFDFGICENASGELEPQLIEMQGFPTLFAYQIYYPEVLEKHFHIPENYSQYLNGYNKEKYIELLKEIILGNHQAENVILLEIKPHEQKTRVDFYCTEEYLGVKPVCLTELIKEGDKLFYINDGKKTRINRIYNRVIFDELQQKKEELGQIVDITQPLDVEWVPHPNWFYRISKYTLPFIRHPYVPETFFLNEIKQIPQDLENFVLKPLFSFAGQGVIIDLKKDDIDKIEDPQNWIFQEK

SEQ ID NO: 1731 - DNA, 858 bp, Unknown
  Obtained from environmental sample
  misc_feature (1)..(858): n is a, c, g, or t
gtgagtacgcttagcgggagagagcccatcaaaaagaaaacaacacattggtatttaccgctcggtaagcatgaagattttcttcgccagtggatactggaagaacataaagatgactggcgatccacggtgctcggccaatgcaagagctggatcgacgggggcctgcaatcgagagctgtgacaagggatctcgactggggaattaaagtacccgtaaaaggtgcagaagggaaagtgctgtatgtgtggttcgacgccccgatcggatatatcagtgccaccaaacaatgggccattgaccagggtaaggactggaagccttactggtatgacgccgatacccaactggttcatttcgtagggaaggataatatcgtatttcattgtatcattttcccggtgatgctgaaactccatggaaatatcctgccggcgaatgtacccgccaatgagttcctcaaccttgaaggggacaagatgagtaccagtcgtaactggaaactggagatgagggattatatcaacgattttgtaaagaaggaaaatggtggcgcgcaatgcgtggatatgctgcggtattaccttacacagatagcacccgagaccaaggacagtgaatttacctggaagggtttccaggatgcggtgaacagtgaactggtttccatctttggcaatttcgtgaaccggacttttgtgctgatgcacaagctctgcaaaggaaaagtacccaaacttcaccaggatattttagatgataatgacaggagcctggtcgtggatattgaaaacacaaaaggggaagtgcaatccgccattgaactttccgtttccgcgatgccctgttccaggtga

SEQ ID NO: 1732 - protein, 285 aa, Unknown
  Obtained from environmental sample
  misc_feature (1)..(285): Xaa is any amino acid
MSTLSGREPIKKKTTHWYLPLGKHEDFLRQWILEEHKDDWRSTVLGQCKSWIDGGLQSRAVTRDLDWGIKVPVKGAEGKVLYVWFDAPIGYISATKQWAIDQGKDWKPYWYDADTQLVHFVGKDNIVFHCIIFPVMLKLHGNILPANVPANEFLNLEGDKMSTSRNWKLEMRDYINDFVKKENGGAQCVDMLRYYLTQIAPETKDSEFTWKGFQDAVNSELVSIFGNFVNRTFVLMHKLCKGKVPKLHQDILDDNDRSLVVDIENTKGEVQSAIELSVSAMPCSR

SEQ ID NO: 1733 - DNA, 519 bp, Unknown
  Obtained from environmental sample
  misc_feature (1)..(519): n is a, c, g, or t
ttggacattcaaagtaaagaagtcttgaaaaaagcccttcaaaattatgaaggaacatttatcgttgtttctcatgatcgtgagtttttagatggtttaacaaatcgtatttgggatattgaaaatcaaacgttaaaaattcatcattatgatgtaaaagagtaccttcaaaagaaaatgaatgcagattcaatgaatgttcaggtaagttcaaataaaaaaatagttgtttctgaaccaaaaatagaaaatgtgattgttgaaaaaaaagcttcatttgaaaatacacaagagcataaacgaaaaaagaataatttacagaaccagattaaaaaatatgaagatttaatcaatgagttggaatcaagtttaaagaaattaagtgatgaattgactcatattgattataatgataaagaaaaatcttctcttttattaaatgattatcaaaaccagaaagagaagttagaccaaacagtgattttatgggaaaaagccttggaggagtttgatgattaa

SEQ ID NO: 1734 - protein, 172 aa, Unknown
  Obtained from environmental sample
  misc_feature (1)..(172): Xaa is any amino acid
MDIQSKEVLKKALQNYEGTFIVVSHDREFLDGLTNRIWDIENQTLKIHHYDVKEYLQKKMNADSMNVQVSSNKKIVVSEPKIENVIVEKKASFENTQEHKRKKNNLQNQIKKYEDLINELESSLKKLSDELTHIDYNDKEKSSLLLNDYQNQKEKLDQTVILWEKALEEFDD

SEQ ID NO: 1735 - DNA, 660 bp, Unknown
  Obtained from environmental sample
  misc_feature (1)..(660): n is a, c, g, or t
atgattttcagtgtgatggatattaaacctgaaaatcaaccgcatattcttaagtggggaattctgagtgcaatcgtttttagaatatttntcatctttgccggagtggcattgatcaacctattccaccctatcatttatgtttttgcaatcatactactttttgcttcttacaaaatggcatttggcggtgagcagaaaattgatgtggaaaataactggttaattaaaattgccagaaaatattttaaacttaatactgcttacgaaggcaaaaagttttttataaaaattaataaaaaattttacatcacaacaacttttcttacacttcttttaatagaatcttcagatatagtttttgcagtagattcaattccagccattatagctataacaaaagatactttcataataatttcttcaaacatcttcgctatccttggattgcgtgctttgtattttgccctggcaggattggtcgatttatttgtttacttaaaatatggtgtatcaataatacttttttatgtcggtataaaaatgctgctttctgaaatttataaaataccaacagagttttccctggccataataatattattcctgggcggttcaatcctgttatcactttttaaacggaatcgatttaaacattaa

SEQ ID NO: 1736 - protein, 219 aa, Unknown
  Obtained from environmental sample
  DOMAIN (1)...(210): Integral membrane protein TerC family
  misc_feature (1)..(219): Xaa is any amino acid
MIFSVMDIKPENQPHILKWGILSAIVFRIFXIFAGVALINLFHPIIYVFAIILLFASYKMAFGGEQKIDVENNWLIKIARKYFKLNTAYEGKKFFIKINKKFYITTTFLTLLLIESSDIVFAVDSIPAIIAITKDTFIIISSNIFAILGLRALYFALAGLVDLFVYLKYGVSIILFYVGIKMLLSEIYKIPTEFSLAIIILFLGGSILLSLFKRNRFKH

SEQ ID NO: 1737 - DNA, 711 bp, Unknown
  Obtained from environmental sample
  misc_feature (1)..(711): n is a, c, g, or t
ttgataactgaatattctttctggtttatcttttccgcagttattgcggtaatgttatttattgatttatatgttacagatcatagacgcggaaaaattactttaaaggcaagtcttatatggagcggtgtatggatattcaccgctcttctttttaatctattcctctacatttatcttgaagacggacatactaaagctctggagtttatcacaggatacattatagaaaaatcactttctgtagataatctttttgttttcttaatgattttcagtgtgatggatattaaacctgaaaatcaaccgcatattcttaagtggggaattctgagtgcaatcgtttttagaatatttttcatctttgccggagtggcattgatcaacctattccaccctatcatttatgtttttgcaatcatactactttttgcttcttacaaaatggcatttggcggtgagcagaaaattgatgtggaaaataactggttaattaaaattgccagaaaatattttaaactttatactgcttacgaaggcaaaaagttttttataaaaattaataaaaatttttactttcaaacaacttttctttcactttttttaaaaaaaccttcaaatttggtttttgcagtaaattccattcccgccctttttagcttatacaaaagaaacctttcaaaaaaaatttccttaaacaattttccctaa

SEQ ID NO: 1738 - protein, 236 aa, Unknown
  Obtained from environmental sample
  DOMAIN (69)...(233): Integral membrane protein TerC family
  misc_feature (1)..(236): Xaa is any amino acid
MITEYSFWFIFSAVIAVMLFIDLYVTDHRRGKITLKASLIWSGVWIFTALLFNLFLYIYLEDGHTKALEFITGYIIEKSLSVDNLFVFLMIFSVMDIKPENQPHILKWGILSAIVFRIFFIFAGVALINLFHPIIYVFAIILLFASYKMAFGGEQKIDVENNWLIKIARKYFKLYTAYEGKKFFIKINKNFYFQTTFLSLFLKKPSNLVFAVNSIPALFSLYKRNLSKKISLNNFP

SEQ ID NO: 1739 - DNA, 1035 bp, Unknown
  Obtained from environmental sample
  misc_feature (1)..(1035): n is a, c, g, or t
ttgaagagaaatgaaaaaattgttgggaaaagccgtgattatgttttaataaagtatgagttagggtcagacgaccatttcgaagcctattggaacgaagcatctcagacttcattctacctcgtttcattaaaagatggttctaggaaaatattgaaaaaaggtatttcaaacttgggagagaaattgcagttttcaccgaccgggaaatggattattttttatgatttcaaatcaggtaattatttttcttatgagattgctacaggaatggtgcgcagtattacagggtgtgttgctaattcctggattgatttggataatgacgagccggagccgcaactacccgatagattagtgaagtggctggaaaatgatgatgcagttttaattaatgatggttacgatatctggctaatcgatccttcggggtgtaaaatacctgttaatctaacaaacgcatatggccgtaagcatcgcataaaattcgacgtacttaatgatgatgcttctttaaacaatttctctgttcaaaaaggatcattaattcttttcaaggcaataaatacaatcaataaagattggggcttttatagcaaagcgcttggcaccactggcaatccagctattttaagcatgggtccttatatctatggtttatgggcgggacagaataattataattatcctccgatcaaggcaaaaaacgctggagtttacctagtgctgcgtagcaatgaatccgaggcgcctaactatttcttaacaacagattttaaaacttttgaacagttaagtaatgtccaaccacaaaaaaattataactgggatacaacaaagttacatagatgggaatctttagatggtacaagtttacaagggatactttacaaacctgaaaattttgattcaacaaaaaaaatcccggaatttttcttattaaggaaaagcgttcaaacggaatggattcatatatctgggctgcgccctccaaggaaaaattatatcccgctctttgaagtaacggttatttga

SEQ ID NO: 1740 - protein, 344 aa, Unknown
  Obtained from environmental sample
  misc_feature (1)..(344): Xaa is any amino acid
MKRNEKIVGKSRDYVLIKYELGSDDHFEAYWNEASQTSFYLVSLKDGSRKILKKGISNLGEKLQFSPTGKWIIFYDFKSGNYFSYEIATGMVRSITGCVANSWIDLDNDEPEPQLPDRLVKWLENDDAVLINDGYDIWLIDPSGCKIPVNLTNAYGRKHRIKFDVLNDDASLNNFSVQKGSLILFKAINTINKDWGFYSKALGTTGNPAILSMGPYIYGLWAGQNNYNYPPIKAKNAGVYLVLRSNESEAPNYFLTTDFKTFEQLSNVQPQKNYNWDTTKLHRWESLDGTSLQGILYKPENFDSTKKIPEFFLLRKSVQTEWIHISGLRPPRKNYIPLFEVTVI

SEQ ID NO: 1741 - DNA, 363 bp, Unknown
  Obtained from environmental sample
  misc_feature (1)..(363): n is a, c, g, or t
gtgacatttatccaagaaagttttcttaaaagacccacggtgtcttttcttaatagaaaaaaaaagattcctatttttgccacccggatatggataaacaggggttctttttattccggggccaataatgaattttccctggcctacctgaaaccaaagattgggggaaatgctagttggaagaaactgccaaacaaggacttgggcttgctacctgtggggcggggggggaccaaggaattgtcagagcgggaagatattattatttcttccaccaacccccgatcattgaccccaatatacctgcaatcaatccaacctaatacaaaaaaaggggaaagccaaaaattcttgcaaatctga

SEQ ID NO: 1742 - protein, 120 aa, Unknown
  Obtained from environmental sample
  misc_feature (1)..(120): Xaa is any amino acid
MTFIQESFLKRPTVSFLNRKKKIPIFATRIWINRGSFYSGANNEFSLAYLKPKIGGNASWKKLPNKDLGLLPVGRGGTKELSEREDIIISSTNPRSLTPIYLQSIQPNTKKGESQKFLQI

SEQ ID NO: 1743 - DNA, 789 bp, Unknown
  Obtained from environmental sample
  misc_feature (1)..(789): n is a, c, g, or t
gtgagaaatatacgggttcatggaaataagattcgctatcttgattatgataatgtcgatacaaagaaaaaagataccttagtcctattgcacggtataggcgcatctgccgaaaggtgggctaaagtgattccattcttatatgatcattttagggtaattgtcccagatatagttggctttggttatagcgacaaaccaacggttgagtacaacatacccttctttgtaaaatttctggaagatttcctgaacagtttgggaatcaagaaaacaagcattgcaggctcatcttttggtggattagttgcagcagaatttgcaattaagaatagccaaatggtaaacaaactagttttagtttctccagctgggaccatgaaaaattcgacgagaacactggaggagtatattctcgcgtctctttatccaacacatgataatgcttggagagccttcatcaatatggcatttgacccccgaacagttacggaacaaactgtagaagattttatcgatagaatgaaacttccgaatgcaaaatacgcatttatgtctaccatgcttggaatcaggaatactctaaacttgtcttctcgactcgacaagatactttcacctacgataatagtatggggagaacaggacgaaatgataccggtcaaatatgcagacgattataagaaaattctcaaatctaatttgatagtaataccaaaatgtggtcatacaccctttactgaaaaaccagaaatattttctaaaatagcaatcgatttcttgagatga

SEQ ID NO: 1744 - protein, 262 aa, Unknown
  Obtained from environmental sample
  DOMAIN (51)...(259): alpha/beta hydrolase fold
  misc_feature (1)..(262): Xaa is any amino acid
MRNIRVHGNKIRYLDYDNVDTKKKDTLVLLHGIGASAERWAKVIPFLYDHFRVIVPDIVGFGYSDKPTVEYNIPFFVKFLEDFLNSLGIKKTSIAGSSFGGLVAAEFAIKNSQMVNKLVLVSPAGTMKNSTRTLEEYILASLYPTHDNAWRAFINMAFDPRTVTEQTVEDFIDRMKLPNAKYAFMSTMLGIRNTLNLSSRLDKILSPTIIVWGEQDEMIPVKYADDYKKILKSNLIVIPKCGHTPFTEKPEIFSKIAIDFLR

SEQ ID NO: 1745 - DNA, 819 bp, Unknown
  Obtained from environmental sample
  misc_feature (1)..(819): n is a, c, g, or t
gtgatgctttatctgatggacacatttctcgcagagaatgctgttgaggacagaagaattacagatatactttacggaggagatcatgaaaagagaatcaaacaggaaataattcttggaataggtggaacacgtctgatcaaaaaactcggtcacaacattaaagcatttcatctgaacgaaggtcattcggcatttctttgttttgagagaattaggaattatatgaaagagaacaaagtctcttacaatgaagcaaaaaatgtgtgttattattcaaatatttttacaactcatacaccggttccggcaggcatcgatatttttacgaaagatctttttgtaaagtatttcagaaaatatgctgaagaagaggttggcgtcagtgttgatgaattattcctcgaaggtgatcttaacaaagacaagtccgataacaatcatttcaatatggcgtatcttgcaataaacaattcacatttcataaacggggtgagcaaacttcacggtgaggtctcacgaaaaatgtggatgctttccgatcagagaagcaaaatagaatcaatcacaaacggcgttcatactgccagctatttgtcatatttttcaaacgcgatgtactgcaagtatttcacaaaagattatatatatgatgaacatatctggaaccgtattgacgaaatttccgatgaagacatctggacaatgaggcttttgaataaatttgatctgataagttttgcccgtcagaggatcacggataaatggataattcttggagctgagaaggatatattaaacgaagccaagagtatctaa

SEQ ID NO: 1746 - protein, 272 aa, Unknown
  Obtained from environmental sample
  misc_feature (1)..(272): Xaa is any amino acid
MMLYLMDTFLAENAVEDRRITDILYGGDHEKRIKQEIILGIGGTRLIKKLGHNIKAFHLNEGHSAFLCFERIRNYMKENKVSYNEAKNVCYYSNIFTTHTPVPAGIDIFTKDLFVKYFRKYAEEEVGVSVDELFLEGDLNKDKSDNNHFNMAYLAINNSHFINGVSKLHGEVSRKMWMLSDQRSKIESITNGVHTASYLSYFSNAMYCKYFTKDYIYDEHIWNRIDEISDEDIWTMRLLNKFDLISFARQRITDKWIILGAEKDILNEAKSI

SEQ ID NO: 1747 - DNA, 450 bp, Unknown
  Obtained from environmental sample
  misc_feature (1)..(450): n is a, c, g, or t
atgtttaaatatctcaagaaggaatttaatgaaaatttcaggcacactcactatgcagaggccattataaaatataaaaattccgaagcgctggatttactgaatcagatcgtaagcaaatcaaggaaagaccttagcagtcgcggatggtcatatctgcgtaaagatatgattcgtcaaatttcttataattttattggaatatatgcagctttactatttgatcttctggaggaagagcctcacccttttgatgtgtcatttgccgaacctctttggagaactgataaagaaaggacgtatcaatttctgttaaatatacttggctataaaacatcttgtggtgatacatttaaatcagatgtacttactggaaaaatccgggacagcattgcaaaaaatgctccggaatttataaaaagatttaatactgatttgaaaagcagataa

SEQ ID NO: 1748 - protein, 149 aa, Unknown
  Obtained from environmental sample
  misc_feature (1)..(149): Xaa is any amino acid
MFKYLKKEFNENFRHTHYAEAIIKYKNSEALDLLNQIVSKSRKDLSSRGWSYLRKDMIRQISYNFIGIYAALLFDLLEEEPHPFDVSFAEPLWRTDKERTYQFLLNILGYKTSCGDTFKSDVLTGKIRDSIAKNAPEFIKRFNTDLKSR

SEQ ID NO: 1749 - DNA, 540 bp, Unknown
  Obtained from environmental sample
  misc_feature (1)..(540): n is a, c, g, or t
atgaacagaatatttttaatagttgttttatttatcagctcaacttgtttttcacaaaaatcattgagagattctctttttagcgggaagctgaaagccgattctgccttggtggcgaaaagtaagatcgtcaaagactcaaccaaaaaaacagaaattgatccgtcaaccgggaaaactgaagttgacccggcaataaagcaaaataattcagaaaaaacggaattaaagtattcagataataacagaacctggaagaaatttgtagacgagtacactaagatcatcaatacagaaatactaactacaaagaaagtcaagaaaggtggctatacggtaaccttggaatatgaaattggaacagatggtgtcgtatccactaaaaacataatctgcgatccaaagagtgaatccctcgtgaatctgatccaggaaaggatgatgccaaatgcccctcaattagcgcctcaggtcgttaacggggcgccacgaaaatccaccaaaagacaaatacttgtttttgtgaaagagaagaactaa

SEQ ID NO: 1750 - protein, 179 aa, Unknown
  Obtained from environmental sample
  SIGNAL (1)...(18)
  misc_feature (1)..(179): Xaa is any amino acid
MNRIFLIVVLFISSTCFSQKSLRDSLFSGKLKADSALVAKSKIVKDSTKKTEIDPSTGKTEVDPAIKQNNSEKTELKYSDNNRTWKKFVDEYTKIINTEILTTKKVKKGGYTVTLEYEIGTDGVVSTKNIICDPKSESLVNLIQERMMPNAPQLAPQVVNGAPRKSTKRQILVFVKEKN

SEQ ID NO: 1751 - DNA, 807 bp, Unknown
  Obtained from environmental sample
  misc_feature (1)..(807): n is a, c, g, or t
ttggctatgtcagtaccgaccatttcttttcccaccaaaaatctcatgaaatccgttttaaagttctcagaaaatgttcattatcaaacctcccccggtgacctggttcttgatacccttcggcttggcgaaggtgttttaagtgacacaggagcattagttatccaaaccggggaattcacgggcaggagcccaaaagataagtttacggttaaggatgaggtgaccgagaatacagttgattggaacgaattcaatatgcccattgacgaaaagtattaccacatcatttataaaaaaatgatcgatcacctggagaagctccctgagttgtgggtaagagattgttatgcatgcgccgatccacgttaccgtcttaatattcgtgtggtaaatgaaaaaccatggagcaatctttttgcatacaatatgttcttaagaccaacggaggaggaacttgaaaagttcaaacccgaatggcatgtaatagcttgccccggattaaaacttgatccgaaggagtgcggtacaagacagcataatgtttctcttgtttctttcaaacataaaatgatcctgattgccggctcaggctatacaggtgaaatgaagaaaggaatttttaccatcctgaattatattttaccacaggaaaaaaatgtgttaagcatgcattgcagtgcaaacatgggcgaaaatggtgacgctgcaattttctttggattgagcggcacgggtaaaactacacttagcgcagatccaaaccgtatgttgatcggggatgatgaacacgcctgggacatctga

SEQ ID NO: 1752 - protein, 268 aa, Unknown
  Obtained from environmental sample
  DOMAIN (24)...(268): Phosphoenolpyruvate carboxykinase
  misc_feature (1)..(268): Xaa is any amino acid
MAMSVPTISFPTKNLMKSVLKFSENVHYQTSPGDLVLDTLRLGEGVLSDTGALVIQTGEFTGRSPKDKFTVKDEVTENTVDWNEFNMPIDEKYYHIIYKKMIDHLEKLPELWVRDCYACADPRYRLNIRVVNEKPWSNLFAYNMFLRPTEEELEKFKPEWHVIACPGLKLDPKECGTRQHNVSLVSFKHKMILIAGSGYTGEMKKGIFTILNYILPQEKNVLSMHCSANMGENGDAAIFFGLSGTGKTTLSADPNRMLIGDDEHAWDI

SEQ ID NO: 1753 - DNA, 948 bp, Unknown
  Obtained from environmental sample
  misc_feature (1)..(948): n is a, c, g, or t
ttgtacgaagtcctaaaaagttattatttctcaaataggagtggcactaaagtgttttgcaaatggaaacaactcataaccttgcaatatttgaagccggcatttcacaaaagggagaaatgggaagcttggaaaaacatcataaaaccaacacttggagtttttaccaacattggcatggcacacaatgaaggattcaaaaacatagtagaaaaagttgatgaaaaactaaaactcttttctgatgcagaggagctcatattttgcagcgactatgaagccttatcgacatgtattcactcatttgttgcaaacaataaaaaaatacgactttttaattggagtaaacataactctgcgatgctaagaattacagaggttgaaaagggaaacagtcacacaaagataaaagcactcttccagcaaaaggaaattacgattactatcccgtttgtagatgatgcctctattgaaaattcaattacgtgttggtgtgttttattgcaaatgaatattgcagatgaaataattgctaaaagaatgctgcacttatttcatatagaaatgaggctggagcttaaagatggcattaataactgttctgtgatcaacgacagctacagcgctgatattaattcactttctatagcacttgattttttagcccagcaacagcaacatccgaagcatacaataatactatccgatattttgcaaagtggtaaaacagataatgaactatactctgaaattgccttaatcgttcaacgaaaaaatatacataagttaatcgcaataggcaggcatatatctgcacagcagcaacaattttcttctttaaaagaaagctacttttttgaatcggtagaagagttcaaagacaacttcgctactctgcactttaatgacgaaacaatactcattaaaggagcacgggtgttaaattga

SEQ ID NO: 1754 - protein, 315 aa, Unknown
  Obtained from environmental sample
  misc_feature (1)..(315): Xaa is any amino acid
MYEVLKSYYFSNRSGTKVFCKWKQLITLQYLKPAFHKREKWEAWKNIIKPTLGVFTNIGMAHNEGFKNIVEKVDEKLKLFSDAEELIFCSDYEALSTCIHSFVANNKKIRLFNWSKHNSAMLRITEVEKGNSHTKIKALFQQKEITITIPFVDDASIENSITCWCVLLQMNIADEIIAKRMLHLFHIEMRLELKDGINNCSVINDSYSADINSLSIALDFLAQQQQHPKHTIILSDILQSGKTDNELYSEIALIVQRKNIHKLIAIGRHISAQQQQFSSLKESYFFESVEEFKDNFATLHFNDETILIKGARVLN

SEQ ID NO: 1755 - DNA, 588 bp, Unknown
  Obtained from environmental sample
  misc_feature (1)..(588): n is a, c, g, or t
ttggcgattgaaaagccatcggaacaattgcatttgctgatgggattgccggtgaccagctttcgagacactcagagatttgaggcctttattgtgaacgctcttttggggggcggaatgacttcaaaactgtaccaaagtgtccgcgaaaaaagaggattggtgtattcgatttattccagtctgaatacatttatggattatggaatgattaatgtttatgcctcatgtgaaaagaaaaacatgaaatcggtttataataatataatggccgaactacaaaaaattcgaaaaaagaaaatttctgagcatgatttggaaatgtataaaacccaggtcaaaggcgctattttgttgggcgctgacgatatcgacaaccgaatgacgtctattggcgttaatgaaatggttttcgaaaaatacaagcccgtcgaagccattatcgaagaaattgatgcggtcagtgccaaatcagtgaatgaatacgtgcaaaaatattttgatttgaatcacttgggtgcagtattgataggtggcggggccaaagaactcgagccttggtttttatcagagacggggaagaaatga

SEQ ID NO: 1756 - protein, 195 aa, Unknown
  Obtained from environmental sample
  DOMAIN (2)...(113): Peptidase M16 inactive domain
  misc_feature (1)..(195): Xaa is any amino acid
MAIEKPSEQLHLLMGLPVTSFRDTQRFEAFIVNALLGGGMTSKLYQSVREKRGLVYSIYSSLNTFMDYGMINVYASCEKKNMKSVYNNIMAELQKIRKKKISEHDLEMYKTQVKGAILLGADDIDNRMTSIGVNEMVFEKYKPVEAIIEEIDAVSAKSVNEYVQKYFDLNHLGAVLIGGGAKELEPWFLSETGKK

SEQ ID NO: 1757 - DNA, 378 bp, Unknown
  Obtained from environmental sample
  misc_feature (1)..(378): n is a, c, g, or t
ttgatattcgattgttatatatacattaataaatattcttctgacaagaattgtacagccaagttgttcgacaatgataaaaggtatgaagatatcgtcggtatagatgaaataactaaaagaactaatagattacttgatgaatttaaggagaattatataaagaacaataaaaatgattttatcagtgacgcaatcacaaacatggttgtttgttgcaaaacatatgaaaaaatttttgcaggcttcataattgtatctcaaagaaataatatgccccaagaattgatagaaggatttgtaaaatggtctactggtcaactagaagacctcaaggaaaaaatccaagaaatagataaaaaaagagatatgcgataa

SEQ ID NO: 1758 - protein, 125 aa, Unknown
  Obtained from environmental sample
  misc_feature (1)..(125): Xaa is any amino acid
MIFDCYIYINKYSSDKNCTAKLFDNDKRYEDIVGIDEITKRTNRLLDEFKENYIKNNKNDFISDAITNMVVCCKTYEKIFAGFIIVSQRNNMPQELIEGFVKWSTGQLEDLKEKIQEIDKKRDMR

SEQ ID NO: 1759 - DNA, 825 bp, Unknown
  Obtained from environmental sample
  misc_feature (1)..(825): n is a, c, g, or t
ttgttagaaaaatacacagacatctttgcagggaataccagacaaccaaggctgacaaccaaggtcaaacatgtgatcgatactggaacagccagacctatcaaattacggacatacagaacgagcccacatgaagatgaaatagctgaaaaagaagtaaatgagatgctcaaaaacggcacaataagaccttcaaagagcccttggagttcaccaattgtgttggtcacaaagaaagacggagctataagattctgtgtggattacagaaaactcaacgagatcacaaagaaggatgtatatccaataccaagagtagatgaaatcttggataaaatggctcgaatgaagtactacacaaccttggatctagcaagtggctattggcaagtagaaatcatggaaacagacaaggaaaagactgctttcaccaccaagaaaggattcttcgaatttaacaatatgccatttggtctctgcaatgcaccagcaacattccaacggatgatggatgaagttatagaaggaatcgaatggactgcagggatggtgtacatggacgacataatcattggatcacatacatttgagaatcacataagagatttgagcgcattatttgatagattaaggaaacactccttatcagtcaaaatatcaaaatgcaaattcttcaagaatgaattgccgtaccttgggcacgtattatcgggagaaggaatgaaaccagatcctaagaagattgaagcaatcgaaaagatagcatatccaactaatctctcagaacttcgcacatttttggggatcacatcatattatcggaaa

SEQ ID NO: 1760 - protein, 275 aa, Unknown
  Obtained from environmental sample
  DOMAIN (67)...(236): Reverse transcriptase (RNA-dependent DNA polymerase)
  misc_feature (1)..(275): Xaa is any amino acid
MLEKYTDIFAGNTRQPRLTTKVKHVIDTGTARPIKLRTYRTSPHEDEIAEKEVNEMLKNGTIRPSKSPWSSPIVLVTKKDGAIRFCVDYRKLNEITKKDVYPIPRVDEILDKMARMKYYTTLDLASGYWQVEIMETDKEKTAFTTKKGFFEFNNMPFGLCNAPATFQRMMDEVIEGIEWTAGMVYMDDIIIGSHTFENHIRDLSALFDRLRKHSLSVKISKCKFFKNELPYLGHVLSGEGMKPDPKKIEAIEKIAYPTNLSELRTFLGITSYYRK

SEQ ID NO: 1761 - DNA, 369 bp, Unknown
  Obtained from environmental sample
  misc_feature (1)..(369): n is a, c, g, or t
atggttgatgttttattgggtttacaatggggcgatgaaggaaaaggaaagattgtagattattttgcagcaaattacgatgtcattgcccggttccagggcggccccaatgcagggcacacattgtatgtaaacgataaaaaaattgttcttcaccagataccttccggcgtatttcatcccaataccgtaaatcttatcggaaatggcgtagtgcttgacccggtgattttaaaaaaagaatgtgaccttgtagcatcctttggaattgatctgaaaaaaaatctttttatttctgagcgaacccatctcatacttcctacccacagggctttggataaggcttctgaaatatcaaaagggaaatga

SEQ ID NO: 1762 - protein, 122 aa, Unknown
  Obtained from environmental sample
  DOMAIN (2)...(122): Adenylosuccinate synthetase
  misc_feature (1)..(122): Xaa is any amino acid
MVDVLLGLQWGDEGKGKIVDYFAANYDVIARFQGGPNAGHTLYVNDKKIVLHQIPSGVFHPNTVNLIGNGVVLDPVILKKECDLVASFGIDLKKNLFISERTHLILPTHRALDKASEISKGK

SEQ ID NO: 1763 - DNA, 360 bp, Unknown
  Obtained from environmental sample
  misc_feature (1)..(360): n is a, c, g, or t
atgaaagaaaaaattgaaattcaaagcgttgattacttaagagaagattctctggcttttattacagaagtttccccgagattcgtagatctaaaagccattgggcaaaatgaaaaacttgagcgcatagttaccttatggaataaaagttcaacagaattaaagatcgaaaaaataaatgtgcagggaaattatatgaaaataaacagtgaaatgagggttcctgcaaatagtacaactgacttaaaactttcgtccaatgttgcctttcctaaaggtttattttcttttcctgtcgaaattttcttcgtcggatttcctaaacccttgataataatggtgaatggagaaggtttttaa

SEQ ID NO: 1764 - protein, 119 aa, Unknown
  Obtained from environmental sample
  misc_feature (1)..(119): Xaa is any amino acid
MKEKIEIQSVDYLREDSLAFITEVSPRFVDLKAIGQNEKLERIVTLWNKSSTELKIEKINVQGNYMKINSEMRVPANSTTDLKLSSNVAFPKGLFSFPVEIFFVGFPKPLIIMVNGEGF

SEQ ID NO: 1765 - DNA, 360 bp, Unknown
  Obtained from environmental sample
  misc_feature (1)..(360): n is a, c, g, or t
atgggggctgacaggatcacacctattacccaggcaaactttttttgtggtgcgccaacatattcaggtgcctggttacttactatcaagcgtcctaatattaatgtaggtgaaaatttaggattaataaaaacacggatgatgaaatcagcaaggaacacagttaagacatacttgatcggcaaaaaattatttttaaaaataataagcatcagggagatgaacgttgctaaaaacagaatacctgcagatgctcttatttctctttcatttaaaaccgggatgttatatccttctatattttctccgaattgtatgagtttattcatttggttaatttttactccaggcagcgattga

SEQ ID NO: 1766 - protein, 119 aa, Unknown
  Obtained from environmental sample
  misc_feature (1)..(119): Xaa is any amino acid
MGADRITPITQANFFCGAPTYSGAWLLTIKRPNINVGENLGLIKTRMMKSARNTVKTYLIGKKLFLKIISIREMNVAKNRIPADALISLSFKTGMLYPSIFSPNCMSLFIWLIFTPGSD

SEQ ID NO: 1767 - DNA, 879 bp, Unknown
  Obtained from environmental sample
  misc_feature (1)..(879): n is a, c, g, or t
ttggagaatatcatggaaaatatcaagaacagccagaaaggccttgaagagctgcaggaggaaataacctctatgaaagaaaggcttgaggaaaaagtttcattcctgacagcaaaagaaaaagaagaggaagagctgagcaagaaattcaagaagcttttcgaggacagggacaaaatacaattaaagatacaagaaagcaattatgatatttcagagaggagaacagagatatcccaaataacagaccagattaattatatagaaataggcgtagcaaagctgagtgcatcacaagaatcaatccaaatagagctcaaagatgttccagaaagcgagcctatcaaagcaagcatggaggtgcttcagcaaaaactggagaaagccaaatctgatatgcattctattggggcaattaacatgcgcgccttggaagtctatgagcagattaaagttgaatatgataaggtaagtgagaaagtagaaactcttcaaagagaaaaggaagaaatattgagaattgtagctgaaatagatcaaaagaaaaagaagacattcatgaaaactttcaaaggcattaatgaattgttctccaggaacgcttcagaattatataataaaggaaaagctttcatgaggcttgaaaatgaggacgatatctttgcaggaggagtcgagatagtaatacaattaggaaaaggaaaatactttgattcaggttcattgtcaggaggagagcagacactaatagcattatcaatgctttttgcaatccagggattcaagccataccatttctatgttttccatgagattgatgcaaccctggataaaaaaaattcaaaacggcttgcagcaattattcaccaagtacattag

SEQ ID NO: 1768 - protein, 292 aa, Unknown
  Obtained from environmental sample
  DOMAIN (129)...(292): SMC family, C-terminal domain
  misc_feature (1)..(292): Xaa is any amino acid
MENIMENIKNSQKGLEELQEEITSMKERLEEKVSFLTAKEKEEEELSKKFKKLFEDRDKIQLKIQESNYDISERRTEISQITDQINYIEIGVAKLSASQESIQIELKDVPESEPIKASMEVLQQKLEKAKSDMHSIGAINMRALEVYEQIKVEYDKVSEKVETLQREKEEILRIVAEIDQKKKKTFMKTFKGINELFSRNASELYNKGKAFMRLENEDDIFAGGVEIVIQLGKGKYFDSGSLSGGEQTLIALSMLFAIQGFKPYHFYVFHEIDATLDKKNSKRLAAIIHQVH

SEQ ID NO: 1769 - DNA, 450 bp, Unknown
  Obtained from environmental sample
  misc_feature (1)..(450): n is a, c, g, or t
ttgcaggcgatttatatttgctgcatggaagaattgttgaaccagattgaggcttaccggaaagaaatcgaagaaatcagtatttccaattcgcaggaacttgaagagtaccgaattaaattcctcggaacaaaaggcattgtgaaaaatttgtttggggaaatgaaatctgttcccgtagaaaagaaaaaagaatttggtttggtattaaatgattttaagcttttaaccgaaaaaaaatacgaggccgcaaaagaatcaacagttaatggcaaacaggcaactgcaaaaaataaatcagcgttgaacgacttagacctgacattgcccggcgataacattccctgtagcacacaccatcccatcaatttagtacggaggcgcattattgatatttttcacccgtctgggttttttccgtggaaaatgggccggaaaataaaagaatga

SEQ ID NO: 1770 - protein, 149 aa, Unknown
  Obtained from environmental sample
  DOMAIN (26)...(99): Aminoacyl tRNA synthetase class II, N-terminal domain
  misc_feature (1)..(149): Xaa is any amino acid
MQAIYICCMEELLNQIEAYRKEIEEISISNSQELEEYRIKFLGTKGIVKNLFGEMKSVPVEKKKEFGLVLNDFKLLTEKKYEAAKESTVNGKQATAKNKSALNDLDLTLPGDNIPCSTHHPINLVRRRIIDIFHPSGFFPWKMGRKIKE

SEQ ID NO: 1771 - DNA, 639 bp, Unknown
  Obtained from environmental sample
  misc_feature (1)..(639): n is a, c, g, or t
ttggtaatgaaaagtattttaggaatagtatcttttttaattgggctttcattgattgcccaaaaaccaatggttagtttaagtgttgattccaaaaatgttcaaattgggaatccggtcacttttaccgtaaaatcgaatgtagaggggaatgtggaaatcgtttttccggatgaatttattcaaggcagcggaacgatgaatggaatggaacaacaaatggattataatacaggggttgtaaccacgatttattatttctctcaaaatggtgctttcaaagaaaatggtttctattcaatttatgcttatgttaaaaacaaaaaagcaatttataaatccaataaggtaaatgtaaaagttgaaaaagaaactacaaccaatgatgatgaaattagtaaaagaaatctcaaacaacctgtttttgggatcattcagcgatcaaaaaccaaaatatatgaaggtgaggcagtggttttggaagcaaaagtttattccaggctaaatatcaatatgttggaatcgtatgagtcatttgaactggagggtggagccgaaacaaaagaaattaataaatcgagccgtttgctgttaaacagggaaaatttcaggggtactcaggtattgacttcaccttga

SEQ ID NO: 1772 - protein, 212 aa, Unknown
  Obtained from environmental sample
  SIGNAL (1)...(20)
  misc_feature (1)..(212): Xaa is any amino acid
MVMKSILGIVSFLIGLSLIAQKPMVSLSVDSKNVQIGNPVTFTVKSNVEGNVEIVFPDEFIQGSGTMNGMEQQMDYNTGVVTTIYYFSQNGAFKENGFYSIYAYVKNKKAIYKSNKVNVKVEKETTTNDDEISKRNLKQPVFGIIQRSKTKIYEGEAVVLEAKVYSRLNINMLESYESFELEGGAETKEINKSSRLLLNRENFRGTQVLTSP

SEQ ID NO: 1773 - DNA, 330 bp, Unknown
  Obtained from environmental sample
  misc_feature (1)..(330): n is a, c, g, or t
ttgcaaataaaaaatcactaccatttatcgtttgagactgatatgaagaaaaaaattgtaatcgatgtagctactatttatgctgggcagggcggtgctggtgggggtatatggagttatgctaagaacttacttttgcacttggatgaacatttggaaaaagaagatatggagattatatgccttgttaaccgccagtttgacctaccgcttaaaaatttaaagaaaaaagaactgaagtatagttttaaaaaatttctgataaggtttttttatacaaacatttatttgccaatatatgtttatcgtcaaaacgcaatttcttcataa

SEQ ID NO: 1774 - protein, 109 aa, Unknown
  Obtained from environmental sample
  misc_feature (1)..(109): Xaa is any amino acid
MQIKNHYHLSFETDMKKKIVIDVATIYAGQGGAGGGIWSYAKNLLLHLDEHLEKEDMEIICLVNRQFDLPLKNLKKKELKYSFKKFLIRFFYTNIYLPIYVYRQNAISS

SEQ ID NO: 1775 - DNA, 870 bp, Unknown
  Obtained from environmental sample
  misc_feature (1)..(870): n is a, c, g, or t
gtgactcttcccccaaataaagccgtttttggtaagtgggctgcaaacaactccacttcagaggaagggggttcactgttaagtaatcttcagaaaagccaggaactaaaatctgttttattggaagaaactccatgggtgctggaagcaaaaagtgaagaacagcaaaagaaaaacatagcgctcttgtttgatatggtccgcatgagcggagaactcgaatcttcgcttagcaaattaaaagatatgcagtcacctaatggtggctttgtttggttcaaaggaggtccggatgatcggtatatcacccaatatattctaaccggtattggtcatctgaaaaaactaaacgcaatcacaaaagaccaggatcaaaaattattatcaatcgtaaataccgcatttccttacttagacagaaagttgaaagaagattatgacaacttaaaaaaacataaatcagatcagaaagtaaacaatacaggcacaatagccatccagtatctatatatgcgaagcttttttcccgaacacggcattgcaaaacaatcccaggctgcttataactattatatcgggcaggcaaaaaaattctggctttcgcaaggtaagtttatgcaggcaatgacagcgttgtttttgtaccgaagcggtgatagaataactccgcaggcaatcatgcgttccctaaaagaaaattcaataaataacgaagaacttgggatgtactggaaggaatggaacatccgtggatattggtggcaccaggcgcctatagaatcgcaggctatgatgatagaagcttttagtgaaataaggaacgatcaaacagtaataaatgatcttaaaacctggttgctaaaaaaataa

SEQ ID NO: 1776 - protein, 289 aa, Unknown
  Obtained from environmental sample
  misc_feature (1)..(289): Xaa is any amino acid
MTLPPNKAVFGKWAANNSTSEEGGSLLSNLQKSQELKSVLLEETPWVLEAKSEEQQKKNIALLFDMVRMSGELESSLSKLKDMQSPNGGFVWFKGGPDDRYITQYILTGIGHLKKLNAITKDQDQKLLSIVNTAFPYLDRKLKEDYDNLKKHKSDQKVNNTGTIAIQYLYMRSFFPEHGIAKQSQAAYNYYIGQAKKFWLSQGKFMQAMTALFLYRSGDRITPQAIMRSLKENSINNEELGMYWKEWNIRGYWWHQAPIESQAMMIEAFSEIRNDQTVINDLKTWLLKK

SEQ ID NO: 1777 - DNA, 411 bp, Unknown
  Obtained from environmental sample
  misc_feature (1)..(411): n is a, c, g, or t
atgctaagaaaaaaataccagcaggaaaatatcatcattgaagatttcatcgatttcgcttttatcatgccgcgaacagacctttatataaccaatggcggttatggaggaacgcttattgcaatagatcatgcattgccgatggtagcggccggaatcaatgaagggaaaaacgagatctgtgcaaggattggttattttaaactgggtattaatttaaataccgaaaaacctgggccaccaaaaataaaaaaagcagtaacccaaatcatttccaccccggtctataaagaaaatgtggaaaagctccgggatgaattcagaagttatgatacgaacaaattagctgcggacctgatcttaagtgtggtacaaaataaggttacgccgaaccttctttcggaatcctga

SEQ ID NO: 1778 - protein, 136 aa, Unknown
  Obtained from environmental sample
  misc_feature (1)..(136): Xaa is any amino acid
MLRKKYQQENIIIEDFIDFAFIMPRTDLYITNGGYGGTLIAIDHALPMVAAGINEGKNEICARIGYFKLGINLNTEKPGPPKIKKAVTQIISTPVYKENVEKLRDEFRSYDTNKLAADLILSVVQNKVTPNLLSES

SEQ ID NO: 1779 - DNA, 837 bp, Unknown
  Obtained from environmental sample
  misc_feature (1)..(837): n is a, c, g, or t
gtgcnaatgaaaacagagggtcatttcagaaaactaaaagaaaattgtaaatacccgccttngcagatcagctttcctgccgatgtggatcgtttatcgccattcaatggtcaaaaaaaattgaaactggtgatgccttgcgcaggtgatgaatatgttattcgtgaatggcttgtttataagatctacaacttaattacaccaaaaagttttcgggcaaggcttgtgagaatagaactcaaagacactaaaaataaaaaacaaccagctccattttatgccttcctgatagaagatgaaaagaatatggcctcacgaaatagagcgaacattgtagaacagaaactcagacccgaagatacaaagcaagatgcttttttaacaatggcagtattccaatacctgatcggtaacactgattggtcagtgcaatatttgcaaaatataagattgctgaagacggattcttttccccaattaattactgtgccatacgattttgatcattccgggatcgtaaatgcgccctatgctcaccccgctgaggaattattgatgagatcggtgcaggagcgtcgttaccgcggttattgtatcagggatatgaaactatttgaaaaaccaattgcattattcaacaggttaaagaacgatatttataatttatacacaaagaatgatctgctggatgaaaaatatattaagtccgttacaaaataccttgacgagttttatgcaacgatcaatgatcctaaaagctggcaaaaggattttgcttatccctgtgatccaaatggaactggtaatgtggtgatcaaaggattgaaagaagagtga

SEQ ID NO: 1780 - protein, 278 aa, Unknown
  Obtained from environmental sample
  misc_feature (1)..(278): Xaa is any amino acid
MXMKTEGHFRKLKENCKYPPXQISFPADVDRLSPFNGQKKLKLVMPCAGDEYVIREWLVYKIYNLITPKSFRARLVRIELKDTKNKKQPAPFYAFLIEDEKNMASRNRANIVEQKLRPEDTKQDAFLTMAVFQYLIGNTDWSVQYLQNIRLLKTDSFPQLITVPYDFDHSGIVNAPYAHPAEELLMRSVQERRYRGYCIRDMKLFEKPIALFNRLKNDIYNLYTKNDLLDEKYIKSVTKYLDEFYATINDPKSWQKDFAYPCDPNGTGNVVIKGLKEE

SEQ ID NO: 1781 - DNA, 345 bp, Unknown
  Obtained from environmental sample
  misc_feature (1)..(345): n is a, c, g, or t
atgatgaagtggttgcgacaaaaaatattcaatcttgtattgtggatcagcaacaagtttgcttcgcgacctacaaaagaaaaagtttctgaggggttaagtaaaattttaaccggcattgaaaacggcgataaaaaagaagggccagtcattccgtttacgcttaatgatcgctttattattttttctgaccagcacgaaggcaatggaaattatgctgatgatttcaggctttgttctacaaattaccatgctgctcttgactatnatttcataatgattttcaattcatcgcattgngcgaatgtgaaagactatgggaaaatacattgtcggaagtgttga

SEQ ID NO: 1782 - protein, 114 aa, Unknown
  Obtained from environmental sample
  misc_feature (1)..(114): Xaa is any amino acid
MMKWLRQKIFNLVLWISNKFASRPTKEKVSEGLSKILTGIENGDKKEGPVIPFTLNDRFIIFSDQHEGNGNYADDFRLCSTNYHAALDYXFIMIFNSSHXANVKDYGKIHCRKC

SEQ ID NO: 1783 - DNA, 603 bp, Unknown
  Obtained from environmental sample
  misc_feature (1)..(603): n is a, c, g, or t
atggaaacagtccagctttctcataaggagtttttgaaaattgataaagattacagcaaggcggcaaaagcagccgagcttaagtatgttactgataaaacaaaaggtattcaaagaaaaaaaaaaggcgaaggctttgtttacatttatgatgacaagccattaaaagataaggatgaactgcaacggataaaaaaattagccattccgccggcatggaccaatgtttggatctgccatgacaagaacgggcatattcaagccacagggttcgatataaataaccgcaaacaataccgctatcattcgctttggaacgcacttcgcaatgaaacaaaatttcatcgtttatatgagtttgggaaactattaccttccttacgattaaagttggaagaagacctggcaaaaaaagagctaagcgaagaaaaagtcctggcaaccgttataacactgatggaaagaacctatatacgcattggcaatgatggatatgaaaaactgtatggctcttatggtctcacaactttaaaggacaggcacgtaactatancaggcgataaacttgcattttcttttaggggaaaaaagaatatttcataa

SEQ ID NO: 1784 - protein, 200 aa, Unknown
  Obtained from environmental sample
  misc_feature (1)..(200): Xaa is any amino acid
METVQLSHKEFLKIDKDYSKAAKAAELKYVTDKTKGIQRKKKGEGFVYIYDDKPLKDKDELQRIKKLAIPPAWTNVWICHDKNGHIQATGFDINNRKQYRYHSLWNALRNETKFHRLYEFGKLLPSLRLKLEEDLAKKELSEEKVLATVITLMERTYIRIGNDGYEKLYGSYGLTTLKDRHVTIXGDKLAFSFRGKKNIS

SEQ ID NO: 1785 - DNA, 597 bp, Unknown
  Obtained from environmental sample
  misc_feature (1)..(597): n is a, c, g, or t
atgaaacttttatcagctacattttttatggtagtattttctgttatttcatgtgagacaaagcaactatttgacaataaacagatagctgaagagatcgcttctgaaattggtggaaaatctgcaaggtttggatttgaggaacttaaatctagtaatcctttagctaataaaaaatatattgaattaaatatagatggatccgaatatttaaaagacagcacttctgaaaaaattgttctcgcttcatattgtgcaactcagctttttaagcggcttgatccacgattgatgcttaaatatgatggaattaatataaattttgataacgaaaatgatattgtaaatccatacaaatattattttgataaaaaagaattggttcatgcctggaaagcatttgataatatcgatacttatctaaattttattaagaacgataatttagtaactgcaatgacatatgtggatactaacctatattacttttacattgatagtattaataacgctattaatattctatgcgggacagcaacaattagcactgcccatacctataaagtttttgaatatttgggtaaaaaaacccattaa

SEQ ID NO: 1786 - protein, 198 aa, Unknown
  Obtained from environmental sample
  SIGNAL (1)...(17)
  misc_feature (1)..(198): Xaa is any amino acid
MKLLSATFFMVVFSVISCETKQLFDNKQIAEEIASEIGGKSARFGFEELKSSNPLANKKYIELNIDGSEYLKDSTSEKIVLASYCATQLFKRLDPRLMLKYDGININFDNENDIVNPYKYYFDKKELVHAWKAFDNIDTYLNFIKNDNLVTAMTYVDTNLYYFYIDSINNAINILCGTATISTAHTYKVFEYLGKKTH

SEQ ID NO: 1787 - DNA, 843 bp, Unknown
  Obtained from environmental sample
  misc_feature (1)..(843): n is a, c, g, or t
atggcccgcatcataatgcaggaattgcagcatgaaggatatttaaaacttggacataatgttaaaatcgggtattttgcccaaaatcaggcacaacttctcaacgaagaacttactgttcttgaaactatcgatgaaattgctgttggtgatataagaacaaaaatcagggatattctgggtgcatttcttttttcgggagaagacgttgataaaaaggtgaaagtgttgagtggcggagaaaaaacccggcttgcaatgataaagttaatgctcgaacctgttaattttcttgtgctcgatgaacctacaaaccatcttgatattcgttcaaaagaaatattgaaaaatgcactgattaattttaacggaactgttcttttggtatcacacgacagagaatttcttgatggtcttgtaaattgtgtttatgaattcagaaataaaaaaattaaacaacatcttggcggaatttacaactttcttgagaaaagaaaaatcgaatcgttaaaagagctggaaattaacaacatatcgaaaaaaatagaaaaaataaatgttgcaaagcttaacaccagccaggaactaagttttcaggaacaaaaagagattagcagaaatattacgcgattggaaaaacaggtggaaaagaccgaattggaaatacaaaatattgaaaccgaaagtgctgaaatggaccgaattttatcttcctctgaaaaactggaagatcattcaattttcgacaaatatgaattgctaaaattaaagctgaaaactgccatggaggaatgggaaaagcacatgaagttttggaaactggaaactgaaaaaaactggtaa

SEQ ID NO: 1788 - protein, 280 aa, Unknown
  Obtained from environmental sample
  DOMAIN (2)...(149): ABC transporter
  misc_feature (1)..(280): Xaa is any amino acid
MARIIMQELQHEGYLKLGHNVKIGYFAQNQAQLLNEELTVLETIDEIAVGDIRTKIRDILGAFLFSGEDVDKKVKVLSGGEKTRLAMIKLMLEPVNFLVLDEPTNHLDIRSKEILKNALINFNGTVLLVSHDREFLDGLVNCVYEFRNKKIKQHLGGIYNFLEKRKIESLKELEINNISKKIEKINVAKLNTSQELSFQEQKEISRNITRLEKQVEKTELEIQNIETESAEMDRILSSSEKLEDHSIFDKYELLKLKLKTAMEEWEKHMKFWKLETEKNW

SEQ ID NO: 1789 - DNA, 1269 bp, Unknown
  Obtained from environmental sample
  misc_feature (1)..(1269): n is a, c, g, or t
atgggtggggttttttttaaacaccttggggttgggggcaaaatgccttggggctgttttaattccaacaatggaatggttgtttcccttttccttaaaattgtttcctttcgcattcgggtgggaaactttggaaaggaattggtggggcttttcgttttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacggcgaagtgtcggacctgggcgatacgaatttatgncaggcagaatggaagtgggatggtatccgtggacaaatgatcaagagaaatcaggaattatttgtatggagtcgcggtgaagaattaatgacagataaatttccagagtactttattttaaaaaatcttttacccgatgggactgttcttgatggagaaattattccggcgatagaccgaaaacccttgccattcgcggttttacaaacacgaatcgggagaaaaaatattggcaaaaaacaactggcagaggcaccgatcagtttttttgcttatgatattttagaatacaattatgaagactggcgcgacaaaacattaatcgaaaggagaaaaaaactggaggaaattattttgccaatagaaagtaatgtgatacaaatttctgagatcatccgatttaattcgtgggatgaattaaaagaaatcagaaaaaattcgcgggaaatgaatagtgaaggaatcatgctgaagcaaaaaaattctgtttataaagtaggaagaaaacgcggcgactggtggaaatggaaaatagatccgttggtgatagattgcgtaatggtatatgcacaaaaaggtagcggcagaagaagcaatctttacacagattacacattcgctgtgcgcgacggcgatcatttagtaacttttacaaaagcctattccggtttgactgataaagaatttgcagaaatagatcattttgtaaaaagaaattctttagaaaaatttgggccagtacgaacggtaaaacctgaattggttttcgaaattgcattcgaagggatcgctgcaagcaatcgtcacaaaagtggagtagctctgcgtttcccaagaatgaaccggggcgaaaagataaaaccgtga

SEQ ID NO: 1790 - protein, 422 aa, Unknown
  Obtained from environmental sample
  DOMAIN (331)...(394): ATP dependent DNA ligase C terminal region
  misc_feature (1)..(422): Xaa is any amino acid
MGGVFFKHLGVGGKMPWGCFNSNNGMVVSLFLKIVSFRIRVGNFGKELVGLFVFXXXXXXXXXXXXXXXXXXXXXXXXXXXXXXXXXXXXXXXXXXXXXXXXXXXXXXXXXXXXXXXXXXXDGEVSDLGDTNLXQAEWKWDGIRGQMIKRNQELFVWSRGEELMTDKFPEYFILKNLLPDGTVLDGEIIPAIDRKPLPFAVLQTRIGRKNIGKKQLAEAPISFFAYDILEYNYEDWRDKTLIERRKKLEEIILPIESNVIQISEIIRFNSWDELKEIRKNSREMNSEGIMLKQKNSVYKVGRKRGDWWKWKIDPLVIDCVMVYAQKGSGRRSNLYTDYTFAVRDGDHLVTFTKAYSGLTDKEFAEIDHFVKRNSLEKFGPVRTVKPELVFEIAFEGIAASNRHKSGVALRFPRMNRGEKIKP

SEQ ID NO: 1791 - DNA, 543 bp, Unknown
  Obtained from environmental sample
  misc_feature (1)..(543): n is a, c, g, or t
gtgctggttgttgaaaacataacaaaaaaatttccgggagttgttgctctcaataatgtctgtcttgaaattgaagcaggaaaggttacggcgatcattggagaaaatggtgcaggcaaatcaacactgatgaaaatcctttccggagtttatcatgattttaacggcagaattatttttaaagatcaacaggtaaaattttcaaatccgaaagaagcacaggaaaaaggaattgccatcattcatcaggaattgaatctgattccttacttaaccgttaccgaaaatatttttttaggaagagagcttgttactaagtgggggatgctcgataaaaaagcaatgcgtttaaaaacgaaatcgttgcttgaaaaattaaaattgaatattgatcccaacacacttgtttctgaattaaaagttggccagcaacaggttgttgaaatagccaaggcattattggttaggtcggatgttataataatggacgaacccacatccgcattagtgaagcggaagtggaggtattgttcgaaatcataa

SEQ ID NO: 1792 - protein, 180 aa, Unknown
  Obtained from environmental sample
  DOMAIN (27)...(180): ABC transporter
  misc_feature (1)..(180): Xaa is any amino acid
MLVVENITKKFPGVVALNNVCLEIEAGKVTAIIGENGAGKSTLMKILSGVYHDFNGRIIFKDQQVKFSNPKEAQEKGIAIIHQELNLIPYLTVTENIFLGRELVTKWGMLDKKAMRLKTKSLLEKLKLNIDPNTLVSELKVGQQQVVEIAKALLVRSDVIIMDEPTSALVKRKWRYCSKS

SEQ ID NO: 1793 - DNA, 747 bp, Unknown
  Obtained from environmental sample
  misc_feature (1)..(747): n is a, c, g, or t
ttgattcatccactgggtggaaacatagaggtttggcaagaagagatatctttaattttaaaatctcagaaatatagaataatagcctacgaattgcgaggccataatagatccactataggagataacctcgattttactatggaaaacctggctaatgatttgtatattttactaaatcaacttcaaatatctagatgtactttgataggtcactcgataggcggaaaaatagcagccgtttttgctaaaaacaacatatcaatggtggatgcaataatgttcataagtggttcttccatacccattaaagaaaatgatcttgaagattctaccgcaataagactagcatttacaaagggaatggctgcagtggcagattacgaacgtcaaaaaaaatatagcaaagaaaaagagtttcaagatgacagacactggaagcacttcaaggagatatttacaaaaacctctgtggatggattcatagcttctaggaaagccttgcgtaccatgccccaaaacataaataaatttttgagaaattctgactgtaaattgtttggtattgtaggaagtgaggatgatgtatttttgaatctcaaaaaaactatgaaaaaagaaattacgaattttgaatttagagtcatttacggggaaggtcattggcttgtgcttcatgatccagttgaattagataaggcgatagagggattcttgagtgaaattaatgttcctaaccagaactag

SEQ ID NO: 1794 - protein, 248 aa, Unknown
  Obtained from environmental sample
  DOMAIN (25)...(237): alpha/beta hydrolase fold
  misc_feature (1)..(248): Xaa is any amino acid
MIHPLGGNIEVWQEEISLILKSQKYRIIAYELRGHNRSTIGDNLDFTMENLANDLYILLNQLQISRCTLIGHSIGGKIAAVFAKNNISMVDAIMFISGSSIPIKENDLEDSTAIRLAFTKGMAAVADYERQKKYSKEKEFQDDRHWKHFKEIFTKTSVDGFIASRKALRTMPQNINKFLRNSDCKLFGIVGSEDDVFLNLKKTMKKEITNFEFRVIYGEGHWLVLHDPVELDKAIEGFLSEINVPNQN

SEQ ID NO: 1795 - DNA, 381 bp, Unknown
  Obtained from environmental sample
  misc_feature (1)..(381): n is a, c, g, or t
ttgaatttgggaaaacagaaaattcttttgaaaaccaaaaaaatcaaaatgccaacagtaagtatcgtatcatgtttctgtaccgtttctactggaattctaatgaatttgaatttagttacacacgaaaataaattgaaaaacactctggatctattgaaacagaataatcatcctgacgttgcatcaaagtgtgttgaagttctctcaagaatagtaaataacataatccttcatcccgatgatccaaaatacaccaagatttcctgtaatagcaaaacacttacagggaatgtattaaatacaaaatatggaatagatttccttcttaattgtggatttcaacgacaaggtgagtttgcgttgcatcacttggtctaa

SEQ ID NO: 1796 - protein, 126 aa, Unknown
  Obtained from environmental sample
  misc_feature (1)..(126): Xaa is any amino acid
MNLGKQKILLKTKKIKMPTVSIVSCFCTVSTGILMNLNLVTHENKLKNTLDLLKQNNHPDVASKCVEVLSRIVNNIILHPDDPKYTKISCNSKTLTGNVLNTKYGIDFLLNCGFQRQGEFALHHLV

SEQ ID NO: 1797 - DNA, 381 bp, Unknown; identical to SEQ ID NO: 1795
  Obtained from environmental sample
  misc_feature (1)..(381): n is a, c, g, or t

SEQ ID NO: 1798 - protein, 126 aa, Unknown; identical to SEQ ID NO: 1796
  Obtained from environmental sample
  misc_feature (1)..(126): Xaa is any amino acid

SEQ ID NO: 1799 - DNA, 351 bp, Unknown
  Obtained from environmental sample
  misc_feature (1)..(351): n is a, c, g, or t
atgcataaatacattaaacgaaacagggatagcatctggttctattccaaaggattcaagaacctcagcgagattaccaaagcaaccgcggtgtggctgctggtgcccataaataatacgaaaagtatcagcactacaaggggtcagcaaaaaatcgtggcgacccacggtatcctctaccatctggaacataacgttacttcggttggaataaaaaggatggcctgtagtgagaaaaatagtttcggcataatctatcgtgcggccggacgaaagatattcggctttgtcgtgcaggttaaaacaaacaagatccgatacctgctcgccttcaatatccattacttgtaa

SEQ ID NO: 1800 - protein, 116 aa, Unknown
  Obtained from environmental sample
  misc_feature (1)..(116): Xaa is any amino acid
MHKYIKRNRDSIWFYSKGFKNLSEITKATAVWLLVPINNTKSISTTRGQQKIVATHGILYHLEHNVTSVGIKRMACSEKNSFGIIYRAAGRKIFGFVVQVKTNKIRYLLAFNIHYL

SEQ ID NO: 1801 - DNA, 336 bp, Unknown
  Obtained from environmental sample
  misc_feature (1)..(336): n is a, c, g, or t
atgaacgggattattctgccaacatacatcgagaacatcacaaccagaaaagacaagacggtaaagatcacgcttggaacgcaggaactttcaccatcaaaggctggtgaacttttcacgctgttaaaccaactggcagtaacctacatatctccgaaagaaatctcgcagtcagaacttgaccaggtggataagctcgaccctgaatttttcaggcagaccccaagccagaaaaaacgcggggtgctgtacaaactgtgggaaccgaacaaagaaggattccaaggatttcaattttgtcctaccggaagtaaaacaaaatggggtcattcgaaa

SEQ ID NO: 1802 - protein, 112 aa, Unknown
  Obtained from environmental sample
  misc_feature (1)..(112): Xaa is any amino acid
MNGIILPTYIENITTRKDKTVKITLGTQELSPSKAGELFTLLNQLAVTYISPKEISQSELDQVDKLDPEFFRQTPSQKKRGVLYKLWEPNKEGFQGFQFCPTGSKTKWGHSK

SEQ ID NO: 1803 - DNA, 888 bp, Unknown
  Obtained from environmental sample
  misc_feature (1)..(888): n is a, c, g, or t
ttggtattttcctggtgggtggaccgganagacaggtttaataataatgtttttgaagcaggttttttggggcttgataatattggagtgtttgatagaaataatataccgggaggtggaactttagaacaagccgatggaacagcatggatgggaatgtattgcctgaatatgatggaaattgcccttgaactggcacaacacgatattgcctatgaagaccttgccacaaaattttttgaacactttacctatatagccgcttccttaaaccgtataaaaaaagatttccccgattcatgggacgaggaagaaggttttttttatgatgttttaaaaatgccggatgggaaatacatccccgttaagatacgttcactcgttggtcttgtaaccttatttggcgtacatgttatcgataaagaattgttggtgaaagtgcctgaattttatcgccgcttaaaatggtttgtcaggtaccggcaaaaaaataatgaatacgaggttattgaagatatcgatgataaaaacgggatcttactttctcttatgccgcagaaaaaattgaaaaagattttggttgcccttctcgatgaaaatgagtttttatctgccggcggtattcgttctctttcaaaaattcatcaaaaaccatatacaattgttattgacggaaaagagtttggccttaattaccaacctggagaatctaactccgatttgtttggaggcaattccaattggcgtgggccaatctggataccggtaaattatttaatcatcctttcagtggaaaaatatcatgaatattataaagatgaattactggtggagttgccaagccactctggaaaaatggtcaaccttaagcagttgcaaacgacttaa

SEQ ID NO: 1804 - protein, 295 aa, Unknown
  Obtained from environmental sample
  misc_feature (1)..(295): Xaa is any amino acid
MVFSWWVDRXDRFNNNVFEAGFLGLDNIGVFDRNNIPGGGTLEQADGTAWMGMYCLNMMEIALELAQHDIAYEDLATKFFEHFTYIAASLNRIKKDFPDSWDEEEGFFYDVLKMPDGKYIPVKIRSLVGLVTLFGVHVIDKELLVKVPEFYRRLKWFVRYRQKNNEYEVIEDIDDKNGILLSLMPQKKLKKILVALLDENEFLSAGGIRSLSKIHQKPYTIVIDGKEFGLNYQPGESNSDLFGGNSNWRGPIWIPVNYLIILSVEKYHEYYKDELLVELPSHSGKMVNLKQLQTT

SEQ ID NO: 1805 - DNA, 969 bp, Unknown
  Obtained from environmental sample
  misc_feature (1)..(969): n is a, c, g, or t
ttgaatgttaaatttaaattcatttatccttcaagaacagcaatttttgatttagctgataatagtattaaaaatatttcaataataaaggataatacaattatttatttgtttgactttactactaataggatatcagaatattcaaattttaataaatcagatttcaaaatatttaatagagatgagttgttgagacttgcggattattcagataatgcgaaatcaaaaaacagaatttcctatcatgaaataggcgggttattaatttttgctaatccagccaaagttgatattagcaaaggcatagcgattcttgatgaaggaaacattccgatttatattaaattaggctctttaggaaaatatataggtactcaagatactgcaatatatttagcttttcacccagatgataatgaaagtgatgtaattatttggggcaaattggaattagatcaacttccgtttgctattgatataaattcaattaaggaaaaaaatagaaatgttgaaaattttaaaaagtccgatggagaatatttatttaaccatttaaatgaattattaaatgactcagctgttaatagtgttgaatataaaccaatatggacatcaaagcaatttgatgtccacaacgcatataatgcttctaataaaattatatgctttacacttagtaaaatattaactttaattaaatatgacaaaatagtgctttctagctgtttaagtgataaggaatatttacttaatagcgaaaatatatttgatttttatttaagtaaggatgaggttgataaaattgaattaagcattttagaaagaataactcttaacgctgatcctttatctaatatacaaattagaaaaagagttctgtatttaggagtagagcatgaatttacgaaaaatttgaatattgataaggaatttaaattgcttttagaaccaatatatctagaataa

SEQ ID NO: 1806 - protein, 322 aa, Unknown
  Obtained from environmental sample
  misc_feature (1)..(322): Xaa is any amino acid
MNVKFKFIYPSRTAIFDLADNSIKNISIIKDNTIIYLFDFTTNRISEYSNFNKSDFKIFNRDELLRLADYSDNAKSKNRISYHEIGGLLIFANPAKVDISKGIAILDEGNIPIYIKLGSLGKYIGTQDTAIYLAFHPDDNESDVIIWGKLELDQLPFAIDINSIKEKNRNVENFKKSDGEYLFNHLNELLNDSAVNSVEYKPIWTSKQFDVHNAYNASNKIICFTLSKILTLIKYDKIVLSSCLSDKEYLLNSENIFDFYLSKDEVDKIELSILERITLNADPLSNIQIRKRVLYLGVEHEFTKNLNIDKEFKLLLEPIYLE

SEQ ID NO: 1807 - DNA, 684 bp, Unknown
  Obtained from environmental sample
  misc_feature (1)..(684): n is a, c, g, or t
ttgtcgggcattattgtttttgttcagttgatgtgtttgttttggaaagataaattgcgattacacatctttgcgttttcgtcaattgcatttatcttttggaaatcatccctgagtggttcatttattaatttttggaacgaactttttacatttgattaccaacttcatcgtgttgtggatttcactgatctattttgcttgttgattttaattccactttatttttattgtccaaaaaatcaagaaatacgatttaacaaaaaactgatcgcttatccccttttcatttttaccttattcactgtatttgcaacttcatataaaaaaggattcggaggaaatgagatctatattcaagacttcatcaaactgaaaatgactcgcgatgaatttaccgatcaactcaaaaaagatagaattcaattcaagattgattcattttatgtttttgcaaaagatacatttgatcgattaatcttgaataatgtaattttaaaatcagacactatttatatgttggatcttggagtcagagccaaaaggcataaaactgaaatttatattcacaagatcactttatctgcaggagattccggaggatactttacatttattcatgatgagtataaagattttatgaaacggtacaaggttgaggtgaaggaaatcttggagaattaa

SEQ ID NO: 1808 - protein, 227 aa, Unknown
  Obtained from environmental sample
  misc_feature (1)..(227): Xaa is any amino acid
MSGIIVFVQLMCLFWKDKLRLHIFAFSSIAFIFWKSSLSGSFINFWNELFTFDYQLHRVVDFTDLFCLLILIPLYFYCPKNQEIRFNKKLIAYPLFIFTLFTVFATSYKKGFGGNEIYIQDFIKLKMTRDEFTDQLKKDRIQFKIDSFYVFAKDTFDRLILNNVILKSDTIYMLDLGVRAKRHKTEIYIHKITLSAGDSGGYFTFIHDEYKDFMKRYKVEVKEILEN

SEQ ID NO: 1809 - DNA, 516 bp, Unknown
  Obtained from environmental sample
  misc_feature (1)..(516): n is a, c, g, or t
atggtaaccgaaaattttggtgaccttcaaattgaatttaaatggaaccgaacaatgggaattgtgcttctgatattttcactcgtttggaacgcggtgctcatttttatgatttcgaaaatgccggctgaaatatggtatttcagcataatacatgccggtgcgggtttattcatattttatttaggtttatcccatntgataaacaaaacactaataacctgcacaaatgaaacgctcaaattaaaatcgggtccagttcctaactttaataacaaggttatttcaaaagaagatgttttgcaactttatttcaccgagagaataacaagaggaaaaaacggctctacttccattacttatcgtgttcacatgcttgataaaaataacagaagtataaagctgatcaagacacttccggatgctgaatcggcccgctttatagaatcaaagcttgaaaaattttataaaataaaaaatgtggccgttgcgggagaatttgacagcaggaattga

SEQ ID NO: 1810 - protein, 171 aa, Unknown
  Obtained from environmental sample
  misc_feature (1)..(171): Xaa is any amino acid
MVTENFGDLQIEFKWNRTMGIVLLIFSLVWNAVLIFMISKMPAEIWYFSIIHAGAGLFIFYLGLSHXINKTLITCTNETLKLKSGPVPNFNNKVISKEDVLQLYFTERITRGKNGSTSITYRVHMLDKNNRSIKLIKTLPDAESARFIESKLEKFYKIKNVAVAGEFDSRN

SEQ ID NO: 1811 - DNA, 807 bp, Unknown
  Obtained from environmental sample
  misc_feature (1)..(807): n is a, c, g, or t
ttggataagacaagacaatcttttattcacccctggagccgttattttactattgttctttttagtcttgctgcctttgccggaatttattgggcatttgtaagtccaaaaaatattttgcctgcagtatcctcagctttgatcgtcgcgtgtccatgttcgcttctgctatcttcaacgttcacgttcggtaatatgctccgctatttcggaaaaaacaagttgtatctgaagaatgcttccgttattgaagcattatcaagagtgaatacaatagtttttgataaaacaggaacacttacctacacttcaaacgcttcggtcgattattgtggtgtaccgcttacaaggcaggaaagaagttacatctatgcgcttgcaaaagattcagcccatcctttgagcaggctggtgaaagagcatttattgcgaatccatacaattattccgtttagggtgaaagacttcagagaactgccgggcaagggaactgaggggacaatcgataataagaaagtcaaagtcggctcttgtttgtttatcaccggatttaatgatagtaagacaaattcggccgaagtgtgggttgctatcgacaatgacgtgaaaggtttttatcgtattcataacttgtatagggaaggcgttaaagaaatggctgcaaagctggaaacaaaaaattaccaactgcatattctctccggcgataatgattcagaaaggaaacggttgcagacttatttcccattagctccattgatgtttaatcaatctcccgcagacaaactggaatacatcaaagaataa

SEQ ID NO: 1812 - protein, 268 aa, Unknown
  Obtained from environmental sample
  misc_feature (1)..(268): Xaa is any amino acid
MDKTRQSFIHPWSRYFTIVLFSLAAFAGIYWAFVSPKNILPAVSSALIVACPCSLLLSSTFTFGNMLRYFGKNKLYLKNASVIEALSRVNTIVFDKTGTLTYTSNASVDYCGVPLTRQERSYIYALAKDSAHPLSRLVKEHLLRIHTIIPFRVKDFRELPGKGTEGTIDNKKVKVGSCLFITGFNDSKTNSAEVWVAIDNDVKGFYRIHNLYREGVKEMAAKLETKNYQLHILSGDNDSERKRLQTYFPLAPLMFNQSPADKLEYIKE

SEQ ID NO: 1813 - DNA, 972 bp, Unknown
  Obtained from environmental sample
  misc_feature (1)..(972): n is a, c, g, or t
ttgaaatacgaaaattttaagcgatcaaataaaaagcagcgaattaacaaaagtcacttcattgttttggtttcacaaataaaaagtgatttgaatggaaacactcttctgaaaaataagattgttgaaacaaaacaacaagcaatcgccataaatgaatatgttgagcaaaacacggagtttaatttacgagaatcggctaaatctatagaaataagaataaagaaacttcttgaagattccgctcccaaatctgcaccatttccagagcttgataaaaatgaagccttgtttgcatgggtacaaacaggtttagacttgcataaagagtcgaataaatgtaagttttgtgataatgatgtttcggaggaacgcctcaaatctttaaatgaatattattccgaaaaattgattaaattacagaatgaaatatctagtattagagcaaatataataaatgataaaacggatttaagttttgacttcccgcacgaaagtaatatagcaaagcatttgcaagaaaaatacaaaaccgctattgaaaaatataatgcaaaaaaggacgactatataaaaatacttgacgtttttgaagaggacttgaagaaaaaggaaattaattattttaattctatattagctagttcggtaacaataattacgatagaaaaagaacttacagtcgtgttagatattattaatgagcataattcgtttgtaactaatttttcagcaaataagcaagacgcgcttaaaaaaattctcaaacattatgttgcagaatatttacagtcggagaactatgtttcaaaggagagcgaaagccatacggctttagttctcgttaataggtgtactgataagctaaagaataataatgcaataatccttgagcttgaaagtttgctaaaagataccttgaaagggcaggaagagttgaatcgctatttgaaaatattcttaatcggatga

SEQ ID NO: 1814 - protein, 323 aa, Unknown
  Obtained from environmental sample
  misc_feature (1)..(323): Xaa is any amino acid
MKYENFKRSNKKQRINKSHFIVLVSQIKSDLNGNTLLKNKIVETKQQAIAINEYVEQNTEFNLRESAKSIEIRIKKLLEDSAPKSAPFPELDKNEALFAWVQTGLDLHKESNKCKFCDNDVSEERLKSLNEYYSEKLIKLQNEISSIRANIINDKTDLSFDFPHESNIAKHLQEKYKTAIEKYNAKKDDYIKILDVFEEDLKKKEINYFNSILASSVTIITIEKELTVVLDIINEHNSFVTNFSANKQDALKKILKHYVAEYLQSENYVSKESESHTALVLVNRCTDKLKNNNAIILELESLLKDTLKGQEELNRYLKIFLIG

SEQ ID NO: 1815 - DNA, 327 bp, Unknown
  Obtained from environmental sample
  misc_feature (1)..(327): n is a, c, g, or t
atgattttaaaattaaatagaattaaggattttggaatatttaaagagtttaattgggatacgtctattaatacttttaagaaaagaaatttaatttatggatggaattactctggcaagactacattttctaaactttttagcaatttagagaagaaatctaaggttcattttgcagacgctcaatacatatatgaaattgcaaaggacaatttaaccttttcacaagatcaattaaatgattttccgtatttggtaaaagtgtttaatactttttacattagaaatgtatttgcatgggatatggatggtgtagacggtttttga

SEQ ID NO: 1816 - protein, 108 aa, Unknown
  Obtained from environmental sample
  misc_feature (1)..(108): Xaa is any amino acid
MILKLNRIKDFGIFKEFNWDTSINTFKKRNLIYGWNYSGKTTFSKLFSNLEKKSKVHFADAQYIYEIAKDNLTFSQDQLNDFPYLVKVFNTFYIRNVFAWDMDGVDGF

SEQ ID NO: 1817 - DNA, 615 bp, Unknown
  Obtained from environmental sample
  misc_feature (1)..(615): n is a, c, g, or t
ttgacacacatgaataattactcaagttatatcaagaactttttggttcactttcctaataaggaaaaggttgttccctgggaaatcgtatcagatattcaaaaccttattcagcaaaagataaaactattgtctcccgactttcgcatttcgcaagacgtagccgttcataaaaaagcaaagatcgaagaaaacgtaacgttgaagggaccaatcattatcaatgaaggatgctttgtcggcgcgcatgcatacctgcgcggaggagtatttttgggagacaactcggtcgtcggtccgggttgcgaagttaaatcaagtattatcctgtccggtagttctttggcacactttaattttgtcggcgattccataatcgggtcttatgtaaatatggaagccggaagtataattgccaaccacttcaacgaacgtctggataagaccatttttgtaatgatcaacaaaaagaagacggctataagcgtaacaaagtttggggcgctggtaggtgatcatagtaaaattggtgctaatgcggtcttatcgcctggaacacttttaccctcccaaagcatagtaaagcgactggaacttgtggatcaagtcgaatga

SEQ ID NO: 1818 - protein, 204 aa, Unknown
  Obtained from environmental sample
  misc_feature (1)..(204): Xaa is any amino acid
MTHMNNYSSYIKNFLVHFPNKEKVVPWEIVSDIQNLIQQKIKLLSPDFRISQDVAVHKKAKIEENVTLKGPIIINEGCFVGAHAYLRGGVFLGDNSVVGPGCEVKSSIILSGSSLAHFNFVGDSIIGSYVNMEAGSIIANHFNERLDKTIFVMINKKKTAISVTKFGALVGDHSKIGANAVLSPGTLLPSQSIVKRLELVDQVE

SEQ ID NO: 1819 - DNA, 594 bp, Unknown
  Obtained from environmental sample
  misc_feature (1)..(594): n is a, c, g, or t
ttgacagaagaaaaagaaaatattactgacgcttttttttcaagttatggagataaaatatactactgcatagctaccagttatggaaaacactcacctgtaggacgagcacaagctcatggaatggatatttattcgattgatattaacacaaagaaaaaagaaaaaatatcaaattggaattcatattcaataaataaaatatcagaagcagatagtattagtctatttgttggtattaatggagatgaagaaggaggaatctttaaatttttaaagaatatgcccgataaattaacaagaattattcctgcaaacaacccgagagaatttgctaatctatattatcagccattatattcaaacgaacatggttttttggcatttaccgccccatatgaattgtacgttatggatttaaaagataatatagctatacctttagtcaattttacagcacaaaaaaatgtagatgggtttgctttttgcaacacacaaaagaaaatggtctttaattttgaagatgatttaaatttatatacaataaatcttgatggtagtgatttaacaaaaataccaatattaataaaataa

SEQ ID NO: 1820 - protein, 197 aa, Unknown
  Obtained from environmental sample
  misc_feature (1)..(197): Xaa is any amino acid
MTEEKENITDAFFSSYGDKIYYCIATSYGKHSPVGRAQAHGMDIYSIDINTKKKEKISNWNSYSINKISEADSISLFVGINGDEEGGIFKFLKNMPDKLTRIIPANNPREFANLYYQPLYSNEHGFLAFTAPYELYVMDLKDNIAIPLVNFTAQKNVDGFAFCNTQKKMVFNFEDDLNLYTINLDGSDLTKIPILIK

SEQ ID NO: 1821 - DNA, 915 bp, Unknown
  Obtained from environmental sample
  misc_feature (1)..(915): n is a, c, g, or t
ttgatggagaattccacgntagaacttgataaaagaatttctattcttgaacatgatcttcaagaacaagataaggcaaaacaaagagtcttatctaaatccagcgcaataagaaatcttgctgctgatttgatgaatatttctatttatgatcctgttgcgtttaaggctttactaaatgaacattcttctaatctaataatagaaaagggcagaaaatatttagatatagtagaggaacaaattccattagatgagaacttgagaaaagtttcatcacttctttatgaaagagcaaaagaaatggaaagaggaagtgaaacaatcgacaaagcgagaatcaaaatattagatgagatgcaagaattgagaaaaaaaacaaccatcgctgaaacaaaaattaaattaaaagaacaaaaaacaaaagaatggtttgaaagatatcggtggtttgttacttctaatggattattagtaattggaggtagagatgcctcttcaaattcagctataattagaaaacatatgacagatcaggatttggtttttcatgcggaaatacatggttctccttttttcttgatcaagaatattggacttgatagtatagatggtactactacaaataatcaaagcattctagagacagccatcgctacagtaaccttcagtagaggatggaaagaaggtctatcgagtgctgacgcatactgggtatacccaaatcaggttaaaaaaggagctccaactggtcaatttcttccaaaaggatcttttgtaattgaaggaaaaagaaattttgtcaaggcattagagttaaaattatcgattggtgtaactaaaagacatgatggttataaattaatatgcggacccgttgatagtataaaattaaaatcccataattttatttaa

SEQ ID NO: 1822 - protein, 304 aa, Unknown
  Obtained from environmental sample
  DOMAIN (150)...(256): Domain of unknown function (DUF814)
  misc_feature (1)..(304): Xaa is any amino acid
MMENSTXELDKRISILEHDLQEQDKAKQRVLSKSSAIRNLAADLMNISIYDPVAFKALLNEHSSNLIIEKGRKYLDIVEEQIPLDENLRKVSSLLYERAKEMERGSETIDKARIKILDEMQELRKKTTIAETKIKLKEQKTKEWFERYRWFVTSNGLLVIGGRDASSNSAIIRKHMTDQDLVFHAEIHGSPFFLIKNIGLDSIDGTTTNNQSILETAIATVTFSRGWKEGLSSADAYWVYPNQVKKGAPTGQFLPKGSFVIEGKRNFVKALELKLSIGVTKRHDGYKLICGPVDSIKLKSHNFI

SEQ ID NO: 1823 - DNA, 480 bp, Unknown
  Obtained from environmental sample
  misc_feature (1)..(480): n is a, c, g, or t
atgggaaagataaaccgagaggaattatttagaatcctagatgaacaatatacaaattgcaaagctcgtatgctattgataatagaggataaaataaaagacctagaggaatataaaggagatgtaatagatataacgacagaaattagtatgggtaatagtctagaaggaggtaagttgtttagatctgtagatgaagattattatgataaacagaaattattatcaagtgattcggtgcctgaaggaccagagaataaaaaatcattggataaattattttggcctgatttgaatggtaacaatatattagactctgttaagtcagcaccgaagcacaaaaagaaatatctaataaaattaaatgataatttcacacaaaaacaatgtgaagagataaccgaacaaatagaacaacaacaattcattgtatataatcaggacgcaattaaacagataatcacgttggatgtagaataa

SEQ ID NO: 1824 - protein, 159 aa, Unknown
  Obtained from environmental sample
  misc_feature (1)..(159): Xaa is any amino acid
MGKINREELFRILDEQYTNCKARMLLIIEDKIKDLEEYKGDVIDITTEISMGNSLEGGKLFRSVDEDYYDKQKLLSSDSVPEGPENKKSLDKLFWPDLNGNNILDSVKSAPKHKKKYLIKLNDNFTQKQCEEITEQIEQQQFIVYNQDAIKQIITLDVE

SEQ ID NO: 1825 - DNA, 768 bp, Unknown
  Obtained from environmental sample
  misc_feature (1)..(768): n is a, c, g, or t
ttggcaagtttttcgtatcaacgagaatattttcgatttgcaaaacaatacataaatcaggttccaattattgatggtaagagacatggcaaggatgtaaatctttataaattgtttgttgagcagtgcttgagtctcctccgaaaaaatggattatgtggtctggttatacccagtggaatttacacggacctaggcgcaatgaaattgcgtgaaatgctctttgacaactctcaaataaaagggcttttctgcttcgaaaatcgaaaggagattttcgaaggagtacatagaagctacaagtttgttatcttgacattggaaaagggaccaaaaaccataaactttcctgctgcattcatgcgattggacgtcaatgaattagaaggctttccccaaaataaaggcttgaatatttctgttgacttaatccgtaagctttcacctgattctttatcggttatggaattcaataatgcgatagatattgagatcgccgagaggctgctacgatttcctttgctgggtgagaaagtaatagacaggtgggaattagagttgcatcgtgagtttaacatgacggatgatgcctatctgtttaggatcattagaacaactaaagcccttcctctttatgaagggaaaatgatacatcagttttcagatactttagcagagcctcgcttttggataaatcagactgatggtcgaaaggcattaattggtaagtcaaaagataatgggcaaattctcggataccagaaataa

SEQ ID NO: 1826 - protein, 255 aa, Unknown
  Obtained from environmental sample
  misc_feature (1)..(255): Xaa is any amino acid
MASFSYQREYFRFAKQYINQVPIIDGKRHGKDVNLYKLFVEQCLSLLRKNGLCGLVIPSGIYTDLGAMKLREMLFDNSQIKGLFCFENRKEIFEGVHRSYKFVILTLEKGPKTINFPAAFMRLDVNELEGFPQNKGLNISVDLIRKLSPDSLSVMEFNNAIDIEIAERLLRFPLLGEKVIDRWELELHREFNMTDDAYLFRIIRTTKALPLYEGKMIHQFSDTLAEPRFWINQTDGRKALIGKSKDNGQILGYQK

SEQ ID NO: 1827 - DNA, 456 bp, Unknown
  Obtained from environmental sample
  misc_feature (1)..(456): n is a, c, g, or t
atggataaggcgcaggaacactccccgtttttagaaagacaaagaatttcacctaccattgttgttcaccgcggtcatagttatggggtttcaactaccatcaaacaaattcagcctgctgcaaaaattgttttactgggtccctgcggtggttataatgtaatacatgatgttcttcaacattcgccggatgcacatattgtagcctccaagcaaacggggaaaatgtatatcaatcagccgttccttaatattttaaatgaaaagatcaggacagggaataacattgactggattcctttctggtctgagtttaaagcaaaggctggaaaaatagaaggctttgatgattatatacccccttataaaaacctgggagcaatttttattaaggcatacaatacccagatgggtgaggaagaaggaataagccttactaaatttgatgctcattaa

SEQ ID NO: 1828 - protein, 151 aa, Unknown
  Obtained from environmental sample
  misc_feature (1)..(151): Xaa is any amino acid
MDKAQEHSPFLERQRISPTIVVHRGHSYGVSTTIKQIQPAAKIVLLGPCGGYNVIHDVLQHSPDAHIVASKQTGKMYINQPFLNILNEKIRTGNNIDWIPFWSEFKAKAGKIEGFDDYIPPYKNLGAIFIKAYNTQMGEEEGISLTKFDAH

SEQ ID NO: 1829 - DNA, 678 bp, Unknown
  Obtained from environmental sample
  misc_feature (1)..(678): n is a, c, g, or t
ttgcaaatttttcgcatgattttaaaacccggtattcgccctacagggatatgtagatacattattgcagggaggccatggataaccccggaaataaataaaaattttttagaaaaagcagggaaaaatgtgcagcgcctggctaacctgattcaggaccttgatgaaatatcaaaactggaacggggtgaaataagtttgaacaaacaaaactttgtgatacaggaccttgtacgtgatgtatttgaaagcctttcactgatggcagagcaacaaaagatctcctttagttttaaaaagggatgcgaaaaatcatttgttgtacatgctgacaaagaaaaaattcgccaggtaattataaaccttcttgagaactccataaaatatggtaaacatggcgggcatgtggtagccagtatttacaatactgatggcgaaaatatattggttgaaataagtgatgatggaatgggcatttctgaaaataatttaaaccgcatttttgaacggttctatcgtgggcccgaaggccgtagccgcgatgtacaaggtagtggcttaggccttgcaatctgtaaacatattattgaagcgcatggacacagtattcatgtgcgcagcaaaacagatgtaggaacaacgattggttttacattagatgcccggaaggaaatataa

SEQ ID NO: 1830 - protein, 225 aa, Unknown
  Obtained from environmental sample
  DOMAIN (110)...(222): Histidine kinase-, DNA gyrase B-, and HSP90-like ATPase
  misc_feature (1)..(225): Xaa is any amino acid
MQIFRMILKPGIRPTGICRYIIAGRPWITPEINKNFLEKAGKNVQRLANLIQDLDEISKLERGEISLNKQNFVIQDLVRDVFESLSLMAEQQKISFSFKKGCEKSFVVHADKEKIRQVIINLLENSIKYGKHGGHVVASIYNTDGENILVEISDDGMGISENNLNRIFERFYRGPEGRSRDVQGSGLGLAICKHIIEAHGHSIHVRSKTDVGTTIGFTLDARKEI

SEQ ID NO: 1831 - DNA, 729 bp, Unknown
  Obtained from environmental sample
  misc_feature (1)..(729): n is a, c, g, or t
ttgaaacctcaaaagggagcgagttcaaacttattcatattaaaagaccctcttgaagaaattgaggatagagtaattaaaatctgcaaatctcctatttcacaggggaaaaccaaaagactaaaaagatttgagcgggaaatccgagcatttagagaggtcattaaaaaagaccttaccggtgtaatccagttctataaatcgggcactattaagattgactatgatgagtttttgtacttgattatggaaaaagcggatgaagatttagcatcttttctaacgaggaaacgttttgattttacacctaatcaaaaattgactttttgcgtaagtattcttaatgggataaagcagttacatggtgcgggaatttaccacagagatatcaaacatgataacattttgcttgtgaatggtgaatttaaaattggagatttagggttggtttcattccagaataaagattttgacattgaccgaagcgatgaaaaaattggtccttttggttggctttcaccagaggcaacaaataaaatgcttaaaacaaaaaagggaattatttacacctacgattgtgatattaacgcaggctcggacgtttttcaattagggaaattattttggtatgtgtttcaaggcaatttacctattggtcaaattctattagaggattacgaaatagctgaagatgatatttccaaatcatttttcaatgctccaatatga

SEQ ID NO: 1832 - protein, 242 aa, Unknown
  Obtained from environmental sample
  DOMAIN (4)...(237): Protein kinase domain
  misc_feature (1)..(242): Xaa is any amino acid
MKPQKGASSNLFILKDPLEEIEDRVIKICKSPISQGKTKRLKRFEREIRAFREVIKKDLTGVIQFYKSGTIKIDYDEFLYLIMEKADEDLASFLTRKRFDFTPNQKLTFCVSILNGIKQLHGAGIYHRDIKHDNILLVNGEFKIGDLGLVSFQNKDFDIDRSDEKIGPFGWLSPEATNKMLKTKKGIIYTYDCDINAGSDVFQLGKLFWYVFQGNLPIGQILLEDYEIAEDDISKSFFNAPI

SEQ ID NO: 1833 - DNA, 624 bp, Unknown
  Obtained from environmental sample
  misc_feature (1)..(624): n is a, c, g, or t
atgcttgggatctccactgaatctttacagaacccaaaagaattgaagacctacatcaaaaaattgcaagactcaattcgagaacttcgcaccagctatgacagtttaattcagcgatttgaagaatttatcttagaagaatttattggcgaagaaatggagtttgaagagtataaacttaaacttcaaaatcgtttcggtaaactgaaaaaacatttgtgtttaccccatcagaaaattttcattcaacgtttagattctgaattggatgacaagaaagcatggttgagttctattgcacaggtagttattggcaaatcattggaaactattaaggacgaagaagaaataatactttacgaaagattcaagaatataattcatgaattagataacttaacaaacatatcgcaggcagattttgatgatgagcttgaagatattttaggaattgaaatgagttcattcgttgatggcataaagcagcgattggtgcgattacccaaaaacaaaaatgtagaggtgagcaagattgaaaacttaatcaaggcaaagctttcaaaagataaatctcttaacattgcggcaatagcgaacgtattaaaagagcttctgcaaaaatga

SEQ ID NO: 1834 - protein, 207 aa, Unknown
  Obtained from environmental sample
  misc_feature (1)..(207): Xaa is any amino acid
MLGISTESLQNPKELKTYIKKLQDSIRELRTSYDSLIQRFEEFILEEFIGEEMEFEEYKLKLQNRFGKLKKHLCLPHQKIFIQRLDSELDDKKAWLSSIAQVVIGKSLETIKDEEEIILYERFKNIIHELDNLTNISQADFDDELEDILGIEMSSFVDGIKQRLVRLPKNKNVEVSKIENLIKAKLSKDKSLNIAAIANVLKELLQK

SEQ ID NO: 1835 - DNA, 462 bp, Unknown
  Obtained from environmental sample
  misc_feature (1)..(462): n is a, c, g, or t
gtgatccaagagaaagagagcattaattcaatgggacttaaggtggcagaccatgttactgccatgcttgcttattgggataagaatcttgtctgccgttttgccaatgccgcataccgggaatggttcggcaaaaccagggaacaaatggttaataagataacgcttcaggaattgctaggcccactctacgaaaaaaaccttccttacattcagggtgcactcaaaggaaagattcaaacttttgaacgggaaattacaacgccaacgggtggtctacgctattcccttgcgaattatttccctgatattgaggatggtgaggtaaaaggattttttgtgcatgttgctgatataagccgcattaaattattggaaaaagaattaacctcttccnacgaaaaaataacagaacaaaatcaacgcctgctgagttttgccaatatgtttctcataacttaa

SEQ ID NO: 1836 - protein, 153 aa, Unknown
  Obtained from environmental sample
  misc_feature (1)..(153): Xaa is any amino acid
MIQEKESINSMGLKVADHVTAMLAYWDKNLVCRFANAAYREWFGKTREQMVNKITLQELLGPLYEKNLPYIQGALKGKIQTFEREITTPTGGLRYSLANYFPDIEDGEVKGFFVHVADISRIKLLEKELTSSXEKITEQNQRLLSFANMFLIT

SEQ ID NO: 1837 - DNA, 396 bp, Unknown
  Obtained from environmental sample
  misc_feature (1)..(396): n is a, c, g, or t
gtgcttgttgctttgtcaattttgaagttgaataataagtcgttgttcatctcctactgttttcaatatccacaaacctggtgctcgggcaaggagcttcccctacctggaaaattctcaaaaccccaggccctcaaaggatcatctgcaactattcggttgctaatatatatgcaacttttcggtttctcaaaattttgtctcacttttttacatcgtgaaaggctagtcggggaaactaaaattaaaatcagtccgatgttggtgtccaacgagaaaaattggttaatgaacattgatgaagaagaaagatcatctttcaaaaggagcgtcatcgaatggtggcagtcatcaacttcaaagttcgctattccttgttccgtgcctgcctactga

SEQ ID NO: 1838 - protein, 131 aa, Unknown
  Obtained from environmental sample
  misc_feature (1)..(131): Xaa is any amino acid
MLVALSILKLNNKSLFISYCFQYPQTWCSGKELPLPGKFSKPQALKGSSATIRLLIYMQLFGFSKFCLTFLHRERLVGETKIKISPMLVSNEKNWLMNIDEEERSSFKRSVIEWWQSSTSKFAIPCSVPAY

SEQ ID NO: 1839 - DNA, 333 bp, Unknown
  Obtained from environmental sample
  misc_feature (1)..(333): n is a, c, g, or t
ttgcatggggacctttttttggttgatttggtcgatgaaatcaagatcggctcggaaaaggggatccgaaacaacatgccgaagcaaaacgcttttcctggcaccaaggtatgccggattttctgtgtcgaagatgaggtggaaaagctcggccactatatcgacaaccagaaacagcatcatgtttttctccgttcgaagacgactgcgaaagactgcttacggagaatgagattcagtttgatgagcatcttatgtggaggtgaagagttgtccctcgattatagtttcaaataccgaacaatcgaacctaccttcgctgcgcttcagtag

SEQ ID NO: 1840 - protein, 110 aa, Unknown
  Obtained from environmental sample
  misc_feature (1)..(110): Xaa is any amino acid
MHGDLFLVDLVDEIKIGSEKGIRNNMPKQNAFPGTKVCRIFCVEDEVEKLGHYIDNQKQHHVFLRSKTTAKDCLRRMRFSLMSILCGGEELSLDYSFKYRTIEPTFAALQ

SEQ ID NO: 1841 - DNA, 432 bp, Unknown
  Obtained from environmental sample
  misc_feature (1)..(432): n is a, c, g, or t
gtgatgcaatcctttgaaaatgcactcatgtggaaactgggtgtctgttctcccggcgaaattgacaagatcaatattctgaaagcatctatccttgcgatgcaccgtgcgcttgatcaatttccggattcacccgaatgtatccttgttgatggcaaccgtttcacaccctggaagagggttccttctgcctgtataatcaaaggggatggcatttacagatccattgccgcagcttctattttggccaaaacgcacagggatgaactcatgcgaaatttgcatgatgagtttccaaaatatggatggaatgaaaataaaggctatccaaccacgtttcatcgtaaacaaatactaactttaggactcactcctcaccaccgcaagagttttagggtaactgatcctgatctgcaaaacaaaatattttga

SEQ ID NO: 1842 - protein, 143 aa, Unknown
  Obtained from environmental sample
  DOMAIN (3)...(134): Ribonuclease HII
  misc_feature (1)..(143): Xaa is any amino acid
MMQSFENALMWKLGVCSPGEIDKINILKASILAMHRALDQFPDSPECILVDGNRFTPWKRVPSACIIKGDGIYRSIAAASILAKTHRDELMRNLHDEFPKYGWNENKGYPTTFHRKQILTLGLTPHHRKSFRVTDPDLQNKIF

SEQ ID NO: 1843 - DNA, 615 bp, Unknown
  Obtained from environmental sample
  misc_feature (1)..(615): n is a, c, g, or t
ttggaaacattattagaatttgcatacgagattaacaggattgatcctgatataattctgaccacaggaggcgatcaatttctatttccacatctactattcagagcaaaagcaaacaaagtcgaaaatcaattactagtaaatctaaatagagaaactaatattgaatatattttaaaaaagaacaagttatttctacattctgttactatgaataattccaattcttcaatttcctatatcgcatatggcaaagtgtactttaaacctaagcccttcttcttatatggcagaattcatattgatatcaataactcattcatatacaaagataatggtctagacggattggcagagttatgcagagtatgtagaatgcctatgcaaatagcatcaagatctacaataggtaaatgtcttagcagtctatatttttacaatgctcaaaaaagtgatgttttaattccatggaagcccacgacatcagaagttttcaaatcgttctctgatttattgaaagctgacaaaggcggatctatttttgaatcaaagccaggagcatatgataatgtggcagaatttgattttgtttcattatatccaaatatcatgtaa

SEQ ID NO: 1844 - protein, 204 aa, Unknown
  Obtained from environmental sample
  misc_feature (1)..(204): Xaa is any amino acid
METLLEFAYEINRIDPDIILTTGGDQFLFPHLLFRAKANKVENQLLVNLNRETNIEYILKKNKLFLHSVTMNNSNSSISYIAYGKVYFKPKPFFLYGRIHIDINNSFIYKDNGLDGLAELCRVCRMPMQIASRSTIGKCLSSLYFYNAQKSDVLIPWKPTTSEVFKSFSDLLKADKGGSIFESKPGAYDNVAEFDFVSLYPNIM

SEQ ID NO: 1845 - DNA, 384 bp, Unknown
  Obtained from environmental sample
  misc_feature (1)..(384): n is a, c, g, or t
ttgatgatgaatcagatgattacgatccagaatagaccaagatcatattctgagttaaaagaactcaaatctcttgatgacagataccattatctcaagttaaatggcgatgttggtaaaaagacatttggttgggatcgatgttttaatcaaagattttatcattctgctgagtggaaacgcgttcgcgatcttgttatcattagagatgatggctgcgatctgggaattcctggatttgaaattggtggtaaaattcttattcatcatatgaatccaatatggatagatgatttgaagcatggtaatccggatattctagatccagagtatctgatttgtggtcagaaagaacccatcaagctattcattacggttctataa

SEQ ID NO: 1846 - protein, 127 aa, Unknown
  Obtained from environmental sample
  misc_feature (1)..(127): Xaa is any amino acid
MMMNQMITIQNRPRSYSELKELKSLDDRYHYLKLNGDVGKKTFGWDRCFNQRFYHSAEWKRVRDLVIIRDDGCDLGIPGFEIGGKILIHHMNPIWIDDLKHGNPDILDPEYLICGQKEPIKLFITVL

SEQ ID NO: 1847 - DNA, 738 bp, Unknown
  Obtained from environmental sample
  misc_feature (1)..(738): n is a, c, g, or t
ttgactggcaaccggtttcgtatcgtgttggtagatgatgccccggtattacttactcccatgagtgaacagtcgcaaaaatatacttatgacgcgttggtaaagatgggtgtggaagtgaaattgaataagcaggtaaaagactatgtcgatgatacggtcatcttcgccgatggtgagaccattcaaagtaaattattgctttggactgcaggtgtaacctccagtaccttcgaaggcatccccaaagaaagctatggtagaggaagaaggttactggtcgatgaatacaataaagtgcagggcacgcataacatctatgctatcggtgacaccagtttacaaaccactgataaaaagtttccccagggtcatccgcaactggcacagccggccatacaacagggaaaaaatctggcgaaaaatttcagggccattttagaagggaaatcgcttacgccattttcttatcatgataaggggacgatggcaatcatcggaagaagtaaagcagtagccgaaattccaaaaccaaaaattaattttaaaggatggcttgcctggatgatgtggctgtttgttcaccttttttcgctgatcagttaccggaacaggatcaagaccatgtacaactggacgttagcttatttcaccaaagatcagtcattgcgaatgatcatacgccccgctgaaaaggggaaacaaaaagaaaaaaagaaaatatcgatgcctgcatag

SEQ ID NO: 1848 - protein, 245 aa, Unknown
  Obtained from environmental sample
  misc_feature (1)..(245): Xaa is any amino acid
MTGNRFRIVLVDDAPVLLTPMSEQSQKYTYDALVKMGVEVKLNKQVKDYVDDTVIFADGETIQSKLLLWTAGVTSSTFEGIPKESYGRGRRLLVDEYNKVQGTHNIYAIGDTSLQTTDKKFPQGHPQLAQPAIQQGKNLAKNFRAILEGKSLTPFSYHDKGTMAIIGRSKAVAEIPKPKINFKGWLAWMMWLFVHLFSLISYRNRIKTMYNWTLAYFTKDQSLRMIIRPAEKGKQKEKKKISMPA

SEQ ID NO: 1849 - DNA, 618 bp, Unknown
  Obtained from environmental sample
  misc_feature (1)..(618): n is a, c, g, or t
gtggaatatcgcaccgcagaggggaagacggagcacgggcggggacgggtcattgatttcaaccgcgaaggcgggaaggacaaaaaccaatatctggtagtcacccacttatgggtgcttggactgaccggctatttacgccctgacgtgttgatctatgtgaacggtctgccacttgtcttcattgaactcacgaattccaaagtgaatgtcagaaacgcctatgaagataatctagcccggtataaagcaaaaattccctacctgttccactacaatgctttctgcattctctccaatgcgctggataccctcgtgggcagtttcaatgccaattgggagtacttctttgtctggctgcaccctgatgacaaaaaagaaaagatcaaccgcaaatccatcgaaaagcaaggcatcaacattgaacgcgtgctggatggtttgttcccacacgaaaggctacttgactatatccaaaacttcatcgtttactataacgaaaccgagaagatcattgcccaaaaccatcagttcatcggtgtgaacaaggcgctcaaagtctttcaggaacgacaaaagcacaagaagaaagataaaggcaagttgggcgtcttctga

SEQ ID NO: 1850 - protein, 205 aa, Unknown
  Obtained from environmental sample
  DOMAIN (8)...(115): Type I restriction enzyme R protein N terminus (HSDR_N)
  misc_feature (1)..(205): Xaa is any amino acid
MEYRTAEGKTEHGRGRVIDFNREGGKDKNQYLVVTHLWVLGLTGYLRPDVLIYVNGLPLVFIELTNSKVNVRNAYEDNLARYKAKIPYLFHYNAFCILSNALDTLVGSFNANWEYFFVWLHPDDKKEKINRKSIEKQGINIERVLDGLFPHERLLDYIQNFIVYYNETEKIIAQNHQFIGVNKALKVFQERQKHKKKDKGKLGVF

SEQ ID NO: 1851 - DNA, 846 bp, Unknown
  Obtained from environmental sample
  misc_feature (1)..(846): n is a, c, g, or t
atgaaaaaattcctggcgatattcttgttttttattgcctttcacggtaatgcatcagcgcaaccggactcttccttcacgctggtaaaaaccatcaccggcgatataatggattttgcggttgacaaccttggcaatttatacttacttacttccacggaccaacttaaaaaaattgatgctaacggcgattcagtagctgtttataataatgtaaaaaagtttggaaaactgaccacggtagatgtttccaacccattgaaggttttgctgtattataaagatttttctacgattgtagtactggatagattactgaatatgcgtaataccattgacctgcgcaaacatggtattttccgtgtgtctgccgttggccagtcttacgatggtaaagtgtggttatatgacgaacttgataacaaactcaaaaaaattgatgaagagggaaaattgttattggagacgcccgacttcaggcaattgtttgatgtggcgccaaagccccaaaaaatatttgaccaggatggcttcatttacctctatgatactgcccggggtttttttgtatttgattattacgggtcattaaaaaatcgcatacccatcaccggttgggacaatgtaaaagtatccggtaaatatattttaggattgagtgcaaacaaattgcagcaatacgagcttacacttttgccttgcgggaacaaaaatctgcaaaacattttcttccgtacgactattaaaatataccgcccaaccaaatttccccctaaaaaaaaagtgatccgcattttataccaacaaaaattaattaattttcggacccttggggcccggcagtaa

SEQ ID NO: 1852 - protein, 281 aa, Unknown
  Obtained from environmental sample
  SIGNAL (1)...(18)
  misc_feature (1)..(281): Xaa is any amino acid
MKKFLAIFLFFIAFHGNASAQPDSSFTLVKTITGDIMDFAVDNLGNLYLLTSTDQLKKIDANGDSVAVYNNVKKFGKLTTVDVSNPLKVLLYYKDFSTIVVLDRLLNMRNTIDLRKHGIFRVSAVGQSYDGKVWLYDELDNKLKKIDEEGKLLLETPDFRQLFDVAPKPQKIFDQDGFIYLYDTARGFFVFDYYGSLKNRIPITGWDNVKVSGKYILGLSANKLQQYELTLLPCGNKNLQNIFFRTTIKIYRPTKFPPKKKVIRILYQQKLINFRTLGARQ

SEQ ID NO: 1853 - DNA, 582 bp, Unknown
  Obtained from environmental sample
  misc_feature (1)..(582): n is a, c, g, or t
gtgaatacagagttccttaaaaaactaaaacaaaaactccaggtcgggaacacccgttccattcatttaaattcgtaccccggcagacttgctgcaaggctagatctgcatgagctgaattccatcaaacaaaacctgccaaatgactttctgaaaaaactactgaacagccattcgtttgaatttaaatttaaaatagaacaaacaggtaacccggttcaatcccaaagttcagcctcggtaaattcccaaccgggagaacctgccccggaacatacaaatacatctgttcaggctttaccttctgaaaacaaggatgcagcacttaaacagaatcttatctcanaaagattatcttcaatttattatgaaaatgaagatacttatcttgagcatggaattaagactttcggcttcgggtatccaactctgatataccgaacaaaaagcgaccctgataaaattttaagcgcacctgtttttatctggatgctggagcttacccgcgataagaatgagtggataaatttcagagatgaagagcaggggatttcgataaatgatgttttgcttaatacttag

SEQ ID NO: 1854 - protein, 193 aa, Unknown
  Obtained from environmental sample
  misc_feature (1)..(193): Xaa is any amino acid
MNTEFLKKLKQKLQVGNTRSIHLNSYPGRLAARLDLHELNSIKQNLPNDFLKKLLNSHSFEFKFKIEQTGNPVQSQSSASVNSQPGEPAPEHTNTSVQALPSENKDAALKQNLISXRLSSIYYENEDTYLEHGIKTFGFGYPTLIYRTKSDPDKILSAPVFIWMLELTRDKNEWINFRDEEQGISINDVLLNT

SEQ ID NO: 1855 - DNA, 357 bp, Unknown
  Obtained from environmental sample
  misc_feature (1)..(357): n is a, c, g, or t
ttgtgcggacggttgagtttttttttttacaaaaatcgaaataaaattttctattcgctcttgtacattaattcttcaggaatgttcaatattaattggtcaaaatctccttttttgaagtggggaatcaaactaccaacatgtaaattttctattgattgttgtactcccgaggaacgaagtaatgcgaaaagaaattttgtgtttactatctcttctttagctctaattgccaacatatcttgtgcaatacaaaaaggtacaggatcaggaacccaacaaactctgccaggcgagcctttggtcacgaaaatcaaatctcctggttttggatgcgctctgaaccaattatcataa

SEQ ID NO: 1856 - protein, 118 aa, Unknown
  Obtained from environmental sample
  misc_feature (1)..(118): Xaa is any amino acid
MCGRLSFFFYKNRNKIFYSLLYINSSGMFNINWSKSPFLKWGIKLPTCKFSIDCCTPEERSNAKRNFVFTISSLALIANISCAIQKGTGSGTQQTLPGEPLVTKIKSPGFGCALNQLS

SEQ ID NO: 1857 - DNA, 441 bp, Unknown
  Obtained from environmental sample
  misc_feature (1)..(441): n is a, c, g, or t
atgaatactcataaaaatttaaataaaaatcccatactcaatcgcctggctcacaatcttttaaacgaagccattgatgcccttaattttgctgtcgattttttacaagagcatggacgcataaaaaatgaaaaaaaattaaagcttgcagtaattcagctccatcgatttatagaatatatattcaaatatctagtatctgaatataaccctcttctcgtattttctaatatcttcagagaaaaaataagcatagacaagagcaaaacaatctcattgcaggaagcaatcaatttctacatcaataacttggcatttggattaactaataatactagcacactagaaccgaaggatttgagaaacaaattgacacgtttactaaatatagaaataagattaactactgggntattgaagaccagagctagaaacatttga

SEQ ID NO: 1858 - protein, 146 aa, Unknown
  Obtained from environmental sample
  misc_feature (1)..(146): Xaa is any amino acid
MNTHKNLNKNPILNRLAHNLLNEAIDALNFAVDFLQEHGRIKNEKKLKLAVIQLHRFIEYIFKYLVSEYNPLLVFSNIFREKISIDKSKTISLQEAINFYINNLAFGLTNNTSTLEPKDLRNKLTRLLNIEIRLTTGXLKTRARNI

SEQ ID NO: 1859 - DNA, 837 bp, Unknown
  Obtained from environmental sample
  misc_feature (1)..(837): n is a, c, g, or t
gtgaagtctgatcgaagaagtattaaattatatcgggaaacagacgttacttctaagattcaatatttattagcaatagaatcagaaaattggactaaaaaagccgtaggtgattttctctttttacttgggcttattcctgattcttctttaggcatagaagaatcaaaaacacgcgctcgtttaaattttaatacaatcagcactgataaactatctgattttaatagaacaatatttgaaaggcttaaagaattacctttggaaaaagattccatacaacgcgatttaatttcttttctcaaagaatcaaacgaaattagaagcagaaaagagctcgttgaaaaaatatataccagttctcctggcttaaacttttctaattggccaatccccgatttaagtgtcaaaaatgtaaggttgaatgttgatgaactaagatcatctgagtttaaaaatattgatggggtaaaatgtttagttactcctagcggaaagattggcaaatttaaagtaagagtttctactatacctgaaattaaaaccattcgagaactttccttttttagggtaacattaatgtcttctaatggagcggctggagagtttgtgcaagaactcaaaaaaataaaaaattcatcaagtaaattagcctataaggatttaaatgtttctattgattccaatattatttcggaaggcacgtattttatcaaagttttagctgaagatgagaatagcgtagtcttaaactccgatgatttatttaaggatgatgaagttgaaaggcattggcacgaattaaaaagtaaagatccaaacgcaattaatctttaa

SEQ ID NO: 1860 - protein, 278 aa, Unknown
  Obtained from environmental sample
  misc_feature (1)..(278): Xaa is any amino acid
MKSDRRSIKLYRETDVTSKIQYLLAIESENWTKKAVGDFLFLLGLIPDSSLGIEESKTRARLNFNTISTDKLSDFNRTIFERLKELPLEKDSIQRDLISFLKESNEIRSRKELVEKIYTSSPGLNFSNWPIPDLSVKNVRLNVDELRSSEFKNIDGVKCLVTPSGKIGKFKVRVSTIPEIKTIRELSFFRVTLMSSNGAAGEFVQELKKIKNSSSKLAYKDLNVSIDSNIISEGTYFIKVLAEDENSVVLNSDDLFKDDEVERHWHELKSKDPNAINL

SEQ ID NO: 1861 - DNA, 450 bp, Unknown
  Obtained from environmental sample
  misc_feature (1)..(450): n is a, c, g, or t
ttggttctcgcagaacaatcaacgtcggttttcaaactttatctgcgtcaatctgaagatttcggggcccttgtaattacagggtggaggatgatgagtccaatcataagtcctctgaaaatccaactttacagcaaatttcggacgggcggcccggaaaaaagtttcctgaaaacccgaaccccgctaaactatgccgggccagactggccgtggatttcaatacattcgaaaagccttttctgccaatggaaaattcccctcaaagttcgaaacaaaggaatccccccgggtgtttccgaaatttccaaaaattccggcttctttggaaaaattaaagtcaacgcggcggcaaatttttgggaaaaaaacggaaccttggtttccgaaaaattccaaaaaaaccgggggaacttgaaggagggggaaatttttattcctcttttataa

SEQ ID NO: 1862 - protein, 149 aa, Unknown
  Obtained from environmental sample
  misc_feature (1)..(149): Xaa is any amino acid
MVLAEQSTSVFKLYLRQSEDFGALVITGWRMMSPIISPLKIQLYSKFRTGGPEKSFLKTRTPLNYAGPDWPWISIHSKSLFCQWKIPLKVRNKGIPPGVSEISKNSGFFGKIKVNAAANFWEKNGTLVSEKFQKNRGNLKEGEIFIPLL

SEQ ID NO: 1863 - DNA, 1149 bp, Unknown
  Obtained from environmental sample
  misc_feature (1)..(1149): n is a, c, g, or t
ttggaacttaccaatggaagggccgaaaaacaaaatgattatctttcttttatgaacaaggcttctccttttcaacaggcaatctggcgacggtttaagaaaaacaaaggtggagtttttggattggtgatgattgcagtttcggtacttattgccttgttttgttatttcatagctcctgattcttcgccgtatgctaatagaattattttagaaataggcggagaaaaaccaggcttcaaacagccttttttactcgttaaaagaccacaacggccaacaaatatttttcaacaggcactgaatggaaaaagagatcaggtggaatatattcccattcaaagctggagtgaaaaagcagatagctttattgtcgaaaaatatattgatgaagatgttactgaaaaaataagctttgcaaaatcttctttagcgtcaaaacctgttacaaccgaaaagttttttctgggcacagataaatttggccgtgatattttaagcaggttaataataggtacaagaataagtttgggggtaggattaataacagttcttatttcgctaacaatcggaattttattaggagccttagctggatattttaaagggaggacagacgatatggtaatgtggttaattaacatcatctggagcataccgactttattaattgtgttcgccatcacattaattttaggggaaggtttttggcaagtgtttatagcccttgggtttaactatgtgggtgaatgtggcagggctggttcgtggccaggtaatagcggcaaaagaactacatatggagaacgcgctaaagtgttaggtttctctgaatttagaatcctcttcaaaaaaattttcccaatatcatgggaccatttctgtaattggcccgtcaaatttgcatctgcaattggccgaacacaacctccggggccttttttggggagctgcaaccgcgcccaacttcaccccaaggctaattgggtttgtttttctgcccacaagaaaagaaccttttgcacccttgcccgggggcactctctacaaatgaagaaaattttgcgaaaattgggaaaaccgggggccttcctggcacaacaaaatcccttaaccctttacaacaaagggaggaccaatggggtttaa

SEQ ID NO: 1864 - protein, 382 aa, Unknown
  Obtained from environmental sample
  DOMAIN (173)...(357): Binding-protein-dependent transport system inner membrane component
  misc_feature (1)..(382): Xaa is any amino acid
MELTNGRAEKQNDYLSFMNKASPFQQAIWRRFKKNKGGVFGLVMIAVSVLIALFCYFIAPDSSPYANRIILEIGGEKPGFKQPFLLVKRPQRPTNIFQQALNGKRDQVEYIPIQSWSEKADSFIVEKYIDEDVTEKISFAKSSLASKPVTTEKFFLGTDKFGRDILSRLIIGTRISLGVGLITVLISLTIGILLGALAGYFKGRTDDMVMWLINIIWSIPTLLIVFAITLILGEGFWQVFIALGFNYVGECGRAGSWPGNSGKRTTYGERAKVLGFSEFRILFKKIFPISWDHFCNWPVKFASAIGRTQPPGPFLGSCNRAQLHPKANWVCFSAHKKRTFCTLARGHSLQMKKILRKLGKPGAFLAQQNPLTLYNKGRTNGV

SEQ ID NO: 1865 - DNA, 582 bp, Unknown
  Obtained from environmental sample
  misc_feature (1)..(582): n is a, c, g, or t
ttggaatcgaaatcgatccagaaagatgtgaaacaggaaggaatagaattgcaagagataccaagatcatttgaaggattaaaccaaaatcacatcaaacttttattacgagtaattaaatttcttacatctagaggatatagtgtaaatataacagaatattcagaatattttaaagagattaaacaaaaaatacaatatgattatgaagatccatatgctataagaattagggcattaactgatcttatagtttcagatcctaatgatttatcatattcttttttcttggacataaaaacttcgttcagtgaacatggtgcatttattgaagcatttccttggtcatgtaatcttacaagatctgaatattataacggtctaaaaactatatatatttatgaatgtattacacctgatgaaacaatactaaaatcatggtttgcagatactaaaaatattatatctagtgatgataaaataatatatagaaaatttagattgctacctgattttgctattgaacatataaaaaattatttacttaaatatcacaataacattataagttttccaatctaa

SEQ ID NO: 1866 - protein, 193 aa, Unknown
  Obtained from environmental sample
  misc_feature (1)..(193): Xaa is any amino acid
MESKSIQKDVKQEGIELQEIPRSFEGLNQNHIKLLLRVIKFLTSRGYSVNITEYSEYFKEIKQKIQYDYEDPYAIRIRALTDLIVSDPNDLSYSFFLDIKTSFSEHGAFIEAFPWSCNLTRSEYYNGLKTIYIYECITPDETILKSWFADTKNIISSDDKIIYRKFRLLPDFAIEHIKNYLLKYHNNIISFPI

SEQ ID NO: 1867 - DNA, 525 bp, Unknown
  Obtained from environmental sample
  misc_feature (1)..(525): n is a, c, g, or t
ttgttaagtccatcgggtgggcggtttgggtcctgcaaaagcacctttcctgaccttattggcaaaataggacatgccgaacttcgggtttattcctccatttatgatccgattttggaaaattttttctatggacaatccttcaattctggtcagaaccttgaacagatcatggctcaacagtatcaacttaaggggttgactcaatcagcccctcagatgttggctgaggttgataagtcctatatcaaggaagctcgtgcttggttaggtaagtcaggtagcattaaactaggcatgcccctaaagacttacgatgctacctcattcctaancctgcgagttcctgccaacttctcggctagttggacttcaacaggtcttgagacaaaggtagtcttccagaccaaaccagctatccgagtcaagatcgttgatcaattcatntcagggataaccctgacagacaattcagtcaagctcaatattgactggtttcctgatctaaccatcgaagggaaatag

SEQ ID NO: 1868 - protein, 174 aa, Unknown
  Obtained from environmental sample
  misc_feature (1)..(174): Xaa is any amino acid
MLSPSGGRFGSCKSTFPDLIGKIGHAELRVYSSIYDPILENFFYGQSFNSGQNLEQIMAQQYQLKGLTQSAPQMLAEVDKSYIKEARAWLGKSGSIKLGMPLKTYDATSFLXLRVPANFSASWTSTGLETKVVFQTKPAIRVKIVDQFXSGITLTDNSVKLNIDWFPDLTIEGK

SEQ ID NO: 1869 - DNA, 339 bp, Unknown
  Obtained from environmental sample
  misc_feature (1)..(339): n is a, c, g, or t
gtgtcttacctattaagagttttcaaattttctaaacaattattaagcatnttaggcattataagtgtgattttaataatgagttctataatttttagtacgaatatcaagacttcatttaacgatatactttcaggagatgctaatgagtatgcaagggaaacaactgctaaacttacaaagataaagtcatgtgataagaataaggaatgtgcggtgaatacctacaagaatgtacctgtaacaatctataatactgacgtaactcgcgatccaacaagcttcattaataaatgtgtagctacatattatggtcttaaagctatagtaagaaaataa

SEQ ID NO: 1870 - protein, 112 aa, Unknown
  Obtained from environmental sample
  misc_feature (1)..(112): Xaa is any amino acid
MSYLLRVFKFSKQLLSXLGIISVILIMSSIIFSTNIKTSFNDILSGDANEYARETTAKLTKIKSCDKNKECAVNTYKNVPVTIYNTDVTRDPTSFINKCVATYYGLKAIVRK

SEQ ID NO: 1871 - DNA, 972 bp, Unknown
  Obtained from environmental sample
  misc_feature (1)..(972): n is a, c, g, or t
ttgaatttctttaaagccatctgggaccaaactggtacaccccaaaatccggttgactggagcaatccagatcaatggattgaagagcgcctcgacggcaaggaaaaaatactaggcaagcgcatttgggaagagagtaacaagacagtaaacccaaggcatgtctatggttcctatttatttattaatacctacaaacttctcgcgattgaccaaagcgggatttaccgcattagtgataaaggcaaagactttttaaataatgagcctgccgttatgagcgaattggataaagcagaagggctacctaaactgcttgcaatattaacagctcattcaccggcaaaacgcggcgacctcatcgatgaatggggcgagttcctcctagcccattccaagtatggcaccccttcaacaattaaagatactcttcagcgccgcattctgaacctcgtggagcgagggtatatccaccgccaaggtaatacctacactattactgacaaaggcattgcatacgcagccgacacttcagtgccagagacacagcaaccttaccagcaggtgctcagcgcaattaagcaatacaacgacgcccagactcaagcccttcgtaaacagctaggcaagatgaatccttacagcttcgagttactgatcaaggacttattggaggctatggactatgaggatgtagttgtgaccaagcagagcggagacaaagggattgacgttgtcgcacactttcaattcggcatcacccagattaaggaggtggtccaggtcaagcgccatcaaggctctattactcgccccgtgctcgacaattacgtggtgcactaccttacatcaggctattcggggaaacatcatcacacttggaaaattcgctcaggttgcaaagaacgcgcactattccccggactgcccaatcacttaaatgatggtgataactcatggattactacttaa

SEQ ID NO: 1872 - protein, 323 aa, Unknown
  Obtained from environmental sample
  misc_feature (1)..(323): Xaa is any amino acid
MNFFKAIWDQTGTPQNPVDWSNPDQWIEERLDGKEKILGKRIWEESNKTVNPRHVYGSYLFINTYKLLAIDQSGIYRISDKGKDFLNNEPAVMSELDKAEGLPKLLAILTAHSPAKRGDLIDEWGEFLLAHSKYGTPSTIKDTLQRRILNLVERGYIHRQGNTYTITDKGIAYAADTSVPETQQPYQQVLSAIKQYNDAQTQALRKQLGKMNPYSFELLIKDLLEAMDYEDVVVTKQSGDKGIDVVAHFQFGITQIKEVVQVKRHQGSITRPVLDNYVVHYLTSGYSGKHHHTWKIRSGCKERALFPGLPNHLNDGDNSWITT

SEQ ID NO: 1873 - DNA, 678 bp, Unknown
  Obtained from environmental sample
  misc_feature (1)..(678): n is a, c, g, or t
atgcggaaattattacaacggcttttacgaaagcctgtgctttggctaacttataaattttcctcaagcccggataaagaaagaatatttaaagccctctctgatttattaaaatgcatcctcgatagcgaaaagaaaaaaggcctggtaattccttttgatattgcaacaggtaaattgatcattttttccgaccaacataagggtgcccgtaatggtgcagatgattttttgatatgcgaacaaaactatcttgaagcgttagaatattattatcaaaatggttttcattttattgacctgggcgattgcgaagagttatgggaaaacatggttatttctgtgaaaaaagaacaaaagcccgctttcgaaaaagagaaaaaatttattccaaacaacactttaataaaaatttttggcaaccatgatctctattggaagaacgatccttttgcgccattcatgctcaaagaaatttatggtacacagttgcccatccatgaaggcgtggtattacaaactgaaataaatggaaagcaattaaatattttttgtacgcacggccaccagggtgatgctgttagtgatggcaactggttcagtaaattttttgtttccaaagtatgggggaccacttcannntctattgaagatcaatccnaatactccctgctatga

SEQ ID NO: 1874 - protein, 225 aa, Unknown
  Obtained from environmental sample
  misc_feature (1)..(225): Xaa is any amino acid
MRKLLQRLLRKPVLWLTYKFSSSPDKERIFKALSDLLKCILDSEKKKGLVIPFDIATGKLIIFSDQHKGARNGADDFLICEQNYLEALEYYYQNGFHFIDLGDCEELWENMVISVKKEQKPAFEKEKKFIPNNTLIKIFGNHDLYWKNDPFAPFMLKEIYGTQLPIHEGVVLQTEINGKQLNIFCTHGHQGDAVSDGNWFSKFFVSKVWGTTSXSIEDQSXYSLL

SEQ ID NO: 1875 - DNA, 648 bp, Unknown
  Obtained from environmental sample
  misc_feature (1)..(648): n is a, c, g, or t
atgattagtaccagcatatcgtctttttcccagaacagttatggttttttcggaggccctcaaatgacaacagcaaaatataaagtgatggaggaaaagcagcctaccgaatttaaaccaggatttcaactaggtgcgacaatgaagataccttttgataaccaattgtactttggtcctgctgtttattatagcatgaagggatacaaagtaacattaaacaatccttcattcccaccaactcaaaaagcaataaataacgaaactactattcacacattagaaattgcccccttacttcacctggattttaataaacaaccctctcatttttttgtaaagtttggtcccgccattgaccttgctattacgggaagagaaaaatttgataccattggtggtacaacgccggttgaacgttccatgaaatttgccttttcagaatacggccgcataacagcacaagccatttttcatttaggcttcgaaagcagcaaaggttattttgtttttgctcattatgccgaaggtttggggggattgaacaatgcagacaatggtcccactattaaacaccgtatcgttggtctttcgtttggctggtttttcgggaatagaaatgggaacgatacgagagtgaagaaatag

SEQ ID NO: 1876 - protein, 215 aa, Unknown
  Obtained from environmental sample
  misc_feature (1)..(215): Xaa is any amino acid
MISTSISSFSQNSYGFFGGPQMTTAKYKVMEEKQPTEFKPGFQLGATMKIPFDNQLYFGPAVYYSMKGYKVTLNNPSFPPTQKAINNETTIHTLEIAPLLHLDFNKQPSHFFVKFGPAIDLAITGREKFDTIGGTTPVERSMKFAFSEYGRITAQAIFHLGFESSKGYFVFAHYAEGLGGLNNADNGPTIKHRIVGLSFGWFFGNRNGNDTRVKK

SEQ ID NO: 1877 - DNA, 531 bp, Unknown
  Obtained from environmental sample
  misc_feature (1)..(531): n is a, c, g, or t
ttgtttttttctattgtaccaacttttcgtacacccaataacgaatttgattttaatagaatcactaaacagatagatttctacattctcaaaataaataaagttttatcaaaattaagtttctttaccccaatatcgtatcaatataatattatgatagcattatttgccataatgccaatcaatacgggtattacgtattgtttattatgtcacgtcattacatcctttcgatatatgaattttgattactattttcttactatttcaggactgcttggaggattgatggccaccgtttgcatgaccatcttcgaaattccgttttggaaaaagtggggattaaagggaattttaaaatggcatgaaaaccagaaactgtatagcaaactgactaataatattaacccagataggttaaaactccttgggaatttttcttataacactttaataaagggagtacctaggcggaatgggctttttcccttttggttgaaacccggaatcctttttaaaaatttccaataa

SEQ ID NO: 1878 - protein, 176 aa, Unknown
  Obtained from environmental sample
  misc_feature (1)..(176): Xaa is any amino acid
MFFSIVPTFRTPNNEFDFNRITKQIDFYILKINKVLSKLSFFTPISYQYNIMIALFAIMPINTGITYCLLCHVITSFRYMNFDYYFLTISGLLGGLMATVCMTIFEIPFWKKWGLKGILKWHENQKLYSKLTNNINPDRLKLLGNFSYNTLIKGVPRRNGLFPFWLKPGILFKNFQ

SEQ ID NO: 1879 - DNA, 477 bp, Unknown
  Obtained from environmental sample
  misc_feature (1)..(477): n is a, c, g, or t
atggcagaaaaagttttaaaaaaatcggaaacggaagaaattatccgcaacaaccagcagtatacattgttctcatggagcaagcaaaaaggcaccaatcctattgcggttaaatatggtgaaggagtttatttatatgattatgatggcaggcgatacatcgatttttcttctggattaatgaatgtgaacattgggcacggcgatcaacgaattactgccgcagtagtaaaacaaatgcaggaagtgagttatgttacgccaagttgtgtaacaaaagtccgcggagagttgggaaaaaaattagcccaaatttgccctggtgatctgaacaaggctttctttactgtatgtggcgcctcctcgatagaaaatgcaataaagcttgcaagactttatacaggtcggcataaaagttttatcccgttatcagtcatatcatggcgcctctattggcgctatttctacaagtggtga

SEQ ID NO: 1880 - protein, 158 aa, Unknown
  Obtained from environmental sample
  misc_feature (1)..(158): Xaa is any amino acid
MAEKVLKKSETEEIIRNNQQYTLFSWSKQKGTNPIAVKYGEGVYLYDYDGRRYIDFSSGLMNVNIGHGDQRITAAVVKQMQEVSYVTPSCVTKVRGELGKKLAQICPGDLNKAFFTVCGASSIENAIKLARLYTGRHKSFIPLSVISWRLYWRYFYKW

SEQ ID NO: 1881 - DNA, 645 bp, Unknown
  Obtained from environmental sample
  misc_feature (1)..(645): n is a, c, g, or t
gtgcgacccagttatgttatttacatgaatttaaacaaagatctgcatccccctcaaataccggtgtttacttttatttatggttgtgcaatcggtattgaaaaattgttatataaggaattagaagttatttctcaactggccgaaatactacaatctgaattcccacaggcaaaattaatggtccggccatatccaaattacaaatcctgggaagtttataacagcctgctgaaacatgataatatcctcctggacaataatttcagggagggagatcaatcagtgaaggattccgaaatattgaaaaaatttgagaccatccaaaacgcaaaagcgttttttcatcttgggacaacgttgggcctcgaggcatgttttactgattgcccaagttttatcctggatctggattaccagcgcaattcaaaatttaacctgaacacctttgtatatcaatttcaaaacaagaaatacattatcgaccagagcccgcttaacacaattaaatctgaatttcaattaagggaaattatttcagatcaggaccagtcgaagtatttaaaatttaaccaactgatccgttctcagtatcctcttaaatcgttccgtgagatcgctgaccagatctctacatttgcctga

SEQ ID NO: 1882 - protein, 214 aa, Unknown
  Obtained from environmental sample
  misc_feature (1)..(214): Xaa is any amino acid
MRPSYVIYMNLNKDLHPPQIPVFTFIYGCAIGIEKLLYKELEVISQLAEILQSEFPQAKLMVRPYPNYKSWEVYNSLLKHDNILLDNNFREGDQSVKDSEILKKFETIQNAKAFFHLGTTLGLEACFTDCPSFILDLDYQRNSKFNLNTFVYQFQNKKYIIDQSPLNTIKSEFQLREIISDQDQSKYLKFNQLIRSQYPLKSFREIADQISTFA

SEQ ID NO: 1883 - DNA, 888 bp, Unknown
  Obtained from environmental sample
  misc_feature (1)..(888): n is a, c, g, or t
ttgatcaaaattattgaagataatattaaacatagcgccaaaagcgtaaagcaggtgctggattttgttaaaggtaatagtaatagaacaacctcaataaatattaagagtctatttaatgaattgacccatgtgctatcccatattttaccagcggccatcacagtacaaacctttacttcaaaagatctctggatcactgtgggaaatgctacccaactctatcaagtgctgctcaatctctgtatcaatgctcgtgatgcaatgggcgataatggtcggctaattttaaaagcagaaaatatgctgttagataaacgctccgcagagatgcaggtcgatgctacacctgggccttttgtgctgattactgtatctgatagcggtaaaggtattcctgtcgaaattaaaaataagatctttgatctattttttaccaccaaagaagagcagggcaccggcttaggcctgcctacttctttagccattgtaaagaatcatcatggttttattaatgtctccagtgaagtcggtgtcggtacaacatttaaaatttatctacctgcagaatttagtcttgaacagctaaaagccataaatcgggaactacctgtaggtcatgaagaacagattctcattgttgatgatgaagcctattttcgcgagattaccaaagcgacattagaaatttataattataaagtgtctgttgctggcgatagcaatgatgcggtattaaaactgaccaaagatattaaaaagattcaattgcaatcacgtcgattgctgctgtcctctccttggctatttcctggagtgtccatgcgcttttcacaggcactgcagatggggaagatctggtcatcgccttcgtggcgccactggtaa

SEQ ID NO: 1884 - protein, 295 aa, Unknown
  Obtained from environmental sample
  DOMAIN (69)...(190): Histidine kinase-, DNA gyrase B-, and HSP90-like ATPase
  misc_feature (1)..(295): Xaa is any amino acid
MIKIIEDNIKHSAKSVKQVLDFVKGNSNRTTSINIKSLFNELTHVLSHILPAAITVQTFTSKDLWITVGNATQLYQVLLNLCINARDAMGDNGRLILKAENMLLDKRSAEMQVDATPGPFVLITVSDSGKGIPVEIKNKIFDLFFTTKEEQGTGLGLPTSLAIVKNHHGFINVSSEVGVGTTFKIYLPAEFSLEQLKAINRELPVGHEEQILIVDDEAYFREITKATLEIYNYKVSVAGDSNDAVLKLTKDIKKIQLQSRRLLLSSPWLFPGVSMRFSQALQMGKIWSSPSWRHW

SEQ ID NO: 1885 - DNA, 546 bp, Unknown
  Obtained from environmental sample
  misc_feature (1)..(546): n is a, c, g, or t
ttggtagcttcgggccatatcgatgaatcggtaaagtacctgaaatctttttctgggttattaagaagcattttagagcaaaaccgtaaagattttattgaaatcgaagaagaaatcgcttccttaaataattatatccagcttcagcaaatgcgctatgctggtgcattcgattataaaataactgttgataatgacctggatttaaacgaaaccttgattccgccgatgctaatacagccttttgtagaaaatgcaatagaacatggtttcagaaacatttcacacaaaggttttttgaacatcgcttttaaaacaaaagataattgtttgttaattgaggtagatgataacggtagtggcctcactgcgaaagttgccgataaacaaaaaaagaaatcacttgcacaaattattataaaggaaagattcgatttgctttttacttctaaaggacagcttgcacactttaaggtagaagataaaaaagagttagcagaaaagggtgttttggtaaaaatcctgatcccaatcattaatgactaa

SEQ ID NO: 1886 - protein, 181 aa, Unknown
  Obtained from environmental sample
  DOMAIN (1)...(62): Histidine kinase
  misc_feature (1)..(181): Xaa is any amino acid
MVASGHIDESVKYLKSFSGLLRSILEQNRKDFIEIEEEIASLNNYIQLQQMRYAGAFDYKITVDNDLDLNETLIPPMLIQPFVENAIEHGFRNISHKGFLNIAFKTKDNCLLIEVDDNGSGLTAKVADKQKKKSLAQIIIKERFDLLFTSKGQLAHFKVEDKKELAEKGVLVKILIPIIND

SEQ ID NO: 1887 - DNA, 468 bp, Unknown
  Obtained from environmental sample
  misc_feature (1)..(468): n is a, c, g, or t
ttgataccgttgatgattaataacatcatcaacaacaaacctctgccggtttatgggaaaggagaaaatgttcgtgattggttatatgtggaagatcacgcgaaagcgattgatgcaatttttcacaagggaaaaactggagagatttataacattggtggcaacaacgaatggaaaaacattgaccttgtaaagttgatgtgccacatcatggataaaaaattggggagagaagaagggacttctgcatcgttaattacatatgtgaaagacagacccggccatgatatgcggtatgcgattgatgcatcaaaagtaattagcgaagttggttggaggcctgaagtttcgttcgaagagggcatagaaaaaactatcgattggttcttggcaaatcaggagtggctaaaacatgtaacttcgggagcgtacctgaagtactatgacaacatgtacgtaaatcgttaa

SEQ ID NO: 1888 - protein, 155 aa, Unknown
  Obtained from environmental sample
  DOMAIN (1)...(133): NAD dependent epimerase/dehydratase family
  misc_feature (1)..(155): Xaa is any amino acid
MIPLMINNIINNKPLPVYGKGENVRDWLYVEDHAKAIDAIFHKGKTGEIYNIGGNNEWKNIDLVKLMCHIMDKKLGREEGTSASLITYVKDRPGHDMRYAIDASKVISEVGWRPEVSFEEGIEKTIDWFLANQEWLKHVTSGAYLKYYDNMYVNR

SEQ ID NO: 1889 - DNA, 468 bp, Unknown; identical to SEQ ID NO: 1887
  Obtained from environmental sample
  misc_feature (1)..(468): n is a, c, g, or t

SEQ ID NO: 1890 - protein, 155 aa, Unknown; identical to SEQ ID NO: 1888
  Obtained from environmental sample
  DOMAIN (1)...(133): NAD dependent epimerase/dehydratase family
  misc_feature (1)..(155): Xaa is any amino acid

SEQ ID NO: 1891 - DNA, 411 bp, Unknown
  Obtained from environmental sample
  misc_feature (1)..(411): n is a, c, g, or t
atgaagactgttcagtttgccgccaagttcgaaaatctcgatgagatccgggagttcgtcgggaacattgcccgccagggcggctttagtgataaggatgtgtataacattcagcttgccacggatgaagctgcctcgaatatcatcgagcatgcctatcaaaacatgcccgataaagtcctggatttatcctgtgggatcaagggcgatgttattacaattacgttgatagattatggcgaatccttcgacccctctgaagtgcctgtgcctgacctgaaggctgatctctctgaccgcaagatcggaggcctgggcattttcctgatgcgcaaattgatggatgaaattgattacaggccgggacccaacaagagtaacgtcctgacaatgatgaaacgtaagaggtaa

SEQ ID NO: 1892 - protein, 136 aa, Unknown
  Obtained from environmental sample
  misc_feature (1)..(136): Xaa is any amino acid
MKTVQFAAKFENLDEIREFVGNIARQGGFSDKDVYNIQLATDEAASNIIEHAYQNMPDKVLDLSCGIKGDVITITLIDYGESFDPSEVPVPDLKADLSDRKIGGLGIFLMRKLMDEIDYRPGPNKSNVLTMMKRKR

SEQ ID NO: 1893 - DNA, 678 bp, Unknown
  Obtained from environmental sample
  misc_feature (1)..(678): n is a, c, g, or t
gtgacctatgatgaagcggaaaaaaaggtcatcctgtttgagagtggaacgggatataagttcgaccttacttcgggagctatgactgtattcgctgaagacatcaaacttgaaaacgtaacgaaaacaactccactcttggcagaatatcgtcagggcggatacgtgctttatacggatcaacacatttcattacttgacaaaaaaggaaaactggtttacacaaaggattaccctcagctctcctcaaccaacctgacaagtcttgctcaatttggtgcggatatagcaggtgtcgatatcgatatagcgggttctattgaaaacatgcagcaacttgacagactatcgaagggagcctatcgcaattccaatgctgcaagtcaggggacatcccaaacccacgtggtggctgcagcttctcttggtggatctccgcttttcgaagtgacaaagacgcgttattctaattccagaaacgcccgcgaccataaattcattatgaccaaagaagatgagaccaaacgtgtcatcgtaatggtcaataaggatacaggaaaagtagataagaggatcaatattgttgatatcactcctctgtatgttgttgacgaaattgattcaagggtctttattgttgagcgcaataagaccattaccggttatgacatgaaataa

SEQ ID NO: 1894 - protein, 225 aa, Unknown
  Obtained from environmental sample
  misc_feature (1)..(225): Xaa is any amino acid
MTYDEAEKKVILFESGTGYKFDLTSGAMTVFAEDIKLENVTKTTPLLAEYRQGGYVLYTDQHISLLDKKGKLVYTKDYPQLSSTNLTSLAQFGADIAGVDIDIAGSIENMQQLDRLSKGAYRNSNAASQGTSQTHVVAAASLGGSPLFEVTKTRYSNSRNARDHKFIMTKEDETKRVIVMVNKDTGKVDKRINIVDITPLYVVDEIDSRVFIVERNKTITGYDMK

SEQ ID NO: 1895 - DNA, 300 bp, Unknown
  Obtained from environmental sample
  misc_feature (1)..(300): n is a, c, g, or t
atgtatcttgagaaaggcgaagagtttgctgtagtgaaagataccacccataataacaacaacaataataataacagcaacgattgtgacaaaacagtattggccaatgtgtattatgataacgataaatacaatattaaacctgaatacaccccggatcttgaaaaaatccttcgttttataaaaaccaatccatcggccgttgtaggaatctatagccataccgatagcaatggtgatcgtagcacaaaccatgattctttcaggaaacagatcgaaatcagtaaaatcattggttaa

SEQ ID NO: 1896 - protein, 99 aa, Unknown
  Obtained from environmental sample
  misc_feature (1)..(99): Xaa is any amino acid
MYLEKGEEFAVVKDTTHNNNNNNNNSNDCDKTVLANVYYDNDKYNIKPEYTPDLEKILRFIKTNPSAVVGIYSHTDSNGDRSTNHDSFRKQIEISKIIG

SEQ ID NO: 1897 - DNA, 651 bp, Unknown
  Obtained from environmental sample
  misc_feature (1)..(651): n is a, c, g, or t
atggaaccttttgcttcaaaatatcggccgaataatttagacgaatttattggacaagaacatttagttggtcaaggcatgccgattagaaaatttatcgagacaaacaatataccttcaatgatttattggggacctccaggaacaggaaagacttctctagcttatattatttcaaaatcagtaaatgctgaattttataaactatcagcagtaatgagcggtaaagcaaaattacttgaagtcgtaaaaaaagctatgcagtcacaaaaagaaaactctttattaggctattcaaaaacaattttatttctagatgaaatacatagatggaataaatctcaacaagacactctacttccatatgttgaaaaaggagtaattattttaattggagcaactacggaaaacccatcatttagtttagtccctgcacttctttctcgagttagagtatttacatttagtaaacactctacagaagatgtaaaaaaatatttagagaagctagttgagaatattaaaaaagaacagaagattgaagttgattctgaaactttagaaataatagcaaggtcatcagatggagacttaaggacctctgcaaatatttggaagctgcttattatgcaactgacggcaaaattataa

SEQ ID NO: 1898 - protein, 216 aa, Unknown
  Obtained from environmental sample
  DOMAIN (40)...(211): ATPase family associated with various cellular activities (AAA)
  misc_feature (1)..(216): Xaa is any amino acid
MEPFASKYRPNNLDEFIGQEHLVGQGMPIRKFIETNNIPSMIYWGPPGTGKTSLAYIISKSVNAEFYKLSAVMSGKAKLLEVVKKAMQSQKENSLLGYSKTILFLDEIHRWNKSQQDTLLPYVEKGVIILIGATTENPSFSLVPALLSRVRVFTFSKHSTEDVKKYLEKLVENIKKEQKIEVDSETLEIIARSSDGDLRTSANIWKLLIMQLTAKL

SEQ ID NO: 1899 - DNA, 834 bp, Unknown
  Obtained from environmental sample
  misc_feature (1)..(834): n is a, c, g, or t
ttgcttcaaaaacattttggccagtcgcgggaattgctggtataccttatatatttttttacagagatagcagcgtatgcagaaaaagatgcgcaccagagatcatcgaaacatttacctactgcagatgatttgaatgtgaatattaagattgccggaaatgaagttatctggaaaataaaagaagacgctacctaccagacagaagtgaaaaaagaaagaccggaacaatatattgataaagacctggtgcgaaaattttatcatctttttgttgaaactgcggagtataagaaatatgcatccactccttcccgcacttttaaagaagaaagggagattgtcaattttctttttgaaggtgtattgcttccaaatgaattatttatcagccaccttgaagaaaattttataaactgggatgacgatgccgatatgatcttaaatctttttaagggctatttgaacaaacctgcttcactgaattttaaagagatggtggcacccgataaatgggaatttgcaaaaaatttgctgcattcggtgctcgaaaaatcagaacatcttgaatctttgatcataccgcggttaaaaaactgggatgcagaacgtattgccttgctcgatatgatcattatgaaaatgggcgtgtccgagtttctttatttcgaaaccataccacccaaagtaaccattaacgagtacattgatattgccaaggaatacagcacccagcaaagcggccagtttgttaacggcatactggataacatacacaaagacctgcagcagcagggaaaattgcacaaaatagatttagaaaagccgaaatga

SEQ ID NO: 1900 - protein, 277 aa, Unknown
  Obtained from environmental sample
  DOMAIN (109)...(262): NusB family
  misc_feature (1)..(277): Xaa is any amino acid
MLQKHFGQSRELLVYLIYFFTEIAAYAEKDAHQRSSKHLPTADDLNVNIKIAGNEVIWKIKEDATYQTEVKKERPEQYIDKDLVRKFYHLFVETAEYKKYASTPSRTFKEEREIVNFLFEGVLLPNELFISHLEENFINWDDDADMILNLFKGYLNKPASLNFKEMVAPDKWEFAKNLLHSVLEKSEHLESLIIPRLKNWDAERIALLDMIIMKMGVSEFLYFETIPPKVTINEYIDIAKEYSTQQSGQFVNGILDNIHKDLQQQGKLHKIDLEKPK

SEQ ID NO: 1901 - DNA, 450 bp, Unknown
  Obtained from environmental sample
  misc_feature (1)..(450): n is a, c, g, or t
atggatcaggctatagaaaagcagatcattgaatctggggaatctgtgaagcacaacttcgctttattaaacaccgttatcggtgtaggaaaagttgtagccactgcaactatcattaaaaccaaaaactttacttccttcaaaaatggaaggaagttctcctgttattgtggatcagcaccctttgaacacagctccgggaaatcgatccgaaaaagaaccaggattagtcacctggcggataaatcaatgaaaaccttgttaactcaatcagctaagactgctatccttcatgacaaagaacttaaacagtattaccaaagacgaacagaaatgggaaaatcaaaaaaaagcaccatcaacgtcgtccgaaataaaattattcatcggatgtttgctgttattaaacgccaaacaccatttgtcaaacaatatctaaaaaccgcctaa

SEQ ID NO: 1902 - protein, 149 aa, Unknown
  Obtained from environmental sample
  DOMAIN (1)...(106): Transposase IS116/IS110/IS902 family
  misc_feature (1)..(149): Xaa is any amino acid
MDQAIEKQIIESGESVKHNFALLNTVIGVGKVVATATIIKTKNFTSFKNGRKFSCYCGSAPFEHSSGKSIRKRTRISHLADKSMKTLLTQSAKTAILHDKELKQYYQRRTEMGKSKKSTINVVRNKIIHRMFAVIKRQTPFVKQYLKTA

SEQ ID NO: 1903 - DNA, 606 bp, Unknown
  Obtained from environmental sample
  misc_feature (1)..(606): n is a, c, g, or t
gtggtcagaatggctgaccatacgatgtggaaagctataacaagaaacaatctttatacaccgaaggaaagcggccacngctttttattttacctggtaaatggtaaagtaaaaacgtttaaaacacacgaagatggaaaagaatacataacagatcttttcagccccggagattttattggttatatagcgttgatagaagataaaaattatgatgataatgccactgttttagaagatgctgaaatcatgcaaataccaaaagaagattttctgcagatgatttatagcgatattaatattgccaataaattcattcatatagttacacaaaatgtgaagcaaaaagaagaacgtttaataaacctggcctatagttctttgcgtaaaagggtggcaaaggctttggttgaagtaagctccaaattcaaagttcaaaatagcccactggaaatttcccgtgatgatgtggctcaatatattggtacagctacggagtcactcatccgtacattaagcgattttaaagatgaaaaattaatagaaataaaaagcggcaaaataatagttaccaatattgagaaattgaaaaacctgctttattaa

SEQ ID NO: 1904 - protein, 201 aa, Unknown
  Obtained from environmental sample
  DOMAIN (7)...(100): Cyclic nucleotide-binding domain
  misc_feature (1)..(201): Xaa is any amino acid
MVRMADHTMWKAITRNNLYTPKESGHXFLFYLVNGKVKTFKTHEDGKEYITDLFSPGDFIGYIALIEDKNYDDNATVLEDAEIMQIPKEDFLQMIYSDINIANKFIHIVTQNVKQKEERLINLAYSSLRKRVAKALVEVSSKFKVQNSPLEISRDDVAQYIGTATESLIRTLSDFKDEKLIEIKSGKIIVTNIEKLKNLLY

SEQ ID NO: 1905 - DNA, 831 bp, Unknown
  Obtained from environmental sample
  misc_feature (1)..(831): n is a, c, g, or t
ttgcagacggtgcaaaagatactgtccttcgtgcattatcggaaggaaaaatttcctctaaaccgcaatcgtcttcatagccacaagggattacttatgacgatgtttgataaagataagataaaagcaaaacttgatgaaacgaaagcgcgtttttcaaaatcacatttaaaagaaaacttagataaagtcaaaaagcaatttaaaaaaatgaagttcaataccagtgattcaattattggtgtacaaacatcccccgttgctcattggattgtatgggcaaccttaattttctttgtggtaattattttatgggcgaaatttgcaacactagaagaagtgaccatctctgaagcaactgtaaaacctcttacaaatattcaaagtattcaaaatatggaagggggtattattaaaaagatttatgtgaaagaaaatgatattgtaaggccaggtcaattattactcgaactcgatcccattagattttcttcttcttttgaagaagcaaatagtaattatgcagcgttaagcataaaaatttcgcgtttaactgctgaaattcaaaataaaccttttgtggttgatcagagtctacgtaacagatttccgagtttagtcgcaagtgaaatggacctttatacactacgtcaacaacaagaaagagatatgaaacgtaatcttgaactcgccgagaaagaatacaaattaactaaacctttagtaaggcaaggagctgcatcggaggtagatgttattcatttagaacggcaagtagtgggcttgcaagctcaattaaatgaatttaacgcccaagcagttactgagtaa

SEQ ID NO: 1906 - protein, 276 aa, Unknown
  Obtained from environmental sample
  misc_feature (1)..(276): Xaa is any amino acid
MQTVQKILSFVHYRKEKFPLNRNRLHSHKGLLMTMFDKDKIKAKLDETKARFSKSHLKENLDKVKKQFKKMKFNTSDSIIGVQTSPVAHWIVWATLIFFVVIILWAKFATLEEVTISEATVKPLTNIQSIQNMEGGIIKKIYVKENDIVRPGQLLLELDPIRFSSSFEEANSNYAALSIKISRLTAEIQNKPFVVDQSLRNRFPSLVASEMDLYTLRQQQERDMKRNLELAEKEYKLTKPLVRQGAASEVDVIHLERQVVGLQAQLNEFNAQAVTE

SEQ ID NO: 1907 - DNA, 357 bp, Unknown
  Obtained from environmental sample
  misc_feature (1)..(357): n is a, c, g, or t
ttgataacggtcatattattgcagacggtgcaaaagatactgtccttcgtgcattatcggaaggaaaaatttcctctaaaccgcaatcgtcttcatagccacaagggattacttatgacgatgtttgataaagataagataaaagcaaaacttgatgaaacgaaagcgcgtttttcaaaatcacatttaaaagaaaacttagataaagtcaaaaagcaatttaaaaaaatgaagtttcataccagtgattcaattattggtgtacaaacatccccccgttgctcatttgaattgtatgggcaacctttaatttttcttggggaaattatttttatgggcgaaatttgcaacaactag

SEQ ID NO: 1908 - protein, 118 aa, Unknown
  Obtained from environmental sample
  misc_feature (1)..(118): Xaa is any amino acid
MITVILLQTVQKILSFVHYRKEKFPLNRNRLHSHKGLLMTMFDKDKIKAKLDETKARFSKSHLKENLDKVKKQFKKMKFHTSDSIIGVQTSPRCSFELYGQPLIFLGEIIFMGEICNN

SEQ ID NO: 1909 - DNA, 780 bp, Unknown
  Obtained from environmental sample
  misc_feature (1)..(780): n is a, c, g, or t
ttgcactatgagagaattgaacaggataatttcctgtttaatgaattactcggattgttagagaatggagtgttttccgatacctatgttaccagtaggcgtgaagagcttgatacaagcggaacagaagcggttgtaaatgaagattccggcgttcagttcaaaataaataaaccattaccttatcacgagtttttaaagcgcattagccgtcaaaccaacttgtccattcagttgcttcatgccgtgttatctgcatacgctaagtcaaataatattttaactgaaaagatcaatgaacacagtgcatccaactttgttaggttgttttatgagtggaaggtagttaagctaagcggtagattcagctattcgaaggcaaatttaccattgaaatcaaccgccttaacttactcagatggcacgccaaagccagaaataacacaaggattaatcggtactaagtttatcgaaggcacaccctctcaaaaatatttatatgatgtgtatgcttttgattctccattggaaaaggaaaatattttagtagatggaatacaagaaataattgtttatggaaaaatcccaaaaagcagtattgctatccctacaataaccgggcagtcctacagtcctgattttatgtatgtggtaaagaaagataatggtgataagattcttaatgtaatagtggaaacaaaagacgtggagaatcaaacttcattaaggggtattgagaaagcaaagattgattgtgccagggtattttcaatcagctaa

SEQ ID NO: 1910 - protein, 259 aa, Unknown
  Obtained from environmental sample
  misc_feature (1)..(259): Xaa is any amino acid
MHYERIEQDNFLFNELLGLLENGVFSDTYVTSRREELDTSGTEAVVNEDSGVQFKINKPLPYHEFLKRISRQTNLSIQLLHAVLSAYAKSNNILTEKINEHSASNFVRLFYEWKVVKLSGRFSYSKANLPLKSTALTYSDGTPKPEITQGLIGTKFIEGTPSQKYLYDVYAFDSPLEKENILVDGIQEIIVYGKIPKSSIAIPTITGQSYSPDFMYVVKKDNGDKILNVIVETKDVENQTSLRGIEKAKIDCARVFSIS

SEQ ID NO: 1911 - DNA, 873 bp, Unknown
  Obtained from environmental sample
  misc_feature (1)..(873): n is a, c, g, or t
gtgtttcctctgatgtgccggagaggaagttgctggcgttggggcacaaagaaatttttaaagaatggtgactcaaacacgatgattagcaatgttgttggaaggataaagtctactggagaatatggagtatatgaaaaatataggaaaggaacatataaggcaaaaactatatggtttgatgatatagaaattagtgatgatgatgaaaatgatgaagatgagatttgggatgaaaccggagttattaccgaacagggatcttcagaattaagaaagtatgaaatgggtgatgtttttgactttccaaagccaacttttttattaaaaaaggtgctaagcttaggtgctaatttagattcagtttgtttagatttcttttctggctctggttcctttgccgaggctgtattaagcttaaattcttcacatgggaaaagaaagttcatttccatacagttaccagaaaatttagattataaactggctgcagcaccgtcgagtgataaagcaaaaattcaaaaagtaatagactttttagatgtcaatgaatatccccataccttagattatgttgggatagagcgcatcaaacgtgctgctttaaaaatcaaacaggagcatccggataaagagcttgatttaggttttaagcatttcatactcgttgagccaaatcaaaatacattagacaagctggagaattttgataagtcagccttaatagttgatagcagtattattgatgacttcggcaaacccactattctcacaacatggctcaataccgatgggtatggccttacagcaaaagcagaaagcattgatctggcgggttacactgcctggtattttcaaagcacctgtatttaa

SEQ ID NO: 1912 - protein, 290 aa, Unknown
  Obtained from environmental sample
  DOMAIN (1)...(168): DNA methylase
  misc_feature (1)..(290): Xaa is any amino acid
MFPLMCRRGSCWRWGTKKFLKNGDSNTMISNVVGRIKSTGEYGVYEKYRKGTYKAKTIWFDDIEISDDDENDEDEIWDETGVITEQGSSELRKYEMGDVFDFPKPTFLLKKVLSLGANLDSVCLDFFSGSGSFAEAVLSLNSSHGKRKFISIQLPENLDYKLAAAPSSDKAKIQKVIDFLDVNEYPHTLDYVGIERIKRAALKIKQEHPDKELDLGFKHFILVEPNQNTLDKLENFDKSALIVDSSIIDDFGKPTILTTWLNTDGYGLTAKAESIDLAGYTAWYFQSTCI

SEQ ID NO: 1913 - DNA, 954 bp, Unknown
  Obtained from environmental sample
  misc_feature (1)..(954): n is a, c, g, or t
ttgagttgcctacataaagagactcaaatactcaatcagggcgatctagcttttatatacgaaggcagagtatatgtaattgtgtttaacgcaaattatcattatattaaggtcgtctgcagcaatgaaaacgatcttactccactagttgagatgcttaaacacgagattaaatggaacaatccataccgtaacaaacttatcgagattgctggtggattgaaattcaaaaagaccagtggtacaaagtttactgatgttgttgcttccaagaaaattatggaagacatctacaacaacacgatcttttcgattcagaatctcccgtatagcaacggcattatccttcatggcccaccgggaacaggtaagtcgcttacctgcgaagcgatcctgaatgaagcagtacgaaataatatttctgctgtctacatgtctcgtaagatagacttctcgacgcttgacagcatccttcaagatctgtttgctccatgcatcctagttctagaagatattgattcgttcggcggcgaacgtgaagattatgatgacgacgatcattcatcaactatggcagactttctgcagttcatgagcggtatttcgcagcgtgagcatcctattgtggtagttgctacaacaaaccacattgataagcttgataaggctatcaaggagcgcccggttcgttttaacagaaagtataagttcgattacccgaacccggaagagatcaaagcactggtaaaacgatactttacaaaagatattgttagcgaagcgatcaacaatacaaacattgagtcgctgtacgacagacagcttactggttctcatattcatgagatcagaagaacttgtgaactcattactacttttaatgctaaaaaaagtaaagaagactggtatcacaatcgacnaacaacatatttcagtacgctgtatcaacagtaa

SEQ ID NO: 1914 - protein, 317 aa, Unknown
  Obtained from environmental sample
  DOMAIN (113)...(296): ATPase family associated with various cellular activities (AAA)
  misc_feature (1)..(317): Xaa is any amino acid
MSCLHKETQILNQGDLAFIYEGRVYVIVFNANYHYIKVVCSNENDLTPLVEMLKHEIKWNNPYRNKLIEIAGGLKFKKTSGTKFTDVVASKKIMEDIYNNTIFSIQNLPYSNGIILHGPPGTGKSLTCEAILNEAVRNNISAVYMSRKIDFSTLDSILQDLFAPCILVLEDIDSFGGEREDYDDDDHSSTMADFLQFMSGISQREHPIVVVATTNHIDKLDKAIKERPVRFNRKYKFDYPNPEEIKALVKRYFTKDIVSEAINNTNIESLYDRQLTGSHIHEIRRTCELITTFNAKKSKEDWYHNRXTTYFSTLYQQ

SEQ ID NO: 1915 - DNA, 636 bp, Unknown
  Obtained from environmental sample
  misc_feature (1)..(636): n is a, c, g, or t
atgtacaactatcctcactataaagaacaggacaaagaaaaaatagtcgagtttatgaaggatcatccctttattactttgatcggctctgataggaatggaagaactgaagccacacagatcccggtaatgattgaagaaaaagaagggagacttttcatctatggtcacatcgcaaaaaaatccgatcatcaccaggctttcgaggaaaatccaaatgtgcttgctttatttaccgggccgcatacttatgtaagcggtacctggtacactggcaatccacaacaggcatcgacctggaattatatttcaatacatgcacggggacaaataagatttttggatgaaactgccctggtcgaattgctaaaaaaactttctcttcattttgaaaataacaatgccgcttcttcaactgtttatgataatcttcccgcagattataaagagaaacttatcaaagccatccttgcctttgagctcgaagtaacagagatggataatgtacataagctcagccagaaccgtgacgaaaagagctatgacaatatcgtccggcaattaaaacagcaggaaggtgatgcaaaagaaatcggtgatctgatggagaaaagaaaagaacaagtattcaaatga

SEQ ID NO: 1916 - protein, 211 aa, Unknown
  Obtained from environmental sample
  DOMAIN (1)...(166): Negative transcriptional regulator
  misc_feature (1)..(211): Xaa is any amino acid
MYNYPHYKEQDKEKIVEFMKDHPFITLIGSDRNGRTEATQIPVMIEEKEGRLFIYGHIAKKSDHHQAFEENPNVLALFTGPHTYVSGTWYTGNPQQASTWNYISIHARGQIRFLDETALVELLKKLSLHFENNNAASSTVYDNLPADYKEKLIKAILAFELEVTEMDNVHKLSQNRDEKSYDNIVRQLKQQEGDAKEIGDLMEKRKEQVFK

SEQ ID NO: 1917 - DNA, 1023 bp, Unknown
  Obtained from environmental sample
  misc_feature (1)..(1023): n is a, c, g, or t
ttgcctggcttgaaatgcgcagaaagcaactatgtatccaaagaagaaataaaatacgaaacctccattccttccaaagacaaattccagatcgttctaattgaagcattgtatgaagacgacaaaggatatatcaacgtaactaccaaccaacaggtggccgaccaggctatagaaaaattgattgcagtagagcctgctatggacatacgagtggaaacgcatgaatcaggattctacgtgagaggaggattccaggctggcaattcttatcgtgttataatcaacaaacaactgaaaggaatctttggcggaacaattaaagaaaattatcagcaggatcttgtttttggcgcacaagagccgagcatcagtttcgtaaataaaaaaggaatctaccttacttcaaaaggcgaaaaaaatgttgcgatcagcatcataaatgttcccgaggtaaaagttcagatttataaaatctacgaaaacaatattcttcaattccttaagcgaaatgcttattccaattattacgatgaatactacagtgaatatgacggaagcggatactcaggattggatgaatttggagatttggttttagaaagagaataccattcaaaaagcttaaagaaaaaaggggggacccacctgcttgacctcaattttaatgacattaatgccttcaaaggaatttatgtagtgaccgtccgttcacaggaacaacaatacattaagtccaccaaaatcatatctatctcggatataggactcatcgtaaaagaatctgcagatgatgttattgtatttgctaattcgattctcaccaatgacaggctcgccggtgtagaagtaaatctaatcagctccaacaatcagtcagtttacaaagcaacaaccgatggagatgggtgtgccaaaatccctgaagtaaaaaagaaagctcccggtttttcctataaaatgattacctgcaaagctaaggagaaattaaaactattgcattttgaaaaaaacaaagtaaaa

SEQ ID NO: 1918 - protein, 341 aa, Unknown
  Obtained from environmental sample
  misc_feature (1)..(341): Xaa is any amino acid
MPGLKCAESNYVSKEEIKYETSIPSKDKFQIVLIEALYEDDKGYINVTTNQQVADQAIEKLIAVEPAMDIRVETHESGFYVRGGFQAGNSYRVIINKQLKGIFGGTIKENYQQDLVFGAQEPSISFVNKKGIYLTSKGEKNVAISIINVPEVKVQIYKIYENNILQFLKRNAYSNYYDEYYSEYDGSGYSGLDEFGDLVLEREYHSKSLKKKGGTHLLDLNFNDINAFKGIYVVTVRSQEQQYIKSTKIISISDIGLIVKESADDVIVFANSILTNDRLAGVEVNLISSNNQSVYKATTDGDGCAKIPEVKKKAPGFSYKMITCKAKEKLKLLHFEKNKVK

SEQ ID NO: 1919 - DNA, 693 bp, Unknown
  Obtained from environmental sample
  misc_feature (1)..(693): n is a, c, g, or t
atgaaaactttaattttcttcctgattttattttttggctccattccctcatacagccaaatagccgatacgatgcctaccttcatttacggtgagcaagagctggattcattcatgcaggataatattgtacttcctatggatcttagtggcttacaatatgaaatcgaaatgtcgttcgacgttgacacaagtggaactgttaagaatgcaaaaattgaagattatcaactgtcaggagttagtattgcagaaaaaaaatctgattttgtaaaaggaatgcaaatgatgctgaacagggaagcaatgcgtgttatatatttttccagcggtttatggatccccgtaatacaagagaatacaaaagttgcaggcagaagaaaaataaaagtaaaatttgatacgaatcagtttggcaaaaacaacatatcaacttttaaagtacgcaatcatgaagacccaagtcgatattataataacggagttaaaaagctgcaacaaaagaaacccattttagcagttaagtatcttgaagaatcgatccgcttaaaagaagatgttgattcatactttaatcttgggattgcctatatgaaaatccagaattcattattagcatgtaaaaactgggaaaaggctcaaaaaatgggcgatacagaagtgcaatcattaattagtaaatactgtaaataa

SEQ ID NO: 1920 - protein, 230 aa, Unknown
  Obtained from environmental sample
  SIGNAL (1)...(19)
  misc_feature (1)..(230): Xaa is any amino acid
MKTLIFFLILFFGSIPSYSQIADTMPTFIYGEQELDSFMQDNIVLPMDLSGLQYEIEMSFDVDTSGTVKNAKIEDYQLSGVSIAEKKSDFVKGMQMMLNREAMRVIYFSSGLWIPVIQENTKVAGRRKIKVKFDTNQFGKNNISTFKVRNHEDPSRYYNNGVKKLQQKKPILAVKYLEESIRLKEDVDSYFNLGIAYMKIQNSLLACKNWEKAQKMGDTEVQSLISKYCK

SEQ ID NO: 1921 - DNA, 858 bp, Unknown
  Obtained from environmental sample
  misc_feature (1)..(858): n is a, c, g, or t
ttgggaaatctggatttagaggcaataaaaagtgagcttaacttttacaggaaatactgtgatcgtgcagcagaactcatgagagatacagaagaaacagcaccttttgcaacaataactctacgaaaaggtttgcccatcctagatagaaatctaaaagagcttattgaagaaattcaaaagaaagcaaagattgcgtgcaaggaatcgaaaggaacagaagcagaagagatagtatgtgaaattaataacgaaattcaggatgccgtcattgattatcagatgcagtatctagaaacaactaaaattctagaagacattttatctattgtaaaaatgaaaattccccaaattcctgaaaacaagtttattcttagtaaaattgaagcagttgataatagaataatttctgcggataaatatcatgacttacctcttattatttctctaatgtcaactattaaagcgatttcagcagagcaagagttagatcaaataaaacataaaatagaatatatctctgacaagtctgaccttatatatgataatgctattagaattagcgccaaactggacgagatcagcttttctatttttcgaattaaactgaattcacataatgttatatcaaatcttgaagcaatgaaaatagaattggaaaaactaagtgaatttgcaaaactaaatggatcctttttgggcaaattgaatcccactcaagctaaagatctaaatgatgtaaataataatatacaagaccgcttagatgacttagcaagtttaattgatgaccttcctaaaagtaatgttatcaaggaaattctagagaaatttgatgaattaagacatcagatctag

SEQ ID NO: 1922 - protein, 285 aa, Unknown
  Obtained from environmental sample
  misc_feature (1)..(285): Xaa is any amino acid
MGNLDLEAIKSELNFYRKYCDRAAELMRDTEETAPFATITLRKGLPILDRNLKELIEEIQKKAKIACKESKGTEAEEIVCEINNEIQDAVIDYQMQYLETTKILEDILSIVKMKIPQIPENKFILSKIEAVDNRIISADKYHDLPLIISLMSTIKAISAEQELDQIKHKIEYISDKSDLIYDNAIRISAKLDEISFSIFRIKLNSHNVISNLEAMKIELEKLSEFAKLNGSFLGKLNPTQAKDLNDVNNNIQDRLDDLASLIDDLPKSNVIKEILEKFDELRHQI

SEQ ID NO: 1923 - DNA, 795 bp, Unknown
  Obtained from environmental sample
  misc_feature (1)..(795): n is a, c, g, or t
atggaaccgacagccttctatcatttaaagaaactaaaagacgtacaatttttccaggagcaaaaaataggaaagttatcttacctcagcaattatgttccggttagaagtgaaagtggcagagagttcgcatatttaaatattccatacttcgaatctgaaagtaaattagaagaagagatatcaaattttttggttacgattattaatttaaatgcctttatttttttaatcgccggaataatcgctttatttattactaaccgcgttacacaatctttctcgctcatcagcgataaaatgaaaaaagtcaatctgggaaaaataaatgagatgatatcatggaacaaaaaagatgaaattggtgaattggtagaggagtataataaaatggtaatgaaattagatacgagcgctgaaatgcttgccagaagcgaaagagaaggcgcctggagagaaatggcaaggcaggttgcacacgaaataaagaatccgttgactccaatgaggctcaacctccagtatctgcaaaaggcaatcgatgccaattctccaaatgtaaaagagatctcggtatacgttgctaaaatattagttgagcagatcgatcatctttcgcaaatagccggggattttgcacagtttgctaatatcggccaaagtaaaaatcaacttttcaaccttgcagattcattaaagcaggtaacgtctttatactccactacagagaaattacaaattaccatgcgtccgcacagtgacagaataatgataagggctgataaacacaaataa

SEQ ID NO: 1924 - protein, 264 aa, Unknown
  Obtained from environmental sample
  DOMAIN (68)...(137): HAMP domain
  misc_feature (1)..(264): Xaa is any amino acid
MEPTAFYHLKKLKDVQFFQEQKIGKLSYLSNYVPVRSESGREFAYLNIPYFESESKLEEEISNFLVTIINLNAFIFLIAGIIALFITNRVTQSFSLISDKMKKVNLGKINEMISWNKKDEIGELVEEYNKMVMKLDTSAEMLARSEREGAWREMARQVAHEIKNPLTPMRLNLQYLQKAIDANSPNVKEISVYVAKILVEQIDHLSQIAGDFAQFANIGQSKNQLFNLADSLKQVTSLYSTTEKLQITMRPHSDRIMIRADKHK

SEQ ID NO: 1925 - DNA, 1053 bp, Unknown
  Obtained from environmental sample
  misc_feature (1)..(1053): n is a, c, g, or t
atgttttggaaacaaaagaaagaacttgatttacgaaagcgttttgccgaaaatctttccagcaaagctgatcctacaaatgagagcatgctgaattttttagccgcagattttaaaaatattttcctgtctgagatcttttcagaatttgaaaatgaagcgcaaaacaggtacataaaagacagtcttgtcaactccaatttttcaggttacgtaaacagatatgatacacggatatatacttttgatgcaaagggtaatccgttatataatgccgattcaacaacactcaacactttaaatacaattatagaaacccaggcgaaggaaataaacaaaaacggcttgtattattatgacgtatcgtacgaccggtttgattacttgattaaaaaagaaattactgatacaaatagtatcgttaaaggatatgtctttattctttctcatccaaaaaaatacaagcccgatgcactttaccctgagctattttcaaaaggaagcacaaattctatagaaaactcatcagtatatgcattcgctgtatataataaaaatgatttaagcaccagccataatgattacccgtttcccacaaaaatatccgagcctaaacttttgaacaatgaatttcaaattagaaaaagaagtggtaatgatgaactgtggtacagagccaacgaagataaagtaattgtgatagctaagcctgacagcttttttattgaatcaataaccttgttcgcttacctatnttgtgcttttcttgcactaaccgccctcttcctgcttttagatgctttgatagagaaaaaatttaatttcgataaaantaatttcttatccaatttaagtattcgtacacagatacacggtacaattattttaatcagcattttttcatttttgattatcggtattacaaccatcctgttttttatcagcaggtatcatattaataatcgtgaaaagctgaccagagtgatacaggtgatgcaaaatgatgtacgcagttctttaagaaaagttatcggcgtttgcactgaaaaataa

SEQ ID NO: 1926 - protein, 350 aa, Unknown
  Obtained from environmental sample
  misc_feature (1)..(350): Xaa is any amino acid
MFWKQKKELDLRKRFAENLSSKADPTNESMLNFLAADFKNIFLSEIFSEFENEAQNRYIKDSLVNSNFSGYVNRYDTRIYTFDAKGNPLYNADSTTLNTLNTIIETQAKEINKNGLYYYDVSYDRFDYLIKKEITDTNSIVKGYVFILSHPKKYKPDALYPELFSKGSTNSIENSSVYAFAVYNKNDLSTSHNDYPFPTKISEPKLLNNEFQIRKRSGNDELWYRANEDKVIVIAKPDSFFIESITLFAYLXCAFLALTALFLLLDALIEKKFNFDKXNFLSNLSIRTQIHGTIILISIFSFLIIGITTILFFISRYHINNREKLTRVIQVMQNDVRSSLRKVIGVCTEK

SEQ ID NO: 1927 - DNA, 357 bp, Unknown
  Obtained from environmental sample
  misc_feature (1)..(357): n is a, c, g, or t
atgaaaagattcttacatctaaaaacatcaaatgtagctatattagcggaaaatgatgataaatctgtcctgataaaaggacaacacataccaaaagaaatcgttacagaaggtgcggattggagagaaatgccagaagatgattatgaagtaatagaatatgagaaggttcaagctggttctaagtattctaaagatatgacaactggtaattatgttggagaaatgggtgaaatttcacaatatatcgcatctttaagagcaaaaataacaaaagtaattcgtaaagaagacggtcggatatttagcattggggaatattatacttgctgtaatggtacttttgaaataaaataa

SEQ ID NO: 1928 - protein, 118 aa, Unknown
  Obtained from environmental sample
  misc_feature (1)..(118): Xaa is any amino acid
MKRFLHLKTSNVAILAENDDKSVLIKGQHIPKEIVTEGADWREMPEDDYEVIEYEKVQAGSKYSKDMTTGNYVGEMGEISQYIASLRAKITKVIRKEDGRIFSIGEYYTCCNGTFEIK

SEQ ID NO: 1929 - DNA, 507 bp, Unknown
  Obtained from environmental sample
  misc_feature (1)..(507): n is a, c, g, or t
atgatctcttttttccgtatccctaaaagagaacatactattcgggaagatgcgatcatcgccccggcagatggcaaagtggtggtgatcgaagaggtacaggccgacgaatatttttccgaccggcggatccaggtgtctatttttatgagcccgctcaatgtgcatgtgaaccggaatcccatcagcggtgagatcatgtacagtaattatcataaagggaaatacctcgtggcctggcatcctaaatcctccacggagaatgaacgccactcggtggtttatcggaaaaacgggaaagagatcctggtcaaacagatcgccggcgcactcgccaaacggatcgtaaattacctcgtcaccgggcaacaggtgaaacagggtgcagaaatggggtttattaaattcggttcaagagttgacctcctgctccccctcgatgccaagatcctggtgaaaatcggggatgcgcccaaaggtggggtgaccgtggtggctacctggtaa

SEQ ID NO: 1930 - protein, 168 aa, Unknown
  Obtained from environmental sample
  DOMAIN (1)...(166): Phosphatidylserine decarboxylase
  misc_feature (1)..(168): Xaa is any amino acid
MISFFRIPKREHTIREDAIIAPADGKVVVIEEVQADEYFSDRRIQVSIFMSPLNVHVNRNPISGEIMYSNYHKGKYLVAWHPKSSTENERHSVVYRKNGKEILVKQIAGALAKRIVNYLVTGQQVKQGAEMGFIKFGSRVDLLLPLDAKILVKIGDAPKGGVTVVATW

SEQ ID NO: 1931 - DNA, 381 bp, Unknown
  Obtained from environmental sample
  misc_feature (1)..(381): n is a, c, g, or t
atgaaaaaaaatacaatcctttgtgttgatgatgactctgacgatttactcttgcttcatgaaacattaaaagatacccgtgaagacttccaggtgatagaggctcataatggacggcaggcactagatcttcttcaaaaactaaagcaggacggtgaacatccctgcctgattatactggatataaatatgcctgttctgaatggtaaagaaactctttccattataaaaaaagatgaggcgctaaaagaaattcctgtggtagtttttacaacctccggcagcgactcggataaaaaattttgccatcttcatggggntgaaatggtaaccaagcccccctcgtttaccaattttaaatctgtgttcaaggctgcttag

SEQ ID NO: 1932 - protein, 126 aa, Unknown
  Obtained from environmental sample
  DOMAIN (4)...(126): Response regulator receiver domain
  misc_feature (1)..(126): Xaa is any amino acid
MKKNTILCVDDDSDDLLLLHETLKDTREDFQVIEAHNGRQALDLLQKLKQDGEHPCLIILDINMPVLNGKETLSIIKKDEALKEIPVVVFTTSGSDSDKKFCHLHGXEMVTKPPSFTNFKSVFKAA

SEQ ID NO: 1933 - DNA, 303 bp, Unknown
  Obtained from environmental sample
  misc_feature (1)..(303): n is a, c, g, or t
atgttaagtgccaggaacattgaaaagtattacggtaagcttcatgtgctgaaatccgtgaatattgatattaaaaaaggagagatcgttagcattgttggctcctccggggcaggtaaaagcacttttttgcacatccttggcacactggataagcccgggaaaggagaggtcatgctgcacgagcagcgtgtagaccgattgtcgggaaacgccttatctaaattccgaaacaaaaatatcgggttcattttccagtttcatcatttattacctgaatttacggcgctggaaaatgtttga

SEQ ID NO: 1934 - protein, 100 aa, Unknown
  Obtained from environmental sample
  misc_feature (1)..(100): Xaa is any amino acid
MLSARNIEKYYGKLHVLKSVNIDIKKGEIVSIVGSSGAGKSTFLHILGTLDKPGKGEVMLHEQRVDRLSGNALSKFRNKNIGFIFQFHHLLPEFTALENV

SEQ ID NO: 1935 - DNA, 735 bp, Unknown
  Obtained from environmental sample
  misc_feature (1)..(735): n is a, c, g, or t
ttgtataccaacacaattaagcccttattcgatttgctggtatcttctgtgatcctgatcgtagcttcgcccatctttctcatcatcgtcgtgattttgtattttgtgaaccggggaaaagtattcttcaggcaggagcggcccggaaaggccggaaagatcttttcagttataaaatttaagacgatgagggatgatcgtgatacaacgggtaacttgcttcccgatgaaaagcggctgagcgggataggaaagctgatacgcaaaacctcacttgatgaattaccccagttgcttaatgtgatcgccggtcatatgtcactggtaggtccccggcctttgctgaaggagtatttgcctttgtacaacgacgttcagcgacgaaggcacgaggttaagccgggaataacgggatgggcacaggtaaatggacgaaataccgtatcatggccgcaaaaatttgcgtatgatgtctggtatgttgatcacgtctcgttttggcttgatatcaaaatattattattaaccgtcatgaaagttttcaaggcggaaggatcagcagcactacatcagttacaatggaaaaatttcatggcaacaactaaggttttacttcagggtggtgggggacatgcgaaggttgttcctgatgtcttgttgacgaaagtatgtggtacccgctctgccgacccgaatttaaccgagattgtttggggttccccgaatgaaaaatag

SEQ ID NO: 1936 - protein, 244 aa, Unknown
  Obtained from environmental sample
  DOMAIN (7)...(187): Bacterial sugar transferase
  misc_feature (1)..(244): Xaa is any amino acid
MYTNTIKPLFDLLVSSVILIVASPIFLIIVVILYFVNRGKVFFRQERPGKAGKIFSVIKFKTMRDDRDTTGNLLPDEKRLSGIGKLIRKTSLDELPQLLNVIAGHMSLVGPRPLLKEYLPLYNDVQRRRHEVKPGITGWAQVNGRNTVSWPQKFAYDVWYVDHVSFWLDIKILLLTVMKVFKAEGSAALHQLQWKNFMATTKVLLQGGGGHAKVVPDVLLTKVCGTRSADPNLTEIVWGSPNEK

SEQ ID NO: 1937 - DNA, 405 bp, Unknown
  Obtained from environmental sample
  misc_feature (1)..(405): n is a, c, g, or t
gtggacctgcgcccactcattattcaacgcctgaaacaattagtagcaaagacatctaataatatttatgatctgtccataggcgatatgaaaatagatatattatcttccactgcaatttttcaaaatattattttaaagccagataaaaaaagagccgattcattaaacggcttaggtatggcgccacctgaaacctttgctttttctttcccacacctgncagtagaaggaatcaattttgatgatgtactcaccgaaaaaaacatggattataaactggtgaagctgactaatcctgttttcgaaatatatcgtgagccaaatgatcctaaagaaataaaagaagattttacccagcgttttttaagtgagatgaaaaactgtccgtacaaaatcttatag

SEQ ID NO: 1938 - protein, 134 aa, Unknown
  Obtained from environmental sample
  misc_feature (1)..(134): Xaa is any amino acid
MDLRPLIIQRLKQLVAKTSNNIYDLSIGDMKIDILSSTAIFQNIILKPDKKRADSLNGLGMAPPETFAFSFPHLXVEGINFDDVLTEKNMDYKLVKLTNPVFEIYREPNDPKEIKEDFTQRFLSEMKNCPYKIL

SEQ ID NO: 1939 - DNA, 660 bp, Unknown
  Obtained from environmental sample
  misc_feature (1)..(660): n is a, c, g, or t
gtgcaaatgaaagacgtactcaactgcaaggaatccacactcggagttaaaaaggtaaacgatcccaggaacttcggcgtggcggaactcgacgagaagggttacatccggaacgtggtggaaaagcctcctatacctaaatccaatctcgctcttgtaggcctttacaagatcaccgaatcgaagctgctcatcgacgccatcggacatatcatcagcaagaattttcgtacacagggagaatttcatcttacggatgcgatcatgcatatgatatcccagggcgcgaagttcaagaccttcccagtagaaaattggtacgactgcgggaacaaggacagcctgctcgagacgaacgcaatgcttctgaaaaagaaacttaaagagggaaagaaatattctttcgaaaacacgattatcattcctcccgtcagcatagcggtgaattgcaagatctcgaattcgatcatcggtccgaatgtttcaatcggcgagagttcgatcctcaattattccatcattaaagacgccatcatcggatcttattccgaaattaacaatgccgtgcttcaccattccgtcatcggctccgacgcatcgctccacggcctcagccagtcgctgaacctgggcgatagcactgaaattgatttcggataa

SEQ ID NO: 1940 - protein, 219 aa, Unknown
  Obtained from environmental sample
  misc_feature (1)..(219): Xaa is any amino acid
MQMKDVLNCKESTLGVKKVNDPRNFGVAELDEKGYIRNVVEKPPIPKSNLALVGLYKITESKLLIDAIGHIISKNFRTQGEFHLTDAIMHMISQGAKFKTFPVENWYDCGNKDSLLETNAMLLKKKLKEGKKYSFENTIIIPPVSIAVNCKISNSIIGPNVSIGESSILNYSIIKDAIIGSYSEINNAVLHHSVIGSDASLHGLSQSLNLGDSTEIDFG

SEQ ID NO: 1941 - DNA, 426 bp, Unknown
  Obtained from environmental sample
  misc_feature (1)..(426): n is a, c, g, or t
atggaatccccaatttttgcaaggaccttaactatgagtagtattaaaaatcctcctttgcctggcgccagcgtttatgtgtctaaaaaagatgctaaagatcatgactataaatttgatacctacgcgaataacatgattagaacgaccgatagtaaaggctcccctgttgaaggcgttaaagtcatatcatttaaatccaagcaaattcctaatcctaaagcaggaacatctggtgaaccagctacaattcagcaagcgaaaatgattattgaagttcaaacttacgataatgcgaaaaagaaagacgttactcgtaaatttgaagttaaagttacaggcaataaacttatcaaggatgttttaggtgattgttcagatgacaatcaaaagattttgctaaagatatgccaagctttgatgtag

SEQ ID NO: 1942 - protein, 141 aa, Unknown
  Obtained from environmental sample
  misc_feature (1)..(141): Xaa is any amino acid
MESPIFARTLTMSSIKNPPLPGASVYVSKKDAKDHDYKFDTYANNMIRTTDSKGSPVEGVKVISFKSKQIPNPKAGTSGEPATIQQAKMIIEVQTYDNAKKKDVTRKFEVKVTGNKLIKDVLGDCSDDNQKILLKICQALM

SEQ ID NO: 1943 - DNA, 918 bp, Unknown
  Obtained from environmental sample
  misc_feature (1)..(918): n is a, c, g, or t
gtgagtttgagtgtttgcgatgaaaaaacaaaatattactggagaaatttatatcaaacggatattactattgagcagcctgccacttatatggccaggcttacggtaaaaaatgccaaattaattgatgagaaatacgatatgcctggcaaaaaaatacccttctttggattatttgccgggggaaaaaaatcaaaagccgggcaaggtttgccagatgcttcgtggaaggtaaaggtgggaaatgatattatgtttgaatcgccggtgaacaaaaattccttagaagtactcccgggtagcgccacctttaaaatttcaaaaggtgacccagtaaaactcatcatatttgatgaggattattacaaatccgatcaggaggtgggaaccattaactattattctaccaccgatattggtaaagatgaaagaaataattatgcctttgaaaagatagaaacctcgaacattctgttcgagaaaactgtagtaccttccatttcaagcatggtgttggactaccataaaaagaagtataatggggttaccggaattgaggtggaaatactgtatgtaatggccgggttaatgaataatgatgcagtaatgcttcgccccgtttttagagataaaaacgggaaaacgatcgtccccagttttataaaattagttgaaaatgattttgacacaaatgctcttactggaaacctcgtaactaaaaagaacggcccggcaaaacaaatttttttcattcctcactatgcatgtaaggttgacatgttcccgggaattgagtttatcatggacagctacaatgaagtgattcaatctcagttttcaaaaacagactatcatcgtttgggattattaaagacgatgtnaacattcaagtggcccgcgcggaagagacagntataa

SEQ ID NO: 1944 - protein, 305 aa, Unknown
  Obtained from environmental sample
  misc_feature (1)..(305): Xaa is any amino acid
MSLSVCDEKTKYYWRNLYQTDITIEQPATYMARLTVKNAKLIDEKYDMPGKKIPFFGLFAGGKKSKAGQGLPDASWKVKVGNDIMFESPVNKNSLEVLPGSATFKISKGDPVKLIIFDEDYYKSDQEVGTINYYSTTDIGKDERNNYAFEKIETSNILFEKTVVPSISSMVLDYHKKKYNGVTGIEVEILYVMAGLMNNDAVMLRPVFRDKNGKTIVPSFIKLVENDFDTNALTGNLVTKKNGPAKQIFFIPHYACKVDMFPGIEFIMDSYNEVIQSQFSKTDYHRLGLLKTMXTFKWPARKRQX

SEQ ID NO: 1945 - DNA, 702 bp, Unknown
  Obtained from environmental sample
  misc_feature (1)..(702): n is a, c, g, or t
ttggcatgcttttatcgttggatgtttattctggggaaagcctataaatacaggtcaacagccatggaaaccattacggttacaggctccgctgaaaaagattttgtaagcgacctgattgtatggaacggttcttattcaagaaaatcaatggacttaaaaagcgcttatgcgcaactgaaaaatgatgagaataccatacggacttaccttacggggaaaggagtcagcaataatgaactggtattttcttctgtaaatatcaataaggaattcaattatagaacggatgcaaacggcagatcgcttggccaggaatttaccggatacaaccttactcagaatgtaaaaattgaatcacctaacgtggataaggttgcgcagatatccagggaagccactgaattgattgagaaggaaattgaattcaattcttcatctcctttattttattatactaaactaactgaagtgaaaatggatctcctggcaaaggcaagcgctgatggtaaaaagagagcggaaatcattgcaaaaaatgcaggcagttctttgggtaaattaaagaaagcaacgcttggcgtttttcagattacaggaaaaaatagcgatgaagattacagctatggcggcactttcaacacctccagcagaaataagacaggctccattactatcagaatggaatttggaactaattaa

SEQ ID NO: 1946 - protein, 233 aa, Unknown
  Obtained from environmental sample
  DOMAIN (21)...(229): Protein of unknown function (DUF541)
  misc_feature (1)..(233): Xaa is any amino acid
MACFYRWMFILGKAYKYRSTAMETITVTGSAEKDFVSDLIVWNGSYSRKSMDLKSAYAQLKNDENTIRTYLTGKGVSNNELVFSSVNINKEFNYRTDANGRSLGQEFTGYNLTQNVKIESPNVDKVAQISREATELIEKEIEFNSSSPLFYYTKLTEVKMDLLAKASADGKKRAEIIAKNAGSSLGKLKKATLGVFQITGKNSDEDYSYGGTFNTSSRNKTGSITIRMEFGTN

SEQ ID NO: 1947 - DNA, 1002 bp, Unknown
  Obtained from environmental sample
  misc_feature (1)..(1002): n is a, c, g, or t
gtgtttgattcgcgatttagtcaagatcgaaaaaccgttgttgattccgtaagagaccgcgtggacagttcagactataaacggtaccgatacaatttttccaaagatgcgctcgaaaatattcacacaaaagctaaacgcctgatcggcgatatcaacaaaagacatcaaaaaataggtcgggagatactcggaagtaaaaactggacaagtgttgtcggcaatttgtggaaggcaacaaagaatcagaaggactcttcggttgttgtggacaaaacccaattcgagtacactacacaagaactagatacactcttggatctatttcaaaaatcccagccaatatatggggaatatttgacggttgcagaccaggcatttattaacccgaagaagcttcatggtgaaaacccctacataatcgagcaagcatttgatgattcatttaagttttattctaatcaactccagcaagttaatctggttctggaagcaaatagagaagagtatttcaaactgagaaaatctgaactggataaccaaatcaaaaagatcaacagcctgattgatgaactgttggctcaggaagctgtcttaaataacctttgcaaaactgaatgtgacctctatttagagtcacgacaaaaagagtttgcaggtcaatgtaagtccataaacgaagtaaatgaagctattggaaatatattcaacacaaataaggagaatcaagatttattcaatgaatcaaaaacagcgtcgttcacgtataagctcggttccttattctcaagaaagaaaaaacaaacgataaaagatcaggctatcttgagagtacattttgacaattttcaagagcttgtaaacaactcnaaagatctcccccctnatcagttcattgatagccctagcaacaaggagcggctatacatacaattttaccaatccctggnangctttcaaggagaactccatctgtatttcagtctgaggttgataagttaa

SEQ ID NO: 1948 - protein, 333 aa, Unknown
  Obtained from environmental sample
  misc_feature (1)..(333): Xaa is any amino acid
MFDSRFSQDRKTVVDSVRDRVDSSDYKRYRYNFSKDALENIHTKAKRLIGDINKRHQKIGREILGSKNWTSVVGNLWKATKNQKDSSVVVDKTQFEYTTQELDTLLDLFQKSQPIYGEYLTVADQAFINPKKLHGENPYIIEQAFDDSFKFYSNQLQQVNLVLEANREEYFKLRKSELDNQIKKINSLIDELLAQEAVLNNLCKTECDLYLESRQKEFAGQCKSINEVNEAIGNIFNTNKENQDLFNESKTASFTYKLGSLFSRKKKQTIKDQAILRVHFDNFQELVNNSKDLPPXQFIDSPSNKERLYIQFYQSLXXFQGELHLYFSLRLIS

SEQ ID NO: 1949 - DNA, 651 bp, Unknown
  Obtained from environmental sample
  misc_feature (1)..(651): n is a, c, g, or t
ttgaaattgcgtttgttgctgcagtacctatgtaagaatttagataaggaacgaaaaatgtacaaactaatagcggtaggtttgttaattgcaataggtttggcaacgacacagcatagttttgcccaaactaaatcggcagagatggagcgaataattaacgagtaccttaccaataaacaatttatgggtacagtattggttgcagaagcagaccacataattctcaataggggctatgggtacgctaatttggagtggaatattcccaacacgcccgaaacaaaatttagaattgcctctcttacaaaacaatttactgctgcgagcattttattgctggaggaaaaaggtaaattgaaaacaacagatacaattacaaaatactttcctgacgcgccggagtcctggaaaaagatcacgattttcaatcttctcaatcatagctctggcatttcggatttcacagcctttccggaaatcaaatcgtttcagttatcacctactacccccactaacacaatagacttatttaaaaacaagccattgaacttccaacctggcgaaaaagtaagttattcaagctcgggttatattttacttggcgcactgatcgaaaaaatcactgggaaaagttacggatcattttaa

SEQ ID NO: 1950 - protein, 216 aa, Unknown
  Obtained from environmental sample
  DOMAIN (49)...(216): Beta-lactamase
  misc_feature (1)..(216): Xaa is any amino acid
MKLRLLLQYLCKNLDKERKMYKLIAVGLLIAIGLATTQHSFAQTKSAEMERIINEYLTNKQFMGTVLVAEADHIILNRGYGYANLEWNIPNTPETKFRIASLTKQFTAASILLLEEKGKLKTTDTITKYFPDAPESWKKITIFNLLNHSSGISDFTAFPEIKSFQLSPTTPTNTIDLFKNKPLNFQPGEKVSYSSSGYILLGALIEKITGKSYGSF

SEQ ID NO: 1951 - DNA, 945 bp, Unknown
  Obtained from environmental sample
  misc_feature (1)..(945): n is a, c, g, or t
ttgatcggaggattattgtatgatacaaaatcgttgacaactgataaaatagaagcaatcgaaaaaagcagtaaacaaaaaggatacgattaccttgatttttttttgcaaactgacggattggtggcagaaagagagcaaggaatcacgattgatgttgcgcatatttatttttcgactgcaaagaaaagttacattattgccgatactccgggtcacgtagaatatacaagaaacatggttacaggagcttcgacttctcaggtttctatcattttgatcgatgccagaaaaggtgtaatcgagcaaacttaccgtcactttttcatcaataatttattgagagtaaaagaagtaatcgttgccatcaacaaaatggatttggtggattattctgaagaagttttcaataaaatcaaagctgattttgaggctttaaatgcaaaaagtactttcaaagaacaaaacgtaagctacattccgttaagtgcaatcaacggcggaaacgttgtggacaaatcggagaatatgccttggtacgaaggacaaacggttttagagcatttagaaggattacatgcttctgatgtatacgaagcaggaaaagcacgtttcccagttcagacggttattcgtccaaaaacagaagaatatcacgattttagaggttacgctggaaaattatacggaaactcaatcaaagttggagatgctgtaacagttcttccttctttaacagagtcaaaagttactaaaattcactttttcgataaaacatttgacgaagctacagcaggttcttcaatcacaatcgaattagaaaatgatatcaatgtaacgagaggtgatatgattgtaaaatcaagcgaacttccaaaaattgaaaaagacattaccacaacagtttgctggatggacagtaaaaaacntggttgcgggaactaa

SEQ ID NO: 1952 - protein, 314 aa, Unknown
  Obtained from environmental sample
  DOMAIN (221)...(286): Elongation factor Tu domain 2
  misc_feature (1)..(314): Xaa is any amino acid
MIGGLLYDTKSLTTDKIEAIEKSSKQKGYDYLDFFLQTDGLVAEREQGITIDVAHIYFSTAKKSYIIADTPGHVEYTRNMVTGASTSQVSIILIDARKGVIEQTYRHFFINNLLRVKEVIVAINKMDLVDYSEEVFNKIKADFEALNAKSTFKEQNVSYIPLSAINGGNVVDKSENMPWYEGQTVLEHLEGLHASDVYEAGKARFPVQTVIRPKTEEYHDFRGYAGKLYGNSIKVGDAVTVLPSLTESKVTKIHFFDKTFDEATAGSSITIELENDINVTRGDMIVKSSELPKIEKDITTTVCWMDSKKXGCGN

SEQ ID NO: 1953 - DNA, 441 bp, Unknown
  Obtained from environmental sample
  misc_feature (1)..(441): n is a, c, g, or t
ttgatagaaatttttctgccatcactgaaggataatcttatggttaaccacatttctgtttatccattggaaaaattatctaaacatactgaaataaagccaggatttgcatttaggagtgaagaattcttagaaaacaccagcgaaatcccacttgtaaagggtgagaatctccaacaaggttatattgactggagcgcagcaaagtattggtcaagcgataagacacgtggagttgaggattattttctagtagaaaatgacattgtagtggctatggaccgtccctgggtaacttcagggctaaagtggtcttatataagaaaaggtgatccgaaatcgttgcttgttcagcgtgtagcaaggttgcgagctaagggaaaactgaatcaatattttctaaggtatcttattggaagtgagtatttctcagatatataa

SEQ ID NO: 1954 - protein, 146 aa, Unknown
  Obtained from environmental sample
  misc_feature (1)..(146): Xaa is any amino acid
MIEIFLPSLKDNLMVNHISVYPLEKLSKHTEIKPGFAFRSEEFLENTSEIPLVKGENLQQGYIDWSAAKYWSSDKTRGVEDYFLVENDIVVAMDRPWVTSGLKWSYIRKGDPKSLLVQRVARLRAKGKLNQYFLRYLIGSEYFSDI

SEQ ID NO: 1955 - DNA, 315 bp, Unknown
  Obtained from environmental sample
  misc_feature (1)..(315): n is a, c, g, or t
atgagaaaaatttatggtctgcttgcattttgcctgttgatgaatactgcgaaagcacaaacatccaatgcaattctctttactgaaaacggtgagaaattcactgcaatacttaatggtgtaaggcaaaatgacaagcctgaaacaaatgttaagatcacggggcttaatgctgaatattacaagctgaaagtaatttttgacaatcctgaactgggtgaaagaaacctgaacctttatataaatacaggaacagaaacttcttactgtataaaaagaacaataaaggggaatatgaggcgancatcaagataa

SEQ ID NO: 1956 - protein, 104 aa, Unknown
  Obtained from environmental sample
  SIGNAL (1)...(19)
  misc_feature (1)..(104): Xaa is any amino acid
MRKIYGLLAFCLLMNTAKAQTSNAILFTENGEKFTAILNGVRQNDKPETNVKITGLNAEYYKLKVIFDNPELGERNLNLYINTGTETSYCIKRTIKGNMRRXSR

SEQ ID NO: 1957 - DNA, 324 bp, Unknown
  Obtained from environmental sample
  misc_feature (1)..(324): n is a, c, g, or t
ttgtcacctgatgcgtcgtacttatcaaccagtaaatgggaaagcctgtctgatgacgataaaaacaaatttgcaccggtatgcccggaatttgtaattgaagtgcgctcaaaatcggataaccttgacgagctgaaagagaaaatgaaaatttggataaaaaatgaatccaagcttgcctggctaattgatccaattgaaaatacaatatatgtttttcgggctgacggatcagttgaaacaattaacggatttgataagatgataaaaggtgaaggccctgtacaaggcttcgcactcgaccttacattattattaaaatag

SEQ ID NO: 1958 - protein, 107 aa, Unknown
  Obtained from environmental sample
  DOMAIN (1)...(106): Protein of unknown function (DUF820)
  misc_feature (1)..(107): Xaa is any amino acid
MSPDASYLSTSKWESLSDDDKNKFAPVCPEFVIEVRSKSDNLDELKEKMKIWIKNESKLAWLIDPIENTIYVFRADGSVETINGFDKMIKGEGPVQGFALDLTLLLK

SEQ ID NO: 1959 - DNA, 393 bp, Unknown
  Obtained from environmental sample
  misc_feature (1)..(393): n is a, c, g, or t
atggatgcagacgaatcattttatgattcagtaaaacaatttaaaaatggggcacatatttttactaaaagagtaaataatcctcaagattttggagttgctggatttaattcaaaatatgaactagttagtatcacagaaaaacctaaaacattcatttcaaattttgcaattattggattttatcttttcgattttaaagtttttgaatacgcaaaacagtgtattccttccagtagaggacagttagaaataactgatgttttacaatcttatttaaatgattcaaaattgtcgtacaatcatattaattttttctggcaagatgctggaacttacgaaaatctatatttagcaaacaaatattggtacgaaaaggaaataaatgcttga

SEQ ID NO: 1960 - protein, 130 aa, Unknown
  Obtained from environmental sample
  misc_feature (1)..(130): Xaa is any amino acid
MDADESFYDSVKQFKNGAHIFTKRVNNPQDFGVAGFNSKYELVSITEKPKTFISNFAIIGFYLFDFKVFEYAKQCIPSSRGQLEITDVLQSYLNDSKLSYNHINFFWQDAGTYENLYLANKYWYEKEINA

SEQ ID NO: 1961 - DNA, 621 bp, Unknown
  Obtained from environmental sample
  misc_feature (1)..(621): n is a, c, g, or t
ttgatcgagttcatcaagatccgcttagaagaatcggataataaagtttacaaattattaaagaagatccaggaattccgcgaagagaacggattggtgtacaacgaaggcttattcaataccgactttgctacaggtcaaaaacgcgagatcagcggaagagccgttaaattactggaacaattacgtaatgccatcaaagaacaagagcaagaagagatccggttacaagatctgtttgagttgaagttcaacattaaagaaggtatgaatgaaaccggctggacgcacaaaattgacagcattggaagtaccggaacagatatccttgtaaaagcgatcatttacattaccctactccatgtatttattaaagaatcatcgcacagaagcagtacagactttaaagtacattgtataattgacgaggtaggacaaatttctgctcactacttacgcgaactattgcgttttgctaagaacagaaatattatgatgatcaacggtttgccaaacaaatcgggattagaaagtcactacaaattcacgtatcaattcagaagagaagagaataataatgttaggatcttccctagtattgtgacggaagtggaagcttaa

SEQ ID NO: 1962 - protein, 206 aa, Unknown
  Obtained from environmental sample
  misc_feature (1)..(206): Xaa is any amino acid
MIEFIKIRLEESDNKVYKLLKKIQEFREENGLVYNEGLFNTDFATGQKREISGRAVKLLEQLRNAIKEQEQEEIRLQDLFELKFNIKEGMNETGWTHKIDSIGSTGTDILVKAIIYITLLHVFIKESSHRSSTDFKVHCIIDEVGQISAHYLRELLRFAKNRNIMMINGLPNKSGLESHYKFTYQFRREENNNVRIFPSIVTEVEA

SEQ ID NO: 1963 - DNA, 837 bp, Unknown
  Obtained from environmental sample
  misc_feature (1)..(837): n is a, c, g, or t
gtgttttactcccacctgcaatttgtaaatctaatgnctgtttttgccagattcttcatgaaaacaaaagtttttccttgtcgccaccactctaccgatgttgtgcttagaggaaataaaaacgccatacgtcaggataaactggtaaaccggttttcgaaaaaaataattgtggtttccaatgcggttaaagatcaaatggtgaagcatgaaggtgttaattcggcaaagatcgagtgtattcccttgggctataattttgatctgtatgataaaccagataaaaccgaagtagaaaaaataaaaaaacaactgaattgtgattttatattattggtgattggccgaatgacgataaataaaaggcatacaatcgcactggaagtactgaataatttaatcaagtcgggattgaatgtaaaaatgatactgatggatgaaggccctgaaaaaacaaatttggaaaattacattgttcaacataatttatcggacaaagtaatattcaccggttttttaagcaacaccatgaattatgtagatgcaggcgacctcttattacatccttccgtttcagaagcaagtaatcaggtggtaaaagaggccgctttactgaataaaacagccattgtgtgcaaaggggttggtgattttgaagaatatttcattcacggtaccaatggatttttagtgtctcagaacaatacagtaaatgaaatgacggaactggttaaaatatattatacaaaaaagaatgagttgaatgctttaggtagtgaattaaaaaaagccgtcacaacaaaattcgacataaaacatgtatccgaagcttactaa

SEQ ID NO: 1964 - protein, 278 aa, Unknown
  Obtained from environmental sample
  DOMAIN (96)...(264): Glycosyl transferases group 1
  misc_feature (1)..(278): Xaa is any amino acid
MFYSHLQFVNLMXVFARFFMKTKVFPCRHHSTDVVLRGNKNAIRQDKLVNRFSKKIIVVSNAVKDQMVKHEGVNSAKIECIPLGYNFDLYDKPDKTEVEKIKKQLNCDFILLVIGRMTINKRHTIALEVLNNLIKSGLNVKMILMDEGPEKTNLENYIVQHNLSDKVIFTGFLSNTMNYVDAGDLLLHPSVSEASNQVVKEAALLNKTAIVCKGVGDFEEYFIHGTNGFLVSQNNTVNEMTELVKIYYTKKNELNALGSELKKAVTTKFDIKHVSEAY

SEQ ID NO: 1965 - DNA, 603 bp, Unknown
  Obtained from environmental sample
  misc_feature (1)..(603): n is a, c, g, or t
atgacgtctcctcttgtaagcataatcatccccatgtataatcaacaacctgcttttttaaaggcatgtattgaaagtgctattgggcaaagctacaagaacatcgagatcattatatcagataaccattctacgaacgaagccccgactatacttgatcaatataagggtcgaaatataaaaattttcaaaccctcatctcatctttcactggtggataattttatttttgccgcttctcatgcaaatggggaattcatcacttttttaagttcagatgatattttatatcctaaatgtattgaaaaagtaattaaaccacttttattggataaaaacattgcttttggttattgtgaaaatgcaatgatagatgtaaggngcgatcaaacttatttggtacgagatttgaaatttaaaaccggtgtttattcaaaaaaagaaatagcacacaaaatgtacaaccgatcgaaatattggatcattggcggagtgatgcgtaccgaatggtataaacaaaccggattcaaaaaagatatcattgccgggagattggatcctttggattcaattactaaaattcggagatgtggcatacattaa

SEQ ID NO: 1966 - protein, 200 aa, Unknown
  Obtained from environmental sample
  DOMAIN (7)...(175): Glycosyl transferase
  misc_feature (1)..(200): Xaa is any amino acid
MTSPLVSIIIPMYNQQPAFLKACIESAIGQSYKNIEIIISDNHSTNEAPTILDQYKGRNIKIFKPSSHLSLVDNFIFAASHANGEFITFLSSDDILYPKCIEKVIKPLLLDKNIAFGYCENAMIDVRXDQTYLVRDLKFKTGVYSKKEIAHKMYNRSKYWIIGGVMRTEWYKQTGFKKDIIAGRLDPLDSITKIRRCGIH

SEQ ID NO: 1967 - DNA, 834 bp, Unknown
  Obtained from environmental sample
  misc_feature (1)..(834): n is a, c, g, or t
ttgcagttaaccattaaacggcactttatggaaatcaatacacaagaagttgagaggcctgaagaagtgattcagaaaacgcacgtgcaaacaatccccgttaatgggtcagatcatgtagaaaagcagaaactggtaaccggtattagaaaagcctatatcaggtttcgcatcaggttgcgaatttttcttttagcttataagggttatgggtcgcttggtaaaacagtaaaggtggtgaaagagttggaacaattaaaaatgaaggtgtttggaggcaatgcaaagcgaaagcttgttcagtgtgataacaaattttattctcacatctatattcctggattcccatctaaggcatttgatggcttcgttgaaagcaaactggcccagttctttccaatgaaaaagaaaaccaaccctctttcatttatcttttttgccattaccagtaagtgccctttacgctgtgagcattgttttgaatgggataacctgaataagaaggaaacgttttccctggatgaattaaaacaagtcgtatcccggtaccaggaagaaggtatcgcccaattccattttagtggtggggagccaatggtcaggatcaatgacctggagcatcttattagcagtgctaataaaaaaagcactttttgggtattgacatctgggtttaatgtaacaaaagagaacgcgaaacgactgaagatagcccgggcaacaggtatagtagtgagcttagatcattacgatgcgcccatgcataatgcttttcgtggtttctcaattcttttgagtgggctatgcaggcaaaacagaaagctaaagaagtaa

SEQ ID NO: 1968 - protein, 277 aa, Unknown
  Obtained from environmental sample
  DOMAIN (146)...(275): Radical SAM superfamily
  misc_feature (1)..(277): Xaa is any amino acid
MQLTIKRHFMEINTQEVERPEEVIQKTHVQTIPVNGSDHVEKQKLVTGIRKAYIRFRIRLRIFLLAYKGYGSLGKTVKVVKELEQLKMKVFGGNAKRKLVQCDNKFYSHIYIPGFPSKAFDGFVESKLAQFFPMKKKTNPLSFIFFAITSKCPLRCEHCFEWDNLNKKETFSLDELKQVVSRYQEEGIAQFHFSGGEPMVRINDLEHLISSANKKSTFWVLTSGFNVTKENAKRLKIARATGIVVSLDHYDAPMHNAFRGFSILLSGLCRQNRKLKK

SEQ ID NO: 1969 - DNA, 756 bp, Unknown
  Obtained from environmental sample
  misc_feature (1)..(756): n is a, c, g, or t
atggaaaataaactaccggaaggatgggaatggaagaaactgggagaaattgctgaaaaaattcattacggctatactgcaagtgcagtggaaaagcaaattggtccaaaattactgcgtataactgatattcaggataataatgtaaattgggaaactgttcctttttgtgaaattgatgaaaaagataaagaaaaatatctcttgcatgaagggaatttcgtttttgcgagaactggggctactgttgggaaaagttatctcctagaaggagatgtacctgagtctgttttcgcttcatatttgataagagtaattctatccaatactattgcaaaaaaatacgtttactattttttccaatcctcttcttactggcttcaaatacaaagtggaaaagtcggagctgggcagccaaatgtaaatgctacaaaactatctgagatcactttaccacttcctcctctcgaaactcagcaaaaaatcgtcgccatcctcgaaaaagccgaagaaacgaaaaaactccgggcacaggcggatgagttaacgcagaagcttcttcagagtatgtttttggagatgtttggagatccagttacaaatccaatgggttggaacactgaaaaacttgaaaaattatgtgtgaaaatatacggaggcggaactccttctaaatccaagccagaatactacgagggagatattccttgggtcactccgaaagatatgaagcaggatttatccaagatagcatag

SEQ ID NO: 1970 - protein, 251 aa, Unknown
  Obtained from environmental sample
  DOMAIN (9)...(171): Type I restriction modification DNA specificity domain
  misc_feature (1)..(251): Xaa is any amino acid
MENKLPEGWEWKKLGEIAEKIHYGYTASAVEKQIGPKLLRITDIQDNNVNWETVPFCEIDEKDKEKYLLHEGNFVFARTGATVGKSYLLEGDVPESVFASYLIRVILSNTIAKKYVYYFFQSSSYWLQIQSGKVGAGQPNVNATKLSEITLPLPPLETQQKIVAILEKAEETKKLRAQADELTQKLLQSMFLEMFGDPVTNPMGWNTEKLEKLCVKIYGGGTPSKSKPEYYEGDIPWVTPKDMKQDLSKIA

SEQ ID NO: 1971 - DNA, 573 bp, Unknown
  Obtained from environmental sample
  misc_feature (1)..(573): n is a, c, g, or t
atgtgtttaaatatggatgtcaaagaaataaaccgccatggacaggaactgatcaaacatctgaaaatcagaacatctcctgtagcagtaaaactgattccgaaaggagcagaaattccagaaggtatcaagaaggcaaaagagaatatgactcactgccagtttgtggataaagttagaagaacccgtgaagagttttacactttaaataaaaaccaaatgtgtaaaattggagctggtgcaatgggtcttggctcaattcccaatgatctggtcagcggggagctctattacaaagaattcgagctattcagcacactgagtgcctcaaggcgtactgttgaaatgatccctatcctcccaccgaattcaacagaagctgttctttactctaccctggaaaaaacttcgtttattccaaacgtcgttatggttatcggtaatcctaaacagatgatgttacttacacaggctgtgatgtatgggataggaggaaggcttgaaacgagcttcgcaggagcacagagtgtatgttctgacggcgttgtgcaagttataaagaaggaaaagtag

SEQ ID NO: 1972 - protein, 190 aa, Unknown
  Obtained from environmental sample
  DOMAIN (9)...(189): Uncharacterized ArCR, COG2043
  misc_feature (1)..(190): Xaa is any amino acid
MCLNMDVKEINRHGQELIKHLKIRTSPVAVKLIPKGAEIPEGIKKAKENMTHCQFVDKVRRTREEFYTLNKNQMCKIGAGAMGLGSIPNDLVSGELYYKEFELFSTLSASRRTVEMIPILPPNSTEAVLYSTLEKTSFIPNVVMVIGNPKQMMLLTQAVMYGIGGRLETSFAGAQSVCSDGVVQVIKKEK

SEQ ID NO: 1973 - DNA, 633 bp, Unknown
  Obtained from environmental sample
  misc_feature (1)..(633): n is a, c, g, or t
atgaaccggacaataccgttatttcctcttaacctagtaatatttccgggttcctattacccgctgcatatttttgaagaccgttacaagaagatgcttaagcgctgcattgacgagcataccgggttcggtattgtggcaagcatcggcggtaaaaattccaggataggcagctatgttattgtttcccggatagttaagaattatgagagcggtgagtcggatataattgtgaaagccgtaaacaggtttcagatcattagtacaagtgttcatgcttccgggtattcagttgctgaagttgaggattactccgataccgatgtcgaggttgacgaagagctacttgaagagataaaaaatatttttgatgatatacttgataaaataaacttccagcttgatgattccttctgggataactttgaccgtacagaatataaatcatttaagatagctgaaaaatcaggattgaatcttcagcagcagcagaggctgctgacatttcaggatgagaataagcggcttatgttcctgatcgatcattttaagaaactggataagcagataaataaagattcaatgttcaaaacaataattatgaatgacgggtatcttaatccgaagaattaa

SEQ ID NO: 1974 - protein, 210 aa, Unknown
  Obtained from environmental sample
  DOMAIN (4)...(185): ATP-dependent protease La (LON) domain
  misc_feature (1)..(210): Xaa is any amino acid
MNRTIPLFPLNLVIFPGSYYPLHIFEDRYKKMLKRCIDEHTGFGIVASIGGKNSRIGSYVIVSRIVKNYESGESDIIVKAVNRFQIISTSVHASGYSVAEVEDYSDTDVEVDEELLEEIKNIFDDILDKINFQLDDSFWDNFDRTEYKSFKIAEKSGLNLQQQQRLLTFQDENKRLMFLIDHFKKLDKQINKDSMFKTIIMNDGYLNPKN

SEQ ID NO: 1975 - DNA, 663 bp, Unknown
  Obtained from environmental sample
  misc_feature (1)..(663): n is a, c, g, or t
atggcagataataaaataatattttcaatggtgggggtcagcaaaacctttcccccgcaaaaacaggtattgaagaatatatacctttcattcttttacggagcaaagatcggcatcattggtctaaacggctcgggtaaatctaccctccttaaaattattgccggggttgaagataatttcgatggtgaagtgcattttaccaaagagtactcaatcggactgctggaacaggagccgtaccttgatgaaaccaaaactgtgaaggaaattatccaggaaggcgcgcaggaagttgttgatatactgaaagagtacgaagaggttaataataaattctcagaaccgatggatgatgacgaaatgacaaagctgatcgaaagacagggcgagctgaccgagcttatcgatcaccataacgggtgggagcttgacgcanagcttgagcgcgcaatggacgctctcagaactcccgagggagatgcgctgataaaaaacctgagcggaggtgaanaacggcgtgttgctttatgccgattgctgcttaaagaacccgatatacttttacttgatgaaccgacaaaccatcttgatgcggaatcaattgacaaaatgaatttgccttcagcttttcngctgaaggcaaatttgtttaagatttag

SEQ ID NO: 1976 - protein, 220 aa, Unknown
  Obtained from environmental sample
  DOMAIN (34)...(220): ABC transporter
  misc_feature (1)..(220): Xaa is any amino acid
MADNKIIFSMVGVSKTFPPQKQVLKNIYLSFFYGAKIGIIGLNGSGKSTLLKIIAGVEDNFDGEVHFTKEYSIGLLEQEPYLDETKTVKEIIQEGAQEVVDILKEYEEVNNKFSEPMDDDEMTKLIERQGELTELIDHHNGWELDAXLERAMDALRTPEGDALIKNLSGGEXRRVALCRLLLKEPDILLLDEPTNHLDAESIDKMNLPSAFXLKANLFKI

SEQ ID NO: 1977 - DNA, 363 bp, Unknown
  Obtained from environmental sample
  misc_feature (1)..(363): n is a, c, g, or t
ttggaaattatcacatcttacaaaaataaagttcgattgaagcgagtccgaattaatccaactaccaatgatatattaaccacaagcttttatagtaaagatcaaaattttgtattaggaaaagaattttgtccactgcttaaggatcaaagtgtggaagtgattttctacaaacaaatgtctttgggtctacatgaattcttttattgtaatgggaaaattaagaaaagaggattaaatattcatggctatataggcgaatggaaagattttgatgaagacggaaatgtaataaaatcaactgactatggaaatttaggggcacttgacactcttaaaagtattaagtttcgttacgactaa

SEQ ID NO: 1978 - protein, 120 aa, Unknown
  Obtained from environmental sample
  misc_feature (1)..(120): Xaa is any amino acid
MEIITSYKNKVRLKRVRINPTTNDILTTSFYSKDQNFVLGKEFCPLLKDQSVEVIFYKQMSLGLHEFFYCNGKIKKRGLNIHGYIGEWKDFDEDGNVIKSTDYGNLGALDTLKSIKFRYD

SEQ ID NO: 1979 - DNA, 918 bp, Unknown
  Obtained from environmental sample
  misc_feature (1)..(918): n is a, c, g, or t
atgtgggtcgaaaaatacaggccaaaacatctagctcaaataattaatcaaaaagaaattgtaaaaggtttagaaaatttactgaaaaaacccaacgaattaccacacttattgttcacaggatctgcagggataggtaagactactacagccttatgccttgcaagacaaatgctaggagataactggaaaagagatactctagagctcaatgcttcagatgaaagggggataaaaatggttcgtgaaagagtaaaagaatttgcatcgatcatgaagctttcaataaatcaagaaaaaaacgagaagccgtttaagatcattattttggatgaagcggatgaaatgactacagaggctcaaacagcattgaggagaataatagaagatagtgctagaactactaggtttatttttatttgtaactatctttcacatataattgaaccaatacaaagcagatgtgtaatttttcgattttcaaaggtttccgaggaagaagtaattgaatatttgaaagatatttgtaaaaaagaggaagtaaaagtcgaagaaaaagcacttcataaaatatatgaacacacaaatggtgatttaagacattcaatcaatatattgcaggctgcctcagtgaacggaaatataagtgtccagcaggttcaaaatgcaataggtatatctggaaaaagcataatagctgaaataataaaattagccattaattccaaatttaatgagtcaagaataaaattattagaattattatatgtttatggagtttcagaaacagattttctaaaatatgccaatgaagagatttataagcttgatctgaaagatccctatgaaatttcatctataattgcagaatacgattacagacttgcaaacggtgcaccacccctgaaatacaactag

SEQ ID NO: 1980 - protein, 305 aa, Unknown
  Obtained from environmental sample
  DOMAIN (36)...(212): ATPase family associated with various cellular activities (AAA)
  misc_feature (1)..(305): Xaa is any amino acid
MWVEKYRPKHLAQIINQKEIVKGLENLLKKPNELPHLLFTGSAGIGKTTTALCLARQMLGDNWKRDTLELNASDERGIKMVRERVKEFASIMKLSINQEKNEKPFKIIILDEADEMTTEAQTALRRIIEDSARTTRFIFICNYLSHIIEPIQSRCVIFRFSKVSEEEVIEYLKDICKKEEVKVEEKALHKIYEHTNGDLRHSINILQAASVNGNISVQQVQNAIGISGKSIIAEIIKLAINSKFNESRIKLLELLYVYGVSETDFLKYANEEIYKLDLKDPYEISSIIAEYDYRLANGAPPLKYN

SEQ ID NO: 1981 - DNA, 369 bp, Unknown
  Obtained from environmental sample
  misc_feature (1)..(369): n is a, c, g, or t
atggtctntattattttgagcgaacaaggcgtagtagaattcnatgatgatgatcaattatcttatataaaagnagcattaattcgagaaagaatatcgctnagccatgaggtatctacaatagaaccagatttttacgcacgcgtaaataattatcttcgtaccatcgaagataaagatagggaatcattaatagtgtctttgaatcccttcatagcttctaggctacaaaagatagtcaaactctctgcttcttctcctttggtaccggaacttgaagaaaaactatcatcagaagaaaaacttctctatgaaaatttccacaagatgacgtctaattttaaaaaactggtgttaaagattgagtaa

SEQ ID NO: 1982 - protein, 122 aa, Unknown
  Obtained from environmental sample
  DOMAIN (3)...(120): Protein of unknown function (DUF1288)
  misc_feature (1)..(122): Xaa is any amino acid
MVXIILSEQGVVEFXDDDQLSYIKXALIRERISLSHEVSTIEPDFYARVNNYLRTIEDKDRESLIVSLNPFIASRLQKIVKLSASSPLVPELEEKLSSEEKLLYENFHKMTSNFKKLVLKIE

SEQ ID NO: 1983 - DNA, 1008 bp, Unknown
  Obtained from environmental sample
  misc_feature (1)..(1008): n is a, c, g, or t
atgtgtttgtgtggtgaacgtctttaccgacagggagagattagatttctcacagataaacttcgaaataagagaaccatggttttcgctcaatcaggttttgggaagacgaatttagtcaaagttttgttatacaacatgattagcaacaaagattatgggaaattggtttttgacctaaacggagaatatgctctccgtgggacttctacatatggactgggggatattgatgaagccttagtaaaacaaaatcttgttgtttatacagacaaagagttgccaagaacatataaagatgcagatcgtttcatcttcggtggaaaagttcgtctgaacatgcatagaaatctatcggtgggggatatcttaaacttcggagccgggttttctgaagttatgaaatcgttcctgttttatctggacgaagaaggtgttgagaattttgtgcagaacattgatgactatgtagaaaatccagccaacttacatcgtgatttttcggatttctttggaaagatggaaaagaaaggagaggaagccagcgccagaaaaacagtcatggctattagaaagcggatccgacacctgattgatgacgataagggtctgcattctagctcatcaaaacttgttgaggatgtttttaagtatttacagcaagggaagactattgtgatagatttgtctcttcgagacaatatagaagcgagcataatttcaactatcttaatcagaaagcttttcgagcagaacaaagaaaatttcacttctcaaagaacggacaaggtaattaaagctgttgttttcgtagaggaagcacaaaatgttttgtcggatgagtttgtgaaaatcaatgctaatccctttgtaagattagcaaaagaaggacgaaaattcggtttgggaatcgtggctattactcagcgtccatcagcgatatcggaagagatacgtacgcaagctgaaaacttctttgcttttctatgggaaactcagatgatatag

SEQ ID NO: 1984 - protein, 335 aa, Unknown
  Obtained from environmental sample
  misc_feature (1)..(335): Xaa is any amino acid
MCLCGERLYRQGEIRFLTDKLRNKRTMVFAQSGFGKTNLVKVLLYNMISNKDYGKLVFDLNGEYALRGTSTYGLGDIDEALVKQNLVVYTDKELPRTYKDADRFIFGGKVRLNMHRNLSVGDILNFGAGFSEVMKSFLFYLDEEGVENFVQNIDDYVENPANLHRDFSDFFGKMEKKGEEASARKTVMAIRKRIRHLIDDDKGLHSSSSKLVEDVFKYLQQGKTIVIDLSLRDNIEASIISTILIRKLFEQNKENFTSQRTDKVIKAVVFVEEAQNVLSDEFVKINANPFVRLAKEGRKFGLGIVAITQRPSAISEEIRTQAENFFAFLWETQMI

SEQ ID NO: 1985 - DNA, 507 bp, Unknown
  Obtained from environmental sample
  misc_feature (1)..(507): n is a, c, g, or t
gtgaaccaaagcgcagaacataaacgtatttgttcttatgcaacaggattttggtctattccagttacaccgggctatggcagaaggttacgtattttcgtttttgacgaacagaatgataagttgattggaattgtaggcctagctgaccccgttattggcttggaaatgagagatgttaagtcaatagattggtctaaagatcaaaagttagatcgcctttataactgtatgactgcttacatcttaggagcgattccgccctatagccgaattttgggtggaaaactggtcgcattaactgtgatgtttccagaggtgcgaaaatggttttacaacaagtacagaaattcaaaatcaattattaccaatatccaaaagaagccacatttggtttatgtagatactatgggagcctttggaaaatcatcaatatataatcgtctattcaattggcctcaatctaaaaactcaaaaatcagtatctcaacagtgttttggagataa

SEQ ID NO: 1986 - protein, 168 aa, Unknown
  Obtained from environmental sample
  misc_feature (1)..(168): Xaa is any amino acid
MNQSAEHKRICSYATGFWSIPVTPGYGRRLRIFVFDEQNDKLIGIVGLADPVIGLEMRDVKSIDWSKDQKLDRLYNCMTAYILGAIPPYSRILGGKLVALTVMFPEVRKWFYNKYRNSKSIITNIQKKPHLVYVDTMGAFGKSSIYNRLFNWPQSKNSKISISTVFWR

SEQ ID NO: 1987 - DNA, 429 bp, Unknown
  Obtained from environmental sample
  misc_feature (1)..(429): n is a, c, g, or t
atgtcattgaacccacaacaataccctaccacaatgacattaaccaaacagaagaataaggatataatcaaacacattcttgaaaatgtctttgatctacaagctgacagtgagctccataaagcactgtcccagaatagcctctttaatgtagcaagcttccttgcttttgatgataaggactatgacaccttagagtatgagaagaataatcagaggacaacaatcaagaaaggaattgcaggattagccaaatcttttaaggcttatgttgcataccgcaatgccattggtcaaccttttgaagatgataactggttacaaattactcaaacagagtttgacaattttaagatcaaaaatgtatccagcttcctctatccctttggctctacctcaaggcccccccacccatgccacaagatttaa

SEQ ID NO: 1988 - protein, 142 aa, Unknown
  Obtained from environmental sample
  misc_feature (1)..(142): Xaa is any amino acid
MSLNPQQYPTTMTLTKQKNKDIIKHILENVFDLQADSELHKALSQNSLFNVASFLAFDDKDYDTLEYEKNNQRTTIKKGIAGLAKSFKAYVAYRNAIGQPFEDDNWLQITQTEFDNFKIKNVSSFLYPFGSTSRPPHPCHKI

SEQ ID NO: 1989 - DNA, 387 bp, Unknown
  Obtained from environmental sample
  misc_feature (1)..(387): n is a, c, g, or t
atgaacttattttatgatgatatttctgaatctctctcatttgaaattcctaaaagtaaaaattcttttccaaaagcaatgttgaatttagaaaaatttgaaataggagaaagttacgttacatctaagataaaaactaaaaaaaatgatatatttgtagtaaatattcaaggtggtagtccaggaatagacatctcctcttcacttttcaattttactgagattcccaaattagcatatttacgtacaatgattgataatacaattttagtaagaaaactaccggttcttggagttaaggattggttactcatttacgaagatactctttttttgttagctgtaaaggaaaagtatgatgaattagaaattctttgtgttttttaa

SEQ ID NO: 1990 - protein, 128 aa, Unknown
  Obtained from environmental sample
  misc_feature (1)..(128): Xaa is any amino acid
MNLFYDDISESLSFEIPKSKNSFPKAMLNLEKFEIGESYVTSKIKTKKNDIFVVNIQGGSPGIDISSSLFNFTEIPKLAYLRTMIDNTILVRKLPVLGVKDWLLIYEDTLFLLAVKEKYDELEILCVF

SEQ ID NO: 1991 - DNA, 393 bp, Unknown
  Obtained from environmental sample
  misc_feature (1)..(393): n is a, c, g, or t
atgggcttagcgcagcttgctaaggttactttaattcttcctaggatggagtcatcaaaagttgcgagtcagctcgcacagtttgaatggtttcatccaataagctctaattctgaatattctgatcctaatctagacgaattacatttacggtcacaaaaactcttttcaagtatagatgaagttgtacgtgagttagggattaaacagagaatggaatatggatgctcttataagggtaaaaccaaaaataaaactgaattacaaatctcggaaaatgtacaagttattttgaaacttgaagaaaattccaaatttttgggtaaatcaaaccccaaaataattaatgatagaaattctttaaacgggcaactggatgaatttcccacttaa

SEQ ID NO: 1992 - protein, 130 aa, Unknown
  Obtained from environmental sample
  misc_feature (1)..(130): Xaa is any amino acid
MGLAQLAKVTLILPRMESSKVASQLAQFEWFHPISSNSEYSDPNLDELHLRSQKLFSSIDEVVRELGIKQRMEYGCSYKGKTKNKTELQISENVQVILKLEENSKFLGKSNPKIINDRNSLNGQLDEFPT

SEQ ID NO: 1993 - DNA, 759 bp, Unknown
  Obtained from environmental sample
  misc_feature (1)..(759): n is a, c, g, or t
atgtataaactgcccgtgtccgtcatcatcacctgcaaagacctccaccaatacctagaggaaagctacaaaagtctggaaaaccagaccatgaggccgacggagatcattatcattcacgatggctgccagcctgcacccgtctttaaaggcaccactacggtattccgagatatcaatagaggtgtatccttcagtcggaatgagggggcaaatatcgccacttcagacacgttactcttcctagatgctgacgataccctagatgagtattttattgaggcgatggtgaagaccaaagaaaagaccagagctgatatcgtttatccgaatgtcttattgtggtcgaactggcacaaagatatcaagatgaaaaacgcctggcacgaatcaccaaacaagatcacctggaaaaatatgcttgattttaatcagatcgtggtgagctgctttattcctaaaaagctgtacttcgaggttggaggaatggcaaacttaccgatattagaggattacgacttcttcttgaaatgtttaaaacagggggcaacattcgccaaatctccagcatccgtacttcgttaccgccaacgggaagagggaagaaacagaaaatcacacgagctgaagaatgaatttacttacaccattcgtgataaatatgcgagtacaaggactaaatttcatccccagatcatacaacttctccgaaatgtccccggagcaggtggagcaactatcggaacagaatgtgaatga

SEQ ID NO: 1994 - protein, 252 aa, Unknown
  Obtained from environmental sample
  DOMAIN (7)...(162): Glycosyl transferase
  misc_feature (1)..(252): Xaa is any amino acid
MYKLPVSVIITCKDLHQYLEESYKSLENQTMRPTEIIIIHDGCQPAPVFKGTTTVFRDINRGVSFSRNEGANIATSDTLLFLDADDTLDEYFIEAMVKTKEKTRADIVYPNVLLWSNWHKDIKMKNAWHESPNKITWKNMLDFNQIVVSCFIPKKLYFEVGGMANLPILEDYDFFLKCLKQGATFAKSPASVLRYRQREEGRNRKSHELKNEFTYTIRDKYASTRTKFHPQIIQLLRNVPGAGGATIGTECE

SEQ ID NO: 1995 - DNA, 1083 bp, Unknown
  Obtained from environmental sample
  misc_feature (1)..(1083): n is a, c, g, or t
atggactaccaatattcttgccgggaaaatgttatggggtcgaaaatttttgggcaagttcggagacaatgggttggggttagtcacgattcgcactttcttgatgccatttgcacacatgtagcagatgttgtaaaggaaaaattaaaaatctatactggtaactatagcttctggtacgagagcagccagctgncagcaaggcagttatctgacaagaataaaaaattagaggaaaagaaaaaggactactgggaatttattgcacgctttagcgcaaatgcttccaaatcgcgtcaagctacttcacgtaaaaaagctctggaaaaattggtgatcgaagaaatacagccatccaacagaaagtaccccggcataatttttaaacctgaaagagatgtgggaaatcaaatcttacatgttcaaaaactatctaaaaaaattgagggcagaaccttattctcccacatttcatttgatgtggtaaaggggcaaaaaattgcttttgtaagtaaggatgccgttgctttaactgcatttttcgatatcataaataataaattatctgccgacaccggcaaatttgaatggggctcgaccataacaacagcctatctccctaacgataacagcgaatattttaccggtaatctcagcttaatggattggctcaggcagtacgtaccacctcatgtaactgatgttgatgaagattttttaagaggatttttaggccgcatgttatttagtggcgatgagataatgaagaaaacatctgtgcttagcggcggtgaaaaggttcgttgcatgataagtaaaatgatgttgcaaaatcctaacgtcataatacttgatgagccaaccaatcatcttgatcttgaaagtatcaccgcttttaatgatggggtaataagttttccgggaatagttttatttactacccatgatcaccagtttacccaaacagttgctaaccgcattatcgaaataactccgaaaggcatgatagaccggctttacagctatgatgagtatttggcagatgagagaattaagacgttgcaacatgaaatgtataactaa

SEQ ID NO: 1996 - protein, 360 aa, Unknown
  Obtained from environmental sample
  DOMAIN (172)...(333): ABC transporter
  misc_feature (1)..(360): Xaa is any amino acid
MDYQYSCRENVMGSKIFGQVRRQWVGVSHDSHFLDAICTHVADVVKEKLKIYTGNYSFWYESSQLXARQLSDKNKKLEEKKKDYWEFIARFSANASKSRQATSRKKALEKLVIEEIQPSNRKYPGIIFKPERDVGNQILHVQKLSKKIEGRTLFSHISFDVVKGQKIAFVSKDAVALTAFFDIINNKLSADTGKFEWGSTITTAYLPNDNSEYFTGNLSLMDWLRQYVPPHVTDVDEDFLRGFLGRMLFSGDEIMKKTSVLSGGEKVRCMISKMMLQNPNVIILDEPTNHLDLESITAFNDGVISFPGIVLFTTHDHQFTQTVANRIIEITPKGMIDRLYSYDEYLADERIKTLQHEMYN

SEQ ID NO: 1997 - DNA, 537 bp, Unknown
  Obtained from environmental sample
  misc_feature (1)..(537): n is a, c, g, or t
atgatggaggaagccttttcaccctactatattaaacgatgttttaatttcggatacgtttttgcatggatgataaaggagacgaaaagattcggaaaaatcttgatgcattcccgcggatggcccggttatagtacctggatagagcgacatcctgctaccaataaaaccatcatcatttttgcaaatgccggtaatgcttttgaaaaattaggagctgtccgttaccttctttacaatatggaagagcctcctttgacagaagtacaactgaaccaaacccagaagcaatctcttaccggcaggtataaacttggtcaacaaatgatttctgtattgctggagaaagatacattatacatacaaagcaccagacagcctaaaaaaatagaactatttgcgaatgctgatggtagcttttttacaaaattcaaaggagaaatgctttggtttcaaaaaaataataaaaatgaaacgacccatttgctcattgacagttatagttatgccgacagggtgtttaaaaagatcgaataa

SEQ ID NO: 1998 - protein, 178 aa, Unknown
  Obtained from environmental sample
  misc_feature (1)..(178): Xaa is any amino acid
MMEEAFSPYYIKRCFNFGYVFAWMIKETKRFGKILMHSRGWPGYSTWIERHPATNKTIIIFANAGNAFEKLGAVRYLLYNMEEPPLTEVQLNQTQKQSLTGRYKLGQQMISVLLEKDTLYIQSTRQPKKIELFANADGSFFTKFKGEMLWFQKNNKNETTHLLIDSYSYADRVFKKIE

SEQ ID NO: 1999 - DNA, 894 bp, Unknown
  Obtained from environmental sample
  misc_feature (1)..(894): n is a, c, g, or t
gtggaatctgcgcaggcagctactgagcctcaaccttctgaagtggaaattcatgaagaagccctttctaccgctcatgacgatttcgactggagcatagacaagagaaacgttacggtttacaacaattcggaaagagaaaagtatgatgaggtttatgacaaaactttcaaacagatcaatgatggggaaatggttaccggtactgtggtagctatgactaagacagatgtggttattaatattggatttaaaagtgacggcctggttggtttgaatgaattccgtgacacacctaatttaaaagttggcgatgaagtggaagtgatggttgcagaaaaagaagataaagacggcaaccttcatttgagccgcaagcaagcccgcaccactcgtgcatgggaaaaaattgttgaaatgcacaaaagtggtgaaatcgttaccggtcttgttaccagcaaaaccaaaggcggacttattgtggatgtctttggaatggaaacattcttaccaggttcgcagattgatgtaaagcctgttacagactatgaccagtttgttggaaaaaccatggaattcaaagtggtgaaaattaatgaagccatcaagaatgccgttgtttctcacaaagcacttatcgaaagcgatattgaacaacagcgtgctgaaattatcggcaagttggaaaaaggacaagtattggaaggaactatcaagaatatcaccgatttcggtgcattcctcgaccttggcggcttagatggtttgctctatattacagatatcagttgggggcgtatcaatcatccaagtgaaatattgaaactggatcaaaaactgaatgtggttgtattggattttgatgatgataaaaaacgcatccagtctggctga

SEQ ID NO: 2000 - protein, 297 aa, Unknown
  Obtained from environmental sample
  DOMAIN (59)...(126): S1 RNA binding domain
  misc_feature (1)..(297): Xaa is any amino acid
MESAQAATEPQPSEVEIHEEALSTAHDDFDWSIDKRNVTVYNNSEREKYDEVYDKTFKQINDGEMVTGTVVAMTKTDVVINIGFKSDGLVGLNEFRDTPNLKVGDEVEVMVAEKEDKDGNLHLSRKQARTTRAWEKIVEMHKSGEIVTGLVTSKTKGGLIVDVFGMETFLPGSQIDVKPVTDYDQFVGKTMEFKVVKINEAIKNAVVSHKALIESDIEQQRAEIIGKLEKGQVLEGTIKNITDFGAFLDLGGLDGLLYITDISWGRINHPSEILKLDQKLNVVVLDFDDDKKRIQSG

SEQ ID NO: 2001 - DNA, 756 bp, Unknown
  Obtained from environmental sample
  misc_feature (1)..(756): n is a, c, g, or t
atgctccaggtgtcagtagtaattatcacatttaatgaagaaaaaaatatcgggcgatgtttagattctgtaaaagatgttggagatgatattgtagtgatcgactcattttcttcagacagtacagaaagtatatgcaaagtaaaaagtgtccgttttgtgcagcataaatttgaaggacacattgaacaaaaaaactgggcaattactcaggcacgatttccgcatattctttccttggatgcagatgaaacgctttccgaggaattaaaaaaatctattgttcatataaaaaataattgggtcaaggatggatattatatgaatcgtcttaccaattattgcggacaatggatttatcactgcggatggtacccggacagaaaacttcgcctatgggattcaagaaaaggtaaatggggaggaactaacccgcacgataaatatcagcttttcgaaggagaaaaggcaacaggttttttgaaaggaaatattttacattacagttacaattctatctcggaacattatagacaggctgataaattctcaactattgcttcgaaagagatgcatttgaaaggaagagccgtttctgtgccaatgatttatataaagaccgcatttaaatttttacgcaattattttattaagcttggatttttggatggtaaatacggctttattatctgtagaataacagcttgggaaacctatctgaaatacctaaagctttatcaattcaacagngaatga

SEQ ID NO: 2002 - protein, 251 aa, Unknown
  Obtained from environmental sample
  DOMAIN (5)...(178): Glycosyl transferase
  misc_feature (1)..(251): Xaa is any amino acid
MLQVSVVIITFNEEKNIGRCLDSVKDVGDDIVVIDSFSSDSTESICKVKSVRFVQHKFEGHIEQKNWAITQARFPHILSLDADETLSEELKKSIVHIKNNWVKDGYYMNRLTNYCGQWIYHCGWYPDRKLRLWDSRKGKWGGTNPHDKYQLFEGEKATGFLKGNILHYSYNSISEHYRQADKFSTIASKEMHLKGRAVSVPMIYIKTAFKFLRNYFIKLGFLDGKYGFIICRITAWETYLKYLKLYQFNXE

SEQ ID NO: 2003 - DNA, 705 bp, Unknown
  Obtained from environmental sample
  misc_feature (1)..(705): n is a, c, g, or t
atgaaagtaaggtatttattggcattcttaattatcagttctgcttcccttgcccagcaagtgagaaataagggagaatttcgtgatcatagtgcgggctattatgaaaattctatcatgcgcggcattgaagcttttgaaggcgaagtacaaaaagttgaaaaaaagaagccggcatttaaaattgatatttcgggacttgatgttccaaaatcagcaggtgagttcaagtcatggtggaagaatgaaccaatctcacaagggaacactggcacttgctggtcgttcagcacaacctctttttttgaaacagaagtttacaggctgcataagaagcaggtaaaaatttcagagatgtttactgcctactgggagtatgtggagaaggcaaggcggtttgtgcaggaaaggggtgattcacattttgatgaaggttctgaggcaaatgcagtagtacgtatctataaaatgtatggtgcaattccttacgagcaatacactgggatgttgaccggacagacttttttcaaccatgaaaagattgttactgagatgaaggaatatctccaaagtgtaaaagagatgaatgcatggaatgaagaactggtaatccagacaattaaatccatgcttaatcattatatgggagcgcctccattaatgggtaaggccggaacaaaagaaatcacaccaaaggatatttaa

SEQ ID NO: 2004 - protein, 234 aa, Unknown
  Obtained from environmental sample
  SIGNAL (1)...(18)
  misc_feature (1)..(234): Xaa is any amino acid
MKVRYLLAFLIISSASLAQQVRNKGEFRDHSAGYYENSIMRGIEAFEGEVQKVEKKKPAFKIDISGLDVPKSAGEFKSWWKNEPISQGNTGTCWSFSTTSFFETEVYRLHKKQVKISEMFTAYWEYVEKARRFVQERGDSHFDEGSEANAVVRIYKMYGAIPYEQYTGMLTGQTFFNHEKIVTEMKEYLQSVKEMNAWNEELVIQTIKSMLNHYMGAPPLMGKAGTKEITPKDI

SEQ ID NO: 2005 - DNA, 441 bp, Unknown
  Obtained from environmental sample
  misc_feature (1)..(441): n is a, c, g, or t
atgtcgaagatcaatatatccaataaaaaagcaactttcgagttcgagataattgataaatttacggcgggaattatgcttaccggaacggaaataaaatccatccgcgagggaaaagcaaatatgagcgatgcgtattgttccttcaccagcggcgaattatttgtgcgaaacctgcatatttccgagtatgatatgggaacgcattataaccacgaacccaaacgcgcacgtaagctgctattgcaaaaaaaagaactcaaaaaactcaatacaaaagttaaagaaaaaggccttaccattgttcctttaaagatatttttaagcggaacaggatatgcgaaaatggatatcgcgttagcaaaaggaaagaaaacatttgataagcgcgaaagcataaaagagcgcgatgtaaaaagagatatggaaagaagctattaa

SEQ ID NO: 2006 - protein, 146 aa, Unknown
  Obtained from environmental sample
  DOMAIN (3)...(70): SmpB protein
  misc_feature (1)..(146): Xaa is any amino acid
MSKINISNKKATFEFEIIDKFTAGIMLTGTEIKSIREGKANMSDAYCSFTSGELFVRNLHISEYDMGTHYNHEPKRARKLLLQKKELKKLNTKVKEKGLTIVPLKIFLSGTGYAKMDIALAKGKKTFDKRESIKERDVKRDMERSY

SEQ ID NO: 2007 - DNA, 579 bp, Unknown
  Obtained from environmental sample
  misc_feature (1)..(579): n is a, c, g, or t
gtgtttgtgaacggacttgatcttgacagcagtccgaatgaaataaaaaaaatcatcggtgttcaactgcaatcgagtggctattacccggctttaacattggttgaattaattgaactttttaatggcatgtacaataaaaatatgcccccgatgcagttgcttgaaatggtaagtcttaaagacaaagccaaagcaaaatttaaagaactcagtggcggtcaaaagcagcggttttcggttgccaccacgttgatcaatgatcccaaaattgtttttcttgatgaacccacaacaggtcttgatccgcaggcacgacgtaatttatgggatctgataaaagccattcgtgataaaggaacgacggttatcatcaccacacattatatggatgaagccgaagtgctctgcgaccgcgtagcaattatagatgcaggaaaaattattgcccttgcttcacccgatcaactgattgatgaactggtagccactggttttgaaaggccgaaagaagtgaagaaagcaaatatggaagatgtgttcattcaactgacgggacatgcgttgagagaggagtga

SEQ ID NO: 2008 - protein, 192 aa, Unknown
  Obtained from environmental sample
  DOMAIN (1)...(146): ABC transporter
  misc_feature (1)..(192): Xaa is any amino acid
MFVNGLDLDSSPNEIKKIIGVQLQSSGYYPALTLVELIELFNGMYNKNMPPMQLLEMVSLKDKAKAKFKELSGGQKQRFSVATTLINDPKIVFLDEPTTGLDPQARRNLWDLIKAIRDKGTTVIITTHYMDEAEVLCDRVAIIDAGKIIALASPDQLIDELVATGFERPKEVKKANMEDVFIQLTGHALREE

SEQ ID NO: 2009 - DNA, 300 bp, Unknown
  Obtained from environmental sample
  misc_feature (1)..(300): n is a, c, g, or t
ttgatgagttcgggggtttggttgaatatgatgaatgggtgcttcattttcaaaaccaaaaacaagatctgttttgccactgtatcttccaaatggtgcctggttgaaacatttttcagcgatgatgggaacaggtattttctcaaatacatccgttggaaaatcaagggtcaatatcgggccggattttttaaccatcaagcatccgctccggttgctattaaattttatttcattcccagcatgttccaggtgttcaaacaaaacgtgggccgatgccagagtggcatgtccgcatag

SEQ ID NO: 2010 - protein, 99 aa, Unknown
  Obtained from environmental sample
  misc_feature (1)..(99): Xaa is any amino acid
MMSSGVWLNMMNGCFIFKTKNKICFATVSSKWCLVETFFSDDGNRYFLKYIRWKIKGQYRAGFFNHQASAPVAIKFYFIPSMFQVFKQNVGRCQSGMSA

SEQ ID NO: 2011 - DNA, 897 bp, Unknown
  Obtained from environmental sample
  misc_feature (1)..(897): n is a, c, g, or t
ttgtgtgtgagatccgatatggatggctatgaagtgctgtacctgcataaccaaaatccggatacggcagacattccctttatttttattaccggaatgggagagaacctgcacatgcgtaaagggatgggcatgggagcagacgattatatcgtgaaaccatttgaagaaatggacctgctcaattccattgaaatgcggttaaagaaaaatatcatctacagaaaaaatttcagcacggataaggcagggctgcatgatttcctttccacagcaaaggcgcttgaagagctaaagcatatttcagaccacagaaaagtaaaaaacctgaaatcaaaggaaatactttacagagaggcagacgaagccgagcacctcgtctttgtgagccatggaaaagttaaaacgtataccatgacagagggaggtaaagagctgattaccggtttacataatgacaacgattttatctgctctcttgactttggaatgaaagtttataccgagtcggcaatggccctggttgacagtgaaatagtactgatcccaacagcggatttcttctccatcctctattcttcacgagatatagccatgagcttcatcggcatcttatccaacaacatgaataccatcaaagagcgcctgctcaaccttgcatatggttcagtacgccgccgggttgcaatcgggttattgtccattcaaaaacaaaatgaaacaccggcgccttcagaaatcaaaatctcacgtgaaaaccttgctagcctaatcgcgatcacgcccgaatccatcagtcgtaccctgcaggactttaaaaaagaaaagatcatcgagattaataagaaaggcattgtgattatagattctcaaaaactgagcaggatgaagaactaa

SEQ ID NO: 2012 - protein, 298 aa, Unknown
  Obtained from environmental sample
  DOMAIN (247)...(278): Bacterial regulatory proteins, crp family
  misc_feature (1)..(298): Xaa is any amino acid
MCVRSDMDGYEVLYLHNQNPDTADIPFIFITGMGENLHMRKGMGMGADDYIVKPFEEMDLLNSIEMRLKKNIIYRKNFSTDKAGLHDFLSTAKALEELKHISDHRKVKNLKSKEILYREADEAEHLVFVSHGKVKTYTMTEGGKELITGLHNDNDFICSLDFGMKVYTESAMALVDSEIVLIPTADFFSILYSSRDIAMSFIGILSNNMNTIKERLLNLAYGSVRRRVAIGLLSIQKQNETPAPSEIKISRENLASLIAITPESISRTLQDFKKEKIIEINKKGIVIIDSQKLSRMKN

SEQ ID NO: 2013 - DNA, 783 bp, Unknown
  Obtained from environmental sample
  misc_feature (1)..(783): n is a, c, g, or t
atgaaacgtgcaatggttgacaaagagaatttctatggtgagattctcaaatatcataagactggaacaaaatactggacacaggttaccattacaccgattacagatgataaaaatgctgaaacgaaatttatctctattgaaagtaatataacacaacgaaaggtggcagaagaaaagatgaaacaatatctgcagaaccttgaaaagaccaatgcagaactcgataagttcgcttatgttgtatcacatgatctgaaagcaccgctgcgtgcaatcggcaacctgacaggatggattgaagaagacataggtgataaacttccacaggaagcaatggatcatttcacaacgattaaaaatcgtgttgtgagaatggaaggacttattaatggaatactcgattatacaaaggcgaataaaaacggcggcaaagaggaaacattcaaaagtgaagacttgattcgcgaatcaatagagttgattggcgttccggaaaatgtaattattaatatacgtcccggtctacctgttatgaaagctgaaaaaacaaaactccaccaggttttcatgaacataattcacaatgcaataaaatataatgataaggaagatgtacaggtggatataagtgcagaggaaaatggttgtgactggcaattcaaaataaaggacaatggtccgggcatagagtcgcgttttcacgataagatctttgtaatctttcnaacattnaattcaggnatgaaatggagagtcgcgncgtangacttgcatagttaa

SEQ ID NO: 2014 - protein, 260 aa, Unknown
  Obtained from environmental sample
  DOMAIN (181)...(259): Histidine kinase-, DNA gyrase B-, and HSP90-like ATPase
  misc_feature (1)..(260): Xaa is any amino acid
MKRAMVDKENFYGEILKYHKTGTKYWTQVTITPITDDKNAETKFISIESNITQRKVAEEKMKQYLQNLEKTNAELDKFAYVVSHDLKAPLRAIGNLTGWIEEDIGDKLPQEAMDHFTTIKNRVVRMEGLINGILDYTKANKNGGKEETFKSEDLIRESIELIGVPENVIINIRPGLPVMKAEKTKLHQVFMNIIHNAIKYNDKEDVQVDISAEENGCDWQFKIKDNGPGIESRFHDKIFVIFXTXNSGMKWRVAXXDLHS

SEQ ID NO: 2015 - DNA, 825 bp, Unknown
  Obtained from environmental sample
  misc_feature (1)..(825): n is a, c, g, or t
atgggttgtaatctaaacacagactttgttttggcagaactcgaacaaaataatagttcacatatctatcttttgaaccaaaccctgaaaaattgtattgacgattttgtagaaggatacaacatttgggaaacaagtaaaggtgaacttattaataaaatggcactaacattagaaaaacttcatttcttgggtgaatatcctgacgcattaaacacaatttcaacttatattaaaaaacaattagcagctcgtggcgtctctgaaggacaattaaattatgtccaaaaagtccttccttctaaatataaaaatgaaaatttagctcgtgatcaaagtggcgataatattatcgccgattccggatctgaaatgaatagagtagcagtagaagaacaaccagaagtaccaacagtgaatatttattctctcaagaaaaaactagaaaattattcaccaactgaattacaaaattatgctctaggattagaacaaaaacaaaaacatattcgtaacaatatgaaagcagaaaaagacgtacttgaatttgtatctataaagaaaaagattccattaccaaaatacaagaaagtatcttcagacgtaccacctgaacacctgcagggtccaacattaatgtatcacaaactcaaagaaatgagtgcaacagtatttgatatttacaaatacctggaagacgttgccaaatcagtttatgaattccccaccagaataaaaaatgttcggaagaatgtgctaaacagatggatatatttcatagaggtgtactgcaaacaatcaaaaatgataattggttccatataa

SEQ ID NO: 2016 - protein, 274 aa, Unknown
  Obtained from environmental sample
  misc_feature (1)..(274): Xaa is any amino acid
MGCNLNTDFVLAELEQNNSSHIYLLNQTLKNCIDDFVEGYNIWETSKGELINKMALTLEKLHFLGEYPDALNTISTYIKKQLAARGVSEGQLNYVQKVLPSKYKNENLARDQSGDNIIADSGSEMNRVAVEEQPEVPTVNIYSLKKKLENYSPTELQNYALGLEQKQKHIRNNMKAEKDVLEFVSIKKKIPLPKYKKVSSDVPPEHLQGPTLMYHKLKEMSATVFDIYKYLEDVAKSVYEFPTRIKNVRKNVLNRWIYFIEVYCKQSKMIIGSI

SEQ ID NO: 2017 - DNA, 906 bp, Unknown
  Obtained from environmental sample
  misc_feature (1)..(906): n is a, c, g, or t
gtggtacgttacacacgcaatgaagacgaaaagcttctgagctttgaagacgatgtacgttcttataacatcacaaaattccgcaaaacaaatcagagcacttgcgttaacttacgccctgttgttaagaaaggcgagaaagttaaaaaaggacaagtgctgagcgaaggttacggaactcaggatggagaacttgcacttggaagaaacctggttgtggcgttcatgccatggaagggttacaacttcgaggatgcaatcgtaatttccgaaagaattgttcgcgaagatatcttcacctctattcacgtggatgaatattcacttgaagtgcgtgaaacaaaacgcgggatggaagaattaacttctgatattccaaacgtaagtgaagaagcaacaaagaatcttgacgaaacaggaatcatccgtgttggctgcgaagtgaaagaaggagatatcctaatcggaaagatcactccaaaaggagaaacagatccttctccggaagaaaaacttcttcgcgcgatcttcggtgacaaagccggtgatgtgaaagatgcttctttacgaatgccctcttccacgtacgggatcgtaatggaaacaaagctcttctcacgcctgatgaaggacaagaaagcaaaatcagacgagaaagatgttcttgataaaatagacaaggaattcaatcaaaaatttggtgaattaaaaacgcgactggttgaaaaattgatgatactcgttagcggaaaatcttcacagggagtaaataactacctgaaagaagaactcgtgggacgcggagttaattcactgaaaagcttcttaacaagatcgatgattatactgaaagttaatccataccaatggactacccgcaagggaatgaacgatcagatctattaa

SEQ ID NO: 2018 - protein, 301 aa, Unknown
  Obtained from environmental sample
  DOMAIN (2)...(253): RNA polymerase Rpb2, domain 6
  misc_feature (1)..(301): Xaa is any amino acid
MVRYTRNEDEKLLSFEDDVRSYNITKFRKTNQSTCVNLRPVVKKGEKVKKGQVLSEGYGTQDGELALGRNLVVAFMPWKGYNFEDAIVISERIVREDIFTSIHVDEYSLEVRETKRGMEELTSDIPNVSEEATKNLDETGIIRVGCEVKEGDILIGKITPKGETDPSPEEKLLRAIFGDKAGDVKDASLRMPSSTYGIVMETKLFSRLMKDKKAKSDEKDVLDKIDKEFNQKFGELKTRLVEKLMILVSGKSSQGVNNYLKEELVGRGVNSLKSFLTRSMIILKVNPYQWTTRKGMNDQIY

SEQ ID NO: 2019 - DNA, 585 bp, Unknown
  Obtained from environmental sample
  misc_feature (1)..(585): n is a, c, g, or t
ttgaaaatttgttttgggggggggatttttagaaagcaacgatactttttttacatggatgaagaaataacttatttatgcaaaaatattaacagcttgaacccatgcataaatcaatacccctattatttaacgcaagtaggaaaagaatttgaaaaacaaataaaagatgatgcacaagaatgcttcaactcctttaaagaagactttactgacatgaattatgaggttgcagcaggacctttaacaactacaactaaactaaagccatctgttatagaaatagctttagagagcgaagtttcattagaaaaaaatgggatacctagaacatttaacagatttgacactttcatacctacaaaactacatgatattgcttttgttactaatgaaatcttaactcaggaggcaaagtattgttactttagcgttgaaggttttatggcattatatacggactttaagattacctcttttttgctggacgatactacaaatatttatacaattaaaaataaagaaagccaggaagaattaaagatggccgtaagaggatgcgcaatgccgggaggatacttttaa

SEQ ID NO: 2020 - protein, 194 aa, Unknown
  Obtained from environmental sample
  misc_feature (1)..(194): Xaa is any amino acid
MKICFGGGIFRKQRYFFYMDEEITYLCKNINSLNPCINQYPYYLTQVGKEFEKQIKDDAQECFNSFKEDFTDMNYEVAAGPLTTTTKLKPSVIEIALESEVSLEKNGIPRTFNRFDTFIPTKLHDIAFVTNEILTQEAKYCYFSVEGFMALYTDFKITSFLLDDTTNIYTIKNKESQEELKMAVRGCAMPGGYF

SEQ ID NO: 2021 - DNA, 942 bp, Unknown
  Obtained from environmental sample
  misc_feature (1)..(942): n is a, c, g, or t
ttgaccgaatctttattgaaaaatcaaaattcttttgccgaactacaccctagcaaaggtcttgaggccggggcttcagaaattatatatgctttgaagatttatacatcttctcttgatgaagtatttcgcaaattagaacttttcttaaactccaaaatactgcgtactgaatttgaaaaaatagtcacttcgataagattatataagattgaaaaaccattggttttactggcatctaattatggtgtaccacaaaatagagagcgtgtcgtatttattgggtgtagaaaagatcaaaaactaattaaggaaattcccgcaaccgttaaagaatctgagcgggttacaatatttgaagcgctctacgatctagactttataggaaataatgacgaaaaatttgattacgaggttactaatttaaaatcaaaatacaatggtaagacttccaaattatcagccttgttatcaaaaagagagatagatggcaaaataaatagtacaaaaggaaaaacttacgctgaatggtcaagggtaggcaggctaaatggccgcttttcaaacgctaaattcccattttatataaaatcaattaaagagctagcagactcttcatctcgattttcagctaaactccataatcataaaaccagtaaacaaaatagtgatgtaattaatcgattagaactaattttgaacaatggtgattactcatcctcaaaatcagctcttagaaaagcgggattagattccgaaaaaagaaattataatgtattaaaaccagatgctcaaagtcccactgtaatgacaattcccgatgattatattcattattctagtcttcgtgccttgacggttcgagaaatggctagattgcaatctttcgatgatttctttgtatttcaaggaaaacgttccactggtggaaataaaacgtaa

SEQ ID NO: 2022 - protein, 313 aa, Unknown
  Obtained from environmental sample
  DOMAIN (10)...(310): C-5 cytosine-specific DNA methylase
  misc_feature (1)..(313): Xaa is any amino acid
MTESLLKNQNSFAELHPSKGLEAGASEIIYALKIYTSSLDEVFRKLELFLNSKILRTEFEKIVTSIRLYKIEKPLVLLASNYGVPQNRERVVFIGCRKDQKLIKEIPATVKESERVTIFEALYDLDFIGNNDEKFDYEVTNLKSKYNGKTSKLSALLSKREIDGKINSTKGKTYAEWSRVGRLNGRFSNAKFPFYIKSIKELADSSSRFSAKLHNHKTSKQNSDVINRLELILNNGDYSSSKSALRKAGLDSEKRNYNVLKPDAQSPTVMTIPDDYIHYSSLRALTVREMARLQSFDDFFVFQGKRSTGGNKT

SEQ ID NO: 2023 - DNA, 672 bp, Unknown
  Obtained from environmental sample
  misc_feature (1)..(672): n is a, c, g, or t
atggaccaaacacaaggcgacatatttcaccacgaccccgaattagacaaatcagtgaagggcgctattagccaactcacgaaacattcaaagacatttgagcgaaaagttcgtccaccaaatccaaagttgcaggcgaagtcccaggagatcatgcaagaggtcggaaagacccgcggccgtcctttgttttttcaatttattggctctggtctgggtcaaggcccttacgtggagctgattgatggcagcgtaaagctggatttgattaacggcattggcattcacattttggggcattcccatccggtcgtggtcgaagcagcggttcgtggtgccctgtctgatatcgtgatgcagggaaaccttgagcccaatgaagagtattataagtttagtaagaaacttttagaaatcgccgcccgcggcagtcgcttccgccatgtctggctttccacatgtggaacaatggcgaatgaaaatgcaatcaaggcgtgtcgacaaaaaactaaagcagcgcgaatagtgattgctatggatgcagcgttctctggccgctcgacgatgatggctgaggttacggacaatcccagcttcaaagaggggcttcccaattacaatgaagtcatgcggattcctttttatgacaaaaaggaccctaagaagttctga

SEQ ID NO: 2024 - protein, 223 aa, Unknown
  Obtained from environmental sample
  misc_feature (1)..(223): Xaa is any amino acid
MDQTQGDIFHHDPELDKSVKGAISQLTKHSKTFERKVRPPNPKLQAKSQEIMQEVGKTRGRPLFFQFIGSGLGQGPYVELIDGSVKLDLINGIGIHILGHSHPVVVEAAVRGALSDIVMQGNLEPNEEYYKFSKKLLEIAARGSRFRHVWLSTCGTMANENAIKACRQKTKAARIVIAMDAAFSGRSTMMAEVTDNPSFKEGLPNYNEVMRIPFYDKKDPKKF

SEQ ID NO: 2025 - DNA, 600 bp, Unknown
  Obtained from environmental sample
  misc_feature (1)..(600): n is a, c, g, or t
gtgaatggattagcacnggtctgttttactccagatagtagatacattcttggagaatactcatttgaaaaaaaagtaaatctttgggatactcaaacaggtgaacttgttacgacacttccaattaatctacaaattgggtcaatggatatttcaccagatggttctaaaatcgctttatcctgttatcataaaattcaagtttggagtttgataagccaaaagcaactcttatcagttgatgataattcagtaaatggttttgctattaaatatagccatgacggcaaaaaattagctgtcggtttgggaagtggagaaataaaaatcttggattctgaaacattgaatttgctttattcattgcaaggtcattttaaaccagttctttctgttgcatttagcaaagacgacaagaatttgattagtggttcatctgaccaaatggctaaactttggaatctccaaactaaagttgaattaaaatcattagtcaatgagcataaaggtcaggtgagttctgttgcttttagtccaacttcaaatttatttgcgacaacaggtgatgacaaactaatcagattatggaagattcaatga

SEQ ID NO: 2026 - protein, 199 aa, Unknown
  Obtained from environmental sample
  DOMAIN (117)...(154): WD domain, G-beta repeat
  misc_feature (1)..(199): Xaa is any amino acid
MNGLAXVCFTPDSRYILGEYSFEKKVNLWDTQTGELVTTLPINLQIGSMDISPDGSKIALSCYHKIQVWSLISQKQLLSVDDNSVNGFAIKYSHDGKKLAVGLGSGEIKILDSETLNLLYSLQGHFKPVLSVAFSKDDKNLISGSSDQMAKLWNLQTKVELKSLVNEHKGQVSSVAFSPTSNLFATTGDDKLIRLWKIQ

SEQ ID NO: 2027 - DNA, 954 bp, Unknown
  Obtained from environmental sample
  misc_feature (1)..(954): n is a, c, g, or t
ttggcaatacttcaaccttacctattaccggttatcggaaaagcgagcctaaatattctaaagatcattcatgaagatcttgtgcttgatctaggtaatcttctgcaacaagctaagaagagcgggaagcctgcctccaaggtcgtgcttcttctgaataacagcattagtcgaaaggaaattttaattgaggtgattcctgcgtgggtgtccgaagagccattctacttagtcgtatttaaggatcattcaacattagctcctgcaacagaggaaaagacaagtaaacagagaaaaggcgcaagcagtaagattttgaggcttgaggaagaattgagtcaatcgcgcgcgctcgttcgggcgtccaacgaggaatatgaaacttcggttgaggagttgcaggccaatagtgaggaaattctctcatcaaacgaagaattgcaaagcgtaaacgaagaactggaatcttcaaaggaggaactgcaatcggcaatagaagaattgacgactacaaatattgaattgaataccagaaacgttgacctcgataaatcccaaaaatccctcaggaaagttaatgagcagcttgaacagtttgcattcatttccagtcatgatttgcaggagccgctccgaaagattcagacgtttgccgacaggcttttgaatgaccagtcaaatttgaatgaatacgccaaagactatgcgaagaaaataggtgcatcctcagctaaaatggcatcgcttataaaggacctgctcagtttttctattttaagccgatcagaaaaaaaatcagtgcctgttgatcttaatcgtgtgttaacggaagttttggaagattttgaaattgcgatagaagagaaaaaggcagtatttacaatcgacacgttgccagtccttcaagcggaacccattcagatgaatcagctcttcataacctatcaaagataa

SEQ ID NO: 2028 - protein, 317 aa, Unknown
  Obtained from environmental sample
  DOMAIN (195)...(262): His Kinase A (phosphoacceptor) domain
  misc_feature (1)..(317): Xaa is any amino acid
MAILQPYLLPVIGKASLNILKIIHEDLVLDLGNLLQQAKKSGKPASKVVLLLNNSISRKEILIEVIPAWVSEEPFYLVVFKDHSTLAPATEEKTSKQRKGASSKILRLEEELSQSRALVRASNEEYETSVEELQANSEEILSSNEELQSVNEELESSKEELQSAIEELTTTNIELNTRNVDLDKSQKSLRKVNEQLEQFAFISSHDLQEPLRKIQTFADRLLNDQSNLNEYAKDYAKKIGASSAKMASLIKDLLSFSILSRSEKKSVPVDLNRVLTEVLEDFEIAIEEKKAVFTIDTLPVLQAEPIQMNQLFITYQR

SEQ ID NO: 2029 - DNA, 549 bp, Unknown
  Obtained from environmental sample
  misc_feature (1)..(549): n is a, c, g, or t
atgtatgtactgcatccctggcatggcgcgcatcatggcgaaaacgcgcccgttactatcaatgccctgatcgaaatccccgaaggaagtaaatgcaaatacgagattgataaaaaaaccgggctgctgaagctggaccgggtgatctactcatcttttcattacccggtgaattatggctttattccccagacattgggagaagacaatgatccgcttgatgtgttggtgatgtgcagcgagtcggtgcaggcactttgcctggtagaagctacagtcatcggaaatatgcaaatgatcgatagcggtgaaaaagatgacaagatcatcgctgtggctgcaaaagacccttctgttaatcacatcaggaacattaacgaaataccgcctcactttttcgcagtgctgaaaaattatttcgagcagtataaggttcttgaaaataaaaaagtagagatagatgatttccaggataaagaagcggcgtacaaagtaatctccgaagcaatctcattttacaaaacaagattcccggcatcatccaagtaa

SEQ ID NO: 2030 - protein, 182 aa, Unknown
  Obtained from environmental sample
  DOMAIN (21)...(175): Inorganic pyrophosphatase
  misc_feature (1)..(182): Xaa is any amino acid
MYVLHPWHGAHHGENAPVTINALIEIPEGSKCKYEIDKKTGLLKLDRVIYSSFHYPVNYGFIPQTLGEDNDPLDVLVMCSESVQALCLVEATVIGNMQMIDSGEKDDKIIAVAAKDPSVNHIRNINEIPPHFFAVLKNYFEQYKVLENKKVEIDDFQDKEAAYKVISEAISFYKTRFPASSK

SEQ ID NO: 2031 - DNA, 552 bp, Unknown
  Obtained from environmental sample
  misc_feature (1)..(552): n is a, c, g, or t
atgcttccagctcctgtaaatcgaaacatgtctcaagacattgaacatcacatccttgaaagattcgaaatcgttgaaaagctcggtcaaggcagcagcggtatcgtctggaaagcaatctacaaaaaatacaagcaagtcattgtcataaagaaaatttgtgatgcttttacaactcctacagacgccaagaggacactaagagaagtcttgtaccatcaggagttcagtgatcatgagaatattgtctgccttctcaatgttatcaaagctaagaatggaaaagatctttatctaattttggattatatggacactaacttgcataatgttataagggcaaagatcctcactcttgatcacataaagttcataacaactcagctgcttagagcagttatgtatattcattcaggagaagtcatacatagagacatcaaatcagccaatattcttgttgacgctgattgccatataaaagtaatcctaaccttcttgttcagtcttttttccatttctcccttaaaacccaagtttaacaatattagctga

SEQ ID NO: 2032 - protein, 183 aa, Unknown
  Obtained from environmental sample
  DOMAIN (22)...(182): Protein kinase domain
  misc_feature (1)..(183): Xaa is any amino acid
MLPAPVNRNMSQDIEHHILERFEIVEKLGQGSSGIVWKAIYKKYKQVIVIKKICDAFTTPTDAKRTLREVLYHQEFSDHENIVCLLNVIKAKNGKDLYLILDYMDTNLHNVIRAKILTLDHIKFITTQLLRAVMYIHSGEVIHRDIKSANILVDADCHIKVILTFLFSLFSISPLKPKFNNIS

SEQ ID NO: 2033 - DNA, 327 bp, Unknown
  Obtained from environmental sample
  misc_feature (1)..(327): n is a, c, g, or t
ttgagtttaactctttccaaaagcaacgggaacgatcataatgaaacagtcgaaatattccaatgtcagattgaattgcaaaagcctgtggttaatattgaaaatagaaaaaagcttaaagcagaaattgcccatttagaaaaatttagaagttctatagaaaataaattgagtaatcagaagtttttacaaaacgcaaagccagaagtaatagcattggaaaaaaagaagatgagtgacacgattgaaaaaataaaagctttaaaggacactatgggaacgatatctttggaagactttttgaatgatagagattctacagattaa

SEQ ID NO: 2034 - protein, 108 aa, Unknown
  Obtained from environmental sample
  misc_feature (1)..(108): Xaa is any amino acid
MSLTLSKSNGNDHNETVEIFQCQIELQKPVVNIENRKKLKAEIAHLEKFRSSIENKLSNQKFLQNAKPEVIALEKKKMSDTIEKIKALKDTMGTISLEDFLNDRDSTD

SEQ ID NO: 2035 - DNA, 540 bp, Unknown
  Obtained from environmental sample
  misc_feature (1)..(540): n is a, c, g, or t
atgaacaggcaggtggaaactattttgaaatcagcattaatggaaaggcaggaagtagagctaaacctgaaacctattaatgtacaccaggtaattgaagatgtcgtagataattttatgctgcggctagatgaaaaaggaggtacacttgaaatgaatttacacgcagggcaatttatcattgaagcagatgaagttcacttttctaaccttatcaataatttgctggacaatgctgtgaagtactccaaagaaaatgttccgccaaaagtttgcattaccactacttctaatgcaaaaaagattttcataaaaattgaagacaatggcattggtatgacaagggaaaccttgaaacgcatatttgaaaaattttacagggcccacacaggcaatattcataatgtaaagggttttggcctgggattgagttatgtcaaaaccgttgttgaagcacatgaaggagtaataaaagcagatagtattttaggtaaaggaagctgttttaccatagaattaccattgcaaaaggaattataa

SEQ ID NO: 2036 - protein, 179 aa, Unknown
  Obtained from environmental sample
  DOMAIN (63)...(176): Histidine kinase-, DNA gyrase B-, and HSP90-like ATPase
  misc_feature (1)..(179): Xaa is any amino acid
MNRQVETILKSALMERQEVELNLKPINVHQVIEDVVDNFMLRLDEKGGTLEMNLHAGQFIIEADEVHFSNLINNLLDNAVKYSKENVPPKVCITTTSNAKKIFIKIEDNGIGMTRETLKRIFEKFYRAHTGNIHNVKGFGLGLSYVKTVVEAHEGVIKADSILGKGSCFTIELPLQKEL

SEQ ID NO: 2037 - DNA, 765 bp, Unknown
  Obtained from environmental sample
  misc_feature (1)..(765): n is a, c, g, or t
atgaagttgtttaatgcaatattttatcaatacagaaaaaacaaaacagtcaaagaaagtaagagaattcagaatcaggaactaaacacaataaaaaagtattttgaaaatggccagattccctggtcagaaggctatcaattacacaaagaaaaatcaattactgaaagtcttaataccgaaggaattctacagaaatttggagacaatgagattatttcaaagtttggatatcgtttagatgaaagaatagtagaatacccctggatttttaataaccttaaaaaagaaaattgtaaattattagatgcaggctctacctttaatttcaaatatattctggaacatgccctgatagaaaataaagatttaacgatttttaccttcgcgccagaaagtcctaatttcaatgagaaaagaatttcttatgtatatggagatttacgggatttaccatttaaagatggatattttgacgtggtgatttcacaatctactattgagcacataggcatgaataattctatttatggctacgatagtgattacnataaaaaaatggaaataaaatcttatgaatttctttatgcgattagggaaatggtaagggtttttgaaaccccgaggccacgctttttatcactgttccttttggggaagttgagaaatcatgatttttttcagcaattcaaaaacgaaatgttgccaaaaattgttgaaacaaatttttctttaaaaggaaattacaaaactacttttttttaa

SEQ ID NO: 2038 - protein, 254 aa, Unknown
  Obtained from environmental sample
  misc_feature (1)..(254): Xaa is any amino acid
MKLFNAIFYQYRKNKTVKESKRIQNQELNTIKKYFENGQIPWSEGYQLHKEKSITESLNTEGILQKFGDNEIISKFGYRLDERIVEYPWIFNNLKKENCKLLDAGSTFNFKYILEHALIENKDLTIFTFAPESPNFNEKRISYVYGDLRDLPFKDGYFDVVISQSTIEHIGMNNSIYGYDSDYXKKMEIKSYEFLYAIREMVRVFETPRPRFLSLFLLGKLRNHDFFQQFKNEMLPKIVETNFSLKGNYKTTFF

SEQ ID NO: 2039 - DNA, 600 bp, Unknown
  Obtained from environmental sample
  misc_feature (1)..(600): n is a, c, g, or t
atgcaggctctacctttaatttcaaatatattctggaaacatgccctgatagaaaataaagatttaacgatttttaccttcgcgccagaaagtcctaatttcaatgagaaaagaatttcttatgtatatggagatttacgggatttaccatttaaagatggatattttgacgtggtgatttcacaatctactattgagcacataggcatgaataattctatttatggctacgatagtgattacaataaaaaaatggaaataaaatcttatgaatttctttatgcgattagggaaatggtaagggttttgaaacccgaaggcacgcttttaatcactgttccttttgggaagtttgagaatcatgatttttttcagcaattcgataacgaaatgttgcaaaaattgttgaacgaattttctttaaaaggaaattacaaaactactttttttaaatacttaccagacggctggtattgttgcaacgaatcagactgtagtgaaatggtatcgtttaatcctcatacaaataaagggaaagcggatgatggtgcggcacattgtagaagcttatgttgtattaagttcgtaaagcatttatga

SEQ ID NO: 2040 - protein, 199 aa, Unknown
  Obtained from environmental sample
  misc_feature (1)..(199): Xaa is any amino acid
MQALPLISNIFWKHALIENKDLTIFTFAPESPNFNEKRISYVYGDLRDLPFKDGYFDVVISQSTIEHIGMNNSIYGYDSDYNKKMEIKSYEFLYAIREMVRVLKPEGTLLITVPFGKFENHDFFQQFDNEMLQKLLNEFSLKGNYKTTFFKYLPDGWYCCNESDCSEMVSFNPHTNKGKADDGAAHCRSLCCIKFVKHL

SEQ ID NO: 2041 - DNA, 768 bp, Unknown
  Obtained from environmental sample
  misc_feature (1)..(768): n is a, c, g, or t
ttggatctttggagagagattaaggctctatcggaagagaagagaacaaatattgttcttgcattagatccatcgtcagaaaaaaaagatatccttgattatgttatcaaacagataaaagatctaagtggctattgttgtgctataaagataaattttcatgttattttacctttatcgagggctgaactacagaaaataacaaagaccgcacatgattacaaattacaggtaatagcagatttaaaattaaatgacatatatgacaccaataaagttgtaatacaacagcttttgtcaatgggttttgattgtttaattattaatccttttattggaaagaacagtttgagaacaatcacacaatatgcacactctctgaattttggcataatcacattagtttacatgagccatccggatgcattagaaggatacggtgcattagttcaatctggacctgcctcacaaaaaaaagacttatctttcccactatataggacattctatgataattctcttttagcaggtgtggatggcatagtaattggaggtaacaggacagaagtgatagcggaattttgctctggtcaaacatctatgcttcccatatattctccaggtcttattacgcagggtggagacgtcaacaaggccttggaatcgggctcgagtttcttaattattggcagagccatactcgaatctgattctcctgttaatactttaaaaactattcatgagaagatatcaaacnaaaagtcatag

SEQ ID NO: 2042 - protein, 255 aa, Unknown
  Obtained from environmental sample
  DOMAIN (16)...(246): Orotidine 5'-phosphate decarboxylase / HUMPS family
  misc_feature (1)..(255): Xaa is any amino acid
MDLWREIKALSEEKRTNIVLALDPSSEKKDILDYVIKQIKDLSGYCCAIKINFHVILPLSRAELQKITKTAHDYKLQVIADLKLNDIYDTNKVVIQQLLSMGFDCLIINPFIGKNSLRTITQYAHSLNFGIITLVYMSHPDALEGYGALVQSGPASQKKDLSFPLYRTFYDNSLLAGVDGIVIGGNRTEVIAEFCSGQTSMLPIYSPGLITQGGDVNKALESGSSFLIIGRAILESDSPVNTLKTIHEKISNXKS

SEQ ID NO: 2043 - DNA, 321 bp, Unknown
  Obtained from environmental sample
  misc_feature (1)..(321): n is a, c, g, or t
atgaatgaggataaaatatttgcattaagaaaaatcaagtatcaaggtacaatgatgatcaatatttgcgacatagatttgctaggtaaggaaattaacaagggcgactttgtaattgacatatcagaagactatttccttcaagaaaagatagatgaagaagaggccatcattttactgaaatcgtcctctgtcctaaacttggtaggtgagaaaatagtgaaactagcattaaaacttaaacttgccaaggaaaatagtgtaaaggtgatagagaatattcctttcttgatggtatttagttttgtaggtaattattag

SEQ ID NO: 2044 - protein, 106 aa, Unknown
  Obtained from environmental sample
  DOMAIN (9)...(102): Protein of unknown function (DUF424)
  misc_feature (1)..(106): Xaa is any amino acid
MNEDKIFALRKIKYQGTMMINICDIDLLGKEINKGDFVIDISEDYFLQEKIDEEEAIILLKSSSVLNLVGEKIVKLALKLKLAKENSVKVIENIPFLMVFSFVGNY

SEQ ID NO: 2045 - DNA, 639 bp, Unknown
  Obtained from environmental sample
  misc_feature (1)..(639): n is a, c, g, or t
atgaaaaaacatctgtttatcaccgcactgcttatgttaactgtaataaattatacaggtgcgcagatctatgcaaaaaatgaagctgggtttataacctacaatgaaatagttgatgttgattctatctccaggaaaaaactatacagtaatgcaataacatggattacgacgttgaagaaacttggacacaagatcgaattctctgtgaaagattctattaatggaaaacttgttacaaagaatgaattttccgtttacaccggaagtggtgtacttgaaaagctttcaggaaagtttaattaccatgtaaccatagaagtcaaagacaaccgctatcgttataccataacggattttatctatcacgaatataagccggaccgataccataacattcaggcaactggcaaaacaaaaaatcttgaggaaactaaagctactggctggcaaaagttatgggataaacaccgaaagactttagatgaaaagattaagaaggatattagtaatctcaaggtttatatgattactaaaccccaagtatcagatcctttaccgcccaaaaaggaagttaaatggggaagattagggcgctccctaaaatcttccagaacaaataatgatcgggctacgtag

SEQ ID NO: 2046 - protein, 212 aa, Unknown
  Obtained from environmental sample
  SIGNAL (1)...(20)
  misc_feature (1)..(212): Xaa is any amino acid
MKKHLFITALLMLTVINYTGAQIYAKNEAGFITYNEIVDVDSISRKKLYSNAITWITTLKKLGHKIEFSVKDSINGKLVTKNEFSVYTGSGVLEKLSGKFNYHVTIEVKDNRYRYTITDFIYHEYKPDRYHNIQATGKTKNLEETKATGWQKLWDKHRKTLDEKIKKDISNLKVYMITKPQVSDPLPPKKEVKWGRLGRSLKSSRTNNDRAT

SEQ ID NO: 2047 - DNA, 588 bp, Unknown
  Obtained from environmental sample
  misc_feature (1)..(588): n is a, c, g, or t
ttgatgcaggtagaatctacaataagttcattgaaattgcctggcatttgtacaaaaatagaagaacaaattcgacactcgattaaatattatattattaaacttcaaaaaaccaaacgcactatgaattcaaaagagttaaaagaagaaatgaaaaacttaccgatccgagcagtgtatctggattatggacgcgtattcgtacaataccttcctgctccggaaatagtttctgcaggaggaattcagcaaattgaattacatgacgaaacgacaaagatcgctttaatggtatcaatgccagaccgcttcaaagatccaaagaacaatcccgacaatgtcaaagaaggtgatatcgttattgtcaatcatcaggctggaaacaaattaaaaattccatttcgctctgctaccgaacacccaatttttgcaatgtgggcaacggatatccttgctgtatggacgcaagctccggaagactactacaacatgatttctgctcaacgcgaagcggatcgtagaaagaatctcggactgccagaaagtgaagttgaaactgcaaaagatccaaagccttctgaaaattaa

SEQ ID NO: 2048 - protein, 195 aa, Unknown
  Obtained from environmental sample
  misc_feature (1)..(195): Xaa is any amino acid
MMQVESTISSLKLPGICTKIEEQIRHSIKYYIIKLQKTKRTMNSKELKEEMKNLPIRAVYLDYGRVFVQYLPAPEIVSAGGIQQIELHDETTKIALMVSMPDRFKDPKNNPDNVKEGDIVIVNHQAGNKLKIPFRSATEHPIFAMWATDILAVWTQAPEDYYNMISAQREADRRKNLGLPESEVETAKDPKPSEN

SEQ ID NO: 2049 - DNA, 903 bp, Unknown
  Obtained from environmental sample
  misc_feature (1)..(903): n is a, c, g, or t
atgtgtagtttacttcagaatgatgaggagtatggttttaagcttaaaattctcttgccgaaattgcatgactatacctacaatcagaatcctgagagatttggcattttaaatagaattgagttagaatccactggtgataaatatactcttcctgaaatgtccagtcaacatagcgctgtatcgttaagtgaaccccaaatgattactttacgattggccaagctaatgaccaatacagagagtagtttcgataataatctcctaagacttgtgattcctgtaactatagacccagatttaagttcttttaattacaaaagtttaaaaataaacgattctgtggtagtcgcaggattggtggaaattgcagtagataataagcaatatcatcttttcaaatatcgaaatgatgatacgaaaaagaattatctttttattgattcagttgaagtgaatactttagatgaatttatcaccaatacctcagcgattattactggcttgggatttatcacaggaaatctatatctagacagatattattatcaggttgttaggtatgacgaatacaaaagggtagagaatattttatttgagaaaaaagaagaatcatcaattactaataaagaaatatttgacccttataaatttcgagtatttcttgaacaggtacaaaaacttcccaaaaatgtacccgttgatttagccatgccctacgtagcattttcaaatctttgtaatacaataaagacaaatgcaaccttcgcccgatgctgtaagctaattgttgaggggcacgaaactaaacatcatttattaagagcggctatttattcgataggaattgaaactatatccaatttgatctatgagtcaaacaaggaaaagataatcccataa

SEQ ID NO: 2050 - protein, 300 aa, Unknown
  Obtained from environmental sample
  misc_feature (1)..(300): Xaa is any amino acid
MCSLLQNDEEYGFKLKILLPKLHDYTYNQNPERFGILNRIELESTGDKYTLPEMSSQHSAVSLSEPQMITLRLAKLMTNTESSFDNNLLRLVIPVTIDPDLSSFNYKSLKINDSVVVAGLVEIAVDNKQYHLFKYRNDDTKKNYLFIDSVEVNTLDEFITNTSAIITGLGFITGNLYLDRYYYQVVRYDEYKRVENILFEKKEESSITNKEIFDPYKFRVFLEQVQKLPKNVPVDLAMPYVAFSNLCNTIKTNATFARCCKLIVEGHETKHHLLRAAIYSIGIETISNLIYESNKEKIIP

SEQ ID NO: 2051 - DNA, 378 bp, Unknown
  Obtained from environmental sample
  misc_feature (1)..(378): n is a, c, g, or t
atgaaaaccaagcaattagaaaaaggccttttgcagcttactgacgagggtgtagcccagttgttcacgcaatttggaggcaataaaaaaataattggctgcgtgggagaattgcaattcgaggtaattcaatacaggcttttacatgaatatggcgcctctgttcagttcaatacgctgcctttttacaaagcctgctggatcaccagcaacaaccaacaaaagctggaagattttatccgttttaaacagggcaatattgctaatgacaaagatggtcacctggtttacctggcacaaagtgaatggtttttaaatactgaaagaaccaataatcccgaaattgaattccattttacaagcgaaatacataaataa

SEQ ID NO: 2052 - protein, 125 aa, Unknown
  Obtained from environmental sample
  misc_feature (1)..(125): Xaa is any amino acid
MKTKQLEKGLLQLTDEGVAQLFTQFGGNKKIIGCVGELQFEVIQYRLLHEYGASVQFNTLPFYKACWITSNNQQKLEDFIRFKQGNIANDKDGHLVYLAQSEWFLNTERTNNPEIEFHFTSEIHK

SEQ ID NO: 2053 - DNA, 696 bp, Unknown
  Obtained from environmental sample
  misc_feature (1)..(696): n is a, c, g, or t
ttgatatgcaaaaaggtttttgtaagtagtgaaggttcgtatgataaattaggtatgaatatagaaaatatcaaaaaagtaattccaaaaattaaggaattaattaatttttgcagaaacgaaaagattccaattttttatacagaagcaatacgtaaaccaagtggtattgatttattgcttcatgtacataatattcttccaaggacaagagaagaaagacttcaaaataagaatataccaatttgtgtacgaggaacctgggatgcacaaacaattgatgaaattaaaccaacagaagaagatcatataatattaaaaagaagagattctgcatttcaagatacagaattaaggatgtggttaaacactttaaagataaatacattgatattttgtggggtagatacatcaatttgtatggagacttctttaagagatggatttaatattggctatgatgcaatattggtttcagatgctactgcttcaggaataaacaagcattatgatacaacaatagaaagaattagagattactacgggattgttacagatttaagtgatttgcaaaagatgataaagaaattagaacagattaatagcggtgaaatcgaatacgatataaaatctgacgaaagcgtaagcgaatttcttgaaaaacacaaattaatagacctaagaaaaggagtatag

SEQ ID NO: 2054 - protein, 231 aa, Unknown
  Obtained from environmental sample
  DOMAIN (11)...(192): Isochorismatase family
  misc_feature (1)..(231): Xaa is any amino acid
MICKKVFVSSEGSYDKLGMNIENIKKVIPKIKELINFCRNEKIPIFYTEAIRKPSGIDLLLHVHNILPRTREERLQNKNIPICVRGTWDAQTIDEIKPTEEDHIILKRRDSAFQDTELRMWLNTLKINTLIFCGVDTSICMETSLRDGFNIGYDAILVSDATASGINKHYDTTIERIRDYYGIVTDLSDLQKMIKKLEQINSGEIEYDIKSDESVSEFLEKHKLIDLRKGV

SEQ ID NO: 2055 - DNA, 543 bp, Unknown
  Obtained from environmental sample
  misc_feature (1)..(543): n is a, c, g, or t
atgaacctatacaccgcatattactcttcacctataggatcactcaaattgcaatgctcagataagtatatcaaaacgattaatttttgtgatgccgaaggtgagatacaaaatgatgaacataaattgctgaatgcctgcagtaaacaattagatgaatactttacaggaaaacgtaagcaatttaccgtgccgttaaaccaggacgggacagaatttcagacaaaaatttgggaccttctttataaaattccctatggcagaaccattagctataatgaattagccaaacaatatggcgatctgaaagctattcgtgctgtagcatctgccagtggcaaaaacaatattgcgatcgttgttccctgtcatcgtgttattggaagtgatcaatccctggttggttatggaggtggcttgtggagaaagaaatggttactggatcatgaagcaaaatttcatcttggcgttcaggaattcgattttgaagcctctgtgaatttaactgagaaaggtgattcggaaatacttggtcattcctga

SEQ ID NO: 2056 - protein, 180 aa, Unknown
  Obtained from environmental sample
  DOMAIN (2)...(68): 6-O-methylguanine DNA methyltransferase, ribonuclease-like domain
  misc_feature (1)..(180): Xaa is any amino acid
MNLYTAYYSSPIGSLKLQCSDKYIKTINFCDAEGEIQNDEHKLLNACSKQLDEYFTGKRKQFTVPLNQDGTEFQTKIWDLLYKIPYGRTISYNELAKQYGDLKAIRAVASASGKNNIAIVVPCHRVIGSDQSLVGYGGGLWRKKWLLDHEAKFHLGVQEFDFEASVNLTEKGDSEILGHS

SEQ ID NO: 2057 - DNA, 747 bp, Unknown
  Obtained from environmental sample
  misc_feature (1)..(747): n is a, c, g, or t
ttgtcgaaaataaaattcggtatagttattccacaaggctggagaaatgatctgccacctaaatcggttacagaacaattcaagtattcaagagatattgtaattgctgcagagaaaaatggctttgattcggcctatgcctacgatcattttatcccccactacagatatccaacgaagggtaacttttttgaatgttatactctattatccgccctttccacttttacaaagaagataaaattagggcagatagtgacttgtaattcttatagaaatcctgcgcttctggcaaaaaagctatccacattagatgtcattaccacaggacgtattgagttaggtatgggagcaggatggtatgaagaagaatacaacgcttacggttattcctacttctcaaatgtagttcgtattttgcagttggaagaatcaattcaaattataaaaaaattatggacaatggaaatgtcaaatttccacggaaagtattattccattaataacgccatctgttctccaaaacccctccaaaaacctcatcccacaatcatggtgggaggatctggcgaaaaatatttgttaaaggtcgccgccaaatatgcagaccgatataacctttatttcggaacacctgaagagatgagcagaaagataaacattctaaaagactataataccaaaaatagaaaaattgaatattcaatcgtacttccttgtgttatcgttccggaacacgaagactga

SEQ ID NO: 2058 - protein, 248 aa, Unknown
  Obtained from environmental sample
  DOMAIN (4)...(246): Luciferase-like monooxygenase
  misc_feature (1)..(248): Xaa is any amino acid
MSKIKFGIVIPQGWRNDLPPKSVTEQFKYSRDIVIAAEKNGFDSAYAYDHFIPHYRYPTKGNFFECYTLLSALSTFTKKIKLGQIVTCNSYRNPALLAKKLSTLDVITTGRIELGMGAGWYEEEYNAYGYSYFSNVVRILQLEESIQIIKKLWTMEMSNFHGKYYSINNAICSPKPLQKPHPTIMVGGSGEKYLLKVAAKYADRYNLYFGTPEEMSRKINILKDYNTKNRKIEYSIVLPCVIVPEHED

SEQ ID NO: 2059 - DNA, 762 bp, Unknown
  Obtained from environmental sample
  misc_feature (1)..(762): n is a, c, g, or t
atggagattgatcatattttggcattatcatcgggtggagataatgatatttctaacttgcaagctctttgtaaaaaatgtcatgaagaaaaatctgccaaagaatctgctgaaagacttttcaatattgacaatattatctcttcttacaacgctgaaacgaataaaatcttttctcagaagaaaaatggatttattcattattacggaactgatgaaagtttatacaaagcaggtcttgacattaataaatgtcgaaaaaatattttgagatattccaatagtgagttttgcgtgttcagtatattagatgatgtgaaacaatttgatagagagttggataaagaaattccaattggtttttattatgttagaacaggaaatttacttccgatgaaaggaaatggctggtattctcacgagatgataagatattgtctcaaagaaaagattattacaattttggatatttgccacgttgtaaaatctagcctttctttaaaaagcgactattttaataattttgttgattatgttactagtaaaggtggagacgatgcaaaattaatggtaaatggatttattgggacatttggtcataaaattgataagaaaaagaagatttatttgaccaaatctcttaactattcgtcttatttatacttcacaagaaataatgttacgatttcaccacacaaagatttctatgaggttgagattaagaagcaagcttatattgaggatagttatgtcccaatttaa

SEQ ID NO: 2060 - protein, 253 aa, Unknown
  Obtained from environmental sample
  DOMAIN (1)...(35): HNH endonuclease
  misc_feature (1)..(253): Xaa is any amino acid
MEIDHILALSSGGDNDISNLQALCKKCHEEKSAKESAERLFNIDNIISSYNAETNKIFSQKKNGFIHYYGTDESLYKAGLDINKCRKNILRYSNSEFCVFSILDDVKQFDRELDKEIPIGFYYVRTGNLLPMKGNGWYSHEMIRYCLKEKIITILDICHVVKSSLSLKSDYFNNFVDYVTSKGGDDAKLMVNGFIGTFGHKIDKKKKIYLTKSLNYSSYLYFTRNNVTISPHKDFYEVEIKKQAYIEDSYVPI

SEQ ID NO: 2061 - DNA, 849 bp, Unknown
  Obtained from environmental sample
  misc_feature (1)..(849): n is a, c, g, or t
ttggggncccatggtcagattgaaatttcacatttttgcgatcaatacaaaattagccattatgctttagatgttgaaaataaaatttgtcataaaagagttgttgataaatcaaactatgcagctctgatttattacattattgacgaccacatgtacccagtgaccgatcagaaaacaagaaatattcttgtcggcgcagctacttcaaccacagaaagaaaaacagttagctcgcttcttgaaaaggatgtggattacgatgacagcgaatttgtagaaagaatgaaaatgccctattttgttgatattcacgtaaaagaattagacaaatataaagattgcaatattttttatcataaggcaaatttgcacaataaattactaaaattatttcagataaaaaatacgcaatataaatctattttaaacggatttaaagttgtttgtatttattatgataacaatgtgagactttttgctaatccaaaccatgcagcaaaaaaagattggacaacatcaatgaatttgtgcaaggcttttaatatttcttacaagcaccaatcaatccaaagaattgcctcgattatttttgaaagttttaatgttaaaggaaaacgaaaatatttaagaaaatatttgactccaatacagcgtcaaaccttaattacatcacaaggtaataaatgcaagtcatgtgatcaacattgtgtagaaatggagattgatcatattttggcattatcatcgggtggagataatgatatttctaacttgcaagctctttgtaaaaaatgtcatgaagaaaaatctgccaaagaatctgctgaaagacttttcaaatattga

SEQ ID NO: 2062 - protein, 282 aa, Unknown
  Obtained from environmental sample
  DOMAIN (228)...(274): HNH endonuclease
  misc_feature (1)..(282): Xaa is any amino acid
MGXHGQIEISHFCDQYKISHYALDVENKICHKRVVDKSNYAALIYYIIDDHMYPVTDQKTRNILVGAATSTTERKTVSSLLEKDVDYDDSEFVERMKMPYFVDIHVKELDKYKDCNIFYHKANLHNKLLKLFQIKNTQYKSILNGFKVVCIYYDNNVRLFANPNHAAKKDWTTSMNLCKAFNISYKHQSIQRIASIIFESFNVKGKRKYLRKYLTPIQRQTLITSQGNKCKSCDQHCVEMEIDHILALSSGGDNDISNLQALCKKCHEEKSAKESAERLFKY

SEQ ID NO: 2063 - DNA, 498 bp, Unknown
  Obtained from environmental sample
  misc_feature (1)..(498): n is a, c, g, or t
gtgatcgtttacaatttggtggacatgttaagccatgcccgtacagaaagggaagtggttaaagaattagctggtgacgaaacaagctacagaagtatcactgcttcatggttcgacatttcaccactaaaccaggcgctaaaaaagattgctgataagaatatcaaaattatcctggctacggaccatggaagtgtgcgggtaaaaacgccggcaaaagttatcggcgataaacaaaccaccaccaaccttcggtataaacatggccgcaatttgaattataatcctaaggaagtattggcattccgggatcctaaggaagttggattgcctgtgccgacggtaaactcctcttacatttttgcaggggaggataccttcttatgctacccgaacaattacaatcattatgtaaactactatcgcaatacgtttcagcacgggggcgtcagccttgaggagatgattgtgccggtaattaagatggtaagcaaataa

SEQ ID NO: 2064 - protein, 165 aa, Unknown
  Obtained from environmental sample
  misc_feature (1)..(165): Xaa is any amino acid
MIVYNLVDMLSHARTEREVVKELAGDETSYRSITASWFDISPLNQALKKIADKNIKIILATDHGSVRVKTPAKVIGDKQTTTNLRYKHGRNLNYNPKEVLAFRDPKEVGLPVPTVNSSYIFAGEDTFLCYPNNYNHYVNYYRNTFQHGGVSLEEMIVPVIKMVSK

SEQ ID NO: 2065 - DNA, 459 bp, Unknown
  Obtained from environmental sample
  misc_feature (1)..(459): n is a, c, g, or t
gtggccgttctaggggaattgaaaagcagatggaaaaactgggatggaaaaggaaactcattgccagaactagcaaatcaatataaatacacctttttgtgtgacgacagctttgaaaaaattcgcccattagttagtagcgcaagaagcatctgcaccgatagtacaggcgtatacacatcaaagatgattagccaaatttttccagatatagccatcccatttgacacagcatcaaaatccataatgaaacagtgcggttataatcccaacgattatggaaatggaatgttaaaagaagaagttcttaattttatcaaacagaatcgattatcagcgagcaaatttaggtcttttgatgatgctccattaagtatttgggaaaattatccgcccctaaatggagaggtcacaacattcagccgagttattgacaaactattttatagccagaaatag

SEQ ID NO: 2066 - protein, 152 aa, Unknown
  Obtained from environmental sample
  misc_feature (1)..(152): Xaa is any amino acid
MAVLGELKSRWKNWDGKGNSLPELANQYKYTFLCDDSFEKIRPLVSSARSICTDSTGVYTSKMISQIFPDIAIPFDTASKSIMKQCGYNPNDYGNGMLKEEVLNFIKQNRLSASKFRSFDDAPLSIWENYPPLNGEVTTFSRVIDKLFYSQK

SEQ ID NO: 2067 - DNA, 510 bp, Unknown
  Obtained from environmental sample
  misc_feature (1)..(510): n is a, c, g, or t
atgcccaacacctacacccaaatacacattcaggcagtttttgctgtacagaaccgacagtcacttattcaaacttcatggaaagttgaactatataaatacattagtggcattctcactagcaacactcataagttaatcattataaacggaatgcccgatcacctgcatgttttatttggaatgagaccagttcaatcactatcagatttgatgcaggatataaaaggaaattcatcaaaatggatcaatgataaaaaattagttaaaggaaagttttcatggcaggaaggttatggagcattttcatatagcaaatctcagttaccttccgtaataaaatatatcggaaatcaggaagaacatcttaaaaaaataactttcttagaagaatatatagcgatttctaaaaaagctggagatagaattttgatgagcgatatattttttaccctggtattaattaaacggaagaaggcctcttcctctgttaccggggtttgcccttga

SEQ ID NO: 2068 - protein, 169 aa, Unknown
  Obtained from environmental sample
  DOMAIN (13)...(109): Transposase IS200 like
  misc_feature (1)..(169): Xaa is any amino acid
MPNTYTQIHIQAVFAVQNRQSLIQTSWKVELYKYISGILTSNTHKLIIINGMPDHLHVLFGMRPVQSLSDLMQDIKGNSSKWINDKKLVKGKFSWQEGYGAFSYSKSQLPSVIKYIGNQEEHLKKITFLEEYIAISKKAGDRILMSDIFFTLVLIKRKKASSSVTGVCP

SEQ ID NO: 2069 - DNA, 609 bp, Unknown
  Obtained from environmental sample
  misc_feature (1)..(609): n is a, c, g, or t
atgagtaaaatggaaaaacttactcctaaattgcaaagaattgtagataaaacatccccggaaattataagaaaaatttattttaataaaaaatttagattaaaaactttaaataattttaaaaaattgcaagaaagcagcacacatttattggatagttcttctaatgtcaaaacaattaaagaggcagagaatagacttactgccgaaagctttttagatgtttctacaaaatatattaaattttgtttaaaagcggagagagagcaaaaatattataaccagcgcggagaatttgttcttttaaaaaaggatgacacttttatttttaatattaaaactattagagataaaaagttaaaagaaggtaatttaatatttaagaaaggattgccaaataataaaattaaacctggagtattaaaaaaatttgcgattaatttaagcggttttgaaaaagaagataatggtagatactatttaaaactttcagattttgaaaacggatactttcatttttggggtaagaaaaataaatattttattaattttaaaattaaaggcggcaccttaaaactaataaatattaactgtttgcgaataaagtaa

SEQ ID NO: 2070 - protein, 202 aa, Unknown
  Obtained from environmental sample
  misc_feature (1)..(202): Xaa is any amino acid
MSKMEKLTPKLQRIVDKTSPEIIRKIYFNKKFRLKTLNNFKKLQESSTHLLDSSSNVKTIKEAENRLTAESFLDVSTKYIKFCLKAEREQKYYNQRGEFVLLKKDDTFIFNIKTIRDKKLKEGNLIFKKGLPNNKIKPGVLKKFAINLSGFEKEDNGRYYLKLSDFENGYFHFWGKKNKYFINFKIKGGTLKLININCLRIK

SEQ ID NO: 2071 - DNA, 384 bp, Unknown
  Obtained from environmental sample
  misc_feature (1)..(384): n is a, c, g, or t
atgaaaaaaatagtaagcatacttgtatttgttctcttagcaaacctgtcacaagctacctatattttgattccaatggacctaaaccaaaagaatcatttaaaagcatatggtgttgcctattgngtattgaaacaagatgtggaagtgcattggctactgaattaccgtggaggcagttttatggtgaaaggtgcaaaagaaattgaaagtgaatgtacgatacgaggcgtttcatttgaagtaattccagatgcgaagtcgagcgctattttaacagagatctccaatcctgaagtgaacatggaggatgtgaaattagaaaaagctcctactgttgctgtttattcccaaaaaacaaacaaccttgggatgatgccgtaa

SEQ ID NO: 2072 - protein, 127 aa, Unknown
  Obtained from environmental sample
  SIGNAL (1)...(19)
  misc_feature (1)..(127): Xaa is any amino acid
MKKIVSILVFVLLANLSQATYILIPMDLNQKNHLKAYGVAYXVLKQDVEVHWLLNYRGGSFMVKGAKEIESECTIRGVSFEVIPDAKSSAILTEISNPEVNMEDVKLEKAPTVAVYSQKTNNLGMMP

SEQ ID NO: 2073 - DNA, 669 bp, Unknown
  Obtained from environmental sample
  misc_feature (1)..(669): n is a, c, g, or t
atgaatcccgagctgccggcaatgcttaatataaaaactccccagaaaaaggagtctctgcaggctctttggaaactgctgaaaatattattggacaatttaaactttgatgatgtggtttataaagtcgtcaacagtattttgactgagctgggttatctaaacctgggttaccggatcattgttttatctttggtagatgagcaggccggcggcctgaggcgggttgctttatctcaaactaaggaagccgatctggcgaaatcggtttccacaataccatttgaaaaaatcgtcattcctctttctgccacaaataattattgtgtcagagttttaagacagcaggagcctttaaccaccagttactggccggatttactaagtccgcctttaactccggaagctgctttaaccaatcagcaggccgccggtataaaaaccagtatggtttacccggtttttgcccagggtaaaccgattggatccttaattttcagtatggttaaggattttaaggaagtgactgaagatgaaaaagatctgctgctgggatttaccgatttggtgggacttgcagtccagaattcaatcctttttacttctctccaaaccaaacagaaagaattaaatgctgccaatgaaaagctgaaaatcatcgataagtaa

SEQ ID NO: 2074 - protein, 222 aa, Unknown
  Obtained from environmental sample
  DOMAIN (39)...(194): GAF domain
  misc_feature (1)..(222): Xaa is any amino acid
MNPELPAMLNIKTPQKKESLQALWKLLKILLDNLNFDDVVYKVVNSILTELGYLNLGYRIIVLSLVDEQAGGLRRVALSQTKEADLAKSVSTIPFEKIVIPLSATNNYCVRVLRQQEPLTTSYWPDLLSPPLTPEAALTNQQAAGIKTSMVYPVFAQGKPIGSLIFSMVKDFKEVTEDEKDLLLGFTDLVGLAVQNSILFTSLQTKQKELNAANEKLKIIDK

SEQ ID NO: 2075 - DNA, 345 bp, Unknown
  Obtained from environmental sample
  misc_feature (1)..(345): n is a, c, g, or t
gtgcaaagtaactccattgacatagatgacacagcatcaaagtataccgtaacagttgaacttgttgaaaaccgatgttgtccggttagctgtggcgttattgcatcagcttcagctcaaaaatttaaaataatcaattccgattttaatgttgaaaatcattttatcattgtaattgaacgctgtccagaaatgagaggggaatacttttttcaaacaggcaagcgatataaaataacgatcactttgaaaggcaagagtgataaaggctacatgatcgataataaatacagcaaagagagtctaaatacgttttggtcagaagacatcaaaagattagactaa

SEQ ID NO: 2076 - protein, 114 aa, Unknown
  Obtained from environmental sample
  misc_feature (1)..(114): Xaa is any amino acid
MQSNSIDIDDTASKYTVTVELVENRCCPVSCGVIASASAQKFKIINSDFNVENHFIIVIERCPEMRGEYFFQTGKRYKITITLKGKSDKGYMIDNKYSKESLNTFWSEDIKRLD

SEQ ID NO: 2077 - DNA, 978 bp, Unknown
  Obtained from environmental sample
  misc_feature (1)..(978): n is a, c, g, or t
atgaaagtaaagattccttttttccggaccagggagggacaaatttgtggaaaatgcgttagagcatgcgagggaaaatcattgacccggagtgatgggttcgggatgataagtcttcaaagtccttcttcttttaaactgacagtgaaaagccccgtcgagatcaaaaagtttttggacgaatatgtaattggccaggatgaagcaaaaaaggttttggccgttgctgtttacaatcactacaaacgtcttcaatacaaatctgctgaagttgccaaggacgatattgaaattgaaaagagcaatatcatcatggttggtgaaaccggtaccggtaaaactttattggcaaagaccatcgccaaattattgaacgttccttttaccattgttgatgctaccgtatttactgaagcaggctatgttggcgaggatgttgaaagtattcttacccgtttattacaggtttgtaattatgatgtggcttctgcagaacgtggcattgtttacatcgatgaaatagataagatcgcaagaaagagcgacaatccttccatcacccgcgatgttagcggtgaaggtgttcagcaaggtatgctgaagttgttggaaggaacagatgttcttgttccaccacaaggcggaagaaaacaccctgaacaaaagcttattaagatcaatactcagaatatactcttcgtctgcggtggtgcatttgatggtatcgatcgcattattgcacgtcgtgttcaaaccaacactattggttttaatgttgacaaagagcaacaggagatgatgaagaagaatcttctgaagtatgtgaatgcacaagacttgaaaactttcgggttgattcctgaattgttaggccgtttgcctgttgctacgcatttggatcctttggatgcagaaactttgagagctattcttaccgagccaaagaatgcattgatcaaacaatatgttcgctattga

SEQ ID NO: 2078 - protein, 325 aa, Unknown
  Obtained from environmental sample
  DOMAIN (102)...(308): ATPase family associated with various cellular activities (AAA)
  misc_feature (1)..(325): Xaa is any amino acid
MKVKIPFFRTREGQICGKCVRACEGKSLTRSDGFGMISLQSPSSFKLTVKSPVEIKKFLDEYVIGQDEAKKVLAVAVYNHYKRLQYKSAEVAKDDIEIEKSNIIMVGETGTGKTLLAKTIAKLLNVPFTIVDATVFTEAGYVGEDVESILTRLLQVCNYDVASAERGIVYIDEIDKIARKSDNPSITRDVSGEGVQQGMLKLLEGTDVLVPPQGGRKHPEQKLIKINTQNILFVCGGAFDGIDRIIARRVQTNTIGFNVDKEQQEMMKKNLLKYVNAQDLKTFGLIPELLGRLPVATHLDPLDAETLRAILTEPKNALIKQYVRY

SEQ ID NO: 2079 - DNA, 444 bp, Unknown
  Obtained from environmental sample
  misc_feature (1)..(444): n is a, c, g, or t
gtgaagctagtgatcaacatcctctccagtacgcacatctaccaacccatcaaacgcgtttttgaatttatcagcaaccctgaaaacgattttcaatggcaatatggaacgttggcttccacccgcacttccgaaagtattgcggcattgggcgcctgttttcaaaccaccggtaatttcatgggacatcgcatccaaagtacctttgaagtgaccgagtatgatcttaataaaaaatacggcttcaaatccctttccggtccactacaatcttttaccacgtatacctttgcactcgccagcggttatacccagatcaacttattgacccaagccaacgtggtcaattttatagaactcaatgagaatattctcgaaaagaagctaaaaaaacaactcaaggaaaatctggcaatgctcaaaagtattctggaagtgggataa

SEQ ID NO: 2080 - protein, 147 aa, Unknown
  Obtained from environmental sample
  misc_feature (1)..(147): Xaa is any amino acid
MKLVINILSSTHIYQPIKRVFEFISNPENDFQWQYGTLASTRTSESIAALGACFQTTGNFMGHRIQSTFEVTEYDLNKKYGFKSLSGPLQSFTTYTFALASGYTQINLLTQANVVNFIELNENILEKKLKKQLKENLAMLKSILEVG

SEQ ID NO: 2081 - DNA, 789 bp, Unknown
  Obtained from environmental sample
  misc_feature (1)..(789): n is a, c, g, or t
atgcggatccaaacaaaatacagagaccgtattcgtaccgattccatcgctcatctcacaagtttgggattattgggagacaaatacattgaaatcagccagggcacgcgtgatggaagaccattgaaggaaaacgagactatcactggtgctcctccactggattttgatgaaatgattgcgcgcgcaaaccacactttcgacaatcttggcgatacggtaataaacatcaaagacatcactcaggcaatgaaagaaggaaagggaacactgggcaaatttcttaaagatgacgctgtttttaaaaaccttaatgaagcgttgcgaaaaacacaagaaggaaatggaactctagctagattaatcaatgatgacaaagtgtataaagatttaagcatggcaatggcaaatgtgcgttctgcaacggataaccttcgcaccggtgaaggcactgcaggcaaaattttgaatgataaagagcttggcaaaaagctggaaagcacgatcaataaacttgaaacagtgatggcccgggtggaaggtggcgaaggtacgcttgggaagctttccaaagatccagcactttataataatttgaacggtgtaatggcgaacataaaaccactttcagagcgagtcgctaaaggcgaaggaacagtcggtaaacttttctacgataaacaactttacgattcaaccaatgacacgatgaaagagatacaacttttaattcgtgacatccggcaagatccgaaaagatatttgcggtttaagttttcaattttctaa

SEQ ID NO: 2082 - protein, 262 aa, Unknown
  Obtained from environmental sample
  misc_feature (1)..(262): Xaa is any amino acid
MRIQTKYRDRIRTDSIAHLTSLGLLGDKYIEISQGTRDGRPLKENETITGAPPLDFDEMIARANHTFDNLGDTVINIKDITQAMKEGKGTLGKFLKDDAVFKNLNEALRKTQEGNGTLARLINDDKVYKDLSMAMANVRSATDNLRTGEGTAGKILNDKELGKKLESTINKLETVMARVEGGEGTLGKLSKDPALYNNLNGVMANIKPLSERVAKGEGTVGKLFYDKQLYDSTNDTMKEIQLLIRDIRQDPKRYLRFKFSIF

SEQ ID NO: 2083 - DNA, 819 bp, Unknown
  Obtained from environmental sample
  misc_feature (1)..(819): n is a, c, g, or t
atgaattcccctgcttgggttacgacctttcatccgttaacaataaaggcgcagacaccccgccatggcattaggggaatattgaacagcggggactaccaggtgatcttcagcgatacaccgggccttataaagccggtttaccgcctgcatgaaaaaatgatgcatgctgtagatgaatcgtttgaagacgccgacctgttattatatattactgaagtagccgatctgaacattgatgagcaggtaaaggaaaaactgatgaacaggaacatcccgctttacgtggtaatgaataaagtggatattgccgatgaggaaaaaataaataaggctgtggaacactggaaagaggtgcttcgtcctgaagaaatattccctgtttctgcactgaagaatttttatctggatgtattattgaaacatatcgttgaaagactgcctgaaggtcctccttattttgacaaggacgatgcactcagcgatcgcgacatgcgtttcttcgcagcggaaataatcagggaaaggatccttgccttttaccagaaggaaattccgtattcagttgaagtaaaaatagtttcctataaggaagctgaagatattgacaggatcagtgcagtattatttgtaacgagagaatcacagaaagcaatactgcttgggaaaggcggtgcagcaataaaaaaactaggaacagaatccaggaagaaactggaagctgttcttggaaaaaaagttttcctggaattaaccgttaaggtagaagcaaactggcgcgatgatgataagctgttgaagcgatttggatatgaatag

SEQ ID NO: 2084 - protein, 272 aa, Unknown
  Obtained from environmental sample
  DOMAIN (207)...(271): KH domain
  misc_feature (1)..(272): Xaa is any amino acid
MNSPAWVTTFHPLTIKAQTPRHGIRGILNSGDYQVIFSDTPGLIKPVYRLHEKMMHAVDESFEDADLLLYITEVADLNIDEQVKEKLMNRNIPLYVVMNKVDIADEEKINKAVEHWKEVLRPEEIFPVSALKNFYLDVLLKHIVERLPEGPPYFDKDDALSDRDMRFFAAEIIRERILAFYQKEIPYSVEVKIVSYKEAEDIDRISAVLFVTRESQKAILLGKGGAAIKKLGTESRKKLEAVLGKKVFLELTVKVEANWRDDDKLLKRFGYE

SEQ ID NO: 2085 - DNA, 702 bp, Unknown
  Obtained from environmental sample
  misc_feature (1)..(702): n is a, c, g, or t
gtggaatcaatatcctgtttatggatttggttttatgggtggagttgtattttcgtttgctcaaaaacaatcacagtagtgtttcatcagcttgcctcatatcttactcagtataaacaggtgagcatacctcaggtaggtagttttcaacttgtgccaacgcctgctatgttagatgtggcttctaaacttattctaccgccaacttatcttccccagtattccgatacggatttggtaaaggaacaccagttagattttttagctacagacttaaatgcagataaagaacacatcaaagagcagttagaaaatttcggaaaagacttgcgtcagagaattcagcagggcgtgttttcctggaaaggtgtgggcaaactcgaggcaggagaggccgcaatgatttttcatcctgatattgtggaaactaaaggactgacggccttacctgcagaaagggttttgcgtaaaaatgtgcagcatactgttagaaggggcgaacaggaaatattatcatcttctttcgataataaagaaaaagaagttgtaaaaaaacgatctctcatcgaactaattggatggggggtagtagttgtttccattgtgttgttaatcgttctttatgtcaacaacggttccaatgttttttccggaacaaaaatgaaggtgcatccttctaatgcatcgtctacgcataaataa

SEQ ID NO: 2086 - protein, 233 aa, Unknown
  Obtained from environmental sample
  misc_feature (1)..(233): Xaa is any amino acid
MESISCLWIWFYGWSCIFVCSKTITVVFHQLASYLTQYKQVSIPQVGSFQLVPTPAMLDVASKLILPPTYLPQYSDTDLVKEHQLDFLATDLNADKEHIKEQLENFGKDLRQRIQQGVFSWKGVGKLEAGEAAMIFHPDIVETKGLTALPAERVLRKNVQHTVRRGEQEILSSSFDNKEKEVVKKRSLIELIGWGVVVVSIVLLIVLYVNNGSNVFSGTKMKVHPSNASSTHK

SEQ ID NO: 2087 - DNA, 1032 bp, Unknown
  Obtained from environmental sample
  misc_feature (1)..(1032): n is a, c, g, or t
atggctcagatgttgacggggcattattccaccagtgccagtactcgcaatgcgggctttgcctgtttcggcagtcttagcgaactgattcacgatggcatctatatgagcacagataaaatgctcgaactcgtggaaatgcgttataagggattgaaaaaaattcaaaagtttttttcaaaaaaagaaattgactttgacttatgtggtggttatgaattatacgatgagagagatgccaattctactgagcagctccataagaatatagattatctcaattcgctattaaagccgattacccgcaaaaagaaaacatttgaactgatcgacgacaaaatttccgaatttggttttggtcacacaaaacacctggttaaaaataaatcagaaggctatttacattcggggaaattggtaaaagctcttttgcaaagagtacaatccatgggcgtacaagtattgccgggtattgaaataaaaggatacgaagtagtaaaagggaaagtagaattaagagcggatggagattataatttaagagctacacaggttttagtttgcaccaatgcttttactaataaactattaccgcaattagatatagtaccggcccgtgggcaggtgttggtaacatcagagataaaagacctgcgctggcagggaagctttcattcagatgaaggctatttttatttccgtaacatagggagaaaggttttattaggtggggcaagaaacaaagcatttaaagaagaagaaacaacaganatggagaccaccggaattatacaaaatgaattagaacgttatcttgatgaaataatattgcccgactacaaaggccagtacaccattgattaccgatggagcggcataatggcaatgggtagtgataaaatgcctattattagggagattgagcccagtatttttttgcgcaatacgcatgaatgggaatggnattgcctcttgctcccatgggttggccggtatgtaactaaatttaatgccggggaactaaggaattaa

SEQ ID NO: 2088 - protein, 343 aa, Unknown
  Obtained from environmental sample
  misc_feature (1)..(343): Xaa is any amino acid
MAQMLTGHYSTSASTRNAGFACFGSLSELIHDGIYMSTDKMLELVEMRYKGLKKIQKFFSKKEIDFDLCGGYELYDERDANSTEQLHKNIDYLNSLLKPITRKKKTFELIDDKISEFGFGHTKHLVKNKSEGYLHSGKLVKALLQRVQSMGVQVLPGIEIKGYEVVKGKVELRADGDYNLRATQVLVCTNAFTNKLLPQLDIVPARGQVLVTSEIKDLRWQGSFHSDEGYFYFRNIGRKVLLGGARNKAFKEEETTXMETTGIIQNELERYLDEIILPDYKGQYTIDYRWSGIMAMGSDKMPIIREIEPSIFLRNTHEWEWXCLLLPWVGRYVTKFNAGELRN

SEQ ID NO: 2089 - DNA, 714 bp, Unknown
  Obtained from environmental sample
  misc_feature (1)..(714): n is a, c, g, or t
atgcaaatatcggtatcagaaggggtcgctgctgccatgttgttttctctgggttctttgctgatcgaaattgtctatgtacgactctcactggttgccattgactggatccgtaagcaggaaaaacttttgaaaatcctggaatatgttactttattgatcgtgaccgccctcgccgcttccagtttctatgcagccctccatcctgatgtaaaggaaaatatcgtgctgagcagttcaatgccgaagttcctgctgggtatgctgatgtgtgctgtaaatcccgtccagatccctttctggttcgggtggagcactgtacttttcaccaaaaagatcctgcttcccaggccgaatcattataattcttatatcgtcggcatcgggatcgggacattcattggtaatgccctttttattttcggcggcctcctgatcgccaattcaatcagcaataaccagcatattctgaattggatcatcggcggcattttcgccattacagcgctgatccagctttggcgtattatcaaacataaagatgcaatccatgatcttgaacaccccgaagaaatgaccgggaggtttgaggagaaaatggataaaatggaagaaagaatggaaaaactggaagaaggtttcgaaaaaatgacccacaaagatgaagaagatgataataaggagaagaaagataaaaagctgaagaaagactaa

SEQ ID NO: 2090 - protein, 237 aa, Unknown
  Obtained from environmental sample
  misc_feature (1)..(237): Xaa is any amino acid
MQISVSEGVAAAMLFSLGSLLIEIVYVRLSLVAIDWIRKQEKLLKILEYVTLLIVTALAASSFYAALHPDVKENIVLSSSMPKFLLGMLMCAVNPVQIPFWFGWSTVLFTKKILLPRPNHYNSYIVGIGIGTFIGNALFIFGGLLIANSISNNQHILNWIIGGIFAITALIQLWRIIKHKDAIHDLEHPEEMTGRFEEKMDKMEERMEKLEEGFEKMTHKDEEDDNKEKKDKKLKKD

SEQ ID NO: 2091 - DNA, 411 bp, Unknown
  Obtained from environmental sample
  misc_feature (1)..(411): n is a, c, g, or t
atgaaaatctgtgttgatgatcttattaaagaggcaaaacgtatgcatactgaattaaaaatttttgaatttaaattaacagaagaggattttaacgatattatacaaaatgattgttatttatgtggtaaaaagaatagtaaaactcatcaaaatggaattgacagaatggataatactaaaggatatacactttctaactgtaaatcatgttgttcgacatgtaattatttaaaatataattataaactcaaagactttttaatgaaattaatgcaaatttatgataacaaaatttgtccaccaacaaaaataaaaaatcaggaatttcaattagtaagaactaaagaattctatgaaaaattcataaccaaacatgaaaatatttacaataatataacaaactcataa

SEQ ID NO: 2092 - protein, 136 aa, Unknown
  Obtained from environmental sample
  misc_feature (1)..(136): Xaa is any amino acid
MKICVDDLIKEAKRMHTELKIFEFKLTEEDFNDIIQNDCYLCGKKNSKTHQNGIDRMDNTKGYTLSNCKSCCSTCNYLKYNYKLKDFLMKLMQIYDNKICPPTKIKNQEFQLVRTKEFYEKFITKHENIYNNITNS

SEQ ID NO: 2093 - DNA, 696 bp, Unknown
  Obtained from environmental sample
  misc_feature (1)..(696): n is a, c, g, or t
atgaatttcatcattttctgtttcgtcttactgctgtctggttttcttacaggtaagagacttgaaactaattctcaacaatcaaaaaaaattgagatccgtgggatttatggcagtccgaacccattctgggaaaaaaatttgcgacttgaccaacttggtgtgaattcggtttttatccatcatcaatcgatcaccgaagctatgatgcaaaggtccaaacgtgaaggattaaaggtctttgcagagtttgcgacacttaatggaaaaaactatgtggagcaacatcctgaagcctgggcgattgacgagaatggacaaaaagtgaaacctgctacatggtttatgggggtctgtccaacagaacccggttttaaagaatacagaataaatgagcttaaacgtcttttgcgccaatttgatgtcgacggcgtatggatggattacctccactggcatgcacaattcgaagatcccgaaccaatattgccagaaacatgtttttgcgaaaattgtataacccgttttcaatccgcgaaaaacatacaaatcccggcaggaacaacacctgaaaaatctggcaggattcttaaaaatcataataaagcctggcgtgattggagatgttcagttataaccgactgggtgaaggacttccgaacgaccctaaaacagaaaagccccgtgcccttttag

SEQ ID NO: 2094 - protein, 231 aa, Unknown
  Obtained from environmental sample
  SIGNAL (1)...(18)
  misc_feature (1)..(231): Xaa is any amino acid
MNFIIFCFVLLLSGFLTGKRLETNSQQSKKIEIRGIYGSPNPFWEKNLRLDQLGVNSVFIHHQSITEAMMQRSKREGLKVFAEFATLNGKNYVEQHPEAWAIDENGQKVKPATWFMGVCPTEPGFKEYRINELKRLLRQFDVDGVWMDYLHWHAQFEDPEPILPETCFCENCITRFQSAKNIQIPAGTTPEKSGRILKNHNKAWRDWRCSVITDWVKDFRTTLKQKSPVPF

SEQ ID NO: 2095 - DNA, 783 bp, Unknown
  Obtained from environmental sample
  misc_feature (1)..(783): n is a, c, g, or t
gtgcttaaattccgattaaaagaaaaaattctagacttactcctgaccgatatatctactgataagcagaaagaattagacgaggcagattatgctatcattaaaataaaaaagaaatctgcgcaatttcagcatttgtactattctaaaaaaagaatgccttttttgtttgatctgttggatgaaattatctttctggctaaagaatacgaacaattctctttggttgtagatcacttaaaggccaaaaagaatttagttagtttcaaaaatggaagcagggaatttgaaaaggtttatgaagaacttgaatattattccaaatgcagtagtctgcttaataaagctgaacattattactttaaactcatcatgctatatgaatatgatagcaagccggataaacaaaaaactttaacgctactcgaaaaagctattgtggaactggaaaaagagaataggggaataaaatctcatatcataaattactatttcaagatgcttgagatggattactgcaacctacaggaagattatttgcaagcccgtagtatttgtttggaaattcttgccattgtaagaaataataaatctgttaagagaaaacaaagaataggggttgtttatgatcatctttctcgttcagaattttacttggggcatttggagcagtcagtagaaaatgcacacgaagctcagaaatattttaatcctaaatctgaaaatttttgtattgctcttgagcaagaattttatgccctcctttgccatgagcaaaaatga

SEQ ID NO: 2096 - protein, 260 aa, Unknown
  Obtained from environmental sample
  misc_feature (1)..(260): Xaa is any amino acid
MLKFRLKEKILDLLLTDISTDKQKELDEADYAIIKIKKKSAQFQHLYYSKKRMPFLFDLLDEIIFLAKEYEQFSLVVDHLKAKKNLVSFKNGSREFEKVYEELEYYSKCSSLLNKAEHYYFKLIMLYEYDSKPDKQKTLTLLEKAIVELEKENRGIKSHIINYYFKMLEMDYCNLQEDYLQARSICLEILAIVRNNKSVKRKQRIGVVYDHLSRSEFYLGHLEQSVENAHEAQKYFNPKSENFCIALEQEFYALLCHEQK

SEQ ID NO: 2097 - DNA, 645 bp, Unknown
  Obtained from environmental sample
  misc_feature (1)..(645): n is a, c, g, or t
atgaaatacctctttcgcagagacactttttttgccactatagccgtctttgtcagcatgggccttctttctcttttgccatttaatttaagtgtattaaatccattcagagttgcgctggaagatttcgattttaatgatatggcttactctgaattaaaaaaaaatcatgatacgccggttgatgaccgtattgttattgtaaatattggttatttagacaggtcatcattaaccagtattttaaatatagttagtgctgaagagcccagggttattggattggatgtgatgtttgaaattgaaaaagattctatctcagatgctattttatttgaacagttaaaatccacacccgaccttgtattagctgcaaaattggattggaatgatagtaaacatccgctcaaagaaagtgtattcaaggatacagcattaacacttggtttcgtaaattttgtaggtgcggaaaaaggaaccatcaggtatttctctcctgtggaaaaggaaaataaattgaagcaccaaagttttgcttcagccattataaacattgtaaacccggatgcttataaaaaattaatagccaggaaaaaacccgttgaaactatcaattatacccgccaccagcacaaatacccttag

SEQ ID NO: 2098 - protein, 214 aa, Unknown
  Obtained from environmental sample
  misc_feature (1)..(214): Xaa is any amino acid
MKYLFRRDTFFATIAVFVSMGLLSLLPFNLSVLNPFRVALEDFDFNDMAYSELKKNHDTPVDDRIVIVNIGYLDRSSLTSILNIVSAEEPRVIGLDVMFEIEKDSISDAILFEQLKSTPDLVLAAKLDWNDSKHPLKESVFKDTALTLGFVNFVGAEKGTIRYFSPVEKENKLKHQSFASAIINIVNPDAYKKLIARKKPVETINYTRHQHKYP

SEQ ID NO: 2099 - DNA, 549 bp, Unknown
  Obtained from environmental sample
  misc_feature (1)..(549): n is a, c, g, or t
ttggagcggatttcagatcaagcaaatcgattgacagagttgacgagtgacttattagatgtttcaagaattgaaaccggtaaattaaaaatgagcctggaaaagtttaatcttgaagagttaataatagataccattgaaagcatacagccttcaacatctgtgcataagctattattgaaaaaaagtataaacgcagctgttacggcagacagatatagattatatcaagttctcataaatctattaacaaatgccataaaatactctccgaaaggaaaagatataattattagaattaccaaagacacgaagcaagttaccgtaagtgttcaggattttggaatcggaattaaaaaagaccagttggaaaaaatatttgacagactctatcaggtaactgatccggcagaaaaaacatatccgggattagggttgggcttatatatttcaaaagaaatagtagaacggcataatggtaaaatatgggtagaaagtgaaaaaggtgttggctctactttttatttcacaattcctatcaagaagtaa

SEQ ID NO: 2100 - protein, 182 aa, Unknown
  Obtained from environmental sample
  DOMAIN (70)...(181): Histidine kinase-, DNA gyrase B-, and HSP90-like ATPase
  misc_feature (1)..(182): Xaa is any amino acid
MERISDQANRLTELTSDLLDVSRIETGKLKMSLEKFNLEELIIDTIESIQPSTSVHKLLLKKSINAAVTADRYRLYQVLINLLTNAIKYSPKGKDIIIRITKDTKQVTVSVQDFGIGIKKDQLEKIFDRLYQVTDPAEKTYPGLGLGLYISKEIVERHNGKIWVESEKGVGSTFYFTIPIKK

SEQ ID NO: 2101 - DNA, 357 bp, Unknown
  Obtained from environmental sample
  misc_feature (1)..(357): n is a, c, g, or t
atgaaaaaagtgcttatcatcgatgatgaattcgatattattgaaccgctagatctattacttactgaagcagggtattcagtgcaaacaattaccaaaggtgaagagacttatgaaaaagttgagcatttcgcaccggatattattttactcgatgttcttctttcaggaagtgatggtaggatcatctgtaaaaatctgaagaatgctaaaaaaaccggaaaaatcccgatcattctaatgtctgcacatccgaatgccaatgcagactcagtcggatgtaatgcaaatgcattcatacctaaaccatttactacgtctgaactattaaccttgataaaactaccttgtaagtag

SEQ ID NO: 2102 - protein, 118 aa, Unknown
  Obtained from environmental sample
  DOMAIN (2)...(117): Response regulator receiver domain
  misc_feature (1)..(118): Xaa is any amino acid
MKKVLIIDDEFDIIEPLDLLLTEAGYSVQTITKGEETYEKVEHFAPDIILLDVLLSGSDGRIICKNLKNAKKTGKIPIILMSAHPNANADSVGCNANAFIPKPFTTSELLTLIKLPCK

SEQ ID NO: 2103 - DNA, 357 bp, Unknown
  Obtained from environmental sample
  misc_feature (1)..(357): n is a, c, g, or t
atgaaaaaagtgcttatcatcgatgatgaattcgatattattgaaccgctagatctattacttactgaagcagggtattcagtgcaaacaattaccaaaggtgaagagacttatgaaaaagttgagcatttcgcaccggatattattttactcgatgttcttctttcaggaagtgatggtaggatcatctgtaaaaatctgaagaatgctaaaaaaaccggaaaaatcccgatcattctaatgtctgcacatccgaatgccaatgcagactcagtcggatgtaatgcagatgcattcatacctaaaccatttactacgtctgaactattaactttgataaaactacattgtaagtag

SEQ ID NO: 2104 - protein, 118 aa, Unknown
  Obtained from environmental sample
  DOMAIN (2)...(118): Response regulator receiver domain
  misc_feature (1)..(118): Xaa is any amino acid
MKKVLIIDDEFDIIEPLDLLLTEAGYSVQTITKGEETYEKVEHFAPDIILLDVLLSGSDGRIICKNLKNAKKTGKIPIILMSAHPNANADSVGCNADAFIPKPFTTSELLTLIKLHCK

SEQ ID NO: 2105 - DNA, 318 bp, Unknown
  Obtained from environmental sample
  misc_feature (1)..(318): n is a, c, g, or t
atggcgatcagatttatcatacaatctaaacaatctctacctcaaacggtagggtcgaaattactgtcgcaatttaaagacacaaattattctataactctccctctattcatccctgattttatttttcgtattttttctattccttctttagttaaatgtgctttagaaagaattaaagttgctacttcattaaaatctgaaaaatctttagcttttacacccaatatgggatattttgcaaagaatgaaataattttttcatctatgtctgataatcttcttactacaaagttaacttcctctctagtagaatag

SEQ ID NO: 2106 - protein, 105 aa, Unknown
  Obtained from environmental sample
  misc_feature (1)..(105): Xaa is any amino acid
MAIRFIIQSKQSLPQTVGSKLLSQFKDTNYSITLPLFIPDFIFRIFSIPSLVKCALERIKVATSLKSEKSLAFTPNMGYFAKNEIIFSSMSDNLLTTKLTSSLVE

SEQ ID NO: 2107 - DNA, 396 bp, Unknown
  Obtained from environmental sample
  misc_feature (1)..(396): n is a, c, g, or t
atgataaatctgatcgccatgactcatttaaaaccaagtgaccctattgaatttggtcattatttagcaggtttaatagatggggtaggacaatttagtagtaaacaacaattaatcattgtatttaattcattagacgcctctttagcttattttataaaaaaacgaataggttttggtaatattcgtaaagttaaagataaaaatgctataattttaaaaatagccgcaatagaaggtttgaaaaaagtaataaaattaataaatggaaaaataagaacagaaaataaatttaatcaaataaataataatatattaaataatgaaaagtatactgaatttagtcaaagtttaaatttaaaattaaatttagataatgattttaaaaatcattga

SEQ ID NO: 2108 - protein, 131 aa, Unknown
  Obtained from environmental sample
  DOMAIN (22)...(108): LAGLIDADG endonuclease
  misc_feature (1)..(131): Xaa is any amino acid
MINLIAMTHLKPSDPIEFGHYLAGLIDGVGQFSSKQQLIIVFNSLDASLAYFIKKRIGFGNIRKVKDKNAIILKIAAIEGLKKVIKLINGKIRTENKFNQINNNILNNEKYTEFSQSLNLKLNLDNDFKNH

SEQ ID NO: 2109 - DNA, 477 bp, Unknown
  Obtained from environmental sample
  misc_feature (1)..(477): n is a, c, g, or t
ttgcgcgggcaggtggcgcagatggacagctccgtggccaccattttgaaaatagaaaaatcggataccagccggcctgacacagcttacctgcggcgggatgaatttaaaatttgggccaaacccttcctggatctgcctgagatcagcgacgaaaaatggcgcgatgattatgaagtcaccaatatgtacgacgacctgatgaaggcctacatcttcacctacaccacgcacgaagaagatgcggagattaaaaaacaagatgtaattgtggagccggccgctgaaggcaataacaacattcgtgcggtgaatattgacaaatggtcgctgcggggcaagaccgtggtgcagcaaaacatgctctgggaaaccggtagccgctttctgattgtgaccaaggtgagccagcccggcgaaaccgaaaaagtgaaaacgctggaagtgaagtggatagaaaagccggaaggattttaa

SEQ ID NO: 2110 - protein, 158 aa, Unknown
  Obtained from environmental sample
  misc_feature (1)..(158): Xaa is any amino acid
MRGQVAQMDSSVATILKIEKSDTSRPDTAYLRRDEFKIWAKPFLDLPEISDEKWRDDYEVTNMYDDLMKAYIFTYTTHEEDAEIKKQDVIVEPAAEGNNNIRAVNIDKWSLRGKTVVQQNMLWETGSRFLIVTKVSQPGETEKVKTLEVKWIEKPEGF

SEQ ID NO: 2111 - DNA, 396 bp, Unknown
  Obtained from environmental sample
  misc_feature (1)..(396): n is a, c, g, or t
ttgagtatagataaagcacgtttaattgtggctcaacaaatccgagatttagaaacaggtgcaactttcaagagtggaagtcgttatgtgttcaatgaaaatgctagagagaaaatagatacaaaactagacatagtaaaatcttctgttgaacaatatctggaacttactgataaaataaaaaatatgttgtatctcatgactggtaaaaaaatacctagaggccaagcatgttataaattgaaacaaatcgatgattcggaacgctacagactggaaatattgaaaggacttaatgaaaacgagatcatcagacttgaatcagatttggatattttagatgaggctgtgactagtttccttgaactcattaataaggaggttttaaaacaatga

SEQ ID NO: 2112 - protein, 131 aa, Unknown
  Obtained from environmental sample
  misc_feature (1)..(131): Xaa is any amino acid
MSIDKARLIVAQQIRDLETGATFKSGSRYVFNENAREKIDTKLDIVKSSVEQYLELTDKIKNMLYLMTGKKIPRGQACYKLKQIDDSERYRLEILKGLNENEIIRLESDLDILDEAVTSFLELINKEVLKQ

SEQ ID NO: 2113 - DNA, 645 bp, Unknown
  Obtained from environmental sample
  misc_feature (1)..(645): n is a, c, g, or t
atgggtagagaagcagcaagaaatgcaacaaaatcgattaacgaaatggtgtcaatacttcatgaacaatatccagattggccatatactaagatagcatatacaatatacaataaacatgaacatttggaaggattcacaaggcaaacaattaggaaggccttaagtgatgaactcgttgagtcattaggactagaagattcttctataaaaaaatcacataacaaagttggtaagggcttaccaactttgttagataacaaagatccagaacaatcttctagtcctgacgaagaacttcatgatttacccgaaccaacggataacgaacaggttgatgatgaagaagaagaagaacaagatataatctatgacaaagatctattgaataaacatgtcaaacatatagccaaattagaggacaaaattaatcaactacagattgagagaattccaactagatccgataaattcgagtttgtatatcgtatagaatttacagatgaaatgttccaacttattaaagcaaattcgagtatatgtccattcaatgttactgcatttccaagtaaaggtgatggatggctaagatttgatagagaaactatagaacgagaaataaaggaggctcagaaaaagaaatga

SEQ ID NO: 2114 - protein, 214 aa, Unknown
  Obtained from environmental sample
  misc_feature (1)..(214): Xaa is any amino acid
MGREAARNATKSINEMVSILHEQYPDWPYTKIAYTIYNKHEHLEGFTRQTIRKALSDELVESLGLEDSSIKKSHNKVGKGLPTLLDNKDPEQSSSPDEELHDLPEPTDNEQVDDEEEEEQDIIYDKDLLNKHVKHIAKLEDKINQLQIERIPTRSDKFEFVYRIEFTDEMFQLIKANSSICPFNVTAFPSKGDGWLRFDRETIEREIKEAQKKK

SEQ ID NO: 2115 - DNA, 720 bp, Unknown
  Obtained from environmental sample
  misc_feature (1)..(720): n is a, c, g, or t
atgaaaagacataatatcatttattttgctgcgatattatttgcctgcaatggcaatacttcggaaaaaaaggaaggatcaatgtataaaactatcggaaccattgaacgccttgaccctgcgttggatgatattatttcagcagatgccaaagcagaaataattgccgaaggttttgaatggagtgaagggccgctatgggtggaaaaccaacaggtgcttttattcagcgatgttccaatgaatactgtttataagtggacagaaggaaaaggaaaagaagtctatcttaacccttccggttataccggggctgaaccatccctgtgcaaagaacccggcagtaacggtttgacatttgacaaaaatggaaatcttgttttatgccagcatggggacaggcgaatggcaagaatggatgcaccacttgataagccggaagcaaagttcatcactcttgcagataaatataatggtaaaaggttcagtagtccgaatgacgcggtgttcaatagtgcaggcgaattattttttaccgatccgccttatggattacaaacacaggacgattcagatactaaaaaagaaatttcatttaatggtgtttataaagtcaaatcaaatggtgaggtgatcttgttggttgattcaattacaaagcccaaatggtattgcattaaatgcccggtgaaaaaaaaattgatcgtttgcctgctctga

SEQ ID NO: 2116 - protein, 239 aa, Unknown
  Obtained from environmental sample
  SIGNAL (1)...(20)
  misc_feature (1)..(239): Xaa is any amino acid
MKRHNIIYFAAILFACNGNTSEKKEGSMYKTIGTIERLDPALDDIISADAKAEIIAEGFEWSEGPLWVENQQVLLFSDVPMNTVYKWTEGKGKEVYLNPSGYTGAEPSLCKEPGSNGLTFDKNGNLVLCQHGDRRMARMDAPLDKPEAKFITLADKYNGKRFSSPNDAVFNSAGELFFTDPPYGLQTQDDSDTKKEISFNGVYKVKSNGEVILLVDSITKPKWYCIKCPVKKKLIVCLL

SEQ ID NO: 2117 - DNA, 489 bp, Unknown
  Obtained from environmental sample
  misc_feature (1)..(489): n is a, c, g, or t
atgaataagctattcctaagtatagtcctgatcctcacttgttgccaactgagcgcgcaggagaagaagctatatcatcccgacgcagatgcagaaaaggacattaaagtagcaatagaaaccgctaagaaagaaaacaaattcgtgttaatccaggctggtggtaactggtgcaagtggtgccttgaatttgcgaggttcgctactacggacccacaaatagattcagtgataagatcctcatttgtatggtatcacctgaacttcagcaaggaaaacaagaatgaaaaaatttttgaaaaactcgattatccgcaaagattcggcttcccggtctttatcattctgaatgaagatggcgtgagaattcatacccaaaacagcgaatatctcgaagacggaaaaagcagttatgataaacgtaaggtgaggtcattcctggaaatgtggacaccacacgcaacaaatccacagaaatataagaactaa

SEQ ID NO: 2118 - protein, 162 aa, Unknown
  Obtained from environmental sample
  SIGNAL (1)...(19)
  misc_feature (1)..(162): Xaa is any amino acid
MNKLFLSIVLILTCCQLSAQEKKLYHPDADAEKDIKVAIETAKKENKFVLIQAGGNWCKWCLEFARFATTDPQIDSVIRSSFVWYHLNFSKENKNEKIFEKLDYPQRFGFPVFIILNEDGVRIHTQNSEYLEDGKSSYDKRKVRSFLEMWTPHATNPQKYKN

SEQ ID NO: 2119 - DNA, 513 bp, Unknown
  Obtained from environmental sample
  misc_feature (1)..(513): n is a, c, g, or t
atgactaaacatgttattacaatactgttggcttcttactgttttataccatttgtctttgcccaggataaaattcaggtaattactgaaaccggagaggtaaacaataacagtacaaaaagtttattgagtgttgagtcatccaaaaaagaatccttacatgaagcagaaattaaaataaagagcgcggagctttaccgatattccttcgatcttttgcaaaagagcaaaactttaaaggaagaacgaactttcaacattgtatcatcattcaggcagaacatcaggttcggcggattttgggaccgctacgccatagttaattttacacccgatatgttcattaagccatttgatttccttagcgtttacgctgtacacaattccagctacttcatccccataaaagcggttaaagaacattttaagctcatggcaatccaaagcgccgccatattggttattgataattccgttaaacaccttatgccggccggcaaagatcaaagataa

SEQ ID NO: 2120 - protein, 170 aa, Unknown
  Obtained from environmental sample
  misc_feature (1)..(170): Xaa is any amino acid
MTKHVITILLASYCFIPFVFAQDKIQVITETGEVNNNSTKSLLSVESSKKESLHEAEIKIKSAELYRYSFDLLQKSKTLKEERTFNIVSSFRQNIRFGGFWDRYAIVNFTPDMFIKPFDFLSVYAVHNSSYFIPIKAVKEHFKLMAIQSAAILVIDNSVKHLMPAGKDQR

SEQ ID NO: 2121 - DNA, 819 bp, Unknown
  Obtained from environmental sample
  misc_feature (1)..(819): n is a, c, g, or t
atggcagaaaatataaatgttggcggcataaatgtaggtttaaatcccgaagaaatgaaagggaagaaggtaattgtaataattttcggtacaagacccgagatcttaaaactgtttgttctgtaccgaattctcaagaaatccgatgaattttacccgctgctctataacacagcacagcagaaaatatcaggcgatatactccaaaatattggcattcacccggatctgacctcaactgaaaaaccaaaccgctcaagtgatttgaatgagcttatcgcgcatttgctgggtgacttcaacgagaaattcagcgataaatcgcccgtaacaaaaagcatgctgcatggtataatcgttcagggtgatacagcttccgcgttttcaggcgcgctgtggggcttcctgaaccagataccggtatttcacgcagaggctggtttacgtacttatgacaagatgaatcccttcccggaagaattcatgcgcgaagctgtcgccagaatgacgacaattcattttgctccaaaaggtattaaccgcgataacctgataagagagggcataaagcccgaaaatgtctttgtaattggtaacacaattaacgatgctattttcacgctcataaaagaaaagaagataaaagaacccgcgcagaaaaattatatactaagtactttccaccgaagggaaaaactggggtttgtagcggattacgcaagagtgctgaactccgttatggatgatgttcaggggtacacagagatactgcatttgatgcatccaaatcatttatacaaaaaacctttaatgaattga

SEQ ID NO: 2122 - protein, 272 aa, Unknown
  Obtained from environmental sample
  DOMAIN (43)...(272): UDP-N-acetylglucosamine 2-epimerase
  misc_feature (1)..(272): Xaa is any amino acid
MAENINVGGINVGLNPEEMKGKKVIVIIFGTRPEILKLFVLYRILKKSDEFYPLLYNTAQQKISGDILQNIGIHPDLTSTEKPNRSSDLNELIAHLLGDFNEKFSDKSPVTKSMLHGIIVQGDTASAFSGALWGFLNQIPVFHAEAGLRTYDKMNPFPEEFMREAVARMTTIHFAPKGINRDNLIREGIKPENVFVIGNTINDAIFTLIKEKKIKEPAQKNYILSTFHRREKLGFVADYARVLNSVMDDVQGYTEILHLMHPNHLYKKPLMN

SEQ ID NO: 2123 - DNA, 684 bp, Unknown
  Obtained from environmental sample
  misc_feature (1)..(684): n is a, c, g, or t
ttgcgggagctcactgccgatcaaataatggaagaagtatgcaagttcgagatcaatagcaataattacaaaacgtttatcctacgaatgacagatgctgctgtagattttaatgaagaatcatttataggaattctaaatgtcttaatgaaaaaaatggggtttgaaaaatcaatcgcagaagtgtgttatccctttataatacgcgtcggtatggtctggacgacaaaaaatatgattccagcccagcaacatttttctattcatattattcaaaataggatcatttccgaaacggataagtttaaagcaagcaataagatacccggagtaatgttgttttcacccggagcacaggatgaactatcgcttctttttatttattacctgttacgaaaaaataattggagtgtaatttatttaggaactaacatcaataaaaaatcaccaaaacagtttacccggcataactctgtagaatatgttttcgttcatgtttccaacttcccgggggatgcagatgtatattttgaagacttatgcaaatcttttcccggcaaaagaattattgttacaggcacagcagcgcaacggttacaaagaaaatttgcgaacttaattatcctaaaatcgaacaaagaaattaatgaatttatacaagacaataaatcagaacctgtttag

SEQ ID NO: 2124 - protein, 227 aa, Unknown
  Obtained from environmental sample
  misc_feature (1)..(227): Xaa is any amino acid
MRELTADQIMEEVCKFEINSNNYKTFILRMTDAAVDFNEESFIGILNVLMKKMGFEKSIAEVCYPFIIRVGMVWTTKNMIPAQQHFSIHIIQNRIISETDKFKASNKIPGVMLFSPGAQDELSLLFIYYLLRKNNWSVIYLGTNINKKSPKQFTRHNSVEYVFVHVSNFPGDADVYFEDLCKSFPGKRIIVTGTAAQRLQRKFANLIILKSNKEINEFIQDNKSEPV

SEQ ID NO: 2125 - DNA, 645 bp, Unknown
  Obtained from environmental sample
  misc_feature (1)..(645): n is a, c, g, or t
gtgattgaaccgattttgaagaagcatggagtgccggatgatttcaaatacatatcagtcgccgaaagcggtttgatgaacagcatttcaaatatgcaagctgtgggtttctggcagttcattgaaggtacaggaaagcaatacaaccttgtgatcaacgaggaagtagatgagcgttacagcgtagagaaaagtacggaagccgcatgcaaatttttcctcgcgtcgaaattgcaattcggctcctggacactggcagcagcatcgttcaacatgggaactgccgctttgcagtcgcagattgagcgacagaaggaaaagaatttttacgacctgctgttaaatgatgaaaccttccggtacatcttcaggatacttgccatcaaagaaatcatggagcacaaaacttcctatggttttcatctggataaaaaagatctttatgcaccgctggaatttacttctcttccggttacacaaacggtgaacgacctggcttcatgggcgcacgatcacaacaccaactacaaaaacctgaaactgctgaacccttggctaaggcaaaattttcttaccgttgatcccggaaaaaaatatgaagtgaaaattctgaagaagggatatacggggaccattgaggattga

SEQ ID NO: 2126 - protein, 214 aa, Unknown
  Obtained from environmental sample
  DOMAIN (1)...(113): Transglycosylase SLT domain
  misc_feature (1)..(214): Xaa is any amino acid
MIEPILKKHGVPDDFKYISVAESGLMNSISNMQAVGFWQFIEGTGKQYNLVINEEVDERYSVEKSTEAACKFFLASKLQFGSWTLAAASFNMGTAALQSQIERQKEKNFYDLLLNDETFRYIFRILAIKEIMEHKTSYGFHLDKKDLYAPLEFTSLPVTQTVNDLASWAHDHNTNYKNLKLLNPWLRQNFLTVDPGKKYEVKILKKGYTGTIED

SEQ ID NO: 2127 - DNA, 897 bp, Unknown
  Obtained from environmental sample
  misc_feature (1)..(897): n is a, c, g, or t
gtggatctttttaacttctttaaaatattcatagtacattcattgtttatcattatagctttcatcataattcttataagcagattcagaaaatataatccaagctttaaatctaaattactatttgcatttctggtaatttctataattccggttgtagtgcttgcattatataatacaaaaatagttggtgaaagagccaaagaaggcattaagaatgaattaagtcagagaacaaattatattgaaaaacatttaacaagtcagctcgaaaaaaataaaaaccgaaatattataactgcttcagaaaatgctgcacgagaattagggatttcatttgctctctatgaatcaacagatcagatttataattctaaagatatttataatagaataggtttgttcgatagaaaattaaatccaaaagcttactatcatcttacttatttaagatatcaggaatatgttgcatctgaaatgcttaataaatacaagtttgattcttattacagggtgattagtgtaagagacaaagattatattttatccgttaatgatgctttcaacaaaataaaagtattattttcaactacagaaattaatgtaataatatttggaatttattcgtttgccgtaataattattatcataattagtacactatttgccaatcaaatttcccaacccattcagagattaactgaagctacggatgccgttagtaaaggtgatcttaatataaaaattgatcataaagaaaagggagagttaaaggatttatttgatggattcaatcaaatgacttcagaacttaagaagaatcagattgaacttgcagagatggaaagggaagcagcatggaaagaaatggctaaacaagttgccccacgaaaataa

SEQ ID NO: 2128 - protein, 298 aa, Unknown
  Obtained from environmental sample
  DOMAIN (204)...(273): HAMP domain
  misc_feature (1)..(298): Xaa is any amino acid
MDLFNFFKIFIVHSLFIIIAFIIILISRFRKYNPSFKSKLLFAFLVISIIPVVVLALYNTKIVGERAKEGIKNELSQRTNYIEKHLTSQLEKNKNRNIITASENAARELGISFALYESTDQIYNSKDIYNRIGLFDRKLNPKAYYHLTYLRYQEYVASEMLNKYKFDSYYRVISVRDKDYILSVNDAFNKIKVLFSTTEINVIIFGIYSFAVIIIIIISTLFANQISQPIQRLTEATDAVSKGDLNIKIDHKEKGELKDLFDGFNQMTSELKKNQIELAEMEREAAWKEMAKQVAPRK

SEQ ID NO: 2129 - DNA, 585 bp, Unknown
  Obtained from environmental sample
  misc_feature (1)..(585): n is a, c, g, or t
ttgccaagtatagatgataatagcaacaacaagaataattccgaaaatatgattggcttggagtttatactggaacttttaaaaaaagaaacgcagattcctaagatccaagccatatcacctgacatttatagaaaaattgcacaaataatcaggggcctttcgatccaaaaatatgaagacttggaattggatgtacatcatgaactcattaaattactaacaatatctacaaaatcattgtttgaattaagaatccgaaagctcttagaaagttctaacgttcaacatttgtcatatccttcattattgtctagcgatgactattcaaaattaactgatgaagagaagtttatttttgaagaagaaagaaaagtttcacaaagaaaggaacttatcatacagtctttaattggcggaaatgtgaacaatttagatacaatatcaagaatcataagatccaaaatgattataatcagatttttagagtctactgatcagttcatgggggttgatatggcaaaatatggtccgttcattaaagaggatattgcgatattacccttgaaaatgcaagatctttaa

SEQ ID NO: 2130 - protein, 194 aa, Unknown
  Obtained from environmental sample
  misc_feature (1)..(194): Xaa is any amino acid
MPSIDDNSNNKNNSENMIGLEFILELLKKETQIPKIQAISPDIYRKIAQIIRGLSIQKYEDLELDVHHELIKLLTISTKSLFELRIRKLLESSNVQHLSYPSLLSSDDYSKLTDEEKFIFEEERKVSQRKELIIQSLIGGNVNNLDTISRIIRSKMIIIRFLESTDQFMGVDMAKYGPFIKEDIAILPLKMQDL

SEQ ID NO: 2131 - DNA, 834 bp, Unknown
  Obtained from environmental sample
  misc_feature (1)..(834): n is a, c, g, or t
atgaaaccggctttaaaacgggtttttaaatattctatactgtgcattttatgtctttggctgctagcatccacttctctggcttatatacttcttaaaaactcctacgatgattataagtatgatcaattaaaagctagttttgaaagcaatccggctaattattatgaattaaaagattttacgcaaaacagtctttttataaatagaataaccacatgtaaagatcaggcgattcttaaactgcttcagacagaacaaaagcttcgcggctatgataagattattagtgcaggaaaaatgaataattatgtaatcgatagtttcaaaacttactttgtcggctggcctaaaaaaatcaaggagttctgcgatcaggaaattggaggcgtgtattcggtaaaaaatttaagatcgtcagcagttacaatatcaaatgcagccgggcactacatcatatttattaatgaacagatttttgaagaaaaagcaaatgattggtgtaatcgaattgattctatgcctgttgattttcacaattcatcattaagattgagtgatataattgaaatcgatagctgcaacacacaatccgcaacactagaaaacattttgcttcatgaaattggccattgcattggcgataaatatgggcttactccaagtttttcacacaaagtgaaagaaacgaaggagttttttaaaaatgtttattctgttagctattatgaactgatgcttgaagaaaagtataaggatttacaggctttaaaattctattcggacgaagaaaaaatttccacttcgtcccttgtgcgctccttagaaaactag

SEQ ID NO: 2132 - protein, 277 aa, Unknown
  Obtained from environmental sample
  misc_feature (1)..(277): Xaa is any amino acid
MKPALKRVFKYSILCILCLWLLASTSLAYILLKNSYDDYKYDQLKASFESNPANYYELKDFTQNSLFINRITTCKDQAILKLLQTEQKLRGYDKIISAGKMNNYVIDSFKTYFVGWPKKIKEFCDQEIGGVYSVKNLRSSAVTISNAAGHYIIFINEQIFEEKANDWCNRIDSMPVDFHNSSLRLSDIIEIDSCNTQSATLENILLHEIGHCIGDKYGLTPSFSHKVKETKEFFKNVYSVSYYELMLEEKYKDLQALKFYSDEEKISTSSLVRSLEN

SEQ ID NO: 2133 - DNA, 513 bp, Unknown
  Obtained from environmental sample
  misc_feature (1)..(513): n is a, c, g, or t
ttgcagggagaaaagaaaagagacctaatgctggtgcctgaatttaagagaggaatcagcttgctgaataaatatggctttacttatgacattctcatttttcctgatcagttagtgtttgcagaagaacttattaaagaatttccagaacagaaatttgtgatcgatcatttggcaaaacccaatattaaagatggtaagacagaagagtggaaaaaagatatggaagcgatcggcaattttgaaaatgtttattgcaaaatatccggtatggtaacagaagcagattggaaaaactggatgactaaagatttctttccttatttagacacagttataaattcatttggttccaataaaataatgtatggttctgactggcctgtatgtttggttgctgcttcttatgaacaagctctaaatattgtacgcgaatatttttcttctttttcaaaaaacgaacaagacttattttttggtggtaatgctgttaaattctataatcttaattaa

SEQ ID NO: 2134 - protein, 170 aa, Unknown
  Obtained from environmental sample
  misc_feature (1)..(170): Xaa is any amino acid
MQGEKKRDLMLVPEFKRGISLLNKYGFTYDILIFPDQLVFAEELIKEFPEQKFVIDHLAKPNIKDGKTEEWKKDMEAIGNFENVYCKISGMVTEADWKNWMTKDFFPYLDTVINSFGSNKIMYGSDWPVCLVAASYEQALNIVREYFSSFSKNEQDLFFGGNAVKFYNLN

SEQ ID NO: 2135 - DNA, 888 bp, Unknown
  Obtained from environmental sample
  misc_feature (1)..(888): n is a, c, g, or t
atgaaccttctattggtttgcatccaagagatacgtttaattgtaatccgggttttaaaagagcttcgtgaccttggcaacactgttgttgttgtggaacacgatgaaatgatgatgcgtgaagccgatcatattattgatatgggaccgctggcttcgcatttaggtggagaagtaattgctgagggcaactatgatgcaattatttctaaccccgaaagtcttacggggaaatatctaaagggtgaattaacaatcgatcctccaaaaaaattacgcaagttccaggaatccataattattgaaggcgcccgccagcataatttaaaagacatcacagttgaatttccgttgaatgtgctttgtgtggtaagtggtgttagcggaagcggaaaaacaacgttgatcaaacacattttgtatcctgctttaaaaaaattgcaaggtgaagctgcggataaagtgggcttccatcgtgctattaaaggcaatatagattctatcgcacatgtggaaatggtcgatcaaaatcccattggaaaatcgtcaagaagtaatccggttacgtacataaaagcctgggataatattcgtgacctgtatgcttcgcaacctttgagtaaaatgcgtggctttcagcccaagcatttttcgtttaatgtagatggaggaagatgtgacgcttgcaagggcgagggagagaaaattgtagaaatgcaatttttggccgacgttcatcttacgtgcgaagtctgcggaggaaaacggttcaaggaagaagtgctggaagtggagtacaaaggaaaaaatgtgtttgatgttctggaaatgagcgtagacgaagccattgagttttttaaagatgaaaaggactgcctaactgcctga

SEQ ID NO: 2136 - protein, 295 aa, Unknown
  Obtained from environmental sample
  misc_feature (1)..(295): Xaa is any amino acid
MNLLLVCIQEIRLIVIRVLKELRDLGNTVVVVEHDEMMMREADHIIDMGPLASHLGGEVIAEGNYDAIISNPESLTGKYLKGELTIDPPKKLRKFQESIIIEGARQHNLKDITVEFPLNVLCVVSGVSGSGKTTLIKHILYPALKKLQGEAADKVGFHRAIKGNIDSIAHVEMVDQNPIGKSSRSNPVTYIKAWDNIRDLYASQPLSKMRGFQPKHFSFNVDGGRCDACKGEGEKIVEMQFLADVHLTCEVCGGKRFKEEVLEVEYKGKNVFDVLEMSVDEAIEFFKDEKDCLTA

SEQ ID NO: 2137 - DNA, 441 bp, Unknown
  Obtained from environmental sample
  misc_feature (1)..(441): n is a, c, g, or t
atggctaaacgaaaaaaccctatcagggctgtcaatacaactaaaaggacaagaaagccaaaaaagaaaaaacgatccctggcaggactttttatcatcattggtctcttgatagccaccactattttctatattgttacccaaaaaaacaaacctctttcaccaaaatccttcagagaaatgattccaaaaggatttccaacggtgggaattgatgtttcccatcaccagggagaaatggattgggatgaattatttaataaaagtggttatgattctttgatacagtttgtttattgcaaagctacggaaggagacactcatattgatactcagtgggaacgcaatcgaaaacaattaaacaatttaggaattcccaatggagcctatcatttttttcgttccaaagaagattcaaaatcacaagtccagcatttttga

SEQ ID NO: 2138 - protein, 146 aa, Unknown
  Obtained from environmental sample
  misc_feature (1)..(146): Xaa is any amino acid
MAKRKNPIRAVNTTKRTRKPKKKKRSLAGLFIIIGLLIATTIFYIVTQKNKPLSPKSFREMIPKGFPTVGIDVSHHQGEMDWDELFNKSGYDSLIQFVYCKATEGDTHIDTQWERNRKQLNNLGIPNGAYHFFRSKEDSKSQVQHF

SEQ ID NO: 2139 - DNA, 819 bp, Unknown
  Obtained from environmental sample
  misc_feature (1)..(819): n is a, c, g, or t
atgggagaaaattttcaaattcagttaatgaaaaaaaacctaaaaactacaacaaatacatatacattaaatagatttgttaatccatctcaaattcttgatctggtgtcacaatatggaacccccttatatctagtagatgaaaatactttacacttgaaagctaacgaattattaaatgcttataaaaaattcaaaggaccaaaaagaattgcatattcagtaaaagctaatttccttcctgcaatattacgttcttttatgaaggatagaattacatttgatctcacatcattaggtgaattatattttttaaaaagatgtaagataaaatcagataatgttatctatactagtattacagaagaagaagaagaatatgttcaagtcttacgaaatgggataactaaagtagtagttagctctttcaatggaatgactaatcttgtaaaggctgcagaaaagtctaatgttaaaccacaaactttgataagaataaatccagaggttggtgtaaaagctgaaatccgagcttcatctaaaaatggaaaatttggagtaccctttaatggaggaaccattgatagtgccttcaaaattgttaaacatattgtgaataataagtttattaattttgatggctttcattttcatttagggtcacaaataactaatttctcctgttattctaatacattctcaaaactggatgtgtttatttctaaaattaaaaaagatattccttcttttaagatcaatactattgatattggaggtggaactcctgtattctataatcaacccagttcctactcctaa

SEQ ID NO: 2140 - protein, 272 aa, Unknown
  Obtained from environmental sample
  DOMAIN (52)...(271): Pyridoxal-dependent decarboxylase, pyridoxal binding domain
  misc_feature (1)..(272): Xaa is any amino acid
MGENFQIQLMKKNLKTTTNTYTLNRFVNPSQILDLVSQYGTPLYLVDENTLHLKANELLNAYKKFKGPKRIAYSVKANFLPAILRSFMKDRITFDLTSLGELYFLKRCKIKSDNVIYTSITEEEEEYVQVLRNGITKVVVSSFNGMTNLVKAAEKSNVKPQTLIRINPEVGVKAEIRASSKNGKFGVPFNGGTIDSAFKIVKHIVNNKFINFDGFHFHLGSQITNFSCYSNTFSKLDVFISKIKKDIPSFKINTIDIGGGTPVFYNQPSSYS

SEQ ID NO: 2141 - DNA, 342 bp, Unknown
  Obtained from environmental sample
  misc_feature (1)..(342): n is a, c, g, or t
atgagcagctcaaattcaatcactagaataatgacagcaattcttctagcgtctataacaatgacaatagtttatgtaggaataccgggcaataagaagattacatatgcaggagatgagtcaggaagatctncttatggaatatggtctgttcaaggtttcaaagctactcagaaatatggatatggatgtgatgagcttgatggagatgcggttttgttgtgttttgaaaaaaataaattttggtggaaaattccgaaagtagtgtataaagtaattttttcaagtcattcttttattcccccaaaaggtctaaataaattaacccttcccccaatctaa

SEQ ID NO: 2142 - protein, 113 aa, Unknown
  Obtained from environmental sample
  misc_feature (1)..(113): Xaa is any amino acid
MSSSNSITRIMTAILLASITMTIVYVGIPGNKKITYAGDESGRSXYGIWSVQGFKATQKYGYGCDELDGDAVLLCFEKNKFWWKIPKVVYKVIFSSHSFIPPKGLNKLTLPPI

SEQ ID NO: 2143 - DNA, 909 bp, Unknown
  Obtained from environmental sample
  misc_feature (1)..(909): n is a, c, g, or t
atgtatatcggtaaattaggcgatggatccagtcctgacgacgggatttatgtgcttctaaaagaagtcgttgataattgtatcgatgaacacactatgggttatggcaaacatgtcgacataaccattgaaggaaaaacggtgaccgtacgtgattacgggcgtggtatcccgctgggaaaggtggtggatgtggtgagtaagatcaacaccggtgcaaagtatgatagcaaagcatttcaaaaatcggttggattaaacggagtgggtacaaaagcggtgaacgctctcagtaattattttaaagtcaccgcaatccgcgagggaaaagaaaagtcagctgaatttcaaaggggcgtgctggtgaaggaatataaggaagccaagagcggtgaggaaaatggaaccctaatcaccttcattcccgacgaaaatgtatttaaaaattttcattacgttcatgaatacctcgataaccagctttggaattattgttatctgaacgcaggcctggttattaacctgaatggaaaaagatatgttagcaaaaatggcttgctcgatctcttacaacgcaaaacaaatgctgacgaactaagatacccaatcatccacctgaagggtgaagacattgaggtggcagtcacgcatgaaaaccaatacggggaagagtattattctttcgtcaacggtcaatacacaacccagggaggcacccatctcgcagcattccgcgaggcatatgttaagacaatccgggatttttataaaaaggattatgatgcctccgatatacgcggcagtatctgttcagcgatctccgttagggttcaggagcccgtgttcgaatcacaaactaagacaaagctgggatcgcagatgtttagatggcgtcctcgaggaaattga

SEQ ID NO: 2144 - protein, 302 aa, Unknown
  Obtained from environmental sample
  DOMAIN (185)...(302): DNA gyrase B
  misc_feature (1)..(302): Xaa is any amino acid
MYIGKLGDGSSPDDGIYVLLKEVVDNCIDEHTMGYGKHVDITIEGKTVTVRDYGRGIPLGKVVDVVSKINTGAKYDSKAFQKSVGLNGVGTKAVNALSNYFKVTAIREGKEKSAEFQRGVLVKEYKEAKSGEENGTLITFIPDENVFKNFHYVHEYLDNQLWNYCYLNAGLVINLNGKRYVSKNGLLDLLQRKTNADELRYPIIHLKGEDIEVAVTHENQYGEEYYSFVNGQYTTQGGTHLAAFREAYVKTIRDFYKKDYDASDIRGSICSAISVRVQEPVFESQTKTKLGSQMFRWRPRGN

SEQ ID NO: 2145 - DNA, 609 bp, Unknown
  Obtained from environmental sample
  misc_feature (1)..(609): n is a, c, g, or t
atgaaggattggaacataccgggtttatcggtatcgattttgaaagatgggaaagtggttttcatgaaaggatatggatatgccgacatcaaaacaaaacagccggttaatgaagaaacgttgtttatcatcgcaagcaacagtaaactatttaccggcacggcgctcgcgaacctggatcatcagaaaaaactttcactcgatgagcacgtgataaaatacgatccttcattcaggttgtatgacagcaacgtcacgcaactcgttacggtaagagacttgctctgccaccggcttggtctgaaaacgtttcatggcgacctcacaaactggaatacaaagtacagccggcaacagatcgtgcacaacatgcggctgcttaaacccgtcggtgcattcaggcaggattacgggtattcaaacagtgcttttgtagaagccggcgaaatactcacgaaaataacgggtaagtcgtggagcgattatatacaggcaaacatcctgacaccgctccggatgacaaataccttcccggttatcgcaggaatagaaaatcgaaaaaatgttgcgcggccctacacagacgcctttgtcacgcggctgttttga

SEQ ID NO: 2146 - protein, 202 aa, Unknown
  Obtained from environmental sample
  DOMAIN (1)...(200): Beta-lactamase
  misc_feature (1)..(202): Xaa is any amino acid
MKDWNIPGLSVSILKDGKVVFMKGYGYADIKTKQPVNEETLFIIASNSKLFTGTALANLDHQKKLSLDEHVIKYDPSFRLYDSNVTQLVTVRDLLCHRLGLKTFHGDLTNWNTKYSRQQIVHNMRLLKPVGAFRQDYGYSNSAFVEAGEILTKITGKSWSDYIQANILTPLRMTNTFPVIAGIENRKNVARPYTDAFVTRLF

SEQ ID NO: 2147 - DNA, 882 bp, Unknown
  Obtained from environmental sample
  misc_feature (1)..(882): n is a, c, g, or t
gtgnctacacaaggacgttcgttttatgtgttggatgaattaaatttgttgcagcaattggactctggcgtcggtaacaaaaaccggcaagtatttgatgttactccggcttatcgaatggcaagaagtcctttcacacaaaactttggaactctccgaaatgccggggctaatccaccagccggagtcctaattaattattttgtgaaagaggctacagattcaacaaaagcatttgtgaccgttttggataaagatcataaagagatcaaaacttactcaaccgaatcgaaagagaataatacaaagctggatgtggcaaaaggcatgaaccaatttgcttgggatcttcgttatcctgaagccgatagaattgaaggaatgattttatggaatggagtgcccggcgcaatcattgtttcgccagggaattattttgcaaaaatcaaggttgggaaagattcggttgaagtgccattcagtattagagccgacccgagttataaactcacccagcacgagtatgatgcacaatttgcttttttgaaacaggtgcgtgacaaattcaatgaaacgcaaaaagcaatcaaggatatcaggaatttgcgtacacaaatcaattcgtttattgcacagcagggaaaagacattccgaaggaagtgaaacaaatggctgacagtatcagtaaagaactaactacggttgaagaaaccctctatcaaaccaaatcaaaaagtagccaagatgtattgaactttccgatccgattgaacgacaaactcgctggtatttttgatgttgccaatagtggaactctgctccaagtaagcaggttactgaagtgtataatgatctgcttcccagatcgacacgcatcttga

SEQ ID NO: 2148 - protein, 293 aa, Unknown
  Obtained from environmental sample
  misc_feature (1)..(293): Xaa is any amino acid
MXTQGRSFYVLDELNLLQQLDSGVGNKNRQVFDVTPAYRMARSPFTQNFGTLRNAGANPPAGVLINYFVKEATDSTKAFVTVLDKDHKEIKTYSTESKENNTKLDVAKGMNQFAWDLRYPEADRIEGMILWNGVPGAIIVSPGNYFAKIKVGKDSVEVPFSIRADPSYKLTQHEYDAQFAFLKQVRDKFNETQKAIKDIRNLRTQINSFIAQQGKDIPKEVKQMADSISKELTTVEETLYQTKSKSSQDVLNFPIRLNDKLAGIFDVANSGTLLQVSRLLKCIMICFPDRHAS

SEQ ID NO: 2149 - DNA, 600 bp, Unknown
  Obtained from environmental sample
  misc_feature (1)..(600): n is a, c, g, or t
ttgtcagaagctgcaaaaggtgttgtaagcagtattgacaaattactacaaagttatggtattagggctgaaataacgtctggcaaaagaagcaaacgtggagtaaaatcaaatcataattccggtaatgcaatagatttagtatcgccaagcagaattagacaagatactattgatttaggtaagtttttacgtgaaaaaaaatactcagcaatatttgaaaaaaaaggtcagcgtaacaaaaataatccatctgttccagttgacggagatcacgtacatgtgaatcttattacgaatggagtttatactgatgacgaaatttttgatgaagaaatagacttgttgattgacacaatattaaaggatgacgaagaactagatccagaagatccggctgatgctgaaaaaataaagttaatagaaaatcttagccctatacagtcgataaaaccgacgcaaatattaaattcaaatatcaaagatggcgttcctgctgtttatcgtttaggtgatattattactgtttgcttagagataatagacaagattatagatgatagaacacataatagcagttcaaatgaattcccggcataa

SEQ ID NO: 2150 - protein, 199 aa, Unknown
  Obtained from environmental sample
  misc_feature (1)..(199): Xaa is any amino acid
MSEAAKGVVSSIDKLLQSYGIRAEITSGKRSKRGVKSNHNSGNAIDLVSPSRIRQDTIDLGKFLREKKYSAIFEKKGQRNKNNPSVPVDGDHVHVNLITNGVYTDDEIFDEEIDLLIDTILKDDEELDPEDPADAEKIKLIENLSPIQSIKPTQILNSNIKDGVPAVYRLGDIITVCLEIIDKIIDDRTHNSSSNEFPA

SEQ ID NO: 2151 - DNA, 348 bp, Unknown
  Obtained from environmental sample
  misc_feature (1)..(348): n is a, c, g, or t
atgaaggttgtttccaaataccagccactgaagcattatcaatggggaagtgattgtgatggatggaacttagttgatgaagatagtttatcagtaaagcaggaattaatgcctgccggtacaaaagaagtgaagcactttcatcaaacagcacaacagttcttttatattttgaaaggcaccgcaacatttgaaatagaagattcaacgatagaaataaacaaaggtgaaggtttgcatattgaagcaggaaagaagcaccgaatagtaaacggaagcagtgaagacttagaattcatcctgtgctcacaaccttccaccaacaacgatagaataaactgcgagtaa

SEQ ID NO: 2152 - protein, 115 aa, Unknown
  Obtained from environmental sample
  misc_feature (1)..(115): Xaa is any amino acid
MKVVSKYQPLKHYQWGSDCDGWNLVDEDSLSVKQELMPAGTKEVKHFHQTAQQFFYILKGTATFEIEDSTIEINKGEGLHIEAGKKHRIVNGSSEDLEFILCSQPSTNNDRINCE

SEQ ID NO: 2153 - DNA, 711 bp, Unknown
  Obtained from environmental sample
  misc_feature (1)..(711): n is a, c, g, or t
ttggatcaaatatttctaaagttaaccattctcctgaggatggtgcaacgaatcttaaagttgttgactgtagaaggagcggttaaagaaacgtgcgaaggtcgcgaacgattatattgccgtattatcgagggataccaagaagactttgggcgcatcaaacaatacattgatttacgttggaaagaatggtatgaaatcaaccggtatacccaatataacggctgcttaatggaatatttacaaaaagcactaaatgacacaaccgcccaacaatgtcagcggtgtgctaactgccagcagaaaggtttcacttcagacgttccagcagatttggtaattgaggctgaagattttctaaaagaatgttcaattgttattaaaccaaaagataaagcgcccggaggattgattaatacaggtgttaagattcctccaaacctgaaaaattatcctggacaaagtttaagttattatggcgatgccggatggggacaatgtgtaaaaaatggaaaatatcaaaagaattattttgcagatgaattagtgacagcctcggtacacttgattttaattcgctggagaccaaatccatttccccaatgggtagcagcgattccatcaaaacgtcatcctaatcttgtggcagattttgcaaaacgactggctgaatgtcttaatattccatttattccagtacttggagcgtaa

SEQ ID NO: 2154 - protein, 236 aa, Unknown
  Obtained from environmental sample
  misc_feature (1)..(236): Xaa is any amino acid
MDQIFLKLTILLRMVQRILKLLTVEGAVKETCEGRERLYCRIIEGYQEDFGRIKQYIDLRWKEWYEINRYTQYNGCLMEYLQKALNDTTAQQCQRCANCQQKGFTSDVPADLVIEAEDFLKECSIVIKPKDKAPGGLINTGVKIPPNLKNYPGQSLSYYGDAGWGQCVKNGKYQKNYFADELVTASVHLILIRWRPNPFPQWVAAIPSKRHPNLVADFAKRLAECLNIPFIPVLGA

SEQ ID NO: 2155 - DNA, 759 bp, Unknown
  Obtained from environmental sample
  misc_feature (1)..(759): n is a, c, g, or t
ttgattcctttaggcaaggaatataacgtccctttaagacatgtaaaagacattaaccatccgaacaatgttcaatttatgaggaacaccagtcctgatatcatttattgctttggatggtcttctttattgaaaaaagaaatactacagttgccaaggcttggtgtgattggttttcatcctgcagctctgcctgaaaacaagggccggcatccccttatctgggctttagctcttggattaacagaaacagcttcaagtttttttgtaatgaatgagaacgcagacgatgggaatatcatcgcacaagaaaaaataaaaatcgattttaaagatgatgcggcttctctctatgaaaaaatgacggcagtagcattgaagcaagtaagctcttttacaaaacaaattcaacaaacaggcactcttacctatataaaagaaaatgccgaaggtaattcatggcgaaagcgtggtaaagcagatgggcgtatagatttcagaatgtcaagcgaagcaatatataatcttgtaagagctttaacccggccttatgtcggtgctcatattgaagcaaaaggagaagatatagtgatatggaaaacaagagtagaaaaaattgataaaaaaaatattgaacctggtaaggtgcttgaagtgaaagacaatacaattctggtaaaaacttatgatggcgctatccggttacttgaacatgaattcggaaacaggctaccaaaaaaaaatgattatttgatatga

SEQ ID NO: 2156 - protein, 252 aa, Unknown
  Obtained from environmental sample
  DOMAIN (2)...(133): Formyl transferase
  misc_feature (1)..(252): Xaa is any amino acid
MIPLGKEYNVPLRHVKDINHPNNVQFMRNTSPDIIYCFGWSSLLKKEILQLPRLGVIGFHPAALPENKGRHPLIWALALGLTETASSFFVMNENADDGNIIAQEKIKIDFKDDAASLYEKMTAVALKQVSSFTKQIQQTGTLTYIKENAEGNSWRKRGKADGRIDFRMSSEAIYNLVRALTRPYVGAHIEAKGEDIVIWKTRVEKIDKKNIEPGKVLEVKDNTILVKTYDGAIRLLEHEFGNRLPKKNDYLI

SEQ ID NO: 2157 - DNA, 750 bp, Unknown
  Obtained from environmental sample
  misc_feature (1)..(750): n is a, c, g, or t
gtggttttccacatacaaggattggtagcaccgtatgcagatgtatattttcctgctggcttttccaaaagagaggttttaaaaaagagcaacctggccgatatctttcgtggagttactttctatcatcgctatttagtaatgaagaaacggggcgaacgggaaatagaaatgataaaacaatggaaatattttaccggcagaaccgactgggacaggaattacgtaaaacttattaacccggcagctatctattttcatggtgaagaattgctgagggcagattttttttccgctcaatggcagcctttacagtcaccggcaaagggacagcagattgttattggcactacaatcaatcctaatatttacaaagggctggacctggtgtataaagtagtgaaccttttaaaagattacaacatctgctggaaaatttttggcattgccgctgataatccggtaaacaacattataaaaaaagtaatggatattaagaaggctgnggcggctgtaaagttttatggccagttaagtgctcctcaattaatcgaagaattgaagacctgccacttttttgtacatccatcctatattgataacagccccaacagcgtttgcgaagcaatgctgcttggcatgccggtgctttcatcttcgncaggtggtggtaaagtcttaataaccataaagaaacgggttctgttcaatcttatgatcatagaatggcaggttgtggttcacttataa

SEQ ID NO: 2158 - protein, 249 aa, Unknown
  Obtained from environmental sample
  DOMAIN (99)...(245): Glycosyl transferases group 1
  misc_feature (1)..(249): Xaa is any amino acid
MVFHIQGLVAPYADVYFPAGFSKREVLKKSNLADIFRGVTFYHRYLVMKKRGEREIEMIKQWKYFTGRTDWDRNYVKLINPAAIYFHGEELLRADFFSAQWQPLQSPAKGQQIVIGTTINPNIYKGLDLVYKVVNLLKDYNICWKIFGIAADNPVNNIIKKVMDIKKAXAAVKFYGQLSAPQLIEELKTCHFFVHPSYIDNSPNSVCEAMLLGMPVLSSSXGGGKVLITIKKRVLFNLMIIEWQVVVHL

SEQ ID NO: 2159 - DNA, 483 bp, Unknown
  Obtained from environmental sample
  misc_feature (1)..(483): n is a, c, g, or t
atgtctgggtttctatcaacatatttcggaaatatatacagggcctttcgttccttcggaaaaggaatgaagataaccggctattatttcactcaccataaggaaattcttacacaagaatatcctgacaaccgcgacacgctcacattcggcgagcgtttcaggggagaagtggtaatgccgcacgatgaaaacaacgagcatcgctgcacaggatgcagtgcttgcgagattgcttgtccgaacggaaccatcaagattttaacgaagcaggagattactgaggacggcaaaaagaaaaaagccatcgataagtttgtttatcatttaggcatgtgcacgttttgcaacctctgtatcattgcctgtccgaccgatgcgatcaagatgagccacgactttgagcacagcgtgtacgacaggaaacaacttaccaaggtgttgaataaaccgggatctaaacttgcaaaaggagtagaataa

SEQ ID NO: 2160 - protein, 160 aa, Unknown
  Obtained from environmental sample
  DOMAIN (63)...(86): 4Fe-4S binding domain
  misc_feature (1)..(160): Xaa is any amino acid
MSGFLSTYFGNIYRAFRSFGKGMKITGYYFTHHKEILTQEYPDNRDTLTFGERFRGEVVMPHDENNEHRCTGCSACEIACPNGTIKILTKQEITEDGKKKKAIDKFVYHLGMCTFCNLCIIACPTDAIKMSHDFEHSVYDRKQLTKVLNKPGSKLAKGVE

SEQ ID NO: 2161 - DNA, 825 bp, Unknown
  Obtained from environmental sample
  misc_feature (1)..(825): n is a, c, g, or t
ttgcgtatctgcgtaagacgaaggagtttgaagaatattgaggcgttgatgaagcgtaaagacggccgccaggtactggttcgcatgacgatccgattagttagtcatgatggcaacgacgactatttcgttggatccgtcatggatatttcgaaagagaaagctgcggccaatgaacttatcgagagcagaaattttcttgataacatcatcaacaccgttgctgcccccatctttgtcaaagactcgaaacatcgatggatcaagttcaataattcgttttgtgatcttttgaaacaaagcccggaagaaattctcggcaagaccgacaaacatttcctcaagccagccgaggcaaaagttttctgggcgatagataaccaggtgctggaaagtgggcagactgttttcaatgaagaaaggataacggataacaatggcattactcatgatctgataacagtcaagtcgcgctatgtcaatgataatggcgagaagttcatcattggatttatcacagagataacgtcgataaaaagaaccgaggaggagatcagtcagctcaacgccaaccttcaaggcgtgatggagagcacgaaggagtctattttttcaatcgacaaccggtacaactacacggcgtacaattcaaaccataaaaaggtgatgaagttgttgtatggctgcgatatcgaagtcggcacgaataaatttaaatgtatcaaagggtcgaaagatgagaaatggctgacagctgatcttcaatcggcgatgcgtggtatcattttgttgttgacgccatctcgactatctacaatatcataa

SEQ ID NO: 2162 - protein, 274 aa, Unknown
  Obtained from environmental sample
  DOMAIN (65)...(126): PAS domain
  misc_feature (1)..(274): Xaa is any amino acid
MRICVRRRSLKNIEALMKRKDGRQVLVRMTIRLVSHDGNDDYFVGSVMDISKEKAAANELIESRNFLDNIINTVAAPIFVKDSKHRWIKFNNSFCDLLKQSPEEILGKTDKHFLKPAEAKVFWAIDNQVLESGQTVFNEERITDNNGITHDLITVKSRYVNDNGEKFIIGFITEITSIKRTEEEISQLNANLQGVMESTKESIFSIDNRYNYTAYNSNHKKVMKLLYGCDIEVGTNKFKCIKGSKDEKWLTADLQSAMRGIILLLTPSRLSTIS

SEQ ID NO: 2163 - DNA, 540 bp, Unknown
  Obtained from environmental sample
  misc_feature (1)..(540): n is a, c, g, or t
atggaagatcaaaatccgatcctgaaaaaagcggttttcaatcccgcatttaaaacctatattttcttgatcgtccttttttacctgttcgtttctatagcagggatcattatcatccctttgtggcttttaggtcttggtcagtggctatcgggtttgtatttcaagacactgaaatgcgaactgagcgagaagaatctttatttttcaaaaggcgtgatcattcatattgaaaagactattccattagaaaatatccaggatctttcatttgtgggcggacctcttcttcgtgccatgggccttacgttcattcgcgtagaaactgcgggtggaggaggagcgcatcacagcaacatgatgagtataccgggcgttgaggaagccgaggaattcaaaaacatgatcctgttacagcgcgaaaaagtgatcagggccaaatcagctggcgtggtaactcaaacatcgggtgatactgctctgttaaaggagatcaggaatgagttgatggaaataaaaaatatcctcgctaggaaataa

SEQ ID NO: 2164 - protein, 179 aa, Unknown
  Obtained from environmental sample
  DOMAIN (54)...(136): Bacterial membrane flanked domain
  misc_feature (1)..(179): Xaa is any amino acid
MEDQNPILKKAVFNPAFKTYIFLIVLFYLFVSIAGIIIIPLWLLGLGQWLSGLYFKTLKCELSEKNLYFSKGVIIHIEKTIPLENIQDLSFVGGPLLRAMGLTFIRVETAGGGGAHHSNMMSIPGVEEAEEFKNMILLQREKVIRAKSAGVVTQTSGDTALLKEIRNELMEIKNILARK

SEQ ID NO: 2165 - DNA, 540 bp, Unknown; identical to SEQ ID NO: 2163
  Obtained from environmental sample
  misc_feature (1)..(540): n is a, c, g, or t

SEQ ID NO: 2166 - protein, 179 aa, Unknown; identical to SEQ ID NO: 2164
  Obtained from environmental sample
  DOMAIN (54)...(136): Bacterial membrane flanked domain
  misc_feature (1)..(179): Xaa is any amino acid

SEQ ID NO: 2167 - DNA, 789 bp, Unknown
  Obtained from environmental sample
  misc_feature (1)..(789): n is a, c, g, or t
atgaagatacttcacctatctgatgatggacttccggattggagagttgaaaaatctgctctaacggcaacaaaagccggacatgaagtattttttggaggtcgactgaacgataattataccaagtctaccctattttcggaactccatgcggtcaagtggacggctggtgctatggtaggcattccatattattaccatagtgtcaaaaagcaggttgaaaaattggttaagaaagtgagacccgatgttgtacattcgcataatattggttctgctaagttatcccatgacctcggccttccttttgtgtttgacgatcatgagtactttgggatgctctcaagagttaatgctgagaatatcaagttccaaaatatcccgcatttaaagtctagatttgacagaatcaagcaaaatatgaaattgtcattaatctcgcgccaaagcatttctaactggacaaagtgggagaaggaattggttctttctgtacccacaataactgtttcagaacagattgcacatgagttaagaaaaatggctgatgggagaaccaaagagatagctgtggtacccaactatccattggaagcagaacaaatttcgtttaaagaaccacaacaccataggcaactatcatctgtttatgcgggaggagacagcaaacataaacaggttactaacaggaatatctctgggttaaccaatctatttgtagacaatgacattggaaatttgacaattatagggtgggaagaccctgagtctactgaaaatacagggtaa

SEQ ID NO: 2168 - protein, 262 aa, Unknown
  Obtained from environmental sample
  misc_feature (1)..(262): Xaa is any amino acid
MKILHLSDDGLPDWRVEKSALTATKAGHEVFFGGRLNDNYTKSTLFSELHAVKWTAGAMVGIPYYYHSVKKQVEKLVKKVRPDVVHSHNIGSAKLSHDLGLPFVFDDHEYFGMLSRVNAENIKFQNIPHLKSRFDRIKQNMKLSLISRQSISNWTKWEKELVLSVPTITVSEQIAHELRKMADGRTKEIAVVPNYPLEAEQISFKEPQHHRQLSSVYAGGDSKHKQVTNRNISGLTNLFVDNDIGNLTIIGWEDPESTENTG

SEQ ID NO: 2169 - DNA, 546 bp, Unknown
  Obtained from environmental sample
  misc_feature (1)..(546): n is a, c, g, or t
atgagtaacagcaagaatcctttaattatcacagacattaaagaaattaaaaatggcgcatttcaattgactctttcacaaactattgtacgtgaaggtcagcaaggtattacatcaatcttgatgcaagggcatccaggttttggagagaataaagctgcagtatcgtgggtaaatgtatccgcaaagcaaatggctgcatttggatttaaaaaaggagataatttctctgaaaagtttggtacagaatgtaatcttcaaattgttgaaactgtaaatccacttgagatttatcgtgagaatgagatgaagtacaaaaacaagcttggacagactgttgaacgtcttccaaagatgaatcctcaaacaaaagaagtaatgtgtctcaataataaaccaatttatcgcagggtaaatttggttgttggagaggccaagcatgcatatattcaacataattctactgttaagattaaagcagcgaagcagcagaagcaaatgtactacgaaattaacattggtattcgatttgattttagactataa

SEQ ID NO: 2170 - protein, 181 aa, Unknown
  Obtained from environmental sample
  misc_feature (1)..(181): Xaa is any amino acid
MSNSKNPLIITDIKEIKNGAFQLTLSQTIVREGQQGITSILMQGHPGFGENKAAVSWVNVSAKQMAAFGFKKGDNFSEKFGTECNLQIVETVNPLEIYRENEMKYKNKLGQTVERLPKMNPQTKEVMCLNNKPIYRRVNLVVGEAKHAYIQHNSTVKIKAAKQQKQMYYEINIGIRFDFRL

SEQ ID NO: 2171 - DNA, 780 bp, Unknown
  Obtained from environmental sample
  misc_feature (1)..(780): n is a, c, g, or t
atgagacaaactatgaagcgctggctatgcaatccgaaaagttgcaacaggaaatggcttcccttgnaaaaaagagacaaccaggtttatcgctctatgtttgaagccaatcctttgcctgatagcgcaagggcaaaacttaccgaacaaaaaatggaagtacaaaaagtagcggcaattaatgatgaagaattaggtaacgagcttgcaaaaacattaaataatatcagcgcaagaattaattatcaatatgccagctacaatgaaattgaaaaattaataaaaaatcaaggtgataaattggcttcgatacccgccattcaaccggtaagcaatcgcgatctggataggattgcatccggttttggaatgagaattgatccggtttatggaactcctaaaatgcacaaaggccttgattttacagcgcctcagggcaccccgatttatgccaccggcgatgggagagtaaccaaggccggctatgatgaaggtggctatggcaatcatgtgattattaataacggttacggttacgaaactttatatggccatatggtaagggtaaaagcgagagcaggacaaaaagtaaaacgtggtgaagtgatcgggtgggtaggcagcacgggaaaaagtaccggcccgcattgccattatgaagtgcatgtaaatggaagggaagtggacccgatatattttttttataacgaccttacacccgaacagtttgataggattttgaaaatcgcatctacgggaagcgcaaaaagtctcgattaa

SEQ ID NO: 2172 - protein, 259 aa, Unknown
  Obtained from environmental sample
  DOMAIN (134)...(230): Peptidase family M23
  misc_feature (1)..(259): Xaa is any amino acid
MRQTMKRWLCNPKSCNRKWLPLXKRDNQVYRSMFEANPLPDSARAKLTEQKMEVQKVAAINDEELGNELAKTLNNISARINYQYASYNEIEKLIKNQGDKLASIPAIQPVSNRDLDRIASGFGMRIDPVYGTPKMHKGLDFTAPQGTPIYATGDGRVTKAGYDEGGYGNHVIINNGYGYETLYGHMVRVKARAGQKVKRGEVIGWVGSTGKSTGPHCHYEVHVNGREVDPIYFFYNDLTPEQFDRILKIASTGSAKSLD

SEQ ID NO: 2173 - DNA, 573 bp, Unknown
  Obtained from environmental sample
  misc_feature (1)..(573): n is a, c, g, or t
gtggaagcgcaaaatccctggaaagtgattctcttttatcaaaatttttccaccatagttttattggataaatacctgaatgtgcttgggaacattaatctgcgcaataaaaatattttcagggtaaaggcggttactacttcttacgataataatatctggctctttgatgaacaggacaataaattaaaaaagattgatgatgcgggaaatttattatcggaatcggtggactttcgtttgttatttgattccgtgcccacgcctcagaaaatacttgaccgcgatggatttgtttatttatacgattcgcaaaaaggaatgtatgtattcgattattatggaagtttcaagagcaaactttcctttttaaactggacaaatttttcagtaatcggtaaaaccatttacggctttgataaagaaaacctttataaatacacggctccattgcccgatataaacaaatacaaactgcctgtagcattgcagaataataattttatccaattgagtaatcataaaatttatattctaaaagaccagcagcttcagatttattcactccaatag

SEQ ID NO: 2174 - protein, 190 aa, Unknown
  Obtained from environmental sample
  misc_feature (1)..(190): Xaa is any amino acid
MEAQNPWKVILFYQNFSTIVLLDKYLNVLGNINLRNKNIFRVKAVTTSYDNNIWLFDEQDNKLKKIDDAGNLLSESVDFRLLFDSVPTPQKILDRDGFVYLYDSQKGMYVFDYYGSFKSKLSFLNWTNFSVIGKTIYGFDKENLYKYTAPLPDINKYKLPVALQNNNFIQLSNHKIYILKDQQLQIYSLQ

SEQ ID NO: 2175 - DNA, 330 bp, Unknown
  Obtained from environmental sample
  misc_feature (1)..(330): n is a, c, g, or t
ttgcaaataaaaaatcactaccatttatcgtttgagactgatatgaagaaaaaaattgtaatcgatgtagctactatttatgctgggcagggcggtgctggtgggggtatatggagttatgctaagaacttacttttgcacttggatgaacatttggaaaaagaagatatggagattatatgccttgttaaccgccagtttgacctaccgcttaaaaatttaaagaaaaaagaactgaagtatagttttaaaaatttcctgataaggtttttttatacaaaacatttatttgccaatatatgtttatcgtcaaaacgcaattcttcataa

SEQ ID NO: 2176 - protein, 109 aa, Unknown
  Obtained from environmental sample
  misc_feature (1)..(109): Xaa is any amino acid
MQIKNHYHLSFETDMKKKIVIDVATIYAGQGGAGGGIWSYAKNLLLHLDEHLEKEDMEIICLVNRQFDLPLKNLKKKELKYSFKNFLIRFFYTKHLFANICLSSKRNSS

SEQ ID NO: 2177 - DNA, 768 bp, Unknown
  Obtained from environmental sample
  misc_feature (1)..(768): n is a, c, g, or t
ttgattactaatagtattatatcacaacccacacaagctattgaaaaagtattatctggagaggaattaacatttaatgatggtttacaattatttgacgaaaatcttttcttattaggttcagttgctgatcaagttagaagaaaatcgaaaggaaatacagtgacttttgtttcatcatattatttaaattatactaatgtttgtgcagcaagttgttctttatgtgctttctatagaaaagggtatgaagaggatgcttatacattaactaatgaacagattgttgaaagagctagaatagctatagaacaactaggtgcttcagaattacacatagttggaggatttcatccaaagcttggcttggaatattatgaaaacatgataaagaatataaaaaaagaattcccgtttgtaaaagttaaagcacttactcctgcagaaatttttttcatatctaaattaaccaaaaactcagttaaagaaattttattaagattaaaagattctggtttggatgctcttcctggaggaggagcagaaatttttagctcagatataagaaatattattgtaagaggaaaatgctcaggagaagaatggcttgatacagctaaacaagctcatgaaattggtctgaaaactaattctactatgctttttggacatattgagaagccagaacatattatcgatcatattataaaaatcagagagcttaataaaaaactcatggcttcaatacttttataccacttaagttag

SEQ ID NO: 2178 - protein, 255 aa, Unknown
  Obtained from environmental sample
  DOMAIN (63)...(238): Radical SAM superfamily
  misc_feature (1)..(255): Xaa is any amino acid
MITNSIISQPTQAIEKVLSGEELTFNDGLQLFDENLFLLGSVADQVRRKSKGNTVTFVSSYYLNYTNVCAASCSLCAFYRKGYEEDAYTLTNEQIVERARIAIEQLGASELHIVGGFHPKLGLEYYENMIKNIKKEFPFVKVKALTPAEIFFISKLTKNSVKEILLRLKDSGLDALPGGGAEIFSSDIRNIIVRGKCSGEEWLDTAKQAHEIGLKTNSTMLFGHIEKPEHIIDHIIKIRELNKKLMASILLYHLS

SEQ ID NO: 2179 - DNA, 804 bp, Unknown
  Obtained from environmental sample
  misc_feature (1)..(804): n is a, c, g, or t
ttgattactaatagtattatatcacaacccacacaagctattgaaaaagtattatctggagaggaattaacatttaatgatggtttacaattatttgacgaaaatcttttcttattaggttcagttgctgatcaagttagaagaaaatcgaaaggaaatacagtgacttttgtttcatcatattatttaaattatactaatgtttgtgcagcaagttgttctttatgtgctttctatagaaaagggtatgaagaggatgcttatacattaactaatgaacagattgttgaaagagctagaatagctatagaacaactaggtgcttcagaattacacatagttggaggatttcatccaaagcttggcttggaatattatgaaaacatgataaagaatataaaaaaagaattcccgtttgtaaaagttaaagcacttactcctgcagaaatttttttcatatctaaattaaccaaaaactcagttaaagaaattttattaagattaaaagattctggtttggatgctcttcctggaggaggagcagaaatttttagctcagatataagaaatattattgtaagaggaaaatgctcaggagaagaatggcttgatacagctaaacaagctcatgaaattggtctgaaaactaattctactatgctttttggacatattgagaagccagaacatattatcgatcatattataaaaatcagagagcttaataaaaaaactcatggtttcaatacttttataccacttaagtttagtctagaaaacactgaattagagaagaacaattga

SEQ ID NO: 2180 - protein, 267 aa, Unknown
  Obtained from environmental sample
  DOMAIN (63)...(238): Radical SAM superfamily
  misc_feature (1)..(267): Xaa is any amino acid
MITNSIISQPTQAIEKVLSGEELTFNDGLQLFDENLFLLGSVADQVRRKSKGNTVTFVSSYYLNYTNVCAASCSLCAFYRKGYEEDAYTLTNEQIVERARIAIEQLGASELHIVGGFHPKLGLEYYENMIKNIKKEFPFVKVKALTPAEIFFISKLTKNSVKEILLRLKDSGLDALPGGGAEIFSSDIRNIIVRGKCSGEEWLDTAKQAHEIGLKTNSTMLFGHIEKPEHIIDHIIKIRELNKKTHGFNTFIPLKFSLENTELEKNN

SEQ ID NO: 2181 - DNA, 588 bp, Unknown
  Obtained from environmental sample
  misc_feature (1)..(588): n is a, c, g, or t
ttggatgctcttcctggagaaggagcagaaatttttagctcagatataagaaatattattgtaagaggaaaatgctcaggagaagaatggcttgatacagctaaacaagctcatgaaattggtctgaaaactaattctactatgctttttggacatattgagaagccagaacatattatcgatcatattataaaaatcagagagcttaataaaaaaactcatggcttcaatacttttataccacttaagtttagtctagaaaacactgaattagagaagaaaaaattgattgttagagaaagttcttctacttatgacttaagaataatagccattgctaaattattattaaaagatgtgttagacaacatatcagtttattgggtttctctaggtaaaaaaatagcccaggtagcattgacatatggaggtaatgatttagttggtacagctttttcagaagaaatatttcgtgctgcaggaaaaactagtggtatatcgatacaggaacttgtaaatttgatcaaagaaataaaaagagaacctgctcaacgagatacattttttaaaataatagaaaaatactaa

SEQ ID NO: 2182 - protein, 195 aa, Unknown
  Obtained from environmental sample
  misc_feature (1)..(195): Xaa is any amino acid
MDALPGEGAEIFSSDIRNIIVRGKCSGEEWLDTAKQAHEIGLKTNSTMLFGHIEKPEHIIDHIIKIRELNKKTHGFNTFIPLKFSLENTELEKKKLIVRESSSTYDLRIIAIAKLLLKDVLDNISVYWVSLGKKIAQVALTYGGNDLVGTAFSEEIFRAAGKTSGISIQELVNLIKEIKREPAQRDTFFKIIEKY

SEQ ID NO: 2183 - DNA, 300 bp, Unknown; identical to SEQ ID NO: 73
  Obtained from environmental sample
  misc_feature (1)..(300): n is a, c, g, or t

SEQ ID NO: 2184 - protein, 99 aa, Unknown; identical to SEQ ID NO: 74
  Obtained from environmental sample
  misc_feature (1)..(99): Xaa is any amino acid

SEQ ID NO: 2185 - DNA, 300 bp, Unknown; identical to SEQ ID NO: 73
  Obtained from environmental sample
  misc_feature (1)..(300): n is a, c, g, or t

SEQ ID NO: 2186 - protein, 99 aa, Unknown; identical to SEQ ID NO: 74
  Obtained from environmental sample
  misc_feature (1)..(99): Xaa is any amino acid

SEQ ID NO: 2187 - DNA, 570 bp, Unknown
  Obtained from environmental sample
  misc_feature (1)..(570): n is a, c, g, or t
ttgaaaggatttgcattcataaccattattatgccacttttttttgtggtgttcacgatccaggcacaggaacggcttgaaacccctgtaaaactaaaaattgaagagggtaattttgaagaagttacagttgttgtaaaaaacaatacaaccggtgaaactaatacgctcaaaggtgaacccaggcttgatcttgggttgaagttgaatagtgattatgtgatatcattcaaaaagccgggttacataaccaagaagattgcactcaatactaccgcccccggtgacaggagcaaaatgggattttatcctttcagttttgaagttattttattcaagcaatatgatggcgtcaatattgttattttcaatcagcctgttggaaaaatatctttcaaccggctaattgatgatttcgattatgatactgattatacaaagcaggtgcaatcagcgttgaagattgctgaagaagaaatcaagcaaaagcagaaggaggccatagttcaggctgagcaacaaaagcaagaggaagcaaagaaaagaagcagaggctgttgcccagggtaa

SEQ ID NO: 2188 - protein, 189 aa, Unknown
  Obtained from environmental sample
  misc_feature (1)..(189): Xaa is any amino acid
MKGFAFITIIMPLFFVVFTIQAQERLETPVKLKIEEGNFEEVTVVVKNNTTGETNTLKGEPRLDLGLKLNSDYVISFKKPGYITKKIALNTTAPGDRSKMGFYPFSFEVILFKQYDGVNIVIFNQPVGKISFNRLIDDFDYDTDYTKQVQSALKIAEEEIKQKQKEAIVQAEQQKQEEAKKRSRGCCPG

SEQ ID NO: 2189 - DNA, 315 bp, Unknown
  Obtained from environmental sample
  misc_feature (1)..(315): n is a, c, g, or t
atgcctgataaagatgcaaaaaaaactgtccgcaaaaaaagcccctggtatttttaccttatcctgataataatccctgtccttttttttgtattactggaagcgggactaagattttttaactacggcagggatattccgcaatggattgatgctgaaaagggaaagtatgttatcaatcctgaggtttcataccgttattttaataatgttaaaaatatacccacaacaattgaggatgtatttgaccacgtaaaaaaacccaatgtcttcaggttatttgtactgcgcgaaagcagtgctgcatgttaccng

SEQ ID NO: 2190 - protein, 105 aa, Unknown
  Obtained from environmental sample
  misc_feature (1)..(105): Xaa is any amino acid
MPDKDAKKTVRKKSPWYFYLILIIIPVLFFVLLEAGLRFFNYGRDIPQWIDAEKGKYVINPEVSYRYFNNVKNIPTTIEDVFDHVKKPNVFRLFVLRESSAACYX

SEQ ID NO: 2191 - DNA, 816 bp, Unknown
  Obtained from environmental sample
  misc_feature (1)..(816): n is a, c, g, or t
atggtacacggagccgaaggcaacgatacaagtctacccctgattaatatgctggaaagcctccgaaataaccatgccgaccctctttgcaaacaaaaactggcttttacctgcggatttttaacccatatggcaatggatatcaactatcatccttatgtttattactttagcggcaattattatgatgaaagtatttctgcccaggttgatgcccagatgaggcaccgcttgatagaaagctggattgacttacatatcctggaaaaaataaatattaaactgaaagattttaaggccctggaaaaaattagccttaacaaaaaaacaaacctggaaatgctggaattcctggccggggcatgtgcaaaagcctggcagtcagataaggatatcttcagatttttgaaaaaaggatatttaatacagatggctttagcggcaaagcttttcaggaataaatcttttacagaaataatcaggcttttaaatgatattttcgataataaactaagaggatatttagctttatgttacccggtaaattaccaggagatccccaaatttatcattgaatttgagtcatttaaacaccctgttaccggtgaagaatttaaaggaaacctggaagacatttcaaataacggtatcaaattaagtacagagtttttaaaagctgttaatcaatatatttttggggatggcgaccaggaaaagctanaatccataataaaaggatatagcctcgatgtaggcttagtcggtgtcaggctagatgacgtaagatattttgcccaatggcagttaattccttaa

SEQ ID NO: 2192 - protein, 271 aa, Unknown
  Obtained from environmental sample
  misc_feature (1)..(271): Xaa is any amino acid
MVHGAEGNDTSLPLINMLESLRNNHADPLCKQKLAFTCGFLTHMAMDINYHPYVYYFSGNYYDESISAQVDAQMRHRLIESWIDLHILEKINIKLKDFKALEKISLNKKTNLEMLEFLAGACAKAWQSDKDIFRFLKKGYLIQMALAAKLFRNKSFTEIIRLLNDIFDNKLRGYLALCYPVNYQEIPKFIIEFESFKHPVTGEEFKGNLEDISNNGIKLSTEFLKAVNQYIFGDGDQEKLXSIIKGYSLDVGLVGVRLDDVRYFAQWQLIP

SEQ ID NO: 2193 - DNA, 726 bp, Unknown
  Obtained from environmental sample
  misc_feature (1)..(726): n is a, c, g, or t
atgaacacgcgttcattcctagttagtaaaggcggattcggatccgaagcacctggtgaaaatatgaactatggattttggataacctatctgggtcatctccaagcaggatttgaagcaaaagactcttcaaattattttgttacttctaaaaaaccagttaatgacaataagtggcattacgctacagtaacttatgatggatcattactgaagttgtttattgatggtgtgttagatcatagtataaataccaagaatgcaaaacctgatattgctggcaaaaataggattgctattgctgccaactctctcttcaaagacaagttgtatgtgggagacgtagatgaagttcgtatttgggatagatctcttactactgcagaggtttacgatgcatatacacaaaacaaattcaatatagataatcaattagtgtttgtgtcatttggtgataatacatcttgtaaacctgaaaaacccattgatgttacatcaataggctatgctggcaataatacagaactcaacgcaatagatggtaatgaatccacgcgttggtctaaatatggacttaattcttgggttcaaatggatttaggtaaggataaggaaatatgtgatattgatataacttggtataaaggcgatcagaggagggttaatttcactatctctacatctgcagatggagaaaattttagtaatctattttctcaaaactag

SEQ ID NO: 2194 - protein, 241 aa, Unknown
  Obtained from environmental sample
  DOMAIN (163)...(240): F5/8 type C domain
  misc_feature (1)..(241): Xaa is any amino acid
MNTRSFLVSKGGFGSEAPGENMNYGFWITYLGHLQAGFEAKDSSNYFVTSKKPVNDNKWHYATVTYDGSLLKLFIDGVLDHSINTKNAKPDIAGKNRIAIAANSLFKDKLYVGDVDEVRIWDRSLTTAEVYDAYTQNKFNIDNQLVFVSFGDNTSCKPEKPIDVTSIGYAGNNTELNAIDGNESTRWSKYGLNSWVQMDLGKDKEICDIDITWYKGDQRRVNFTISTSADGENFSNLFSQN

SEQ ID NO: 2195 - DNA, 804 bp, Unknown
  Obtained from environmental sample
  misc_feature (1)..(804): n is a, c, g, or t
atgtctatgaaactattgatagttgaagatgaacaactccttgccctgcagctttcccggctggtaaaagaaataaagccagaatgcaatatcgtcgggcaaaccaatagtattgaaaccacgcttcattggttgcatagtcatgatgcgcccgacctggtatttatggatatcgaattggcagatggacagtgctttgaaatattcaaccattttcctttgaagaccccggtgatctttacaactgcctacgacgaatatgccctccaggctttcaaggtaaacagcattgactacctcttaaaacccatccaggaaaaagacctccgaacggcattgaataaatggaacgaaatgcattattccacggactggcaggttattgcattggataacatgctgaaagatcttgctaaacagggactgaacaacaattataaagaccgcttccttgtcaagcaggggcagaaaatgttatccgtagccacagaagaagtagcattcttcaatgcccgcaacacgctgaactttatcatcaccaaggagaaacaaaagtttatagtcgactacaccctcgaccaggtagagcaactgctaccttcccagaaattcttcagggtcaacaggcagtttatcatttctcatgacatcataacatccgtccatccctggttcaacggtaagctcaaagtgggaaaccaaacttccattcgaagacgagatcgtagtgagccgggaaaaagcaccgcattccaaatgtggatggtgcctattaactccactttcgatcgaccactgtcggnt

SEQ ID NO: 2196 - protein, 268 aa, Unknown
  Obtained from environmental sample
  DOMAIN (156)...(256): LytTr DNA-binding domain
  misc_feature (1)..(268): Xaa is any amino acid
MSMKLLIVEDEQLLALQLSRLVKEIKPECNIVGQTNSIETTLHWLHSHDAPDLVFMDIELADGQCFEIFNHFPLKTPVIFTTAYDEYALQAFKVNSIDYLLKPIQEKDLRTALNKWNEMHYSTDWQVIALDNMLKDLAKQGLNNNYKDRFLVKQGQKMLSVATEEVAFFNARNTLNFIITKEKQKFIVDYTLDQVEQLLPSQKFFRVNRQFIISHDIITSVHPWFNGKLKVGNQTSIRRRDRSEPGKSTAFQMWMVPINSTFDRPLSX

SEQ ID NO: 2197 - DNA, 723 bp, Unknown
  Obtained from environmental sample
  misc_feature (1)..(723): n is a, c, g, or t
atgtctatgaaactattgatagttgaagatgaacaactccttgccctgcagctttcccggctggtaaaagaaataaagccagaatgcaatatcgtcgggcaaaccaatagtattgaaaccacgcttcattggttgcatagtcatgatgcgcccgacctggtatttatggatatcgaattggcagatggacagtgctttgaaatattcaaccattttcctttgaagaccccggtgatctttacaactgcctacgacgaatatgccctccaggctttcaaggtaaacagcattgactacctcttaaaacccatccaggaaaaagacctccgaacggcattgaataaatggaacgaaatgcattattccacggactggcaggttattgcattggataacatgctgaaagatcttgctaaacagggactgaacaacaattataaagaccgcttccttgtcaagcaggggcagaaaatgttatccgtagccacagaagaagtagcattcttcaatgcccgcaacacgctgaactttatcatcaccaaggagaaacaaaagtttatagtcgactacaccctcgaccaggtagagcaaactgctaccttcccagaaattcttcagggtcaacaggcagttatcatttctcatgacctcataacatccgtccatccctggttcaacggtagctcaagtggaaacaaattcccatcgaagacagatctatga

SEQ ID NO: 2198 - protein, 240 aa, Unknown
  Obtained from environmental sample
  DOMAIN (3)...(121): Response regulator receiver domain
  misc_feature (1)..(240): Xaa is any amino acid
MSMKLLIVEDEQLLALQLSRLVKEIKPECNIVGQTNSIETTLHWLHSHDAPDLVFMDIELADGQCFEIFNHFPLKTPVIFTTAYDEYALQAFKVNSIDYLLKPIQEKDLRTALNKWNEMHYSTDWQVIALDNMLKDLAKQGLNNNYKDRFLVKQGQKMLSVATEEVAFFNARNTLNFIITKEKQKFIVDYTLDQVEQTATFPEILQGQQAVIISHDLITSVHPWFNGSSSGNKFPSKTDL

SEQ ID NO: 2199 - DNA, 597 bp, Unknown
  Obtained from environmental sample
  misc_feature (1)..(597): n is a, c, g, or t
atgacggccattgttaacgtgtataatattactgaagataacgagaaagcctcaaaatggtatttcagaagtctggagatcaacaaagaacttgataataagaatgggatatctgtttgcctggggggtattggtattaactatcttcacttgaaaaattatccgaaggccgaatccaacctgaaagaggctttgcttatttctgaagagttaggagacttaaacctaatcatgaatcaaactttcggattaagtgaattatatgattctctcaaacgttacgatctggcctataagtatcatcttcaattcgaggcagcgaaggacagtttatttaatgatgaaaaaagcagggagataggaggattagaggccagtcatgaagctcagttagaagaaatggagaaaaaagcaaaagaggaggcggaagcaaaaacaaaattggaaaaaactcagcgaacaaatttacttcagtatagtggaatcgtagtatcgttgcttgttattgcttctattattgcattacttggttccgtgaaagtaaaacccatttatagcctccgatattatattccttgcttttcttcttttctttga

SEQ ID NO: 2200 - protein, 198 aa, Unknown
  Obtained from environmental sample
  misc_feature (1)..(198): Xaa is any amino acid
MTAIVNVYNITEDNEKASKWYFRSLEINKELDNKNGISVCLGGIGINYLHLKNYPKAESNLKEALLISEELGDLNLIMNQTFGLSELYDSLKRYDLAYKYHLQFEAAKDSLFNDEKSREIGGLEASHEAQLEEMEKKAKEEAEAKTKLEKTQRTNLLQYSGIVVSLLVIASIIALLGSVKVKPIYSLRYYIPCFSSFL

SEQ ID NO: 2201 - DNA, 360 bp, Unknown
  Obtained from environmental sample
  misc_feature (1)..(360): n is a, c, g, or t
atgaagtggaaaatatatgtcaacgaaaactctacctatgatctttcttttaaggatagtggaaactacaagcttataaatgagcctcaaataaaagatcataggagcactgatcttataaggtttggggcccaaattaaggaatatcgtcagagggcaggtcagagtatcagtgaagttgctacccaaattggtatcgatagaagttatctctcgaagctcgagaatggacatgagcctcctactcttcccatacttagcaaactacttagtcatttttctattaccaaaagcgaagcgcaaaatatagcaatcctggcgggatatgccggcggcttaattgtgtttgaagggaggtga

SEQ ID NO: 2202 - protein, 119 aa, Unknown
  Obtained from environmental sample
  DOMAIN (46)...(100): Helix-turn-helix
  misc_feature (1)..(119): Xaa is any amino acid
MKWKIYVNENSTYDLSFKDSGNYKLINEPQIKDHRSTDLIRFGAQIKEYRQRAGQSISEVATQIGIDRSYLSKLENGHEPPTLPILSKLLSHFSITKSEAQNIAILAGYAGGLIVFEGR

SEQ ID NO: 2203 - DNA, 360 bp, Unknown; identical to SEQ ID NO: 2201
  Obtained from environmental sample
  misc_feature (1)..(360): n is a, c, g, or t

SEQ ID NO: 2204 - protein, 119 aa, Unknown; identical to SEQ ID NO: 2202
  Obtained from environmental sample
  DOMAIN (46)...(100): Helix-turn-helix
  misc_feature (1)..(119): Xaa is any amino acid

SEQ ID NO: 2205 - DNA, 348 bp, Unknown
  Obtained from environmental sample
  misc_feature (1)..(348): n is a, c, g, or t
gtgtttgtaaaaattaatgatgaggatcgcacttctgtccggatgacaaacggtatcgtaaattttgtttactggaatggcaagcctgccgttattaaagaaaaagaaattcaaacgatcaaacgctttcttgacgaatatgaaaatgtggaagtcatgaagatggagttagcggaaggtgacagggtgcaggtaattgcaggtcctatgatggataaggaaggaaaaattttggaagtaaaaaataaaacagcaaaagtctgtatcgatagtcttggttacatgcttattgcttatattgataagactaagctgctccctgttcaacagacaaaccaccagagatga

SEQ ID NO: 2206 - protein, 115 aa, Unknown
  Obtained from environmental sample
  DOMAIN (57)...(90): KOW motif
  misc_feature (1)..(115): Xaa is any amino acid
MFVKINDEDRTSVRMTNGIVNFVYWNGKPAVIKEKEIQTIKRFLDEYENVEVMKMELAEGDRVQVIAGPMMDKEGKILEVKNKTAKVCIDSLGYMLIAYIDKTKLLPVQQTNHQR

SEQ ID NO: 2207 - DNA, 717 bp, Unknown
  Obtained from environmental sample
  misc_feature (1)..(717): n is a, c, g, or t
atgaagcaattatccgaaacctggtttgtagaagggtatattgatttcgaattaaagaaatatacactccttgcgtacctgcaacaaatcaataaatatttcaacgagaacaaactttacccacaactctccgacctgatctttcattacaataatattgtcgctttccgtgaaaataaaaaacacctccaggaacactttcctaaaaaattaaccggcgtgcagattgaaaaattacagaccctgtacgaacaaatgatcgaggatgatgaattaatgcaggagctggaagaaataataaactattctgccgatgaaatgaaaaccaccattagcagcggggcagagatttatgaatttgtggaggataatatgctcatttctcctattggcattatacccctggacgttaaagaaggttatttctttttgagtgcagggaatactaaagatacaagagtgtatcactaccgcttgtctttttttgaaaagcatgatgagaaatatcgtaccatgaagacttcgtatattgatgtttggcaccgcagcatggcgcatacgtatgagaatattaaatacgatttgatcaaaaataataataacctctctaaccccgctgtatacagcatagaaactgagctcacttttccgatagaagaaacacttttgccgattgctaaaagaagactagtaaaatatatttctgtagccgcttaa

SEQ ID NO: 2208 - protein, 238 aa, Unknown
  Obtained from environmental sample
  misc_feature (1)..(238): Xaa is any amino acid
MKQLSETWFVEGYIDFELKKYTLLAYLQQINKYFNENKLYPQLSDLIFHYNNIVAFRENKKHLQEHFPKKLTGVQIEKLQTLYEQMIEDDELMQELEEIINYSADEMKTTISSGAEIYEFVEDNMLISPIGIIPLDVKEGYFFLSAGNTKDTRVYHYRLSFFEKHDEKYRTMKTSYIDVWHRSMAHTYENIKYDLIKNNNNLSNPAVYSIETELTFPIEETLLPIAKRRLVKYISVAA

SEQ ID NO: 2209 - DNA, 555 bp, Unknown
  Obtained from environmental sample
  misc_feature (1)..(555): n is a, c, g, or t
atgatattaccaatctatgcatacggacagcccgtcttacgaaagaaatcaagcccgatttcaaaggactatcctaatctcaaggaattgatagcggatatgtatgagactatgtatgccgcgaagggtgttggcctggcagcaccgcagatagggaaggatatccggctttttgtagtcgatactattcagcttgacaagaaaaatgataccgacacgggaataaaaaaagttttcataaatgctcaaatcctggatgaatctggagaattatggtcctatgaggaaggttgtcttagcatcccggatattcatagtgaaattaagcgaaccccaactatacggatcaattattttgatgaagaatggaatgaatatactgaaatgtttgaaaaaataaatgcccgggtaattcagcatgaacatgatcacattgagggaatattatttattgataagatgaagcctctgaggaagcgtctgatcaacggtaaattggaaaaaattaaaaaaggcgacgttgatgtcgtttatccaatgaggtttatccgttaa

SEQ ID NO: 2210 - protein, 184 aa, Unknown
  Obtained from environmental sample
  DOMAIN (2)...(160): Polypeptide deformylase
  misc_feature (1)..(184): Xaa is any amino acid
MILPIYAYGQPVLRKKSSPISKDYPNLKELIADMYETMYAAKGVGLAAPQIGKDIRLFVVDTIQLDKKNDTDTGIKKVFINAQILDESGELWSYEEGCLSIPDIHSEIKRTPTIRINYFDEEWNEYTEMFEKINARVIQHEHDHIEGILFIDKMKPLRKRLINGKLEKIKKGDVDVVYPMRFIR

SEQ ID NO: 2211 - DNA, 354 bp, Unknown
  Obtained from environmental sample
  misc_feature (1)..(354): n is a, c, g, or t
ttggtaatcatgcgttatatatgtttcaaagttaattgtagattcaaaaaatggacaccagcattaggttatattttgaatgtacttaatctaattcaaaataaagcaccctggattccagatttagtggtaacatccgtaaatgatggaaagcatatgcaaaattccaaacattatacggatgaagctgttgatttaagaactcgagattttaagagttcagacgataaagaacattttattaaattattaagagaatatcttggtcctaaatttacagttcttcatgaaagtgtgggaacggcaaatgaacatattcatgtacaggtaaaaaagggcacagtttatttatga

SEQ ID NO: 2212 - protein, 117 aa, Unknown
  Obtained from environmental sample
  misc_feature (1)..(117): Xaa is any amino acid
MVIMRYICFKVNCRFKKWTPALGYILNVLNLIQNKAPWIPDLVVTSVNDGKHMQNSKHYTDEAVDLRTRDFKSSDDKEHFIKLLREYLGPKFTVLHESVGTANEHIHVQVKKGTVYL

SEQ ID NO: 2213 - DNA, 333 bp, Unknown
  Obtained from environmental sample
  misc_feature (1)..(333): n is a, c, g, or t
atgaagtacaattttaatgaaattgagaaaaaatggcaggatttttgggaaactaataaaacctttgccgcaagtattgatcattccaaaccaaagtattacgtgctggatttcttcccgtatccttccagtgatggattgcatgtaggtcaccctgagggttacaccgcgacagatataattgcgcggtataaaaggatgaagggctttaacgtactgcacccgatgggctgggatgcattcggtctgcctgcagaacagtttgcaattaaaaccggcattcacccaaggataacaacgcaaaagagcatagataatttaagcgtcagctaa

SEQ ID NO: 2214 - protein, 110 aa, Unknown
  Obtained from environmental sample
  misc_feature (1)..(110): Xaa is any amino acid
MKYNFNEIEKKWQDFWETNKTFAASIDHSKPKYYVLDFFPYPSSDGLHVGHPEGYTATDIIARYKRMKGFNVLHPMGWDAFGLPAEQFAIKTGIHPRITTQKSIDNLSVS

SEQ ID NO: 2215 - DNA, 381 bp, Unknown
  Obtained from environmental sample
  misc_feature (1)..(381): n is a, c, g, or t
ttgatggcaaatcagttagcgaaggacaaaaaaacaatagcgctcatggatcgtggggaagatagtcttttaccccttcagcgaagaatcttctggtactaccagggacgtntacgctgggttggccaaacacctcctccaaataatggagaactgatctacaaaatcgaaaagagtatccaaaaagaatccccggaagttcagtgggcaatgaattttactgcaggatggattggcgtttatgacaaacaatatcgcaaccgttgtattgcgataggagagaataccggactttataaaggcaaaatggtgtccaaaggatgcacaccggagtacctgccggagtttattgccatagaaagtaaaaagcgtgatctgtga

SEQ ID NO: 2216 - protein, 126 aa, Unknown
  Obtained from environmental sample
  misc_feature (1)..(126): Xaa is any amino acid
MMANQLAKDKKTIALMDRGEDSLLPLQRRIFWYYQGRXRWVGQTPPPNNGELIYKIEKSIQKESPEVQWAMNFTAGWIGVYDKQYRNRCIAIGENTGLYKGKMVSKGCTPEYLPEFIAIESKKRDL

SEQ ID NO: 2217 - DNA, 573 bp, Unknown
  Obtained from environmental sample
  misc_feature (1)..(573): n is a, c, g, or t
gtggatgacaatacattaaagaatgttttaaaagcgtatttaagagaggcaatgggtcgagaggattttgaagaaatagttaattcagatgataattctgaattgcaaactatacccgatgtttgcttatggcagcaatactgtattggtagtgctggaaaggaaaatcttgttattgagctaaagaagccaagtcttgatgctggatttgatgaaaaaacacagattgaatcttacgcatcaaaagtcgttaatgatagaagatttcctaaaaataagactagatggaaatttattcttgtaacaaaagatatcaaacctgagctgcaaccgcttttaaaacaagctaatcgtagctatggccatatttctcaattagataattgcgatgtttttattttgacatggggggatattatttcagaagcaaaacttcgccatgagttcattaaggaaaggctcaatataaatctgcaagaaaatgaagaaggcttggcttatatcaaaagtaaatataaagaatatttgccccagggcttcaatgaaacaaaagaaaaagacagtgacttataa

SEQ ID NO: 2218 - protein, 190 aa, Unknown
  Obtained from environmental sample
  misc_feature (1)..(190): Xaa is any amino acid
MDDNTLKNVLKAYLREAMGREDFEEIVNSDDNSELQTIPDVCLWQQYCIGSAGKENLVIELKKPSLDAGFDEKTQIESYASKVVNDRRFPKNKTRWKFILVTKDIKPELQPLLKQANRSYGHISQLDNCDVFILTWGDIISEAKLRHEFIKERLNINLQENEEGLAYIKSKYKEYLPQGFNETKEKDSDL

SEQ ID NO: 2219 - DNA, 300 bp, Unknown
  Obtained from environmental sample
  misc_feature (1)..(300): n is a, c, g, or t
ttgtacctggctggtcaccggcatgtatatgaaaggcataaggcagttcgtggcagcgatatatttgaacaatccgattcacatatttataataaaccaaaaggaacagtttatataactaatggttcctgtggaggttcattacaaggccttggtggggagaagctgcctacgatggcatttactgcaaaagaaaaaatatatacctactctattatgacaatagaaaataagaaaattgattattcggtttatgataaaaaaggaaaccgcattgattatttcgagatagtcaagtaa

SEQ ID NO: 2220 - protein, 99 aa, Unknown
  Obtained from environmental sample
  misc_feature (1)..(99): Xaa is any amino acid
MYLAGHRHVYERHKAVRGSDIFEQSDSHIYNKPKGTVYITNGSCGGSLQGLGGEKLPTMAFTAKEKIYTYSIMTIENKKIDYSVYDKKGNRIDYFEIVK

SEQ ID NO: 2221 - DNA, 444 bp, Unknown
  Obtained from environmental sample
  misc_feature (1)..(444): n is a, c, g, or t
atgccagattggagacataatattgatgagcttttaaaaagccagggttttgaaaaaaaagctcctgagctatccgctgatgacgagaatgtgatccaggaatttttggataatataggccgcccagctttcgaaaacatttgcgaccagataaattcgtttcaaaacatcagggctgaaataagtctctcaaaaaaaaatgcccactcatccattgaaccattcgagctgtctatttataaaatgagccaaccaaaattatcttaccgcctcgctttcttaaaaaaagaaaacggaatcaatataagtggagaatacagtacacccaatatttacggagaaaatacccgttaccaaagtagtggattaaacctggcaatagccggaactacggaggacgatattgcaagtgatttttttggcattatgaagtctaaattttag

SEQ ID NO: 2222 - protein, 147 aa, Unknown
  Obtained from environmental sample
  misc_feature (1)..(147): Xaa is any amino acid
MPDWRHNIDELLKSQGFEKKAPELSADDENVIQEFLDNIGRPAFENICDQINSFQNIRAEISLSKKNAHSSIEPFELSIYKMSQPKLSYRLAFLKKENGINISGEYSTPNIYGENTRYQSSGLNLAIAGTTEDDIASDFFGIMKSKF

SEQ ID NO: 2223 - DNA, 444 bp, Unknown; identical to SEQ ID NO: 2221
  Obtained from environmental sample
  misc_feature (1)..(444): n is a, c, g, or t

SEQ ID NO: 2224 - protein, 147 aa, Unknown; identical to SEQ ID NO: 2222
  Obtained from environmental sample
  misc_feature (1)..(147): Xaa is any amino acid

SEQ ID NO: 2225 - DNA, 426 bp, Unknown
  Obtained from environmental sample
  misc_feature (1)..(426): n is a, c, g, or t
gtgaagttaagagagctcattggacctgactcatattacgccatgcttgccgtgcataaactaatgctcggtctaaagatgcttccggcgtatatcagtctgacgtttgaagagttctatgacgccattgatcttatgacgccagaagagcaagaggcttgcattcgtgaggccgtggcattcgttccgctcgagcgcgaagagctcaatgacgtaatcaagtttgctcaagacaataatggcgtgccgtacggacctgagaatattaaaaatttaatgccttcggaatttcatgaaatcattgtcgcagtcggactcgaagtaatgaaggcccataaaattaagctggttagctctaaggaaaaaaaaaacttaaagacttctcagtcgacgtcagatcagtctttgtcaggcacccaacattaa

SEQ ID NO: 2226 - protein, 141 aa, Unknown
  Obtained from environmental sample
  misc_feature (1)..(141): Xaa is any amino acid
MKLRELIGPDSYYAMLAVHKLMLGLKMLPAYISLTFEEFYDAIDLMTPEEQEACIREAVAFVPLEREELNDVIKFAQDNNGVPYGPENIKNLMPSEFHEIIVAVGLEVMKAHKIKLVSSKEKKNLKTSQSTSDQSLSGTQH

SEQ ID NO: 2227 - DNA, 336 bp, Unknown
  Obtained from environmental sample
  misc_feature (1)..(336): n is a, c, g, or t
ttgaacgaaatagcgcatgccgaaacttgctccgcaccaccatacggcccagctgctgaggagatagaagttcaggatggtgaaaaggataatgaaaaattttttgtcgcggtgtttctcattcagaagaaaaaagccgatgaggggaagaacgagcagtggcgtgtatacgaaaagactttttttgaaactgaaaagaacatcaaggatatgtggttcgagaaaatcgaatccttccgtgtgtttgtaggaataataaatgtattcgcccgtagttactttccaataaatgaactgcggtatgaatggcaggaaggcgaatactgcaaatattaa

SEQ ID NO: 2228 - protein, 111 aa, Unknown
  Obtained from environmental sample
  misc_feature (1)..(111): Xaa is any amino acid
MNEIAHAETCSAPPYGPAAEEIEVQDGEKDNEKFFVAVFLIQKKKADEGKNEQWRVYEKTFFETEKNIKDMWFEKIESFRVFVGIINVFARSYFPINELRYEWQEGEYCKY

SEQ ID NO: 2229 - DNA, 948 bp, Unknown
  Obtained from environmental sample
  misc_feature (1)..(948): n is a, c, g, or t
ttgagcaattacatgtatagtcttttgaaggccgcaggtataaggtcttattatacactggtaagagcgggaagggacttagacgataaatatttgctcggcgatttcccgtctgatcaattcaaccatatcattctttgtgtgccccttgcaaaggatacgatgtggcttgaatgcacgagtcaaacagaatcggcaggttatatgggcgattttacaggcaaccgtatggcgttgttaattactgaggacggaggtaagttagttgctaccccacactatggccttaaagaaaatattcaaataagaaacatcaaaggaaagattggtgcggatggtgcattggtaatgaatgtaagcaccaattataaatgcatgcaacaggatgggaaaagtgcattgatcaaccaactatcaaaagataaagtaaaaaaatatttacaagaggatctggagctatccacttatgaagtgagcaattttaaatacgaacagaaaaaaaatgttttcccggaaattgatgaacacctggatgtagtagttgataattatgcaaccattactggcaaacgcatttttatcacaccaaatattttaagtcgcggtggaatgaagctttcagaagaagaggaaagaaaaatagattttgtgctggattatgaatatcgtgatgaggacaattatgaaattgaaattcctgagggctaccagttagaatcagccccgcaggatgtttccttaaaaacaaagtttggctcttacaactgtactacaagactcaatggaaataagattctttacaaccgtgtacgagagcagtttggagggaaggttccccgcaaaagatcacaggagctcactaaattttttgaagatatctacaaagctgaccgggcaagactagttttagtaaagaaggcagaagtaaaattggccggaacaacgtaa

SEQ ID NO: 2230 - protein, 315 aa, Unknown
  Obtained from environmental sample
  misc_feature (1)..(315): Xaa is any amino acid
MSNYMYSLLKAAGIRSYYTLVRAGRDLDDKYLLGDFPSDQFNHIILCVPLAKDTMWLECTSQTESAGYMGDFTGNRMALLITEDGGKLVATPHYGLKENIQIRNIKGKIGADGALVMNVSTNYKCMQQDGKSALINQLSKDKVKKYLQEDLELSTYEVSNFKYEQKKNVFPEIDEHLDVVVDNYATITGKRIFITPNILSRGGMKLSEEEERKIDFVLDYEYRDEDNYEIEIPEGYQLESAPQDVSLKTKFGSYNCTTRLNGNKILYNRVREQFGGKVPRKRSQELTKFFEDIYKADRARLVLVKKAEVKLAGTT

SEQ ID NO: 2231 - DNA, 795 bp, Unknown
  Obtained from environmental sample
  misc_feature (1)..(795): n is a, c, g, or t
gtggatcaagaatgcctgacgaacagaaactcaaacgaattcaaattaattaaccagtcaacttcgtataaaaacacgttgacagaggatgagtattctgctgaagtggaaaccgtgggcgatgtaattatagcaagagcgttttttaataagacattaccctttccttcaaaacttcaaaaacttgacaagcccatttcgtttaataaaacaaacgtttcagccttcggtattgaatcctacgacgaagaagcagcaaagtttacagaaattctttattacaaagacgacgacaactttattctcaagctaacaccaaaagacagtgagcatcaaattttgcttgcaaagggcattgataaagtacctaatctttcgtccgctattgaacaaacaaacaagttgattgcttttggcaacaaagaacggacattacctaaaatatcatggaaatacactcttaacgatattgacattttttcaattcctgctatcaaattcaacattgagacacactataatgacattcaagggcaggcttttacaactaatggcaagctacatcatgtggaagaagcctatcaacgaacaggctttattttaaatgaaaacggcgctgttgttgagagcgaagcctatacaacaacagacagtacagctacagagccaatcaagattttgccgaagaaaatggtatttgacaaaccattttttgtaattattaagcggacaaaaagtgacaatccatattttgtaatgtatgttcgaaacactgaactgctgacaaaggaataa

SEQ ID NO: 2232 - protein, 264 aa, Unknown
  Obtained from environmental sample
  misc_feature (1)..(264): Xaa is any amino acid
MDQECLTNRNSNEFKLINQSTSYKNTLTEDEYSAEVETVGDVIIARAFFNKTLPFPSKLQKLDKPISFNKTNVSAFGIESYDEEAAKFTEILYYKDDDNFILKLTPKDSEHQILLAKGIDKVPNLSSAIEQTNKLIAFGNKERTLPKISWKYTLNDIDIFSIPAIKFNIETHYNDIQGQAFTTNGKLHHVEEAYQRTGFILNENGAVVESEAYTTTDSTATEPIKILPKKMVFDKPFFVIIKRTKSDNPYFVMYVRNTELLTKE

SEQ ID NO: 2233 - DNA, 606 bp, Unknown; identical to SEQ ID NO: 935
  Obtained from environmental sample
  misc_feature (1)..(606): n is a, c, g, or t

SEQ ID NO: 2234 - protein, 201 aa, Unknown; identical to SEQ ID NO: 936
  Obtained from environmental sample
  DOMAIN (15)...(164): AhpC/TSA family
  misc_feature (1)..(201): Xaa is any amino acid

SEQ ID NO: 2235 - DNA, 723 bp, Unknown
  Obtained from environmental sample
  misc_feature (1)..(723): n is a, c, g, or t
atgtataaagaaatggttgcatgcagcatggaaaaggcattcatgataactcctgtttggagagctgaaaaacataatactatacgccatataaatgaaattaggcaaatggatattgaatgttcatttatgaaccaaatggatgtaatgagaattgaagaaaaatgcgtccagcatattatttcagaagttttaaagagaaataagtttgagattgaattgcttggattaaacgttaaagttccttctgctaaatatgcaagttatgatgagaccattgatttattgaagaaagctggaataaagatagctttgggagatgacttaaatcctgaagctgagaaaaaacttggagagttatatcctgacactttagtctttgttcattcttggccatcatcattaaaaccattttatataatgcctaaagatggtaaagaagattcagattattcagagggattcgattgtatttacaatggcatggaaataacttcaggggggcagagaattcatttgcctgaattactgctaaaaagaataaaacataaagggatgaaaactgacgggttaatggattatgtaaactcttttaggtatggagctcctcctcactccggctggagcattggcttagagcgactgacaatgcttatctgcggattggataatattcgtgaagctactatgttcccaagggacagagatagattaactccttga

SEQ ID NO: 2236 - protein, 240 aa, Unknown
  Obtained from environmental sample
  DOMAIN (1)...(236): tRNA synthetases class II (D, K and N)
  misc_feature (1)..(240): Xaa is any amino acid
MYKEMVACSMEKAFMITPVWRAEKHNTIRHINEIRQMDIECSFMNQMDVMRIEEKCVQHIISEVLKRNKFEIELLGLNVKVPSAKYASYDETIDLLKKAGIKIALGDDLNPEAEKKLGELYPDTLVFVHSWPSSLKPFYIMPKDGKEDSDYSEGFDCIYNGMEITSGGQRIHLPELLLKRIKHKGMKTDGLMDYVNSFRYGAPPHSGWSIGLERLTMLICGLDNIREATMFPRDRDRLTP

SEQ ID NO: 2237 - DNA, 435 bp, Unknown
  Obtained from environmental sample
  misc_feature (1)..(435): n is a, c, g, or t
gtgggcaagatctacaacgatcagtggatgatggaacgtgggtatctggatgtaaaaactttcaaggatttggttagcgcccgtaacacccaaaagaaactcgtgaccattgaaccgaagcacacggtagctgaagcagtagagttaatgaagaaatacgacattgaacatattccggtggtaaatgggaacggacccatcggctcgatcagtgaaaacgggttgtttcagaaagtattttccaatcccgacattcgtaatgaatcagtagaaagcgtgatggaacatccctttccgattgttgattttgataccccggttgaaagactcagcacgcttataaataaagaaaatggcgccgtgctaagcaaagacgaggcaggcaattttcacatcgttactaagtatgatgtcatacaggcccttggaagttga

SEQ ID NO: 2238 - protein, 144 aa, Unknown
  Obtained from environmental sample
  DOMAIN (28)...(80): CBS domain
  misc_feature (1)..(144): Xaa is any amino acid
MGKIYNDQWMMERGYLDVKTFKDLVSARNTQKKLVTIEPKHTVAEAVELMKKYDIEHIPVVNGNGPIGSISENGLFQKVFSNPDIRNESVESVMEHPFPIVDFDTPVERLSTLINKENGAVLSKDEAGNFHIVTKYDVIQALGS

SEQ ID NO: 2239 - DNA, 468 bp, Unknown
  Obtained from environmental sample
  misc_feature (1)..(468): n is a, c, g, or t
ttgggcgatatgagatcgtacaattttgtggtcgacatcaccccggatatcgaagatgttcaatatcgaatcagggcgattgactttgaccaacagtcgtacgaaggacggaaaaacttatacctcccacagttctttaaagaaaacataccatttgttgaaacggtgatgaagtctttgaataaagattctatcgaacaatatcaaaccgaagaaagaacgctaatggcatttcgtgtggcatccacccgtcaccggttgatgcaactactgaatattatgtcgaaagattcgatttcgacgccagaaaaaatcacgcaattaaaaaacgaactgggtgattacttcaaaaataattccttctataagtgcacttctatgggccaggtggtaaaacggcagcttaaacaaacattgcaaaaaaacttaatgctgatccagcaaaacctcgggaagtttgaggattga

SEQ ID NO: 2240 - protein, 155 aa, Unknown
  Obtained from environmental sample
  misc_feature (1)..(155): Xaa is any amino acid
MGDMRSYNFVVDITPDIEDVQYRIRAIDFDQQSYEGRKNLYLPQFFKENIPFVETVMKSLNKDSIEQYQTEERTLMAFRVASTRHRLMQLLNIMSKDSISTPEKITQLKNELGDYFKNNSFYKCTSMGQVVKRQLKQTLQKNLMLIQQNLGKFED

SEQ ID NO: 2241 - DNA, 552 bp, Unknown
  Obtained from environmental sample
  misc_feature (1)..(552): n is a, c, g, or t
ttgaataattgtgtaaataaaataaaaaatttaccttttttttgtaaagaatatgatcaacaagatgatcaacaagatgattattatttaagtattgataatcctaacaaacagcctatttatattattaattattattttccagataatataaaatctgatgtttttaataatatactttctatttataattctcgtttatatgaaaataaaaaagcttattattctctttctgaacttgttgctaaaggtgaaggcccagctgatgaatatcctgatcctcttgaagaaattgaaaaagaagatggtttttatatgtttgatttaaaggaattagatccagagaaaattaaaccaataataaaattaaataaacttttatttgaagacgttgaacgaaatattgctaatctttcatttgctaattctgatgaacttataagttttacaatagtagattcttttgattatttatcttatttttataacttttttaaaatgcacgatttaacgtcagaagaaatttgtttactttttcagtcaataaaataa

SEQ ID NO: 2242 - protein, 183 aa, Unknown
  Obtained from environmental sample
  misc_feature (1)..(183): Xaa is any amino acid
MNNCVNKIKNLPFFCKEYDQQDDQQDDYYLSIDNPNKQPIYIINYYFPDNIKSDVFNNILSIYNSRLYENKKAYYSLSELVAKGEGPADEYPDPLEEIEKEDGFYMFDLKELDPEKIKPIIKLNKLLFEDVERNIANLSFANSDELISFTIVDSFDYLSYFYNFFKMHDLTSEEICLLFQSIK

SEQ ID NO: 2243 - DNA, 987 bp, Unknown
  Obtained from environmental sample
  misc_feature (1)..(987): n is a, c, g, or t
atgggaaatcaccaggttcaaaagtatagttctcataagcatatcgaactgaatcgagtccagaaaaagaatcatcgtcaattagaaaaggacaatattagaagtgttggtaaaaccattacttcttacggagtgttcattgacttaggtggtttagatggattaatccacattacagatttatcttggtctcgtatcaatcacccaagtgaagttttagaattagatcaaaaattaaatgttgtaatcttagatttcgatgatgagaaaacaagaattcaattaggtttaaaacaattaaacgctcacccatgggatgcattatctgctgaattaaacgttggagataaagtaaaaggtaaagtagttgttttagctgattacggtgcttttattgaggttgctgaaggagttgaaggattaattcacgtttctgaaatgtcttggtctacgcatttacgttctgctcaagatttcgttaaagttggtgatactgtagaagcagttatcttaactttagatagagatgatagaaaaatgtctttaggtatcaaacaattaactactgatccttggaatggaattactgagaagtacccagttggttctaaacatacaggaatcgttagaaactttactaatttcggaattttcgtagaattagaagaaggaattgacggtttagtttatatttctgatttatcttggactaaaaaaatcaagcatccatcagaatttgttaacgttggtgacaaattagaggttgttgttttagaattagacgttgaagctcgtaaattatctttaggtcacaaacaaactttagataatccatgggacaaacatgaagctgcatacgctgtaggttcagttcacaatggtactatttctgaaatcgttgacaaaggtgcaactgtagatttcggtgatgatgttcaaggattcgttccaactcgtcatttagaaaaagaagatggtaaaaaatga

SEQ ID NO: 2244 - protein, 328 aa, Unknown
  Obtained from environmental sample
  DOMAIN (27)...(98): S1 RNA binding domain
  misc_feature (1)..(328): Xaa is any amino acid
MGNHQVQKYSSHKHIELNRVQKKNHRQLEKDNIRSVGKTITSYGVFIDLGGLDGLIHITDLSWSRINHPSEVLELDQKLNVVILDFDDEKTRIQLGLKQLNAHPWDALSAELNVGDKVKGKVVVLADYGAFIEVAEGVEGLIHVSEMSWSTHLRSAQDFVKVGDTVEAVILTLDRDDRKMSLGIKQLTTDPWNGITEKYPVGSKHTGIVRNFTNFGIFVELEEGIDGLVYISDLSWTKKIKHPSEFVNVGDKLEVVVLELDVEARKLSLGHKQTLDNPWDKHEAAYAVGSVHNGTISEIVDKGATVDFGDDVQGFVPTRHLEKEDGKK

SEQ ID NO: 2245 - DNA, 594 bp, Unknown
  Obtained from environmental sample
  misc_feature (1)..(594): n is a, c, g, or t
atgaactaccaagaacttgatttagtcgtattaaaacatattttatctaacaaaaaaaatgctttggaatttgtttacgaatccaacgagaagatttttatgtcagatatttggcgctttgctaaattgattctcgattatgtgcgcgtttacaaagaaatacccacacaacgagttattaatgaacaaaacaaacacaatgaggcactgcttcagtatattaattcaatatggaaagatattgactcagttaaagtagacgagcgggaatataaacatgatttagaaaaaatcaaacgccgatttactgaacggttaatctatgctttaaaagatcgtttagttaatgaagatggtagaattgatataagcaaaagtgttgctgaactaaatacaacgtttagtcaaattaaaaatgttagtaaaagtaaggcatatgaccagaagacattacaggaaggactatctgattttagaaataattatgcagataagttaaatgaaccaaaccacgggattggtattacaactggctataggtttgtcgaatttggttacttccggaaatggtcggggggggaaggntcttattag

SEQ ID NO: 2246 - protein, 197 aa, Unknown
  Obtained from environmental sample
  misc_feature (1)..(197): Xaa is any amino acid
MNYQELDLVVLKHILSNKKNALEFVYESNEKIFMSDIWRFAKLILDYVRVYKEIPTQRVINEQNKHNEALLQYINSIWKDIDSVKVDEREYKHDLEKIKRRFTERLIYALKDRLVNEDGRIDISKSVAELNTTFSQIKNVSKSKAYDQKTLQEGLSDFRNNYADKLNEPNHGIGITTGYRFVEFGYFRKWSGGEGSY

SEQ ID NO: 2247 - DNA, 306 bp, Unknown
  Obtained from environmental sample
  misc_feature (1)..(306): n is a, c, g, or t
gtggattcagaaattaactattggaatattgattcatacatcacccgcattccttatgttcaagattcgatgacgattgccattgagacgggcaatgcagaaaatcagactttaggatttattattctgaaggaacaaaagacagcgaaagaactaaaaaaagatctggcgcatatccttttggactaccaggttccggaaaagattttctttgtggagaattttccaaccaacatttcaggaaaagtctgtcgtaaaacattaaaagcaaattatattgaatcactagataaggtaaaagcatga

SEQ ID NO: 2248 - protein, 101 aa, Unknown
  Obtained from environmental sample
  misc_feature (1)..(101): Xaa is any amino acid
MDSEINYWNIDSYITRIPYVQDSMTIAIETGNAENQTLGFIILKEQKTAKELKKDLAHILLDYQVPEKIFFVENFPTNISGKVCRKTLKANYIESLDKVKA

SEQ ID NO: 2249 - DNA, 756 bp, Unknown
  Obtained from environmental sample
  misc_feature (1)..(756): n is a, c, g, or t
atgcaaattagagaacttattcagcgccggctggactcaaaaatcaaagtgtttaaccgtgaagggattcagatcgctgactctcagttcaaacaagaataccagacgattcgccagtatcttttagacttccattctcaagaacaagactgcgtcgccattaaagaagataaagactatcgctactttttaacaatcctcgcctgtcaggaaattgggataccttatgttcccatgaaacacgactatccgatggaccgtgtgggacagattcaggaagactcaaaattcactttgctgattactgatgagaagatgcaagagatcctggcctatggcgggaagaagaacactacccttccgaaagttaacggtgagaagactgcttacattctttttacttccggcagtaccggtcgtcctanaggtgtgatcattcaacgtaaagcgctggagaatttctaccagtggaacaatgattatttcaccaatgtcacatctcangaccgcttgcttcangtaacagagtttacctttgatatttcactttttagatgtgggacttttttctcactaaaaatgtggagacttattttttctaactggaaccggcaacattttcaaaactgggttttgaaaatgaaaactaaccggattagggcgctcaatacccgttcccaaaaatttggatatgttttttatctaaccctcctgggccgattcccagggactaacaagggccttaaatgtttttat

SEQ ID NO: 2250 - protein, 252 aa, Unknown
  Obtained from environmental sample
  misc_feature (1)..(252): Xaa is any amino acid
MQIRELIQRRLDSKIKVFNREGIQIADSQFKQEYQTIRQYLLDFHSQEQDCVAIKEDKDYRYFLTILACQEIGIPYVPMKHDYPMDRVGQIQEDSKFTLLITDEKMQEILAYGGKKNTTLPKVNGEKTAYILFTSGSTGRPXGVIIQRKALENFYQWNNDYFTNVTSXDRLLXVTEFTFDISLFRCGTFFSLKMWRLIFSNWNRQHFQNWVLKMKTNRIRALNTRSQKFGYVFYLTLLGRFPGTNKGLKCFY

SEQ ID NO: 2251 - DNA, 507 bp, Unknown
  Obtained from environmental sample
  misc_feature (1)..(507): n is a, c, g, or t
atgcaaacgaaagatgaatacgaggtagcgataattggtggtgggctttctggattggctacttctatccaattggcaaaatcgggccactctgttatactttttgagaaggaaaaatatccttttcataaagtttgtggcgaatacatcagtttagaaagttggaattatctgaaccagttaggattgcctcttgatgaaatggacgttcccataattgatactttagtcattacagcgccgaatggaaaatcatttaaaacaaaattaccgttaggcggtttcggaatcagccgttatcgtctggactctatgctggctgaaattgccagaaaaactggtgttcatctgatggaggaaactaaaattgccgacgtagaatttaatgaaaattttactgtattaactcattcgctaaaagttaattcaactatttgttgcgccgcttttggcaagagaagcaatcttgatgtcaaatggaaaagaggttntcntgaatcaatctga

SEQ ID NO: 2252 - protein, 168 aa, Unknown
  Obtained from environmental sample
  DOMAIN (9)...(138): FAD binding domain
  misc_feature (1)..(168): Xaa is any amino acid
MQTKDEYEVAIIGGGLSGLATSIQLAKSGHSVILFEKEKYPFHKVCGEYISLESWNYLNQLGLPLDEMDVPIIDTLVITAPNGKSFKTKLPLGGFGISRYRLDSMLAEIARKTGVHLMEETKIADVEFNENFTVLTHSLKVNSTICCAAFGKRSNLDVKWKRGXXESI

SEQ ID NO: 2253 - DNA, 582 bp, Unknown
  Obtained from environmental sample
  misc_feature (1)..(582): n is a, c, g, or t
atgtctatggatttccttgaatttaaggccagccagttgaatactattaatacagacaagcaaggaaaattagattacactaagttcatttcccaaataccatcaaaaccattacagaattatgcgttctccaatataggccatttgatgtttaaaaataatgctgcaaacctggggttttcgcaattatcatttagcaatggtgctgcttatggcgatcttgacaatgacggcgacgaggatcttgttgtgaacaatattaattcatcaagttttctttatcgcaacgaagcaaatcagctttcaaaaaatcattttcttaaagtgaagttcaagggacccgataaaaatgtgtttggaattggtgcagaagtgagactttggaacaaggatggaataaaagttcttcagaatttcaatacccgcggatttcagagcagtatagaacctgtattgttatttggattgggaaaagaaatatcaattgagcggaaggtttcaccggttgtttccagcggcatccacgcaccgcccaacccggaaaggatgaacatcggcgccatagcaaagatcactgcctga

SEQ ID NO: 2254 - protein, 193 aa, Unknown
  Obtained from environmental sample
  misc_feature (1)..(193): Xaa is any amino acid
MSMDFLEFKASQLNTINTDKQGKLDYTKFISQIPSKPLQNYAFSNIGHLMFKNNAANLGFSQLSFSNGAAYGDLDNDGDEDLVVNNINSSSFLYRNEANQLSKNHFLKVKFKGPDKNVFGIGAEVRLWNKDGIKVLQNFNTRGFQSSIEPVLLFGLGKEISIERKVSPVVSSGIHAPPNPERMNIGAIAKITA

SEQ ID NO: 2255 - DNA, 561 bp, Unknown
  Obtained from environmental sample
  misc_feature (1)..(561): n is a, c, g, or t
gtggccagcaaaaaattcatcattattattttatcgttatttatactgtatgtaattacggaattaaataagccaaagccaatggactggacagttactataagaaagagtgataaaaatccctatggcggctatattgtatataaccagttaaagactttatttcctggcgctgcagtgcgttcttattacctgcctgtttataatcagttaaataatgtcagggaaaagaataccgcctaccttatactaaccccctcctttgagccatctaaatatgattaccaggaaatgatgcattacgttgagcagggaaattatgttgtagtgtcagcagaaaattttggcacgcagtttttagattctttacatattaaaactaaaatctcattttcaataaatagcaacgattcaaccaccataaattttgtaaatccctttataaagtcaaaagaagtctttacttttttgaattttacgatgaaccagtacttttcaaaacttgatacagtaaaaacgatagtgcttggtataaatgataaagaccaccctaatttataa

SEQ ID NO: 2256 - protein, 186 aa, Unknown
  Obtained from environmental sample
  misc_feature (1)..(186): Xaa is any amino acid
MASKKFIIIILSLFILYVITELNKPKPMDWTVTIRKSDKNPYGGYIVYNQLKTLFPGAAVRSYYLPVYNQLNNVREKNTAYLILTPSFEPSKYDYQEMMHYVEQGNYVVVSAENFGTQFLDSLHIKTKISFSINSNDSTTINFVNPFIKSKEVFTFLNFTMNQYFSKLDTVKTIVLGINDKDHPNL

SEQ ID NO: 2257 - DNA, 756 bp, Unknown
  Obtained from environmental sample
  misc_feature (1)..(756): n is a, c, g, or t
atggcttcgttaggagagcttactgcaggcattgcccatgaaatacaaaacccattaaacttcgttaataatttttctgaagtaaatagtgagttaattgacgaaatgaaagatgaaataaaaagcggaaattatgatgtagtagaaatgatcgcaaaaaatattcaggacaaccacgaaaaaattaatattcacggaaaacgcgccgatgctattgtaaaaggcatgctgcaacattcccgaacaagtactggacaaagagaacctacagacattaatgcgttggcagacgaatatttacgattggcctatcatggtttgcgtgcaaaggataaagattttagcgcaacaatgaagaccgattttgacgaaaatatgggtctaacaaaaattattccgcaggatattggaagagtttttcttaacttatacaccaatgcattttatgccgtatcagagaaaaagaggcaaaatttaaatgagtatgaaccaactgtttcggtaagaacaaaaaatatcaatggccttgttgaaatacaggtaaaagataatggaaacggtattccgcaaaaaatgcagactaaaatatttcaacccttttttaccactaaaccagcagggcagggaacaggactaggtttgtctctgagttatgatattgtaaaggcacatggtggtgaattaaaagtggaatcaaaagaaggtgaagggtccgtatttataattcaattaccagttaattatgcaacggaatga

SEQ ID NO: 2258 - protein, 251 aa, Unknown
  Obtained from environmental sample
  DOMAIN (3)...(85): His Kinase A (phosphoacceptor) domain
  misc_feature (1)..(251): Xaa is any amino acid
MASLGELTAGIAHEIQNPLNFVNNFSEVNSELIDEMKDEIKSGNYDVVEMIAKNIQDNHEKINIHGKRADAIVKGMLQHSRTSTGQREPTDINALADEYLRLAYHGLRAKDKDFSATMKTDFDENMGLTKIIPQDIGRVFLNLYTNAFYAVSEKKRQNLNEYEPTVSVRTKNINGLVEIQVKDNGNGIPQKMQTKIFQPFFTTKPAGQGTGLGLSLSYDIVKAHGGELKVESKEGEGSVFIIQLPVNYATE

SEQ ID NO: 2259 - DNA, 684 bp, Unknown
  Obtained from environmental sample
  misc_feature (1)..(684): n is a, c, g, or t
atgatcttttttcaaggctgtcaaagcctgaagcaatcttccaaatatggttttaatgaagggtattataaaagccgattgttccataaaaaactaaaatccgtttatatagttccaggcgatgattcaataaaagtttacacaacaaaaagccttcaaaaagattccattgacacggttaaatctttgaaaatagcctttccacttaatcacaagcccgcaggttttaataactatttttttaaacaaaatacatttgatgttgacatactaagcatattgatcaaataccgttcttcggtttccgggttccctaatcaattcaatacttctatattaaacggagctgtttattttgggtaccgctccgatttttatcatttgcattacaacaaaacaccactaggtatttataaaagaaaaatcagccattatggacttagctatggactatttgccggtttgggagcctcaagagtagatccatatgttactttaaatgcgcttgatatagaatatgacggacttgtacaagtatctggaatagcagccatcattgccgtaaataaattgagttgtggtttaaactttggtgtagatcatcttttagataagaaccgaaaattttggatttaccagggtaaaccatggataggattaagcatcgggttaaatttgaattag

SEQ ID NO: 2260 - protein, 227 aa, Unknown
  Obtained from environmental sample
  misc_feature (1)..(227): Xaa is any amino acid
MIFFQGCQSLKQSSKYGFNEGYYKSRLFHKKLKSVYIVPGDDSIKVYTTKSLQKDSIDTVKSLKIAFPLNHKPAGFNNYFFKQNTFDVDILSILIKYRSSVSGFPNQFNTSILNGAVYFGYRSDFYHLHYNKTPLGIYKRKISHYGLSYGLFAGLGASRVDPYVTLNALDIEYDGLVQVSGIAAIIAVNKLSCGLNFGVDHLLDKNRKFWIYQGKPWIGLSIGLNLN

SEQ ID NO: 2261 - DNA, 648 bp, Unknown
  Obtained from environmental sample
  misc_feature (1)..(648): n is a, c, g, or t
atggcaaccaataaaaaatatttattgttgatgaccatactctttaaagagaggcatttaaaatgggcactttcatcaaatcctcatttttcaataattggcgaagcaggtgatggagagaaggcggtagaacttgttccaagattaagaccggatgtaattacgatggatattaatttacctggtattaatggtatagaagcaacaaaacagatcaggagaacgttgccaggagcaaaagttttgggcgtttccttacatacgcagccctcatacgcacttaagatgatgaaagtcggggcttatggctatgtaactaaaaattccagcaaaaatgaaatgttcaaagcgattactgaagtatttggaggaagaaaatatgtatgtgatgaaataaaaaatattctatctagccatataacaggcggggatgaacaaaaagcaaaattagattctttgtcactgcgggaaatagaagttatcaagcatataaaagatggcaagtcttcaaaagaaattgcacaagaattatttgtttctgtaaaaacgatcgaagtgcaccgctataatatcctcaaaaaattgaaattgaaaaatacagcagcgttggtcaattttattaacaatcgccctgaactggatatctaa

SEQ ID NO: 2262 - protein, 215 aa, Unknown
  Obtained from environmental sample
  DOMAIN (150)...(207): Bacterial regulatory proteins, luxR family
  misc_feature (1)..(215): Xaa is any amino acid
MATNKKYLLLMTILFKERHLKWALSSNPHFSIIGEAGDGEKAVELVPRLRPDVITMDINLPGINGIEATKQIRRTLPGAKVLGVSLHTQPSYALKMMKVGAYGYVTKNSSKNEMFKAITEVFGGRKYVCDEIKNILSSHITGGDEQKAKLDSLSLREIEVIKHIKDGKSSKEIAQELFVSVKTIEVHRYNILKKLKLKNTAALVNFINNRPELDI

SEQ ID NO: 2263 - DNA, 543 bp, Unknown
  Obtained from environmental sample
  misc_feature (1)..(543): n is a, c, g, or t
atggatgtgtattggcttgataaaaaactggaatcaaaagatgaaaaagtacaggacaaaattagcggcataattgaactaataaatgaaacagtaaaatcggtaagaagaatttcttctaatcttcgtcccagtattttagacgatttgggtttaatagcagcattggaatggcacagcagggaggtggaaaaaagatcagaaataaaagtgcatttcgtcacccatatggcagaacaggaaattcctttagatattgctaccggcatatttagaatttaccaggaagctttaaataatgctgtacgtcatgccaatgcgcacgaaataaaaagcagtttgcaaataaacaataatcaaattattttgaaaattaaagacgacggaagaggtatagatcctgacaaaaaggcgaattcaaaatcctttggccttattggtattaaggaacgcacttttgttatgggaggtaaatttgaacttaaaagcgaaccagggtatggtactgaattatgcatttctattccattgcccatgccataa

SEQ ID NO: 2264 - protein, 180 aa, Unknown
  Obtained from environmental sample
  DOMAIN (85)...(178): Histidine kinase-, DNA gyrase B-, and HSP90-like ATPase
  misc_feature (1)..(180): Xaa is any amino acid
MDVYWLDKKLESKDEKVQDKISGIIELINETVKSVRRISSNLRPSILDDLGLIAALEWHSREVEKRSEIKVHFVTHMAEQEIPLDIATGIFRIYQEALNNAVRHANAHEIKSSLQINNNQIILKIKDDGRGIDPDKKANSKSFGLIGIKERTFVMGGKFELKSEPGYGTELCISIPLPMP

SEQ ID NO: 2265 - DNA, 717 bp, Unknown
  Obtained from environmental sample
  misc_feature (1)..(717): n is a, c, g, or t
ttgatgattaaaaatgaaacctctattgttgatgacaggggatataaccaggggtttaaagaaacctttgcgcttaaaaaaagaatggaaaggcgggcacaatggatgattgatctaatggaagtgcaggtggataaaaaggtattggagataggatgcggcaccggctatgtatctttttacattgcccaaaaaaccggaatgcaggttgtaggttctgatttgtgtaagccatttataaaaggtgcaaacaaaaaatacatactgccaaatctttcatacgatacgcttgattttaatgaagctgctaaaagcattcataacaaatttgattacatcattggcaatggtattttacaccatttatattacaacctggatgaggcgctggtaacactaaaaagtttattgaacccgggcggtaaaataatttttatggaaccgaatatcttcaatccatacgttgcggctatttttaaaaataaaagtctgcggcaatgggcaaaactggaaccggatgaaatggctttttcaaaaaagttcatacaggaaaaactacacgccgccggttttacgcaggtcggcattacgtataaagattttcttttgccgggcataccaaaagcgctggtcaaaccctctattgttattggaaatattttagaaaaaacaccattaaaatacataagccagtcaattttgatctgtgctcaatag

SEQ ID NO: 2266 - protein, 238 aa, Unknown
  Obtained from environmental sample
  misc_feature (1)..(238): Xaa is any amino acid
MMIKNETSIVDDRGYNQGFKETFALKKRMERRAQWMIDLMEVQVDKKVLEIGCGTGYVSFYIAQKTGMQVVGSDLCKPFIKGANKKYILPNLSYDTLDFNEAAKSIHNKFDYIIGNGILHHLYYNLDEALVTLKSLLNPGGKIIFMEPNIFNPYVAAIFKNKSLRQWAKLEPDEMAFSKKFIQEKLHAAGFTQVGITYKDFLLPGIPKALVKPSIVIGNILEKTPLKYISQSILICAQ

SEQ ID NO: 2267 - DNA, 504 bp, Unknown
  Obtained from environmental sample
  misc_feature (1)..(504): n is a, c, g, or t
ttgagtaaaaaggatgttatgatcttttccaaatcattcggatatgcactaaggggcattttatacattgccattatgaaagaacaaaaacgttatgtacaggtggaggagattgcctcaaagctggcagcgccgcggcatttcatgggcaagatcatgaaaaggctggcgaaagaaaagctgctgatctctgcaaaaggaccttccggcggatttatgcttggtgaaaatactttggaaaaacctttaatggacctgatcgtgattaccgatgatgctgcgttatttgatacctgtgttttaagagccaaggaatgcaatggcactaatccatgtccgatgcatggccaaatggagggattaaaaaccaatctgaaatccatactgtcaaatacaactattggcgatcttttagaagaagacaaaccggaattcatcagaagtctttccaacgccattggcatcgaggtacccaagcttccggaagtacaaaaggtttattaa

SEQ ID NO: 2268 - protein, 167 aa, Unknown
  Obtained from environmental sample
  DOMAIN (7)...(129): Transcriptional regulator
  misc_feature (1)..(167): Xaa is any amino acid
MSKKDVMIFSKSFGYALRGILYIAIMKEQKRYVQVEEIASKLAAPRHFMGKIMKRLAKEKLLISAKGPSGGFMLGENTLEKPLMDLIVITDDAALFDTCVLRAKECNGTNPCPMHGQMEGLKTNLKSILSNTTIGDLLEEDKPEFIRSLSNAIGIEVPKLPEVQKVY

SEQ ID NO: 2269 - DNA, 795 bp, Unknown
  Obtained from environmental sample
  misc_feature (1)..(795): n is a, c, g, or t
atgcctactcctgatgtgcttattaagaacgcaaaaagaggtagggataattatcttactcgtgtatcaattataccaagtctacaaaatcttaaatggcgtaataaaatagctgactacgtgccattgcaacaacaagggaagattctgcatgaatattatatggcagttattgggttcgcaagagaaggtcttgataacttcaataaaaaatatgccttatcgggtagatcaagggatagaaatctacctgagattgactttcctacaaaagatcaaataatactacaagatggtgacagacttttatctaatagatatgaggtatttggtagcaatatttcttcttacatactttgggcagcgtggaataatcaattcgaaaatagcacattaataaacgttcattataaaggcaaaatagtgctgaaagaagatcaaattacacaaggtcttttcgatatacttcgagatatacttggcataccaactaatttagattatttaccggaaaagctattctatgataaattctatgagagactgaatgaaaaatccgagataataattaaaaagaaagacggaaagaaggttagtgctcaaaaaactgttttgcttagaaaacatttaattagtgtagtacaatattataaaagacataacaaatcatttaatcaactcctctatccaaatagagttttaaatccaaatggaacagcaaatcaagcatgtgatattgatacacttaataaaatttacattaatgcagcaataagcaatagcattcccatttga

SEQ ID NO: 2270 - protein, 264 aa, Unknown
  Obtained from environmental sample
  misc_feature (1)..(264): Xaa is any amino acid
MPTPDVLIKNAKRGRDNYLTRVSIIPSLQNLKWRNKIADYVPLQQQGKILHEYYMAVIGFAREGLDNFNKKYALSGRSRDRNLPEIDFPTKDQIILQDGDRLLSNRYEVFGSNISSYILWAAWNNQFENSTLINVHYKGKIVLKEDQITQGLFDILRDILGIPTNLDYLPEKLFYDKFYERLNEKSEIIIKKKDGKKVSAQKTVLLRKHLISVVQYYKRHNKSFNQLLYPNRVLNPNGTANQACDIDTLNKIYINAAISNSIPI

SEQ ID NO: 2271 - DNA, 348 bp, Unknown
  Obtained from environmental sample
  misc_feature (1)..(348): n is a, c, g, or t
atggactatgtatgcagaaatgttaatccaacaaaaattcctattgaatttaaagagttaaataaagaggattttaagggtttggaaattgaaggtaataacaagattattgttcaacctgatgaaaatggatttattggagaagcacttaacgatgtaattaattttagtgatagtaatactgttgttatcaatgcaggtgtcgggcaaggaaaatctacattttgtataagcttggcagagtattacattaatctaactaatgaaaagggagaaaatcaatatgttgtcttgttcgttgctccctacatttctataatcaaccagtatgagaagaaaatactttga

SEQ ID NO: 2272 - protein, 115 aa, Unknown
  Obtained from environmental sample
  misc_feature (1)..(115): Xaa is any amino acid
MDYVCRNVNPTKIPIEFKELNKEDFKGLEIEGNNKIIVQPDENGFIGEALNDVINFSDSNTVVINAGVGQGKSTFCISLAEYYINLTNEKGENQYVVLFVAPYISIINQYEKKIL

SEQ ID NO: 2273 - DNA, 522 bp, Unknown
  Obtained from environmental sample
  misc_feature (1)..(522): n is a, c, g, or t
ttgcgaaagaaggccacaccgatcacccgcgattatcctaatctcagtcagctgatcgatgacatgtatgagacgatgtatagtgccaaaggtgtgggcttagctgctccgcaaattggaaaagatatcaggctttttatagttgatacaatccagttggataaaaagaatgaaacagctaccgggataaagaaagtctttatcaacgcggaaatacttgatgagtcaggcgatccctggttatatgaagaaggctgcttaagcattcctgatttacatgctgaaattgaaaggaatccaacaattacactaaagtatgtagacatagaatggaatgaacatattgaaacatttgaaaaaattaatgcacgtgtcattcagcatgaacatgaccatattgaagggattcttttcattgacaggatgaaaccattaaaacggagattaatcaatggtaagcttgaaaaaattaagaaaggcgatattgaagtcagtcatccaatgcgttttgtgaaaccttga

SEQ ID NO: 2274 - protein, 173 aa, Unknown
  Obtained from environmental sample
  DOMAIN (1)...(148): Polypeptide deformylase
  misc_feature (1)..(173): Xaa is any amino acid
MRKKATPITRDYPNLSQLIDDMYETMYSAKGVGLAAPQIGKDIRLFIVDTIQLDKKNETATGIKKVFINAEILDESGDPWLYEEGCLSIPDLHAEIERNPTITLKYVDIEWNEHIETFEKINARVIQHEHDHIEGILFIDRMKPLKRRLINGKLEKIKKGDIEVSHPMRFVKP

SEQ ID NO: 2275 - DNA, 429 bp, Unknown
  Obtained from environmental sample
  misc_feature (1)..(429): n is a, c, g, or t
atgtgggaacaaaagaaaatgggcgtacaagatttctcaaagatccctaacggtcatcccgctattgaaaaccgtatggagctattatttaccgaaggtgtacagaaagggaaaatcacattacagcagtacgtagacgtcacttcaaccaatgcggcaaaaatatttggtatgttccctcgcaaaggatgcatagctcccgggagtgatgcggacctggtaatctttgacctaaatgaagagcatactatttctgcatcaacacatcatatgaatgtggactacagtgcgtatgaaggatgggagttgaaaggcaaatgcaagacgactattctgcgaggtaaggtagcagttgatcacggagaggttcggatcgataaagggtatgggcagtttgtaaagcgtaataaggtaaaagtggtggaataa

SEQ ID NO: 2276 - protein, 142 aa, Unknown
  Obtained from environmental sample
  misc_feature (1)..(142): Xaa is any amino acid
MWEQKKMGVQDFSKIPNGHPAIENRMELLFTEGVQKGKITLQQYVDVTSTNAAKIFGMFPRKGCIAPGSDADLVIFDLNEEHTISASTHHMNVDYSAYEGWELKGKCKTTILRGKVAVDHGEVRIDKGYGQFVKRNKVKVVE

SEQ ID NO: 2277 - DNA, 603 bp, Unknown
  Obtained from environmental sample
  misc_feature (1)..(603): n is a, c, g, or t
atggttggatattacgagcctgcaaatattccggttgaattaaattctttttcagcttctgttaatcaaaataatgttacactaaagtggtcaacagctactgaaataaataataaaggctntgaggtgcagtcgttatttgtgggtgatcagtcagccgccgaatggaaaactttgacttttattgatggcaaaggaaccagcgctgaaaagcaggattatttatattcggataaaaacctggaagcaggtaaatacagctacaggcttaagcagattgattttgacgggacatttaaatattatgatttagccgaaacggtggaaattggtgttccggaggcatttgacctttcacagaattatccgaatccgtttaatccgtcaactaaaattaaattcagccttccttcagatgaatttgtaagcttaaaaatttataactctttaggcgaggaaatatcatctctgttgaataaagaatttaaatcagggttttatgatattgaatttaacgcttccaatcttccttcaggaatttatttttataaaataactgccggaagttttaatgaaacaaaaaagatgatgtttattaaataa

SEQ ID NO: 2278 - protein, 200 aa, Unknown
  Obtained from environmental sample
  misc_feature (1)..(200): Xaa is any amino acid
MVGYYEPANIPVELNSFSASVNQNNVTLKWSTATEINNKGXEVQSLFVGDQSAAEWKTLTFIDGKGTSAEKQDYLYSDKNLEAGKYSYRLKQIDFDGTFKYYDLAETVEIGVPEAFDLSQNYPNPFNPSTKIKFSLPSDEFVSLKIYNSLGEEISSLLNKEFKSGFYDIEFNASNLPSGIYFYKITAGSFNETKKMMFIK

SEQ ID NO: 2279 - DNA, 870 bp, Unknown
  Obtained from environmental sample
  misc_feature (1)..(870): n is a, c, g, or t
ttgaaaagacgcggagcgaactatttggggctctgtccatttcataatgagaaaacaccatcttttacggtttctccatcaaaggaaatttttaaatgctttgggtgcggtaagagcgggaataccatttcttttataatggaacacgaaaagctttcttatgtagaagcgttaagatggctggctaataaatacaatgttgaaatagaggaaacggagacctctcctgaacaaaaactacagcaacaaacttctgaaagcttattcatcattaatcaatttgcacaacaattttattcgaacattttatttcaaacagaagaaggaaaagatattggcttaacctatttaaaagaaagaggtttcaccgaagagattgtcaaaaaatttggattgggctatgcgcctgattcaaaagaccgatttgcaaaagaagctatcgctaaacaatacaatcctgaattactccaaaaatcggggttggttgttaatcgtaatgagcaactcgcagataattatcgcgacagaattatttttcctgtacataacaacagtggtaaagtaattggttttggtgcaagattaattaagaagaacgacaaagctccaaagtacattaacacaccggagaatgaactttatgtaaaaagtaaaattctttacggtacttattttgcccgccatgccatcgacaaggcagatgaatgtttgttagtagagggttatacagatgtcatttctcttcaccaggcaggaattgaaaatgtggttgccagcggaggaacgtcgttaactcaggaccaacttcgtctgataaaaaatacacgaaaaacctcaccattatatatgatggtgacccctgcagtgtga

SEQ ID NO: 2280 - protein, 289 aa, Unknown
  Obtained from environmental sample
  DOMAIN (1)...(74): CHC2 zinc finger
  misc_feature (1)..(289): Xaa is any amino acid
MKRRGANYLGLCPFHNEKTPSFTVSPSKEIFKCFGCGKSGNTISFIMEHEKLSYVEALRWLANKYNVEIEETETSPEQKLQQQTSESLFIINQFAQQFYSNILFQTEEGKDIGLTYLKERGFTEEIVKKFGLGYAPDSKDRFAKEAIAKQYNPELLQKSGLVVNRNEQLADNYRDRIIFPVHNNSGKVIGFGARLIKKNDKAPKYINTPENELYVKSKILYGTYFARHAIDKADECLLVEGYTDVISLHQAGIENVVASGGTSLTQDQLRLIKNTRKTSPLYMMVTPAV

SEQ ID NO: 2281 - DNA, 396 bp, Unknown
  Obtained from environmental sample
  misc_feature (1)..(396): n is a, c, g, or t
atgaaattattcatttcattatcacttttattcatttctatttttgttattgctcaggatccttcaaaacaaaacttcaaattagatcgcaataaaattgctattctaaaggcaaaggaaaaaaagaatgtgactttgaatgcgaaggattttgtattgattgaggatatccttcaaagatgcattgatgcacacaattcgaaaatagattccgcttctcatgaatttttacaactaanagattacaggcgtcaatacattgcttattctgacaatcaccaaaaaatggtttgggtaaattgcttttgtaatgaagatgctaaaatgtttccttattggaagaagagacggtattcgtttacgatggcgggggttgtttttttaatttacttataa

SEQ ID NO: 2282 - protein, 131 aa, Unknown
  Obtained from environmental sample
  SIGNAL (1)...(18)
  misc_feature (1)..(131): Xaa is any amino acid
MKLFISLSLLFISIFVIAQDPSKQNFKLDRNKIAILKAKEKKNVTLNAKDFVLIEDILQRCIDAHNSKIDSASHEFLQLXDYRRQYIAYSDNHQKMVWVNCFCNEDAKMFPYWKKRRYSFTMAGVVFLIYL

SEQ ID NO: 2283 - DNA, 339 bp, Unknown
  Obtained from environmental sample
  misc_feature (1)..(339): n is a, c, g, or t
atgagaaaacagcttgctgctgaaaaaggaaatcgtaaaaaatttaaagcaacttttaaccggttagggaagaaaacgaatttcaacggattccctgaagataccatcttgttaaaaaacgtagtggatctagaaacgaatcagattgtaacagatcatatctggtttaactacacaaaagggtttgaaaaaatatccttgaaagagggtacgcaaattgagtttgaagcaagaattaaagagtacaagaagggatacgtaaataagagtttaaaaattaataaccgtaaaacggattataaacttagtcacccaacaaaaattacgaagatttgttag

SEQ ID NO: 2284 - protein, 112 aa, Unknown
  Obtained from environmental sample
  misc_feature (1)..(112): Xaa is any amino acid
MRKQLAAEKGNRKKFKATFNRLGKKTNFNGFPEDTILLKNVVDLETNQIVTDHIWFNYTKGFEKISLKEGTQIEFEARIKEYKKGYVNKSLKINNRKTDYKLSHPTKITKIC

SEQ ID NO: 2285 - DNA, 339 bp, Unknown; identical to SEQ ID NO: 2283
  Obtained from environmental sample
  misc_feature (1)..(339): n is a, c, g, or t

SEQ ID NO: 2286 - protein, 112 aa, Unknown; identical to SEQ ID NO: 2284
  Obtained from environmental sample
  misc_feature (1)..(112): Xaa is any amino acid

SEQ ID NO: 2287 - DNA, 1101 bp, Unknown
  Obtained from environmental sample
  misc_feature (1)..(1101): n is a, c, g, or t
ttgattaatgctgtaagaaacggaaaaaaggttaccgtcgttgtagaattacaggccaggtttgatgaagaaacaaatatatattattcaaaaaaacttcaggaggaaggcgcagaggtgattttcggagttcagggtctgaaggttcattcaaagctttttctgatatcacgccgggagaagcggcgagtcgtcaactatgttcatataggaaccggtaattttaatgaacagactgcaaaaatttattctgatcattcacttcttacttccaataaacacatcactaaagaagttgaaaagctttttcatttttataaaaataattttaaaacaggaagttataagcatttgatagtttcacctttcaacacacggaaaaaatttattcaactcattcagaaagaaattgaaaatgcaaaagcaggtaaggaagcatggatgattctcaagatgaacagcatcgttgataacgatatgatcgaaaaactttatgaagcaagtaaggcaggagtcaaaataaaacttataataagaggaatttgctccatcataaccggtgtaccaggactgagtgaaaatatcagcgccatcagtattgtggataaatttttagaacatagcagaatttattttttctgtaatggcggaaaagaaaaaatgtatatatcatcgggcgactggatgtacaggaatcttgataacagatcagaagttgcagttccgatttattcgttgaatcttaaagagcagttgaaaaagtatttaaatattcaattaaaggataattgtaaaagcagatcattggataattcagacgacaatcctcatgtaattccggaaaacggcaaagtttgccgcgctcaggaagatatttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaa

SEQ ID NO: 2288 - protein, 366 aa, Unknown
  Obtained from environmental sample
  DOMAIN (1)...(298): Polyphosphate kinase
  misc_feature (1)..(366): Xaa is any amino acid
MINAVRNGKKVTVVVELQARFDEETNIYYSKKLQEEGAEVIFGVQGLKVHSKLFLISRREKRRVVNYVHIGTGNFNEQTAKIYSDHSLLTSNKHITKEVEKLFHFYKNNFKTGSYKHLIVSPFNTRKKFIQLIQKEIENAKAGKEAWMILKMNSIVDNDMIEKLYEASKAGVKIKLIIRGICSIITGVPGLSENISAISIVDKFLEHSRIYFFCNGGKEKMYISSGDWMYRNLDNRSEVAVPIYSLNLKEQLKKYLNIQLKDNCKSRSLDNSDDNPHVIPENGKVCRAQEDIYXXXXXXXXXXXXXXXXXXXXXXXXXXXXXXXXXXXXXXXXXXXXXXXXXXXXXXXXXXXXXXXXXXXXXXXXX

SEQ ID NO: 2289 - DNA, 507 bp, Unknown
  Obtained from environmental sample
  misc_feature (1)..(507): n is a, c, g, or t
atggtcaaaactggtaagttattaaaaagaatttttacagacttaaagcatgttacctgtttggcgcatatgttgcataacatatgtgaaaaaattcgagtgaaatcaaagtttgtagatgatattattgcaaatcttaaaagacttttaaccaagaataaagataaccaagaaatttttaaaaacatcacaggtttaaatattccaaagttccctattatcacaagatggggaacttggttggattttataaatttcttatttgaaaattacttggaaattcttcaatttatacgtaaaatggacgaaaaatatgaaagttgttatggtgctattgttgattctgacgattttaaaattcaaatacgttattgtaaaaaatttacttggcttgtaaaaataattgaagagttcgaaaccagagatttgtctgttgagcaacaaattgaatcgttaatgagaacaaaggaaaaattggaagataaatatcttatcgaatatttttaa

SEQ ID NO: 2290 - protein, 168 aa, Unknown
  Obtained from environmental sample
  misc_feature (1)..(168): Xaa is any amino acid
MVKTGKLLKRIFTDLKHVTCLAHMLHNICEKIRVKSKFVDDIIANLKRLLTKNKDNQEIFKNITGLNIPKFPIITRWGTWLDFINFLFENYLEILQFIRKMDEKYESCYGAIVDSDDFKIQIRYCKKFTWLVKIIEEFETRDLSVEQQIESLMRTKEKLEDKYLIEYF

SEQ ID NO: 2291 - DNA, 750 bp, Unknown
  Obtained from environmental sample
  misc_feature (1)..(750): n is a, c, g, or t
atggaagcatcagttgtacggtgtaatgcgatcatttaccgatctttgataataaaaatcctgatggatcaggaagaagataaaaaatcaaaattcacaagattagtgctggttcacttcgtggcactggaaaagtatgccatcagcttatgcaggaattcttttgatgcagatgacctggtgtctgaaacgcttttaaaggcctttgaaaactttacccgtgtacgggatgaaggaaagatcaagcaatggttgttcaggattctgaggaatgtctttatcaattattgccgaaaacaaaaaaatactcttttaattgaaagtgtattggaaaacaattcggagccgggagatttttctttgtttgaatctattgccagaagtaattttgttgcagacgggaatcctgaaaagaaatttatcagcatgctgacttcggatcagatagaaaaagcaattcatgagcttcccattgatttccgggaagctttgatattatgcgatgttgaggattttagctacgcagagatctcggatattttaaaagtgccgataggtaccgtcaaaagccgtatcgcacgtgcccaggaatatttttacaaaaaagcttttggcttcctgctcatgaaactgggcattaaattcatcttgcgactgccaaaaattaaattccgattattgcgtgtacatgtgggagaaaaaaaaattaaaaccccccaaataaaattaatttcctttattcaaaattaa

SEQ ID NO: 2292 - protein, 249 aa, Unknown
  Obtained from environmental sample
  DOMAIN (152)...(201): Sigma-70, region 4
  misc_feature (1)..(249): Xaa is any amino acid
MEASVVRCNAIIYRSLIIKILMDQEEDKKSKFTRLVLVHFVALEKYAISLCRNSFDADDLVSETLLKAFENFTRVRDEGKIKQWLFRILRNVFINYCRKQKNTLLIESVLENNSEPGDFSLFESIARSNFVADGNPEKKFISMLTSDQIEKAIHELPIDFREALILCDVEDFSYAEISDILKVPIGTVKSRIARAQEYFYKKAFGFLLMKLGIKFILRLPKIKFRLLRVHVGEKKIKTPQIKLISFIQN

SEQ ID NO: 2293 - DNA, 687 bp, Unknown
  Obtained from environmental sample
  misc_feature (1)..(687): n is a, c, g, or t
atggaattaactggacaaaaggggaaagggcacaacttgacggggcatctggtaaattattgctctattaaaataatatccggaaacgaaaaatttaaaaacatactttttgatataaataaatacagctttaaagaagaccttgtgttctttccggggaataacctgcctaagattgtatacgtacagatgatcattaatgccctatctgttggagaaactgcatgggcagaagaattcatagaaacatatgcttcccgtcttaagccggaaacaaaaaaagcaatgtatgcactaggaaaggcgcttgtattggctgacctggcaaaatatgaagatgtactgaaacagctccatgaagttgattatattgatgtaagagataaaatacaggtaaaaatactgacagcaaaggcatattatgaattgaaccagcttgaaacactccgaagctttatcgattcaacaaggcactttattaagagcagcaccggtttgaacaaattgaggcagaatttttacagtaatttcttaaattaccttcaaaaagcagttactttgaaagaaaaacccgataaagcccaggtacacgcactcaaaaaagaaattcaggaaataaaagaaatatcacccaaaaaatggatacttgaaaaatttgatgaactggctgcaggaaataaagaataa

SEQ ID NO: 2294 - protein, 228 aa, Unknown
  Obtained from environmental sample
  misc_feature (1)..(228): Xaa is any amino acid
MELTGQKGKGHNLTGHLVNYCSIKIISGNEKFKNILFDINKYSFKEDLVFFPGNNLPKIVYVQMIINALSVGETAWAEEFIETYASRLKPETKKAMYALGKALVLADLAKYEDVLKQLHEVDYIDVRDKIQVKILTAKAYYELNQLETLRSFIDSTRHFIKSSTGLNKLRQNFYSNFLNYLQKAVTLKEKPDKAQVHALKKEIQEIKEISPKKWILEKFDELAAGNKE

SEQ ID NO: 2295 - DNA, 699 bp, Unknown
  Obtained from environmental sample
  misc_feature (1)..(699): n is a, c, g, or t
ttgaaagattcccagataataacgatactgcgaacattcagcattcaggagatgaatgacttcggcagatttgtgatatcaccgtttttcaacaccagcgaagccacttcaaaattattctcagcgctaaaaaaattttatcccggtttttctgccatagatcttacaaagcaaaagctttttgcggaagtatatggaaaaagagaatacagtaatctgcttttcaacaaactttcttccaaccttatcaagttatcgtttgagttcattaaactgacaaataataccctggaaaaatatgcgctattgaggggcttgaggaaaaaaaggctcggcagtcttttcagatcgcaatttgcaagaacagaaaaagagcttgagcggggtaatgtaaacgaaggcgatactgtgtaccaaatgctcataaacatggaaaatgccaatttcaatcttgataccgataattattccggctttgagatctccggtatgagacatatggagcttaacacactatacttccttgaacgggtagcagcaaattacatccaaaaaaccaatatcgggatccctcccgagcttgaaaagaaaaagataatatcaaaattaaacgatagcattgattacgaaggcatgtatgaaaagatctcgggctcggagctattttacaaaaacgcctgcttcattttttatcaatga

SEQ ID NO: 2296 - protein, 232 aa, Unknown
  Obtained from environmental sample
  misc_feature (1)..(232): Xaa is any amino acid
MKDSQIITILRTFSIQEMNDFGRFVISPFFNTSEATSKLFSALKKFYPGFSAIDLTKQKLFAEVYGKREYSNLLFNKLSSNLIKLSFEFIKLTNNTLEKYALLRGLRKKRLGSLFRSQFARTEKELERGNVNEGDTVYQMLINMENANFNLDTDNYSGFEISGMRHMELNTLYFLERVAANYIQKTNIGIPPELEKKKIISKLNDSIDYEGMYEKISGSELFYKNACFIFYQ

SEQ ID NO: 2297 - DNA, 321 bp, Unknown
  Obtained from environmental sample
  misc_feature (1)..(321): n is a, c, g, or t
ttgccgttgataaattcggtatgttctttgatatcccggtttttgaaattcaaaatatatttcgaactgaacctcattgaagaatctctggcaatgatagattcatttgaacatttcctgaagaaagatactaagatcaacaggtccgttaaaccttcttatattggttttgtaaaatactataagaagctgatccaatgcaggatcagggaagactattctacattgggattaataatggaaaagcttcagaaggaaaaagcaaatgagaaaaaatggctgctgaagaaaatagaggaactggcaggaacaaaaatttaa

SEQ ID NO: 2298 - protein, 106 aa, Unknown
  Obtained from environmental sample
  misc_feature (1)..(106): Xaa is any amino acid
MPLINSVCSLISRFLKFKIYFELNLIEESLAMIDSFEHFLKKDTKINRSVKPSYIGFVKYYKKLIQCRIREDYSTLGLIMEKLQKEKANEKKWLLKKIEELAGTKI

SEQ ID NO: 2299 - DNA, 636 bp, Unknown
  Obtained from environmental sample
  misc_feature (1)..(636): n is a, c, g, or t
atgtctttccaaaacaagcttggcgttttgaagcaaagagttaagcgcgatgttacgcgtaccctcattacccagtctgtatctttcagaaccaggagactcatcgtatttctgactccgggtttcgatagtccttcaggtggaatactttcaatcgcgtcaatctatcgcgaatctgcagcactcgaaaatcttcacggggccagggtcgcaatctgtaccgttcccggtgaaccatctctgctgaaatacacatggtttaagaataaaaattacttgctcgatctcgaggcgctgctaaaccgctgtaatgagctcgattatttgctggtccatatccccgagtatgcggtcaataaggttcatgagtggttagagtcttattggccagaattacaaaagataaaagaactccacttaaacgtaatggtccagcatatcgacctggttgaaggtcaggatctcaaggcctggctcgctttggtaaaattacgtgcacaacggcgcacgaagcttacaccaatactgaaactcgtgagtcccttgggaatcccttcgcatcgactctccagtttgcaatggtcccaaaaaactatttctatttcttactacaaaaaaaaaggagccggttcctga

SEQ ID NO: 2300 - protein, 211 aa, Unknown
  Obtained from environmental sample
  misc_feature (1)..(211): Xaa is any amino acid
MSFQNKLGVLKQRVKRDVTRTLITQSVSFRTRRLIVFLTPGFDSPSGGILSIASIYRESAALENLHGARVAICTVPGEPSLLKYTWFKNKNYLLDLEALLNRCNELDYLLVHIPEYAVNKVHEWLESYWPELQKIKELHLNVMVQHIDLVEGQDLKAWLALVKLRAQRRTKLTPILKLVSPLGIPSHRLSSLQWSQKTISISYYKKKGAGS

SEQ ID NO: 2301 - DNA, 687 bp, Unknown
  Obtained from environmental sample
  misc_feature (1)..(687): n is a, c, g, or t
ttgagtgaattatgcatgtatgagcattccaaggcagcaaaaggcaaaggctacacagtagactgggtaaagaaaaagattgctggaatcgaacaaagtattcctggcaaaatctattttgaaactttgcaggatttcctctacttcacacaccgggtcagagagtatgacaaaattttgcaagccagggaagtcattctgcccctttatccgtctttaactgattgggtaaatagtaattcagcaatactactagataactcggagcattggaatgatctaatgaaggtgtgtaagtacttcaccacctttcccccaccccatccttattatatccgtgaactaccgattgaagtgcatactaagttcatagaacagaacgcaactttattaaagaatttattggaccagttgcttccgaccaaatggctgaacaaggatgaaaaggatttcagctcacggtattttttaaagaaaattaaggtatacacccaaatcagaatattggatgaggatctaaagccctaccttggctatgatgaatgcgcactgtctctggatgatgctgtttggctcaaatggacgcctgaaaaagtctttattattgagaatcagacctgctttctcacttttccgaaggtgaaaaattcggtagccattttcggggaaggctttaaaagcaggtga

SEQ ID NO: 2302 - protein, 228 aa, Unknown
  Obtained from environmental sample
  misc_feature (1)..(228): Xaa is any amino acid
MSELCMYEHSKAAKGKGYTVDWVKKKIAGIEQSIPGKIYFETLQDFLYFTHRVREYDKILQAREVILPLYPSLTDWVNSNSAILLDNSEHWNDLMKVCKYFTTFPPPHPYYIRELPIEVHTKFIEQNATLLKNLLDQLLPTKWLNKDEKDFSSRYFLKKIKVYTQIRILDEDLKPYLGYDECALSLDDAVWLKWTPEKVFIIENQTCFLTFPKVKNSVAIFGEGFKSR

SEQ ID NO: 2303 - DNA, 756 bp, Unknown
  Obtained from environmental sample
  misc_feature (1)..(756): n is a, c, g, or t
ttgccccgcgggcattttataaaacaaatttctgcacttggattagctggttcactaccgaaattgttacagactgcttccgcaccaaaaaatgaaacaaagaaaccagggcaaactaatactattttatttcagggcgactctataacagacggcaaccgcagccgcaattcagattggaatcatgtaatggggcatggttaccaatatatcattgcttccaaactttggtatgaattgccagggaaaaaactgaaaatttttaaccgcggtatcagcggtaatacagttatggatttaaccgcacgatggaaagaagatactttgttattaaaaccggatttgctcagtatacttatcggggttaatgatacagaagccttcataagaggaaatgaaaatttatctgtagaacactatcaaaagacctacgatgaattacttcagaacacaaggcaccaattacccggaattcaattagtgttgtgtgagccctttatacttcctgtaggaagggtgaaggaaaacatagataattacgaaaaagaaataaaactacgccagcaggcagtgaaagatcttgctggtaaatacaaagctattttcgttcctttccaggccgccttcaacaaggctttacaaaaagctccccccgaatattggatatgggatggcatacatccaatgcccgcggggcaccaactgatggcaatagaatggttgaaacaggtaaccgaatccggtttttttaagtaa

SEQ ID NO: 2304 - protein, 251 aa, Unknown
  Obtained from environmental sample
  DOMAIN (42)...(240): GDSL-like Lipase/Acylhydrolase
  misc_feature (1)..(251): Xaa is any amino acid
MPRGHFIKQISALGLAGSLPKLLQTASAPKNETKKPGQTNTILFQGDSITDGNRSRNSDWNHVMGHGYQYIIASKLWYELPGKKLKIFNRGISGNTVMDLTARWKEDTLLLKPDLLSILIGVNDTEAFIRGNENLSVEHYQKTYDELLQNTRHQLPGIQLVLCEPFILPVGRVKENIDNYEKEIKLRQQAVKDLAGKYKAIFVPFQAAFNKALQKAPPEYWIWDGIHPMPAGHQLMAIEWLKQVTESGFFK

SEQ ID NO: 2305 - DNA, 600 bp, Unknown
  Obtained from environmental sample
  misc_feature (1)..(600): n is a, c, g, or t
atgaaacgatggctcaatagtttgaagcatacaaacattggaaaatcaatactgtttttctttgttgggatattcagctatccaggattagctatcattaataaattaaaaatatcaggtacagaaaatttaaaaggtcttcccaggaaaaatgttttatttgtcagtaatcaccagacttattttgctgatgtaattacgatgctgcatattttttgcgcggttaagtggggcaaacgtaacaggcttgggtttccctggtaccttttaaatccatttacccgggtgtattttgtagctgcagaagaaaccatgaaaaaggatctaatcagccgcttattcaggatggcaggatgtattacagtaacacgggcatggaaaaatgaaggcaatgaagtgcaaagagggcttagcccgggaagtatcaggaccattacacaggcacttaatgataactgggtaataactttcccgcagggaacaactacaccatttgctccgggaagaaaaggtgctgcgttcattataaaacaaaataaaccgatcgttataccggttgttatcgatggattttcaagggcctttgataagaaggtttaa

SEQ ID NO: 2306 - protein, 199 aa, Unknown
  Obtained from environmental sample
  DOMAIN (35)...(189): Acyltransferase
  misc_feature (1)..(199): Xaa is any amino acid
MKRWLNSLKHTNIGKSILFFFVGIFSYPGLAIINKLKISGTENLKGLPRKNVLFVSNHQTYFADVITMLHIFCAVKWGKRNRLGFPWYLLNPFTRVYFVAAEETMKKDLISRLFRMAGCITVTRAWKNEGNEVQRGLSPGSIRTITQALNDNWVITFPQGTTTPFAPGRKGAAFIIKQNKPIVIPVVIDGFSRAFDKKV

SEQ ID NO: 2307 - DNA, 585 bp, Unknown
  Obtained from environmental sample
  misc_feature (1)..(585): n is a, c, g, or t
ttgagaaccaagtttgtcataataaaccttttactggtcattgcctgtaagggccaggaacctgcttataactatcaattctttgttaacagccgcatggaaggcaattatttttatagcaaggtggtttccgaagagccatcttctgtaaaacaaatcaatggtagattacccgttaataataacaggttttttacgcctggcaattcactggaactggaatataaaaacggccgtcaggggcattggaaagcttttatatataagccacaattcagggggcaggatcattttaaagatgtaaaatttctttcaatacacttgtttgctgcccaaaacattcccaataatgatcttccttatatacaacttttgttacaggacagcagcctcacaaaaaaagtatccttcanactacatacaccaaacaaatgggagttaataaacatacctgttgatgaatttgggaaaggagccattactgatccccggaaaattataggaattgttttttcaaaacagggaaaccaccgaaacaccaatcatctctttttggatgatattgaattcacaaccaggttataa

SEQ ID NO: 2308 - protein, 194 aa, Unknown
  Obtained from environmental sample
  misc_feature (1)..(194): Xaa is any amino acid
MRTKFVIINLLLVIACKGQEPAYNYQFFVNSRMEGNYFYSKVVSEEPSSVKQINGRLPVNNNRFFTPGNSLELEYKNGRQGHWKAFIYKPQFRGQDHFKDVKFLSIHLFAAQNIPNNDLPYIQLLLQDSSLTKKVSFXLHTPNKWELINIPVDEFGKGAITDPRKIIGIVFSKQGNHRNTNHLFLDDIEFTTRL

SEQ ID NO: 2309 - DNA, 576 bp, Unknown
  Obtained from environmental sample
  misc_feature (1)..(576): n is a, c, g, or t
atgccccgaggaggttatcatattacagatcaatacggaatttatttcctgactttcacggttgtaggatgggcagatatttttacccgcactcaatgccggcaaatcattattgactcttttaatttttgcaaaaagcataaaggcttgatactatacggttatgtaattatgtccaaccatatccacctcattgcacagacaaaggaatctagtcagggaatgtctgtttttatacgggatttcaaaagacatacatcaaaagaattgataaaatggtttcttaccagcagacaagagagcagaaaagaatgggtgacagctatatttaatgcttatggcattgagaattcaaacaacaagcaatttcaggtctggagtagggataatagacctatgcaggtttttacaccgaagttcgcaaaacaaaagctcgattacattcacatgaatccagttaaagctggaattgtagataaacctgaagactttatatatagcagcgccaggaattattgcaatcgcaaggactttattctggaagttgagttattagatttgatctatacattatga

SEQ ID NO: 2310 - protein, 191 aa, Unknown
  Obtained from environmental sample
  misc_feature (1)..(191): Xaa is any amino acid
MPRGGYHITDQYGIYFLTFTVVGWADIFTRTQCRQIIIDSFNFCKKHKGLILYGYVIMSNHIHLIAQTKESSQGMSVFIRDFKRHTSKELIKWFLTSRQESRKEWVTAIFNAYGIENSNNKQFQVWSRDNRPMQVFTPKFAKQKLDYIHMNPVKAGIVDKPEDFIYSSARNYCNRKDFILEVELLDLIYTL

SEQ ID NO: 2311 - DNA, 576 bp, Unknown; identical to SEQ ID NO: 2309
  Obtained from environmental sample
  misc_feature (1)..(576): n is a, c, g, or t

SEQ ID NO: 2312 - protein, 191 aa, Unknown; identical to SEQ ID NO: 2310
  Obtained from environmental sample
  misc_feature (1)..(191): Xaa is any amino acid

SEQ ID NO: 2313 - DNA, 726 bp, Unknown
  Obtained from environmental sample
  misc_feature (1)..(726): n is a, c, g, or t
atggtcagattgaaatgccatgagcgacttcaggaatttacctttatatcgagtcatgatctgcaggaaccgctgcgtaaaattcaaatttttaccaatttcctttctaccccggccgctcaactcaacgagtatgctaaaaagtattcggataagatcaattcctctgccttcagaatgtctgcgttgataaaagaccttcttagcttctcaattctaagggatgataagatagaaatggaaaaagttgatctgaatgccgttatgagaaatattataaatgattttgaagttctcattgaagagagaaaggcgactgtcaacgtttcgttgcttcccgtcgtttgtggtgagccggttcagatgaatcagctcttctacaacctgatcagcaatgcgctaaaatttagcagggaaaatccggtcattaatatcagcgcaggcgaagcgagcgctaatgattttttaatttacccggaattagtgaaagacacgtactacgttttcatcagtgtaaaggataacggtattggatttgatcaaaaataccaggataagatcttcacactttttcaacggcttaacgataaaaaagacgtgcctggcacgggagtagggttagcgatctgcaaaaaaattgttgacaatcacaaaggattcatttttgtaaatagtacaaaaaacataggaactaccttcgaagtgtttcttccgggcaaagtataa

SEQ ID NO: 2314 - protein, 241 aa, Unknown
  Obtained from environmental sample
  DOMAIN (9)...(76): His Kinase A (phosphoacceptor) domain
  misc_feature (1)..(241): Xaa is any amino acid
MVRLKCHERLQEFTFISSHDLQEPLRKIQIFTNFLSTPAAQLNEYAKKYSDKINSSAFRMSALIKDLLSFSILRDDKIEMEKVDLNAVMRNIINDFEVLIEERKATVNVSLLPVVCGEPVQMNQLFYNLISNALKFSRENPVINISAGEASANDFLIYPELVKDTYYVFISVKDNGIGFDQKYQDKIFTLFQRLNDKKDVPGTGVGLAICKKIVDNHKGFIFVNSTKNIGTTFEVFLPGKV

SEQ ID NO: 2315 - DNA, 336 bp, Unknown
  Obtained from environmental sample
  misc_feature (1)..(336): n is a, c, g, or t
ttgcgaggagatgccgggaattttcatgatgcagtgaagctgtgctttgaaataacttcgtaccctggagggtgcgaaatgttattgattctgagacaaaacaagacataccccgattacgcatttatcgacatcaatatgcccaaaatgaacggctatgaatgtgctcaggaaatacgatcaaatccggcgtacgacagcataaaaataataatgtacagtactgcctntaatccgcaggatctgaagcaattctcaaagcttggttttagttttttgaccaagcacgacacgttccgtgaattggtgcaatccattaaaaaactgattacgtga

SEQ ID NO: 2316 - protein, 111 aa, Unknown
  Obtained from environmental sample
  DOMAIN (5)...(111): Response regulator receiver domain
  misc_feature (1)..(111): Xaa is any amino acid
MRGDAGNFHDAVKLCFEITSYPGGCEMLLILRQNKTYPDYAFIDINMPKMNGYECAQEIRSNPAYDSIKIIMYSTAXNPQDLKQFSKLGFSFLTKHDTFRELVQSIKKLIT

SEQ ID NO: 2317 - DNA, 342 bp, Unknown
  Obtained from environmental sample
  misc_feature (1)..(342): n is a, c, g, or t
atgaatccaatccccgataaatcgtgggtgattggcgagtacctcgaaaactggtacgacatgaaggatggcgaggcatatatcatcctcacgcaggaagagggtctcgtattcaagatagttcagaaccaactgaagaaaaagaaaaatgtgatcctcaaatcactgaattcactctatgaaccctacgaactgcatgtcggcgaaatcagagaagtatggaagttctgtaattacctgagcaacgaattgccggataatacatttacaaaagatgaactgctgacgaagattttacacctcgaaaaagaagtgagaggcattagagagtctatttcataa

SEQ ID NO: 2318 - protein, 113 aa, Unknown
  Obtained from environmental sample
  misc_feature (1)..(113): Xaa is any amino acid
MNPIPDKSWVIGEYLENWYDMKDGEAYIILTQEEGLVFKIVQNQLKKKKNVILKSLNSLYEPYELHVGEIREVWKFCNYLSNELPDNTFTKDELLTKILHLEKEVRGIRESIS

SEQ ID NO: 2319 - DNA, 765 bp, Unknown
  Obtained from environmental sample
  misc_feature (1)..(765): n is a, c, g, or t
atgaaaaaactgaacaatgagctcaagcaaaaaaatcataagctcgaattgtacaataaagaactcgactcatttacctacattgccagccatgatttaaaggaaccgatcagaaaaatccttacctatagcgagcagatggaaatggaagattatggaaatttatccgacttgaacagaaagcaattaagccgcattaagcagtccgcccagcgcatgcaaaatcttttgaacgatcttttattatactcacatgtaaacatcagtgataaaacatttgaagaggtcgatctcaacaaaatcgttgacgatgtaatcgataatctcagggaagagataaccgaaacgcatacggagataaaagcagacaagcttcctgtgatcaaaggcatgccttttcagatcaagcagttatttgaaaaccttatcagcaattctataaaatacaaacaagatcatataccgccggcaattcttatagggggatacgtaatgaatgaaaaagatattaccgaaaaattttataaggaaagcgatcagtattacaagctgttttttcaagacaatggttccggttttgaacagatgtacgaagaaaaaatattcaagctttttcaacgtctccattctaaaacaaataaacctggaaccgggattggcctgacgatttgcaaaaagatcgtggataatcacaatggctttatcaaagcaaccagcgaaataaataaaggaaccaggtttgaaatttatctgccgataaattaa

SEQ ID NO: 2320 - protein, 254 aa, Unknown
  Obtained from environmental sample
  DOMAIN (21)...(89): His Kinase A (phosphoacceptor) domain
  misc_feature (1)..(254): Xaa is any amino acid
MKKLNNELKQKNHKLELYNKELDSFTYIASHDLKEPIRKILTYSEQMEMEDYGNLSDLNRKQLSRIKQSAQRMQNLLNDLLLYSHVNISDKTFEEVDLNKIVDDVIDNLREEITETHTEIKADKLPVIKGMPFQIKQLFENLISNSIKYKQDHIPPAILIGGYVMNEKDITEKFYKESDQYYKLFFQDNGSGFEQMYEEKIFKLFQRLHSKTNKPGTGIGLTICKKIVDNHNGFIKATSEINKGTRFEIYLPIN

SEQ ID NO: 2321 - DNA, 336 bp, Unknown
  Obtained from environmental sample
  misc_feature (1)..(336): n is a, c, g, or t
atgttccgtaaaactattctgggtggtcttgccataattgccgcattgaccatcaacgctcaaactatcaaaacgccacctgtaagcagtactcaaaacatcaaacaagacctaggcattggctcagtagagctttcctactcccgtcctaacgttaaggcaaggaaaatatttggagaccttgttccattaggacaggtatggcgtaccggtgctaaccaagccacgacattaacttttagcgacgaagtattgattggtggtacaaaagttccggcaggcaaatatggtttgttaagcataccgataaaaacgagggacgtaaaatcaaaataa

SEQ ID NO: 2322 - protein, 111 aa, Unknown
  Obtained from environmental sample
  SIGNAL (1)...(20)
  misc_feature (1)..(111): Xaa is any amino acid
MFRKTILGGLAIIAALTINAQTIKTPPVSSTQNIKQDLGIGSVELSYSRPNVKARKIFGDLVPLGQVWRTGANQATTLTFSDEVLIGGTKVPAGKYGLLSIPIKTRDVKSK

SEQ ID NO: 2323 - DNA, 369 bp, Unknown
  Obtained from environmental sample
  misc_feature (1)..(369): n is a, c, g, or t
gtgatagttatgcaacgcagcaaatcgtctcctataccggaagttgtattaagtaatacaaagcgggacagcagttatcgcaaacctcgtataagttttgaagaagcagaacctgctaacggcatcgcatactatgatgagtatgtagctaataacctccaaatgcccggtgaagaattacaaaaaaatagctccggtgaggtaaaactttcttttgatgtaaatgatgcagggcaggcagtgaatatcaaaatagaaaaatcactatgtaccgaatgtgataaagaagccattcgtgttttgcaacaaggtcctaaatggctaaagaaaaagaaagacaaaaagggaaagcttagcatcaggttttga

SEQ ID NO: 2324 - protein, 122 aa, Unknown
  Obtained from environmental sample
  DOMAIN (52)...(86): Gram-negative bacterial tonB protein
  misc_feature (1)..(122): Xaa is any amino acid
MIVMQRSKSSPIPEVVLSNTKRDSSYRKPRISFEEAEPANGIAYYDEYVANNLQMPGEELQKNSSGEVKLSFDVNDAGQAVNIKIEKSLCTECDKEAIRVLQQGPKWLKKKKDKKGKLSIRF

SEQ ID NO: 2325 - DNA, 711 bp, Unknown
  Obtained from environmental sample
  misc_feature (1)..(711): n is a, c, g, or t
ttgttgttttgtaaagtaaaagcggtaagtaagcgcttagctttgttatcgattcaaaaagaatttaaaatgcctgagaagaatgtcgtggatttgttgagaaagaattcgaacgaatttcatcctgtagttccatttgaaagaatggataaactattgcttttagattttacggaaaagaataaggaattaaacgccgaaacattagagaatactaacctttttataaaatatattaattcaaaattggaagctgcaggagcgaggtatgggattggtgggtatggtgaacatcggacaatttattccagaagcaagatttttggcccatccccaacaacgactccaatagcggaagatggtgctaaagccccttcccggtgggaaggggatgaagagtccaaatcattcgtagaagaagacactattgggtatcgttatgccgatagatcactttattctttattgaaagaattctcattaaaacatagattatatccaactcanactgaaaatatattatgggagcttcttaaatcaaaacaattagaaggatacaaattcagaaggcaacatatcatcgatagatttattgctgatttttgttgtctgaaacaaaagctggtgattgaaattgatggtttaattcatcagctacccgaaacaaagcagcgaccaggaaggactgatgttctgatcattaggatttga

SEQ ID NO: 2326 - protein, 236 aa, Unknown
  Obtained from environmental sample
  DOMAIN (154)...(235): Protein of unknown function (DUF559)
  misc_feature (1)..(236): Xaa is any amino acid
MLFCKVKAVSKRLALLSIQKEFKMPEKNVVDLLRKNSNEFHPVVPFERMDKLLLLDFTEKNKELNAETLENTNLFIKYINSKLEAAGARYGIGGYGEHRTIYSRSKIFGPSPTTTPIAEDGAKAPSRWEGDEESKSFVEEDTIGYRYADRSLYSLLKEFSLKHRLYPTXTENILWELLKSKQLEGYKFRRQHIIDRFIADFCCLKQKLVIEIDGLIHQLPETKQRPGRTDVLIIRI

SEQ ID NO: 2327 - DNA, 858 bp, Unknown
  Obtained from environmental sample
  misc_feature (1)..(858): n is a, c, g, or t
gtgcagctatccatttttcacttttcacttttccttaagtgtatggataaaaatgtacacattttgaacaaagaactaattatcagaaccagttcagatgccgtagattttgccttattaaaagatggaaaactaattgaattacacaaagaagaaggtggcgaggacaaaggcggatttcaggttggcgatatctttatcgctaaaatcagaaaaccggtcccgggacttaacgctgcgtttgtaaacgtaggcttcgagaaagatgcattcctgcactatcacgatttaggccctaacctctcttcaatgatgaaattcataaaacttgtaagcgcaggtaaaataaaagatttctccctaaaaaactttccttttgagccggaaataaacaaggatggtgccatcagcgacgtgctgagcgccaatcagtctattctcgttcaggtagttaaggagccaatatcgaccaaaggcccaagaataagctcagagctttccctggccggaagatatgtggttttagttcccttctcagacagggtttcggtttcacagaaaatcgaatccaaagaagagaaagaccgactaaaacgactggttcaatctatcaagcctaaaggatttggtgttattgttcgcacagtagcagaaggcaaaaaagtggccgaactggacaaagacctgcagaacctgctcgacaaatggtcggcaacctgcaaaagaataccaaccgcacatcatccgtcaagaatcttgggcgaagtaaacaaagcttcttccatcttaagagacgtattcaatgacaccttcacaggaatttatgtcgatgatgaggatttgtattatcaaacntaa

SEQ ID NO: 2328 - protein, 285 aa, Unknown
  Obtained from environmental sample
  misc_feature (1)..(285): Xaa is any amino acid
MQLSIFHFSLFLKCMDKNVHILNKELIIRTSSDAVDFALLKDGKLIELHKEEGGEDKGGFQVGDIFIAKIRKPVPGLNAAFVNVGFEKDAFLHYHDLGPNLSSMMKFIKLVSAGKIKDFSLKNFPFEPEINKDGAISDVLSANQSILVQVVKEPISTKGPRISSELSLAGRYVVLVPFSDRVSVSQKIESKEEKDRLKRLVQSIKPKGFGVIVRTVAEGKKVAELDKDLQNLLDKWSATCKRIPTAHHPSRILGEVNKASSILRDVFNDTFTGIYVDDEDLYYQT

SEQ ID NO: 2329 - DNA, 720 bp, Unknown
  Obtained from environmental sample
  misc_feature (1)..(720): n is a, c, g, or t
ttgattgtatcaataatgcatgtaaataatgaaattggaacaatccaagatatagaagaaataggaaaaatttgtagattaaaagatgtttatttccacactgatgccgtccaaagttttggaaaattaaagattgatgtaaaaaaaatgaatattgatctaatgtcagtttcaggccataaaataaattctccaaaaggcattggatttctttataaaagaagtgaggtaaacattaaaccaataaattatgggggcggacaggaaaaaaatctaagaagtggtactgaaaatgcccccgggattattggaattgcaaaggcattggacattaaaagaaatcaaaaacaaataaaaattcaaagagataaattaatgaaagaactttcaaaaatacccggttccagaattaatgggtctattgaaaaaagaatatacaataatatcaacatatctttttatggaattgaaggagaaagtttagttttaatgttaagtaaagagggggtttgttgttcaacaggatctgcatgtagttctcataaacttcaggaaagccatgttcttaaagcaatcaatgttcctccattatatattcacggcagtttaagaataacaatagataaaatatcagatcaagaaataaaatttatttcaaaaaaaataaaagaaaaagtagaaaaacttagagaaatgagtccgtttaagttaaaggagtaa

SEQ ID NO: 2330 - protein, 239 aa, Unknown
  Obtained from environmental sample
  DOMAIN (1)...(218): Aminotransferase class-V
  misc_feature (1)..(239): Xaa is any amino acid
MIVSIMHVNNEIGTIQDIEEIGKICRLKDVYFHTDAVQSFGKLKIDVKKMNIDLMSVSGHKINSPKGIGFLYKRSEVNIKPINYGGGQEKNLRSGTENAPGIIGIAKALDIKRNQKQIKIQRDKLMKELSKIPGSRINGSIEKRIYNNINISFYGIEGESLVLMLSKEGVCCSTGSACSSHKLQESHVLKAINVPPLYIHGSLRITIDKISDQEIKFISKKIKEKVEKLREMSPFKLKE

SEQ ID NO: 2331 - DNA, 444 bp, Unknown
  Obtained from environmental sample
  misc_feature (1)..(444): n is a, c, g, or t
ttgtttattcagacgaatagaaaaactttaaaaactttcttgtttttaataaagaaaatgaggtccaaaactaaattttttattactcttataactgccattttactcttagttttttttctttggacgacaaagatcctttcaatttttactggaaatgctttaaatagtaatgaaatacaaagtctagcaaaatgtttaacagaaaaaggggcggtcatgtatggtgcatattggtgtcctcattgccaaaatcaaaaatccctatttggagagaatgtaaagcttctaaattatgtagagtgtgatccttctggagaaaatcccccaccccagaaatgtgaagaagcaggcatacaaggatatcctacttggattattaataatcagaagtatgaaggagaattaagtttaaataagctaanatcactttcaggatgttaa

SEQ ID NO: 2332 - protein, 147 aa, Unknown
  Obtained from environmental sample
  misc_feature (1)..(147): Xaa is any amino acid
MFIQTNRKTLKTFLFLIKKMRSKTKFFITLITAILLLVFFLWTTKILSIFTGNALNSNEIQSLAKCLTEKGAVMYGAYWCPHCQNQKSLFGENVKLLNYVECDPSGENPPPQKCEEAGIQGYPTWIINNQKYEGELSLNKLXSLSGC

SEQ ID NO: 2333 - DNA, 303 bp, Unknown
  Obtained from environmental sample
  misc_feature (1)..(303): n is a, c, g, or t
gtgggaaagcaggtaaaacaaattcttccccgtttatgggaatcagccctgcaggcggtaagtagcatattaaaaacccggtttaattatgaccccggcccttaccagggatttacccaggaccaaaaaaattataatggctcgctaaataagactggaacatcagcacagtccataaattatcatttacgtataatgggttggatgcaaaaaaagataaacctgctcacccaagtgctatcgggcggcgcggaccggactatactactttacagttccaaaattcaggctatgaaattgtaa

SEQ ID NO: 2334 - protein, 100 aa, Unknown
  Obtained from environmental sample
  misc_feature (1)..(100): Xaa is any amino acid
MGKQVKQILPRLWESALQAVSSILKTRFNYDPGPYQGFTQDQKNYNGSLNKTGTSAQSINYHLRIMGWMQKKINLLTQVLSGGADRTILLYSSKIQAMKL

SEQ ID NO: 2335 - DNA, 471 bp, Unknown
  Obtained from environmental sample
  misc_feature (1)..(471): n is a, c, g, or t
atgagccccgtgataattttatttctaagggacaacatcgtaaaagtgaactacataaaggtgccggtccgcgcaccgggactgccaaagatcaggaagctgctgagatcaacaagtcccaaggataaagaacagttgctattgctttgcgctcagaacgctgagaattttttcatgaatgacagcacctggttgtttcttgacgatatcaaaaaagaaattcctgcacttagggaacagtctgattattcggtttccgcgggaagggtcgtggagattgaagatgaacaatattactaccatcttaaagtaaaggacgtgaaagtgaagaacgcatattctcccatcaactttgaaaaacagaatatcaggaaattcattctcaacaacaggaaaacccagttgattaaccagtataagcaggaattgctggaaaaggcaaaagcggaaaaaacctttacaattttatag

SEQ ID NO: 2336 - protein, 156 aa, Unknown
  Obtained from environmental sample
  misc_feature (1)..(156): Xaa is any amino acid
MSPVIILFLRDNIVKVNYIKVPVRAPGLPKIRKLLRSTSPKDKEQLLLLCAQNAENFFMNDSTWLFLDDIKKEIPALREQSDYSVSAGRVVEIEDEQYYYHLKVKDVKVKNAYSPINFEKQNIRKFILNNRKTQLINQYKQELLEKAKAEKTFTIL

SEQ ID NO: 2337 - DNA, 477 bp, Unknown
  Obtained from environmental sample
  misc_feature (1)..(477): n is a, c, g, or t
atggtaaaaccaccatgggctttaattatggaaagattatcgctaccagacttacctgataaactgacaatgaagaatacgaggtttatatatattggtttgattctgctatgcttgttacagcaatggtcgttttctcaaagcggttataaaaaatactggaaggatggtaaattacaatggacagattttaaagtaaagcaaggcaccggtaacaggtcggcaataattcaatacacatttggatatgctgcaggcaaaacaaaggtaaatgatgttattgtaaggagaatgaatgctgattgctatgctgacaggcaattgtcatgggtagatccgaacagcatgaatgatgatcaactcttatacctgcaggtaatattcgacattgcagagttnatcaggagaaagatgcagctcgatctaaatngaacatcttcggttaattctgtacaggaaaaattcagcgggcagtaa

SEQ ID NO: 2338 - protein, 158 aa, Unknown
  Obtained from environmental sample
  misc_feature (1)..(158): Xaa is any amino acid
MVKPPWALIMERLSLPDLPDKLTMKNTRFIYIGLILLCLLQQWSFSQSGYKKYWKDGKLQWTDFKVKQGTGNRSAIIQYTFGYAAGKTKVNDVIVRRMNADCYADRQLSWVDPNSMNDDQLLYLQVIFDIAEXIRRKMQLDLNXTSSVNSVQEKFSGQ

SEQ ID NO: 2339 - DNA, 468 bp, Unknown
  Obtained from environmental sample
  misc_feature (1)..(468): n is a, c, g, or t
atgaaaaaaatatttctttctttttgccttcttagcagttttataggctttgctcaaaaaacaatctacgatgccaatgctgttttaagagaaggcaaaggatatgaggctattgaagtttccgatggtatagatctgtttattagttatggtgaagaagccattgcagtaagtgcttcggaaactaagtatcgcgacaaaataaaaacggtggtgcaaaacggactgctgaaaatatcatatgatgaaaaaggaatttcctggaatacgaaaagaaatttaaaggtctacgtgtcattcaaaaaattaactgccctggcggtgtcaggaggttctgatattaacgttgatggcagcatcaaaggagatcagcttacaattgatatttcaggcggctgcgattttaaagggagggtggatgtaaataaattgtccattgatcatccggcacgcccgcgatggcgataa

SEQ ID NO: 2340 - protein, 155 aa, Unknown
  Obtained from environmental sample
  SIGNAL (1)...(18)
  misc_feature (1)..(155): Xaa is any amino acid
MKKIFLSFCLLSSFIGFAQKTIYDANAVLREGKGYEAIEVSDGIDLFISYGEEAIAVSASETKYRDKIKTVVQNGLLKISYDEKGISWNTKRNLKVYVSFKKLTALAVSGGSDINVDGSIKGDQLTIDISGGCDFKGRVDVNKLSIDHPARPRWR

SEQ ID NO: 2341 - DNA, 417 bp, Unknown
  Obtained from environmental sample
  misc_feature (1)..(417): n is a, c, g, or t
ttggcaacagatggtgatgtttggagaatattgcgaaagggaactttggttgatttaatcaaactcagtttcttttattttcagaaagacaaagatgaaaagcacttgattgacatattcaatcattcaatgaaagtgaagctactttcacgaataaaagcgattgtagtgaaaggaagcttagatgaagtttcaatgaaattcaacagagaaccagaatatattctgaaacagtatgacactatctacagcgaactgcaaccgacttttaaaaattacacttcaacaaatctttacgacttgaatgggaaaatgcaatacctcaatgtgattaacgaactggaaatagattcttatgctgaggatatttttgatgaaataatcggaatcactttcaacatacttcaaggcgagtaa

SEQ ID NO: 2342 - protein, 138 aa, Unknown
  Obtained from environmental sample
  misc_feature (1)..(138): Xaa is any amino acid
MATDGDVWRILRKGTLVDLIKLSFFYFQKDKDEKHLIDIFNHSMKVKLLSRIKAIVVKGSLDEVSMKFNREPEYILKQYDTIYSELQPTFKNYTSTNLYDLNGKMQYLNVINELEIDSYAEDIFDEIIGITFNILQGE

SEQ ID NO: 2343 - DNA, 597 bp, Unknown
  Obtained from environmental sample
  misc_feature (1)..(597): n is a, c, g, or t
atggcagcaggaaaattatttgatatgatatattatactattacaaacggaaaaattgttcgacagcttcagaacaaaacagacacttctgttgaaagaattaataaaaacggcaggcttgttcatgaggaattttatagctatctggatggggtattaattgatatagctattaaggaacatgaggagtatggcaaattttggtctgttacattaaaggatgaagaaggagcagtgcaaaaccttcaattcagttattcatcaggttattctatgggttttttaaaggcgttgcccaatatagatttattacaaaaaattaaaattattcctcacgccaaaaaagaaaacgacaaaaccaaaacaacaatattcatcaatcaatttgataaagcagcaaaatggcattttaccaaagaaaatcctaatggcctacctccattgaagaaaataaaaattaaaggaaaagagacctgggatgatactgaggcaatggaatttttggagaaaatggtatttgaaaaaatacaggcacagttatcaactgaaaataaggttccagctaaagttaatacaggcgatgatttgccattttaa

SEQ ID NO: 2344 - protein, 198 aa, Unknown
  Obtained from environmental sample
  misc_feature (1)..(198): Xaa is any amino acid
MAAGKLFDMIYYTITNGKIVRQLQNKTDTSVERINKNGRLVHEEFYSYLDGVLIDIAIKEHEEYGKFWSVTLKDEEGAVQNLQFSYSSGYSMGFLKALPNIDLLQKIKIIPHAKKENDKTKTTIFINQFDKAAKWHFTKENPNGLPPLKKIKIKGKETWDDTEAMEFLEKMVFEKIQAQLSTENKVPAKVNTGDDLPF

SEQ ID NO: 2345 - DNA, 372 bp, Unknown
  Obtained from environmental sample
  misc_feature (1)..(372): n is a, c, g, or t
ttgttttttaatttcttaaaaaataaaaaggatgtgtctggagtcactgccaaagataaaagcataaaaaatcgagttgaatataaccggcaggtaattcttacaaaacaatctgcagatggaattattacatattcaaagacatggcaccctcacgaaggaatacttattcttcaaggtaaaagcaagaagagtggtgaaatacgtattgacggattagtagttcctccttttgcttcaagtgggccttattactcgggtttcccaacaaacgagttgcccatggacctttcttatataggtactgcccattcccatccaggtggttcaaatagaccatcattacaagacttgaacattttttcggtgtag

SEQ ID NO: 2346 - protein, 123 aa, Unknown
  Obtained from environmental sample
  misc_feature (1)..(123): Xaa is any amino acid
MFFNFLKNKKDVSGVTAKDKSIKNRVEYNRQVILTKQSADGIITYSKTWHPHEGILILQGKSKKSGEIRIDGLVVPPFASSGPYYSGFPTNELPMDLSYIGTAHSHPGGSNRPSLQDLNIFSV

SEQ ID NO: 2347 - DNA, 441 bp, Unknown
  Obtained from environmental sample
  misc_feature (1)..(441): n is a, c, g, or t
gtgttcaagtcagttataccgggctatgttgagagcgctgacgtgtttaagccaaaagactttgtaaccattactaccccattcagggcaaagggtaatgaagccaatattgtttttgttatcaatggacaatgcgttgttgatgattttaccctacgcatgcgaaatgcttattttgtagccgtcacacgttcacgtggatggtgctacattagtggatatggaacgggcatggaaaagctagcagtagaaattgagtcaataaaaaaggacttccctctgtttcgtttcaagtgtccagatccagctaatattcagcatggaaaatcatttctcaataaatccgataaagaattggacgaattccaaaagatattggaactcattgataaaaatccggaattcaagcatttgatagcagaccgtataaaagaaaattga

SEQ ID NO: 2348 - protein, 146 aa, Unknown
  Obtained from environmental sample
  misc_feature (1)..(146): Xaa is any amino acid
MFKSVIPGYVESADVFKPKDFVTITTPFRAKGNEANIVFVINGQCVVDDFTLRMRNAYFVAVTRSRGWCYISGYGTGMEKLAVEIESIKKDFPLFRFKCPDPANIQHGKSFLNKSDKELDEFQKILELIDKNPEFKHLIADRIKEN

SEQ ID NO: 2349 - DNA, 474 bp, Unknown
  Obtained from environmental sample
  misc_feature (1)..(474): n is a, c, g, or t
atgcctccttctttgaatattgacaaattagatctccagatcatacagtacctgatgcaggatgcgaatatttcttatgcagatcttggtaaaaaactatttgtttctgcaggtactgtgcatgtccgcattaaaaaacttctggacagtggtattgtaagtggaacccgcatgcacgtaaatttaaaaaagctcggatatgatgtgattgccttcattggtatttttttagagaaaagttctttgtatgatgtagtagcgaaagaccttagaaaaataccagagatcgttcgtatgaattacactacaggtaactatagcatctttgctgaaattgtttgcagggacattgcccaactaagaagagtgttgcacgatgaactgcaaaaaataaaaggtattgagcgtacggaaacatttatttccctggaagaaagtttgcatcggaacgtgcaggtaacacccaatgaataa

SEQ ID NO: 2350 - protein, 157 aa, Unknown
  Obtained from environmental sample
  DOMAIN (31)...(132): AsnC family
  misc_feature (1)..(157): Xaa is any amino acid
MPPSLNIDKLDLQIIQYLMQDANISYADLGKKLFVSAGTVHVRIKKLLDSGIVSGTRMHVNLKKLGYDVIAFIGIFLEKSSLYDVVAKDLRKIPEIVRMNYTTGNYSIFAEIVCRDIAQLRRVLHDELQKIKGIERTETFISLEESLHRNVQVTPNE

SEQ ID NO: 2351 - DNA, 561 bp, Unknown
  Obtained from environmental sample
  misc_feature (1)..(561): n is a, c, g, or t
atggggaagattatcttctctccccaaccaatttcacatacagtgatggtagtacaatcgaatggaaagaacgagtgcgtttatttgattggtggcagaaagaaaaatgtaaatagcccaagcgatctttattcttctgcatttcaatttgatttaaaaacgaaagaatggaaagaaaaaagatccctgccttatacttcgtctgcaggcactggcgttgccgttggaacacattccattttattatttggtggcgataacggcgcaacttttcacaaaaccgaagaactcatttttgctatcaacaaggaaaaggacgaaacaagaaggaaacaacttgatgcagaaaaaataaaactgcaatcaacgcatcccgggttttgcaaacaagtgctttcgtacgatacaagaaaagatgaatggcaagctgctggctgtatttcgtatgattcgccggttacaacaacagcagttaaatggaacaataaaatcattatcccgggtggagaaataaaagcaggagtaagaacgccgcaaattctttcagctaaaattttttga

SEQ ID NO: 2352 - protein, 186 aa, Unknown
  Obtained from environmental sample
  misc_feature (1)..(186): Xaa is any amino acid
MGKIIFSPQPISHTVMVVQSNGKNECVYLIGGRKKNVNSPSDLYSSAFQFDLKTKEWKEKRSLPYTSSAGTGVAVGTHSILLFGGDNGATFHKTEELIFAINKEKDETRRKQLDAEKIKLQSTHPGFCKQVLSYDTRKDEWQAAGCISYDSPVTTTAVKWNNKIIIPGGEIKAGVRTPQILSAKIF

SEQ ID NO: 2353 - DNA, 507 bp, Unknown
  Obtained from environmental sample
  misc_feature (1)..(507): n is a, c, g, or t
atgaaagttaaaccactcaattttttatcccgaaattctattttatcttttcaaatcggcttaattttgatggctatttttttaatcgctgaaaactcttttgctcaacctaagcctgatgatcaaaagttatacgaaactatcattaaactcgaccaggaatttcttggattctacaatacctgcgataaaaatctcgaaaaatacggctcattttattcggaaaatattgagttttatcacgatcaaggcggtttaataacttcaaaattagacattatcgaagcaacaaaaaagaatgtttgcggaaaagttacccgtgaacttgttgaaggcagtattgaggtttatccgattaaaaattacggcgcaatcgaaataggctttcacaaattccacaataataccgaaaaagaagggactccatccaaagcgggaagattcgtaattgtctggcaaaatatgaaggatgagtggaaaattacgagagtaatcagtctccattag

SEQ ID NO: 2354 - protein, 168 aa, Unknown
  Obtained from environmental sample
  misc_feature (1)..(168): Xaa is any amino acid
MKVKPLNFLSRNSILSFQIGLILMAIFLIAENSFAQPKPDDQKLYETIIKLDQEFLGFYNTCDKNLEKYGSFYSENIEFYHDQGGLITSKLDIIEATKKNVCGKVTRELVEGSIEVYPIKNYGAIEIGFHKFHNNTEKEGTPSKAGRFVIVWQNMKDEWKITRVISLH

SEQ ID NO: 2355 - DNA, 804 bp, Unknown
  Obtained from environmental sample
  misc_feature (1)..(804): n is a, c, g, or t
atgacaaagcgttacggcaaagctncaacctatgatgacggctggaaattggagatttggagcgattcaatcggctatctaaagatgaataattcgcttacttggcgtttgaaaaagattaaattcaaagaatttttggcaaacgcttttgcagaactgcgtgtaaaaaatatcaaaaatctaattattgatgtgcgcggaaatgatggcggcgatatgaatccgggttttgaaatctcgctttatttagcgcaaaaagctttaccggtctatgcggaaagtaaaagattagtggggaatgtttcggcgcagcccgatctgctgaaaaatctcgatacatacagcgatgaattgattaacggactaaaaaatggtttatctgcaaatacttacaagcaagctggaaataattattttgaaattttaccgaacggaaaactcgaaagttttccgcaggttaaaccttatgaaaataattttcttggtagaacttttatcatcagcgatggaagcaacgcctcggcaacatttcaatttctcgaatatgtgcaggcaaataagctcgccacaatcgtcgggcaaacgacagggggcaacaaacaggggatcaacggcggcaattatttctttttgagtttacctaattcaaaagttgaaattgatattccggtttattttcaagcaccgttaaagccgcaaaaagatgtgagtattgtccctgatatgtttgtgaaaaaagatgttagcgacatcggcaataactatgaccgcgaaatcgaaacaataaaaaatatgattaaataa

SEQ ID NO: 2356 - protein, 267 aa, Unknown
  Obtained from environmental sample
  DOMAIN (23)...(244): Peptidase family S41
  misc_feature (1)..(267): Xaa is any amino acid
MTKRYGKAXTYDDGWKLEIWSDSIGYLKMNNSLTWRLKKIKFKEFLANAFAELRVKNIKNLIIDVRGNDGGDMNPGFEISLYLAQKALPVYAESKRLVGNVSAQPDLLKNLDTYSDELINGLKNGLSANTYKQAGNNYFEILPNGKLESFPQVKPYENNFLGRTFIISDGSNASATFQFLEYVQANKLATIVGQTTGGNKQGINGGNYFFLSLPNSKVEIDIPVYFQAPLKPQKDVSIVPDMFVKKDVSDIGNNYDREIETIKNMIK

SEQ ID NO: 2357 - DNA, 324 bp, Unknown
  Obtained from environmental sample
  misc_feature (1)..(324): n is a, c, g, or t
ttgcagcaaacaaacttgcaccaaaacttaatttgcgggcagccaggaaatttcaaattttttaaaaaaccaatttgggaaaagctctggcaaacaacaacattgaagacaataaaatgcatttgcattttttcaatcttgtacaacaataattcctgtaatttttttataaagaaggaggagggtttaaaaaattctcatcaccattatttcaaatgctcttttatggcaatggccaatgcaattttaaactggttgataaagcgtttaataacttgttcgcgttggctgcttttgcggaaatgggctttggtatcatggtag

SEQ ID NO: 2358 - protein, 107 aa, Unknown
  Obtained from environmental sample
  misc_feature (1)..(107): Xaa is any amino acid
MQQTNLHQNLICGQPGNFKFFKKPIWEKLWQTTTLKTIKCICIFSILYNNNSCNFFIKKEEGLKNSHHHYFKCSFMAMANAILNWLIKRLITCSRWLLLRKWALVSW

SEQ ID NO: 2359 - DNA, 795 bp, Unknown
  Obtained from environmental sample
  misc_feature (1)..(795): n is a, c, g, or t
atggaacccttcaatgtgaaaattgtcgacctcgagaaaaattctcaagagttgcttgaacaaaaacaaaactcaaatcaagaaacccagggagtcatcgctttgtcttcttctgggaacatcagtgaatctaccaaactcgattcttccctttctcccgaatcgcaatcttctcttgatctcaacttccaaatctggtctttgaatgagcaaactctctatgtaaaagagtgcaagacagaaaaggaatgtcaacttacctcccaaattgatagcattcaggattacatttctgctttgtctctcaaattcgaaaaggctgaaaagcgctttctcagtcaaagatatcatttagaaacagtcgaatcatacttccaaagcatcaaagaagatagtctcgctgccaccatccaagacattgaaaactttttgggggtcagtctctctgacttgagccaagctgtgaaatctcacttgttaattttctacgatttggaggaaattttaaacaatcaattggaatactttttgggtcacttggaaatggcaatcaaagcttccaaaaacagagtttccaaaaaagaagctaccgtcaacttcaatgattatgtttctaaattgaagcaacttcatggactgtggactgaagctttggctgatacttccattcaagaagtctcaacaaacaatggaactgaaattttaaacggtaaatttgaaaaacaaacaattcttgaaaaattttctttttattcatttgaatttttctgcaggtttaaacaaggaacaatgtga

SEQ ID NO: 2360 - protein, 264 aa, Unknown
  Obtained from environmental sample
  misc_feature (1)..(264): Xaa is any amino acid
MEPFNVKIVDLEKNSQELLEQKQNSNQETQGVIALSSSGNISESTKLDSSLSPESQSSLDLNFQIWSLNEQTLYVKECKTEKECQLTSQIDSIQDYISALSLKFEKAEKRFLSQRYHLETVESYFQSIKEDSLAATIQDIENFLGVSLSDLSQAVKSHLLIFYDLEEILNNQLEYFLGHLEMAIKASKNRVSKKEATVNFNDYVSKLKQLHGLWTEALADTSIQEVSTNNGTEILNGKFEKQTILEKFSFYSFEFFCRFKQGTM

SEQ ID NO: 2361 - DNA, 324 bp, Unknown
  Obtained from environmental sample
  misc_feature (1)..(324): n is a, c, g, or t
atgatcgaagtaaaagatattgatttcgatgtaaaaacaaaaagccttttattgaaatcagctgattggctttttaataaacgtatcatcaacgaaattgccagggtgtcaaaatttgatctttctacttatatcgatactgcaaaaattttgatcaataagcaattaaatgcagaatggatcaatggtgtaaaaagtattggctcaattaatgatctgaaaatttcaggcttctatccattaactgactatttcattatccgcagcaacgcaagcggtaacctggtgataaaagtggatgcaatgaattttaatttgcaatga

SEQ ID NO: 2362 - protein, 107 aa, Unknown
  Obtained from environmental sample
  misc_feature (1)..(107): Xaa is any amino acid
MIEVKDIDFDVKTKSLLLKSADWLFNKRIINEIARVSKFDLSTYIDTAKILINKQLNAEWINGVKSIGSINDLKISGFYPLTDYFIIRSNASGNLVIKVDAMNFNLQ

SEQ ID NO: 2363 - DNA, 708 bp, Unknown
  Obtained from environmental sample
  misc_feature (1)..(708): n is a, c, g, or t
gtggatatagattgtccaagggtttatttttcgccgccgaagatcaaacgggaagtaaagaaatataagatcaatgtgctgatcggctggatgggtcatatcaatgcattgctggccttctttaaaccgctctttcccaaaaagatggtgctgctttgccgggagtcgtcaataccttcgaaattcatattgcactacacatacccgggacttttcagattcatgtaccgtttccttaatagatacgacggaatcatctgtcagtcgcaggctatgaaaaatgatcttgttgaaaatttcaaggtaagatcagcgaagatcaatgttattcataacccggtcgttccttccggcagaaatacagagatgaatgcttcggcattgtcctttattacccactcgaaaatggtactttttgtaggacggttcagtgcagagaagcaggtaggcttgctgattgaagcaatgcaaaccattacaggcaattataaattaatccttgtaggctacggtccgatggaacaggaagtgagacggaaaatagcagaagctgacctgggaaacaagatcatgatcgttaatgattgcgatgaccccacaccttattataaacaagcttcctgccttgttctcacttcttcgtttgaaagggtttccgaatgtattattagaagccaatctgcaaggctgcccggtggtggtttataa

SEQ ID NO: 2364 - protein, 235 aa, Unknown
  Obtained from environmental sample
  misc_feature (1)..(235): Xaa is any amino acid
MDIDCPRVYFSPPKIKREVKKYKINVLIGWMGHINALLAFFKPLFPKKMVLLCRESSIPSKFILHYTYPGLFRFMYRFLNRYDGIICQSQAMKNDLVENFKVRSAKINVIHNPVVPSGRNTEMNASALSFITHSKMVLFVGRFSAEKQVGLLIEAMQTITGNYKLILVGYGPMEQEVRRKIAEADLGNKIMIVNDCDDPTPYYKQASCLVLTSSFERVSECIIRSQSARLPGGGL

SEQ ID NO: 2365 - DNA, 486 bp, Unknown
  Obtained from environmental sample
  misc_feature (1)..(486): n is a, c, g, or t
atggagctcatcaagcaggtggagatcaacattgactacatcctcgcacttatccggaaataccatgatgggcatctaaaggataaggaaatcgtgattaacatccaaaaggctattgattccagtctcgaattgcgaaataaaaaggatctgatagaggacttcatcgaatcattgacacctgcatctgacatcgatgacgactggcattcctttgtggatgagaagaagcttgcagagttggacaggattattgaccaggaaaaccttaataaggaagagacttatgattttattcaaaatgcctttcgtgacggatatgtgcagacgaccggtacactgattacgaaagtattgccacccgtttccaggtttagtccggggggagagcggaccaggttgcgtgatagtgtgcttgagaagttggttgcgtttttcaacaggttttgggatatatcgggtggggtgtttttgaaggagaggtag

SEQ ID NO: 2366 - protein, 161 aa, Unknown
  Obtained from environmental sample
  misc_feature (1)..(161): Xaa is any amino acid
MELIKQVEINIDYILALIRKYHDGHLKDKEIVINIQKAIDSSLELRNKKDLIEDFIESLTPASDIDDDWHSFVDEKKLAELDRIIDQENLNKEETYDFIQNAFRDGYVQTTGTLITKVLPPVSRFSPGGERTRLRDSVLEKLVAFFNRFWDISGGVFLKER

SEQ ID NO: 2367 - DNA, 414 bp, Unknown
  Obtained from environmental sample
  misc_feature (1)..(414): n is a, c, g, or t
atggcagaaaaagttttaaaaaaatcagaaacggaagaaattatccgcaacaaccagcagtatacattgttctcatggagcaagcaaaaaggcaccaatcctattgcggttaaatatggtgaaggagtttatttatatgattacgatggcaagcgatacatcgatttttcttctggattaatgaatgtgaacattgggcacggcgatcaacgaattactgccgcagtaataaaacaaatgcaggaagtgagttatgttacgccaagttgtgtaacaaaagtccgcggagagttgggaaaaaaattagcccaaatttgccccggtgatctgaacaaggctttctttactgtatgtggcgcctcctcgatagaaaattgcaataaagcttgcaagactttatacaggtcggcataa

SEQ ID NO: 2368 - protein, 137 aa, Unknown
  Obtained from environmental sample
  misc_feature (1)..(137): Xaa is any amino acid
MAEKVLKKSETEEIIRNNQQYTLFSWSKQKGTNPIAVKYGEGVYLYDYDGKRYIDFSSGLMNVNIGHGDQRITAAVIKQMQEVSYVTPSCVTKVRGELGKKLAQICPGDLNKAFFTVCGASSIENCNKACKTLYRSA

SEQ ID NO: 2369 - DNA, 885 bp, Unknown
  Obtained from environmental sample
  misc_feature (1)..(885): n is a, c, g, or t
gtgttcgacaagttcgatgccctgatcaagattcaaaaagataatattcaggccaaccttcattcttttgaaaattatgaagatccgacggtgaaatttatggcggaaaactctattgaaagtgaagtgacgccaatgaccaatgatattatcaggagattaaagaagatcgccgatgaacaatcgcagatcacaaaggaagcggatacccgcgtgatcaattctatcgatatgttgcagaccttaaccctatggcttggaggtgtgttcttattcgtttccctcctgagtgcgatctatcttctgaggtcggtcacaaaacctgttgcgttccttcaaaatattgttgtgaagctcggtcgtggtgaactggttgaggagaagagagctaagtttaacaacgacgagataggggacatggcactcgcgatggataatcttgttaacggcctcaaggcgactacgtctttcgctgaaaatataggtaatggaaactatcgcagcgatttcaagccgttgagtgatcacgatgttttgggtaacgcattgatcaacatgcgtaacaacctctcgaaggttgctgatgacgacaagaaaagaaactgggctactgaaggtctcgctaaatttggcgagatcctgcgtaccaataataacgatcttctcaaattgtctgatgagatcattggtaacctcgtgaagtacctgaaagcaaatcagggtgctttatatatcatcgacgacgctgacggaacagaagagccgacgatgtcaatgaaggcttgttatgcgtgggataagaagaaatttatgaatcancagatccatcgggggagaaggtcttngctggtcaggcatggcaggaaggtgacatcgtttatctga

SEQ ID NO: 2370 - protein, 294 aa, Unknown
  Obtained from environmental sample
  DOMAIN (83)...(153): HAMP domain
  misc_feature (1)..(294): Xaa is any amino acid
MFDKFDALIKIQKDNIQANLHSFENYEDPTVKFMAENSIESEVTPMTNDIIRRLKKIADEQSQITKEADTRVINSIDMLQTLTLWLGGVFLFVSLLSAIYLLRSVTKPVAFLQNIVVKLGRGELVEEKRAKFNNDEIGDMALAMDNLVNGLKATTSFAENIGNGNYRSDFKPLSDHDVLGNALINMRNNLSKVADDDKKRNWATEGLAKFGEILRTNNNDLLKLSDEIIGNLVKYLKANQGALYIIDDADGTEEPTMSMKACYAWDKKKFMNXQIHRGRRSXLVRHGRKVTSFI

SEQ ID NO: 2371 - DNA, 468 bp, Unknown
  Obtained from environmental sample
  misc_feature (1)..(468): n is a, c, g, or t
atgaagtactgcaaaaatgtggctgatgctgaggatgccacgatgcagatcttcgagcatttaatcaaggaattaaaaaagcacaacattcaagccttcaggccctggctgcatacggtggttaagaaccactgcatgatgaagtttcgcaaggaagccagcgatggcaagaaacgcgagcaatgggagaaagattcgcaacaggttgtggaatcagcctcgtcggagcatctaaaagaagcagaagacaaagagttcattttgcaaaatctgcatgaaggtattggagaattgaaagaagagcagcgcacctgcatcgaattattttacatgaagaattgcagttatgcggagatcacggccatcaccggatacagcaccagcgaagtgaagagctatatccaaaacgggaagcgaaacctgaaaaatataatcaagcaaaaaaatgaccgcgcacaggaaggataa

SEQ ID NO: 2372 - protein, 155 aa, Unknown
  Obtained from environmental sample
  DOMAIN (94)...(143): Sigma-70, region 4
  misc_feature (1)..(155): Xaa is any amino acid
MKYCKNVADAEDATMQIFEHLIKELKKHNIQAFRPWLHTVVKNHCMMKFRKEASDGKKREQWEKDSQQVVESASSEHLKEAEDKEFILQNLHEGIGELKEEQRTCIELFYMKNCSYAEITAITGYSTSEVKSYIQNGKRNLKNIIKQKNDRAQEG

SEQ ID NO: 2373 - DNA, 588 bp, Unknown
  Obtained from environmental sample
  misc_feature (1)..(588): n is a, c, g, or t
atggacaaccaaatcatcgaacaaaaagacaaattattccaacattttgaaaagttcatcaagcttaatgaggaactaaaattggcattatccgacagcgttcgctttgttacttttaagaaaggcgatcttgtacataatgccaacgaaatatgcaccaaggcttattttattcaaaaagggcttttcagaacatactttctaaaagatgggaaagaaattagcgaatatttttcagccgaagaagaatggagtaattccccaaaaagttttagcacaaggcaaaaagacatctactacattgatgctattgaagaaacaaaaaccttttgccttaacgtaaacgaccttgtttatttgtttgacaattttcctgaaatggaacgatatgcaaggctttcaatgggtaccattatggggcatcttatggaaagaatagtttcattgcgatttacaacggcaaaagacaaatatgaccattttattaaaacgtaccacgacattcatcatcggatacccctgggcatggtagcttcctatttaggaatagcgcagggaacgttaagcaggatcagagcagagaaatga

SEQ ID NO: 2374 - protein, 195 aa, Unknown
  Obtained from environmental sample
  misc_feature (1)..(195): Xaa is any amino acid
MDNQIIEQKDKLFQHFEKFIKLNEELKLALSDSVRFVTFKKGDLVHNANEICTKAYFIQKGLFRTYFLKDGKEISEYFSAEEEWSNSPKSFSTRQKDIYYIDAIEETKTFCLNVNDLVYLFDNFPEMERYARLSMGTIMGHLMERIVSLRFTTAKDKYDHFIKTYHDIHHRIPLGMVASYLGIAQGTLSRIRAEK

SEQ ID NO: 2375 - DNA, 447 bp, Unknown
  Obtained from environmental sample
  misc_feature (1)..(447): n is a, c, g, or t
atgttagtaaaaccgctgctcgataaggttcttatcacgttggaaattgaggataaaacctctatcctgattttattgaccaaagaaggagagattagccgcaagggagatggtaacccgcataacgaacttcctttaatgcagggtgtttcggatgatggtcatttcgaggcgctgatgatgaccgtgagcgaagatattttcaactatgtcggggttatcaatcagcccggaaggattggccgcacttgccgtctttccctgatctttcaaggcaaaagtgatgtggattattcctttcgggtggtttatggagaagattctcagggcccacctgttgaacttgcccagattttaattaacgctgtaaagattaccgaaccctggtatcaggagcaattgaagcccaaaccggaagaaaagaagtggtggcaggtttggaaatag

SEQ ID NO: 2376 - protein, 148 aa, Unknown
  Obtained from environmental sample
  misc_feature (1)..(148): Xaa is any amino acid
MLVKPLLDKVLITLEIEDKTSILILLTKEGEISRKGDGNPHNELPLMQGVSDDGHFEALMMTVSEDIFNYVGVINQPGRIGRTCRLSLIFQGKSDVDYSFRVVYGEDSQGPPVELAQILINAVKITEPWYQEQLKPKPEEKKWWQVWK

SEQ ID NO: 2377 - DNA, 744 bp, Unknown
  Obtained from environmental sample
  misc_feature (1)..(744): n is a, c, g, or t
gtggctttatggactttccatacagtaaattttccgcaatcattagataaagttgatagctcgggtttaaaatatattgagccaaatacttttcatagtgccggccccgagtttaaagactccatgatattacaattatcgtctgcaggtattgaaaaattgaaagccatgattgcgcagaagggactgatatgcgaatcaatctatattgttggcgattctacattacaatcatggataaagcaattcaatattgcaaggcaacttggcgtaaaatatgtaactacagaaccgccattgaatatgtggaacagcattgatagtatcgcaggcgcttatggagttaaagtggctatacatgagcactggaagggtgttagtcattattggaatcctgacacaacgttgatggcgctgcaggggcatccaaattttggcgtttgtgcagatcttggtcattggccaaagagtgggattgatcccctggatgctgtaaaaaaattaagcgggcacatcctcggcgtgcattttaaagacattgctgcatacaacgatccggctttaaaagatgtggttgttggaacaggcgtgattaaatttcctgaaatatttgcagcgctgaaaaatcaaaattttaatgggaatatttatatcgaacgtgattcagtagaagtgatgggcaatttgccctccgttatacaggaagtaaaatactacaatgaacagatgagtaaattgaagtga

SEQ ID NO: 2378 - protein, 247 aa, Unknown
  Obtained from environmental sample
  DOMAIN (28)...(247): Putative hexulose-6-phosphate isomerase
  misc_feature (1)..(247): Xaa is any amino acid
MALWTFHTVNFPQSLDKVDSSGLKYIEPNTFHSAGPEFKDSMILQLSSAGIEKLKAMIAQKGLICESIYIVGDSTLQSWIKQFNIARQLGVKYVTTEPPLNMWNSIDSIAGAYGVKVAIHEHWKGVSHYWNPDTTLMALQGHPNFGVCADLGHWPKSGIDPLDAVKKLSGHILGVHFKDIAAYNDPALKDVVVGTGVIKFPEIFAALKNQNFNGNIYIERDSVEVMGNLPSVIQEVKYYNEQMSKLK

SEQ ID NO: 2379 - DNA, 372 bp, Unknown
  Obtained from environmental sample
  misc_feature (1)..(372): n is a, c, g, or t
atggctttggaaaaaataaacattattccgcaagacattggccgcatcatgataaacatatttaataatgctttctactcaattaatgaaaagaggttaagagaaaaagattacgaacctgaaattttagtgcgcacacaaagaaaagggaataaagcagagcttaagataaaagataatggtattggaattcccccgaaaatcattgacaaaatttatcaacctttttttacaactaagccgtctggagaaggaacggggcttggcttatcattaagttacgatattataaaagcgcaccagggcgagttaaaggttgaaagtgttgaaggagaatatgctgaatttaccattgagcttacgtacaattaa

SEQ ID NO: 2380 - protein, 123 aa, Unknown
  Obtained from environmental sample
  DOMAIN (8)...(123): Histidine kinase-, DNA gyrase B-, and HSP90-like ATPase
  misc_feature (1)..(123): Xaa is any amino acid
MALEKINIIPQDIGRIMINIFNNAFYSINEKRLREKDYEPEILVRTQRKGNKAELKIKDNGIGIPPKIIDKIYQPFFTTKPSGEGTGLGLSLSYDIIKAHQGELKVESVEGEYAEFTIELTYN

SEQ ID NO: 2381 - DNA, 492 bp, Unknown
  Obtained from environmental sample
  misc_feature (1)..(492): n is a, c, g, or t
ttgccaaggcaacttggcgtaaaatatgtaactacagaaccgccattgaatatgtggaacagcattgatagtatcgcaggcgcttatggagttaaagtggctatacatgagcactggaagggtgttagtcattattggaatcctgacacaacgttgatggcgctgcaggggcatccaaattttggcgtttgtgcagatcttggtcattggccaaagagtgggattgatcccctggatgctgtaaaaaaattaagcgggcacatcctcggcgtgcattttaaagacattgctgcatacaacgatccggctttaaaagatgtggttgttggaacaggcgtgattaaatttcctgaaatatttgcagcgctgaaaaatcaaaattttaatgggaatatttatatcgaacgtgattcagtagaagtgatgggcaatttgccctccgttatacaggaagtaaaatactacaatgaacagatgagtaaattgaagtga

SEQ ID NO: 2382 - protein, 163 aa, Unknown
  Obtained from environmental sample
  misc_feature (1)..(163): Xaa is any amino acid
MPRQLGVKYVTTEPPLNMWNSIDSIAGAYGVKVAIHEHWKGVSHYWNPDTTLMALQGHPNFGVCADLGHWPKSGIDPLDAVKKLSGHILGVHFKDIAAYNDPALKDVVVGTGVIKFPEIFAALKNQNFNGNIYIERDSVEVMGNLPSVIQEVKYYNEQMSKLK

SEQ ID NO: 2383 - DNA, 894 bp, Unknown
  Obtained from environmental sample
  misc_feature (1)..(894): n is a, c, g, or t
ttgatactggcaaagtttacaattcagcattcactattcagttttattcactatttattttttaaaatgcaactaagaaaagcaacaagaaaaaaagctaaaataagattaggcctgtcagcagttagtggcggtggaaaaactttttccgcattactaattgcgaaaggaatttgtaatgattggaataaaattgccatcatagattctgaaaataacagtgcagatctatatgcccaccttggcaattataatgtgatgccaatagcggcacctttttcacccgaaaaatatgtagaagcaattaagatttgtgaaaaagcaggcatggaagtaatcatcattgacagtatcactcatgaatgggatggcaaaggaggttgtttggagatagtcgaatctttaggcggtaaataccaggattggggaaaggttactccgcgtcaccagtcttttattgatgccatcattcaaagcccctgccatgttattaccacagtccgacgcaagcaagattatgaagtaataaaagatggcaatggaaaaataaaagttgaaaaaagcgggttaagagagatcacacgtgaaggatttgaatatgagctcaccattaatcttgagttggatacgaagcataatgctacagcaagcaaggaccgcacaggcttgtttatgggcaagtctgcgtttattccgtctgagaaaaccggtgaattaatacaacaatggtgcgaccagggagaagatgcttttgatataaagccaggaagcgaatggtaccatcgtgtggaggaaatgcatacccaaaaagaattagtagaactctantacaggcacaaaactgatgttgatgtaaacccggtattgcagcaattaatttccnacagagaatga

SEQ ID NO: 2384 - protein, 297 aa, Unknown
  Obtained from environmental sample
  misc_feature (1)..(297): Xaa is any amino acid
MILAKFTIQHSLFSFIHYLFFKMQLRKATRKKAKIRLGLSAVSGGGKTFSALLIAKGICNDWNKIAIIDSENNSADLYAHLGNYNVMPIAAPFSPEKYVEAIKICEKAGMEVIIIDSITHEWDGKGGCLEIVESLGGKYQDWGKVTPRHQSFIDAIIQSPCHVITTVRRKQDYEVIKDGNGKIKVEKSGLREITREGFEYELTINLELDTKHNATASKDRTGLFMGKSAFIPSEKTGELIQQWCDQGEDAFDIKPGSEWYHRVEEMHTQKELVELXYRHKTDVDVNPVLQQLISXRE

SEQ ID NO: 2385 - DNA, 903 bp, Unknown
  Obtained from environmental sample
  misc_feature (1)..(903): n is a, c, g, or t
atgccggcttttttcccagaaagtattgacaagtatcaggactttaaggacgctgtgaggaaattgtcgctcagtgattcggcgctgcagtttacaccagagaattcaccagtacttggttttggtattcgcattggttttttgggcctactgcacatggacattgttcgagagcggctagagcgtgagtataaccttgaacttgttgtcactaatccatctactgactaccaggttactctttcaaatggcgaagaagtcgacatcaaatcagccagcgaactgcccgatgcctcacttattcaggaaattcgtgaaccatgggtaaagggcgaaattattgtacctgatgaatacgtgggcggtgttattcagctgattgccagcaagcgtggacgacaaaaaaatcttagttacgttgataaacgtgccctagttagtttcgaagccccgcttgctaacctgctaactgatttttacgaccagcttaagagcatcacaagtggctacggttcatttaattacgagctggacgattatcggcccgaagatttagtgcggcttgatttttatgtcgctggtgaaatagtcaatgcactcagtgttatggttcaccgcagcgaggctcaatctcttggaaagaacattgtagaaaaactcaaagacgttataccaaggcagaacttccaggtgagcttacaagcagctattggtggaaagttcatagcacgagaggatatcagtgcttatcgcaaggatgtgacgactgggctgtatggaggcgacgtttcgcgtaagaaaaaagtcctcgccaagcaagccaaaggtaaaaaacgccttaaacgattcggcaaagttgatatacctgccgaagcgttcacggtaatgctcaaacgcgattaa

SEQ ID NO: 2386 - protein, 300 aa, Unknown
  Obtained from environmental sample
  DOMAIN (103)...(191): Elongation factor G C-terminus
  misc_feature (1)..(300): Xaa is any amino acid
MPAFFPESIDKYQDFKDAVRKLSLSDSALQFTPENSPVLGFGIRIGFLGLLHMDIVRERLEREYNLELVVTNPSTDYQVTLSNGEEVDIKSASELPDASLIQEIREPWVKGEIIVPDEYVGGVIQLIASKRGRQKNLSYVDKRALVSFEAPLANLLTDFYDQLKSITSGYGSFNYELDDYRPEDLVRLDFYVAGEIVNALSVMVHRSEAQSLGKNIVEKLKDVIPRQNFQVSLQAAIGGKFIAREDISAYRKDVTTGLYGGDVSRKKKVLAKQAKGKKRLKRFGKVDIPAEAFTVMLKRD

SEQ ID NO: 2387 - DNA, 441 bp, Unknown; identical to SEQ ID NO: 2005
  Obtained from environmental sample
  misc_feature (1)..(441): n is a, c, g, or t

SEQ ID NO: 2388 - protein, 146 aa, Unknown; identical to SEQ ID NO: 2006
  Obtained from environmental sample
  DOMAIN (3)...(70): SmpB protein
  misc_feature (1)..(146): Xaa is any amino acid

SEQ ID NO: 2389 - DNA, 312 bp, Unknown
  Obtained from environmental sample
  misc_feature (1)..(312): n is a, c, g, or t
atgataaaaaggaatgattggcataaattgtgttctaattgtatacattttgatttaagttttctatttctggaaaagatttttttttctgtaaaaaactcgataataaatttggcaacaagattgagtgttagttataagtggacaaaaatgatgtataactcgtttactcacggtatttctagatcgctaaaatactggttattgagatttcaagtcttgttgtcaacaatcaaggtaagaactatcttgtctatgcctctgtatgtcattccctcgtcctttatttcctttgctttgttatccttataa

SEQ ID NO: 2390 - protein, 103 aa, Unknown
  Obtained from environmental sample
  misc_feature (1)..(103): Xaa is any amino acid
MIKRNDWHKLCSNCIHFDLSFLFLEKIFFSVKNSIINLATRLSVSYKWTKMMYNSFTHGISRSLKYWLLRFQVLLSTIKVRTILSMPLYVIPSSFISFALLSL

SEQ ID NO: 2391 - DNA, 936 bp, Unknown
  Obtained from environmental sample
  misc_feature (1)..(936): n is a, c, g, or t
atgcccngnnnnnnctnnncnnnnnnnnnnnncnnnccnnnnnntnctcnnnctnnnctcccncttccttctgaaaacaaccactgggagatccaaaaattgcacggcgataaaaaattcaatgacgaactaagagcgactcaaaggaagatcaatttgtatctgatcgctgctgttatactggtcggacttgttggtatcattatttttatcgagtttttaaataaacggaaggctaatcatatcattcatcaacagaaagaagaagttgacaaaaagaatttagaaattgaacaacagaaaaaattagttgaacaccagcgcgacctggtagaagacaagaataaggagatagttgattcaataaattacgcgagaaagatccaatatgctttattagcgcacgatgaatttttaaaagctaatttgccggggcatttcattctatttaaaccaaaggatatcgtaagcggtgatttttattgggccgcgaaaaaaggagataaattttatttggctgtttgtgattcaacaggacatggggttccgggtgcattcatgagtcttttgaatatttcttttttaaacgaagcgttgaatgagaaaaacattacagcgccgaatgaagtatttaatcatgttcgcagacgtttaatagaaagtatttcgcatgagaaccagagagacggaatggatgggatcttagtttgtttcgaaaaaaagaagataacatattcggcggcgaataataaaccgttgttgatccgtaactccaaaataaaagaattggaatatgataaaatgcccatcgnaaaaggaaaaaccgagcaatcctacagatcgtttacaataaacctgaaaaagggatcactttatttattcccgatggttatgctaatcaattcccgtgtccaaaaagaaagaaatccaatataa

SEQ ID NO: 2392 - protein, 311 aa, Unknown
  Obtained from environmental sample
  misc_feature (1)..(311): Xaa is any amino acid
MPXXXXXXXXXXPXXXXXXLPLPSENNHWEIQKLHGDKKFNDELRATQRKINLYLIAAVILVGLVGIIIFIEFLNKRKANHIIHQQKEEVDKKNLEIEQQKKLVEHQRDLVEDKNKEIVDSINYARKIQYALLAHDEFLKANLPGHFILFKPKDIVSGDFYWAAKKGDKFYLAVCDSTGHGVPGAFMSLLNISFLNEALNEKNITAPNEVFNHVRRRLIESISHENQRDGMDGILVCFEKKKITYSAANNKPLLIRNSKIKELEYDKMPIXKGKTEQSYRSFTINLKKGSLYLFPMVMLINSRVQKERNPI

SEQ ID NO: 2393 - DNA, 507 bp, Unknown
  Obtained from environmental sample
  misc_feature (1)..(507): n is a, c, g, or t
atggcagaaataagtcaggatagtggaaaaaaggatggaaaagtcaggagcaaaaagacgtctacccgtatcgatatgacaccaatggtagacctagcgtttctcttgctcaccttttttgtaatgaccactacactcaataaacctcagacgatggaaatcaccatgcctgagaagccgaaagaacaggataagccaccggtggtaaatgagaaacgggtgcttacgttggttcttggtggaaacaataaggtgtactggtacctcgggatcacggatcccaaggttgagctttccgatttttcgaacgatggaatccggaaagttttgttgcagcaaaatgcccagataaaggaaatggtggttcttataaaaccttcggatgaatcgaagtacaggaacgtcgtcgatattctcgatgagatgaatatcagcaacatcgcgcgatacgcgcttgtggatatcacaccggtggataaagaactcataaaagattcgaaactatga

SEQ ID NO: 2394 - protein, 168 aa, Unknown
  Obtained from environmental sample
  DOMAIN (17)...(158): Biopolymer transport protein ExbD/TolR
  misc_feature (1)..(168): Xaa is any amino acid
MAEISQDSGKKDGKVRSKKTSTRIDMTPMVDLAFLLLTFFVMTTTLNKPQTMEITMPEKPKEQDKPPVVNEKRVLTLVLGGNNKVYWYLGITDPKVELSDFSNDGIRKVLLQQNAQIKEMVVLIKPSDESKYRNVVDILDEMNISNIARYALVDITPVDKELIKDSKL

SEQ ID NO: 2395 - DNA, 912 bp, Unknown
  Obtained from environmental sample
  misc_feature (1)..(912): n is a, c, g, or t
atgcgcatgctgtgcaaaaggaggctctggatgtcagaaaataaaccaaagattattatcaccggtgcaagcggctttttgggcacagaattgatcaagcagtttaagcgggatgactggcaaatcgtggctttagtccgaaatgccaaaaaatataaaaccaaaggcgtggaatatgttgaatacgatctttcaaaaccatttgatgattcagcttttgccggtgccgattatctgattcacacagcttatatgaagcacgatagcaaacaccccgatgctatgaagataaactacgatggttcaaaacgagtcctgcaagctagtcgcaaatataaattgaaacgaaatgttttcatatccagcatgtcggcccattcaggtgctgaatcagtttacgggaagcaaaagttgaaaattgaaaaactattcagcgggtctgactgcacagttattcgctccgggctgatcatgggcaatggcggcatcgtcaaacaaatggctgatttcatgaaaagtaaacacgctgtgcctctgatcggaggcggcaagcaaccacttcaggtaattggcgtttacgaccttgtaagagtcataaaagccatcctgaagcagaataaatcaggtacttttaccattgccacacctgagatttattcttataagactttctaccaaaagttaagtaaaaaacttggcattaaaatcttgtatgttcccgtaccaatcggcttactgcttggtattaccaaactaactgctttgctgcaccttcccttttccatcaactccgacaatgtcttgggcttaaaaaatctacgcagtgctcaaactgcaggcgatttaacgaaattaaaaatagaacttgatgacttagataagattttgaccaaatcgaatctatcagcttga

SEQ ID NO: 2396 - protein, 303 aa, Unknown
  Obtained from environmental sample
  DOMAIN (18)...(267): NAD dependent epimerase/dehydratase family
  misc_feature (1)..(303): Xaa is any amino acid
MRMLCKRRLWMSENKPKIIITGASGFLGTELIKQFKRDDWQIVALVRNAKKYKTKGVEYVEYDLSKPFDDSAFAGADYLIHTAYMKHDSKHPDAMKINYDGSKRVLQASRKYKLKRNVFISSMSAHSGAESVYGKQKLKIEKLFSGSDCTVIRSGLIMGNGGIVKQMADFMKSKHAVPLIGGGKQPLQVIGVYDLVRVIKAILKQNKSGTFTIATPEIYSYKTFYQKLSKKLGIKILYVPVPIGLLLGITKLTALLHLPFSINSDNVLGLKNLRSAQTAGDLTKLKIELDDLDKILTKSNLSA

SEQ ID NO: 2397 - DNA, 627 bp, Unknown
  Obtained from environmental sample
  misc_feature (1)..(627): n is a, c, g, or t
atgtcaaaggccgaagcccttggccggttagtgtcgtgcggttttaaaatcgttgaagtaaaagaaataaacaatctcacttatttcgttggtagaaaaattcttattccaacctatgatgcaaatccttcctacgggccgttgtttgcaatgaacaggattggcaaggatggcaaaatgataaaagtttttaagttcaggacgatgtatccttatgccgaatatctgcaggaatatatatatgagcagtataacctggctgaaggtggtaaatttgcgcatgacttcaggataactgcatggggaagtctactaagaaagttctggcttgatgaattaccaatgatcatcaacctttttaagggcgacatcaaaatcgtcggtgttcgaccgctaagcaagcattatttcagcctttatacagaggaattacaggaaaaacgaaagtattgtaaaccgggattattacctcctttttatgttgatctccctaaaacactggaggaaatcattgattctgaattacggtatctcaatgcttatgagaaagatccttttaaaacggatgtaaaatatttcgcnaaaagttgctataccatcctattaaagaaggccaggagccattga

SEQ ID NO: 2398 - protein, 208 aa, Unknown
  Obtained from environmental sample
  DOMAIN (15)...(206): Bacterial sugar transferase
  misc_feature (1)..(208): Xaa is any amino acid
MSKAEALGRLVSCGFKIVEVKEINNLTYFVGRKILIPTYDANPSYGPLFAMNRIGKDGKMIKVFKFRTMYPYAEYLQEYIYEQYNLAEGGKFAHDFRITAWGSLLRKFWLDELPMIINLFKGDIKIVGVRPLSKHYFSLYTEELQEKRKYCKPGLLPPFYVDLPKTLEEIIDSELRYLNAYEKDPFKTDVKYFAKSCYTILLKKARSH

SEQ ID NO: 2399 - DNA, 708 bp, Unknown
  Obtained from environmental sample
  misc_feature (1)..(708): n is a, c, g, or t
ttggtagcaccgtatgcagatgtatattttcctgctggcttttccaaaagagaggttttaaaaaagagcaacctggccgatatctttcgtggagttactttctatcatcgctatttagtaatgaagaaacggggcgaacgggaaatagaaatgataaaacaatggaaatattttaccggcagaaccgactgggacaggaattacgtaaaacttattaacccggcagctatctattttcatggtgaagaattgctgagggcagattttttttccgctcaatggcagcctttacagtcaccggcaaagggacagcagattgttattggcactacaatcaatcctaatatttacaaagggctggacctggtgtataaagtagtgaaccttttaaaagattacaacatctgctggaaaatttttggcattgccgctgataatccggtaaacaacattataaaaaaagtaatggatattaagaaggctggggcggctgtaaagttttatggccagttaagtgctcctcaattaatcgaagaattgaagacctgccacttttttgtacatccatcctatattgataacagccccaacagcggttgcgaagcaatgctgcttggcaggccggtgctttcatcttcgccaggtggtgtaaagtctttaataacacataaagaaaacggcttcctggttcatccttatgatcaataa

SEQ ID NO: 2400 - protein, 235 aa, Unknown
  Obtained from environmental sample
  DOMAIN (92)...(235): Glycosyl transferases group 1
  misc_feature (1)..(235): Xaa is any amino acid
MVAPYADVYFPAGFSKREVLKKSNLADIFRGVTFYHRYLVMKKRGEREIEMIKQWKYFTGRTDWDRNYVKLINPAAIYFHGEELLRADFFSAQWQPLQSPAKGQQIVIGTTINPNIYKGLDLVYKVVNLLKDYNICWKIFGIAADNPVNNIIKKVMDIKKAGAAVKFYGQLSAPQLIEELKTCHFFVHPSYIDNSPNSGCEAMLLGRPVLSSSPGGVKSLITHKENGFLVHPYDQ

SEQ ID NO: 2401 - DNA, 456 bp, Unknown
  Obtained from environmental sample
  misc_feature (1)..(456): n is a, c, g, or t
atgatggcctgcttttttattaattggaggaaaggcaaaaccaggaaggcctttcgagggttaaattttcagcaaaagagaaagaaaattttttttttctttgggcgcagggctgatgtggaagcacttatacaggtgatggatgtaggcgtactctgcaccaacagtgaaatacatggagaaggtgtttccaattcaatcattgagtacatgagccttgaaaagcctgtaattgccaccaaaggcggcggcacaaacgaagtaattgaagatggtaaaaatggatttttaattggccacaaagaagtagataaattagtagagaagctgctttatctttatgataacccggctgcaggaaaacaaatgggtgcaaatgccctgcaaaccatttatgataaatttttgctggatagaatgacggatgagttcattgccatttataacaggaaatag

SEQ ID NO: 2402 - protein, 151 aa, Unknown
  Obtained from environmental sample
  DOMAIN (6)...(130): Glycosyl transferases group 1
  misc_feature (1)..(151): Xaa is any amino acid
MMACFFINWRKGKTRKAFRGLNFQQKRKKIFFFFGRRADVEALIQVMDVGVLCTNSEIHGEGVSNSIIEYMSLEKPVIATKGGGTNEVIEDGKNGFLIGHKEVDKLVEKLLYLYDNPAAGKQMGANALQTIYDKFLLDRMTDEFIAIYNRK

SEQ ID NO: 2403 - DNA, 774 bp, Unknown
  Obtained from environmental sample
  misc_feature (1)..(774): n is a, c, g, or t
ttgatgtcaaaaaagatcgttgcggtgatctgcggtggatataccgcggaaaaaaatatttctctcatgagcggggaagttgtgtttcagaatatcgaccgcgaaaaatatgagccttacaaagtgatcgtagacacagacggctggtttgtggatcccataaaatcaaaaatcgaattaaatgatttcagcttcacagccgatggaagaaaaataaaatttgattgcgtcttcaatgccattcacgggtcacctggtgaagacggtaaaatccagggctattttgatatgatgaaaatcccgtattccaattgcggtcccctcgcttcgggcgttacttttaataaatactggacaaaagaaattgtgagggatgatgttcccatggcaaaggatattttcatcaaaaacgggatcacggatttcaacgcagcaatcgggcaaatcaaaaatgaattttcactgccggtttttgtaaagccaaataacaatggttcgagttatggcgtttccaaagtgaaggatatgaaggagcttgaagcagcgatacaggaggcgcttaaatacgatacagaagtacttgttgaagaggggattgccggcgtggaggtaacgtgcggagtatattcacaaaatggaaagatcattgcactgccgatctgcgaaattgttaccagcaaacacgaattttttgattacacagcgaaatatacaagcggtgaaagcgatgaaataattcccgcccgcattcagaacccgacagaaaaaaggtga

SEQ ID NO: 2404 - protein, 257 aa, Unknown
  Obtained from environmental sample
  DOMAIN (115)...(257): D-ala D-ala ligase C-terminus
  misc_feature (1)..(257): Xaa is any amino acid
MMSKKIVAVICGGYTAEKNISLMSGEVVFQNIDREKYEPYKVIVDTDGWFVDPIKSKIELNDFSFTADGRKIKFDCVFNAIHGSPGEDGKIQGYFDMMKIPYSNCGPLASGVTFNKYWTKEIVRDDVPMAKDIFIKNGITDFNAAIGQIKNEFSLPVFVKPNNNGSSYGVSKVKDMKELEAAIQEALKYDTEVLVEEGIAGVEVTCGVYSQNGKIIALPICEIVTSKHEFFDYTAKYTSGESDEIIPARIQNPTEKR

SEQ ID NO: 2405 - DNA, 525 bp, Unknown
  Obtained from environmental sample
  misc_feature (1)..(525): n is a, c, g, or t
ttgatgtcaaaaaagatcgttgcggtgatctgcggtggatataccgcggaaaaaaatatttctctcatgagcggggaagttgtgtttcagaatatcgaccgcgaaaaatatgagccttacaaagtgatcgtagacacagacggctggtttgtggatcccataaaatcaaaaatcgaattaaatgatttcagcttcacagccgatggaagaaaaataaaatttgattgcgtcttcaatgccattcacgggtcacctggtgaagacggtaaaatccagggctattttgatatgatgaaaatcccgtattccaattgcggtcccctcgcttcgggcgttacttttaataaatactggacaaaagaaattgtgagggatgatgttcccatggcaaaggatattttcatcaaaaacgggatcacggattttcaacgcagcaatcgggcaaatcaaaaaatgaattttcactggcccgttttttgtaaagcccaaataacaaatgggttcgaggttatggcgtttttccaa

SEQ ID NO: 2406 - protein, 175 aa, Unknown
  Obtained from environmental sample
  DOMAIN (5)...(114): D-ala D-ala ligase N-terminus
  misc_feature (1)..(175): Xaa is any amino acid
MMSKKIVAVICGGYTAEKNISLMSGEVVFQNIDREKYEPYKVIVDTDGWFVDPIKSKIELNDFSFTADGRKIKFDCVFNAIHGSPGEDGKIQGYFDMMKIPYSNCGPLASGVTFNKYWTKEIVRDDVPMAKDIFIKNGITDFQRSNRANQKMNFHWPVFCKAQITNGFEVMAFFQ

SEQ ID NO: 2407 - DNA, 678 bp, Unknown
  Obtained from environmental sample
  misc_feature (1)..(678): n is a, c, g, or t
atggaaagagtgaacacactcatactaaaacttcaaaagcaactggaacagaaagataccgcagaaaatttactgcttactgtacaaatgcttcacgctgaattatctcctaaaataacaaccggaaagccaaacggctcagataaggttattgtgataatgcctgctacccttgcttcagttaagcaaagcgatgaaaacttttataatgtaactgaatcaaccgaacccgtgttagcggaagaagaaaaaattattgaggtgctgcaggtagatgaaaaagaaattgaggaggaactggagcaaataaaaagaaatgcagaaacaaaaaataaaatgagcagtaacgcaaagccatttttgctttttgatccgattgaagatgtgccaacacttacacatcaaactgtagatgctagtgttcctaaagagataaatgaaacgattgttgaaaaacccgagtcgataaatgaaaaacttaaggagataagaacagagctttcggagaaacttaccgacggcccgataaaagacctgaggaaagcgattggagtaaacgaccggtttttgtatattaatgagttgtttcgtggagatgaggcaatgtatgagagaagtgtaaaaacaattaataacttttccattcttgcagaagctgaatattgngattcgccgtga

SEQ ID NO: 2408 - protein, 225 aa, Unknown
  Obtained from environmental sample
  misc_feature (1)..(225): Xaa is any amino acid
MERVNTLILKLQKQLEQKDTAENLLLTVQMLHAELSPKITTGKPNGSDKVIVIMPATLASVKQSDENFYNVTESTEPVLAEEEKIIEVLQVDEKEIEEELEQIKRNAETKNKMSSNAKPFLLFDPIEDVPTLTHQTVDASVPKEINETIVEKPESINEKLKEIRTELSEKLTDGPIKDLRKAIGVNDRFLYINELFRGDEAMYERSVKTINNFSILAEAEYXDSP

SEQ ID NO: 2409 - DNA, 348 bp, Unknown
  Obtained from environmental sample
  misc_feature (1)..(348): n is a, c, g, or t
ttgaaagaaggtttttttaataacaaaatcagccgcaccatcatcaacagttttttatcgcgacctaaaatcaaaaaaattgatgcgcttatattagcctgtacacactacccgcttataaaacctgaaatttcggagttttataaaaaagacattttcattgttgattccgctgacattgttgcgaaacatgtcaaaaaattactcgaagcagatcgtttgctcaatgaaaaatcaaaaaggaagcaccggttttatatttctgattttacaaaatcgttcgaggagagtacaaagattttttttaaagggaaaataaaactggagcatcttaatctttggaaatga

SEQ ID NO: 2410 - protein, 115 aa, Unknown
  Obtained from environmental sample
  misc_feature (1)..(115): Xaa is any amino acid
MKEGFFNNKISRTIINSFLSRPKIKKIDALILACTHYPLIKPEISEFYKKDIFIVDSADIVAKHVKKLLEADRLLNEKSKRKHRFYISDFTKSFEESTKIFFKGKIKLEHLNLWK

SEQ ID NO: 2411 - DNA, 627 bp, Unknown
  Obtained from environmental sample
  misc_feature (1)..(627): n is a, c, g, or t
atgaaaaagatagttgtgttgttggcattaatcaccgcaatggttcctgcaggcgtattcgcccagaaatattgctacgtagatacagagtacattcttgaaaatataaccgaatataaagcggctcaacagcagctcgaccagttatcggtgaattggcaaaaagaaattgaagccaagtatgctttcattgataagctgtataaagatttccaggctgagcaaatcctgcttactgatgagatgaaacgtaaacgtgaaaatgaaatcgttcagaaagaaaaagaagtgaaagatttccaaaaacagaagtttggtttcgaaggggaattattcaaaaagaaacaagagctggtaaaacccatccaggataaaatttataatgcgatcaaaaaaatggcaaccgaccagagttacgcggttgtgtttgataagtcgagcgacctgatcatgctgtatgcaaatcccaaatatgacaagagtgatgatattctgaacgcgctcgggtataaagtgggtgataaagcatccggtacaggcagcggtggaacaagtcccaaaaccggtacaggtaatcaaccggtaaaggacagtactcctaccaacacggatgtcaaacccagataa

SEQ ID NO: 2412 - protein, 208 aa, Unknown
  Obtained from environmental sample
  SIGNAL (1)...(21)
  DOMAIN (1)...(169): Outer membrane protein (OmpH-like)
  misc_feature (1)..(208): Xaa is any amino acid
MKKIVVLLALITAMVPAGVFAQKYCYVDTEYILENITEYKAAQQQLDQLSVNWQKEIEAKYAFIDKLYKDFQAEQILLTDEMKRKRENEIVQKEKEVKDFQKQKFGFEGELFKKKQELVKPIQDKIYNAIKKMATDQSYAVVFDKSSDLIMLYANPKYDKSDDILNALGYKVGDKASGTGSGGTSPKTGTGNQPVKDSTPTNTDVKPR

SEQ ID NO: 2413 - DNA, 747 bp, Unknown; identical to SEQ ID NO: 2057
  Obtained from environmental sample
  misc_feature (1)..(747): n is a, c, g, or t

SEQ ID NO: 2414 - protein, 248 aa, Unknown; identical to SEQ ID NO: 2058
  Obtained from environmental sample
  DOMAIN (4)...(246): Luciferase-like monooxygenase
  misc_feature (1)..(248): Xaa is any amino acid

SEQ ID NO: 2415 - DNA, 384 bp, Unknown
  Obtained from environmental sample
  misc_feature (1)..(384): n is a, c, g, or t
gtgattatgaatcaaagaataaaaaagattgttggtataatgctattaagtgtggttgcggttgcaacaaatgcacaatcactcaatattaaaaatgatgtcttttggaacacaaaagacggtcgtcctgtttatagccagggcggtggcatattcaaatttaatgatcctgctacgggaaaaatgaaatactactggtatggtgttcagtataaagaagcggcgatttatcgtaacgacccatcagtaacattacccaatgctacatttgaaacagtaacctgctatagctctaccgatttagttaactggacatttgaagcggatgtttttaccaaagaagaagcatttaaatctattcccagaactgggtgggacgtttag

SEQ ID NO: 2416 - protein, 127 aa, Unknown
  Obtained from environmental sample
  SIGNAL (1)...(20)
  misc_feature (1)..(127): Xaa is any amino acid
MIMNQRIKKIVGIMLLSVVAVATNAQSLNIKNDVFWNTKDGRPVYSQGGGIFKFNDPATGKMKYYWYGVQYKEAAIYRNDPSVTLPNATFETVTCYSSTDLVNWTFEADVFTKEEAFKSIPRTGWDV

SEQ ID NO: 2417 - DNA, 822 bp, Unknown
  Obtained from environmental sample
  misc_feature (1)..(822): n is a, c, g, or t
atgtcaacagtaattactgttcaaaatgttagtaagagttatcttctgcagcatcagcagaaagagcaataccttagtttccgtgaaattattacgagtaaagttaaaagagcttttttaaaaaactcggatcaaaagaataaaagtgaaacattttgggccttggataatgtttcttttaatgtgcaacagggtgagcgactaggaattatcgggagaaatggtgcggggaaatcgactttgttaaaaattctcagccgaattacccagccttccaaaggaaaaattggaataaagggaaaagttgcaagtttacttgaggtaggtacaggatttcatccggaattaacaggtcgtgaaaatatatttttgaatggctctgtattgggaatgagtaaatgggaaattaaaacccggtttgatgaaattgttgcttttgctgaaattgataaattccttgatacacctgttaaaaggtactcaagtgggatgtatgtaaaacttgcatttgctgtcgcagcgcatttagagccggaaatattaattatagacgaggtgctagcagttggcgatgcgcaatttcaaaagaaatgtttaggcaagatggaggaagtaagcaaaaaccagggacgtacaattttatttgttagtcataacctggctgctttatcgagcttgtgtccttcttcaattttattggaaaatggaaaaatatttcaaaatggtccaacggaaaaaattataacaacttatttgcgaagatccaatgctgctaccggagagacaaaggatgatcaggatccggatgaaacaaaaaattaa

SEQ ID NO: 2418 - protein, 273 aa, Unknown
  Obtained from environmental sample
  DOMAIN (65)...(236): ABC transporter
  misc_feature (1)..(273): Xaa is any amino acid
MSTVITVQNVSKSYLLQHQQKEQYLSFREIITSKVKRAFLKNSDQKNKSETFWALDNVSFNVQQGERLGIIGRNGAGKSTLLKILSRITQPSKGKIGIKGKVASLLEVGTGFHPELTGRENIFLNGSVLGMSKWEIKTRFDEIVAFAEIDKFLDTPVKRYSSGMYVKLAFAVAAHLEPEILIIDEVLAVGDAQFQKKCLGKMEEVSKNQGRTILFVSHNLAALSSLCPSSILLENGKIFQNGPTEKIITTYLRRSNAATGETKDDQDPDETKN

SEQ ID NO: 2419 - DNA, 363 bp, Unknown
  Obtained from environmental sample
  misc_feature (1)..(363): n is a, c, g, or t
atgaaaacgatcattgagccatttaaaataaaatcagttgagccgatatatttcaacacaaaggaagaacgaactacaattcttgataaagctttttataacccattcctgattcattcagatgacgtattgattgacctgctgaccgacagcggcaccagtgccatgagcagtgatcagtgggcaggcattatgaaaggcgatgaatcctatgcaggaagccccagttttttccggtttgaaaaacagtacaggaataacagggatgccaatcatcattcctgctcacaaggaaaggcaacaaagaaaatctattcagtattctcggcgggcaaaggaaataattttatcagcaatacttaa

SEQ ID NO: 2420 - protein, 120 aa, Unknown
  Obtained from environmental sample
  DOMAIN (2)...(117): Beta-eliminating lyase
  misc_feature (1)..(120): Xaa is any amino acid
MKTIIEPFKIKSVEPIYFNTKEERTTILDKAFYNPFLIHSDDVLIDLLTDSGTSAMSSDQWAGIMKGDESYAGSPSFFRFEKQYRNNRDANHHSCSQGKATKKIYSVFSAGKGNNFISNT

SEQ ID NO: 2421 - DNA, 846 bp, Unknown
  Obtained from environmental sample
  misc_feature (1)..(846): n is a, c, g, or t
atggaactgattaaaatccctgttgatgtcatctccctgatgaattactattcaccatttttgtctggttatgtaacagaaatatatagttgcgaaaaaaaccgacttcattattttctgtattttgaatgtaataaagaaaaatatgaaagtattatactttgctcagcattgaatcttagtaacttattaactttcaaaaaattacgtctgcatgaatccgtcatagttgtagaaaaaagcttcgaatcatttatctatcggatccatttagaaaatcttatttatgattataataagacaaaaaaaatacctgaaaaatggaaaaaatcaataaaaaattacatcaatttttatgatgaaatagctgcaaaaaaaatcacagacgatgttataaaaaaaggaattaaaaatgaatccaataaaacccatctggccatttttatcaaaaatacacaaccagatgaaaagttgatagaggaatcgaaaggcaaattagattggctttatataagccaatattccctgctatcagaaaaattcatacgtcgttattccgatcaattagactggcaaattctatctgttcatcaaaaaatgtccgaacaattaatacaggattttcaggataaagtttgctggagagaaatatcagcacatcaaaaattatcaggaaagtttatacacaagtttacaaaccaggtatcctgggtagaaatatccaaacatcaaaaactttcaggggactttttggaaaaattcaggtttaaggtacactggtattttatatatagtaattcccaaatagatgagaaaataaaacaaaatggaaaagctggagaatag

SEQ ID NO: 2422 - protein, 281 aa, Unknown
  Obtained from environmental sample
  misc_feature (1)..(281): Xaa is any amino acid
MELIKIPVDVISLMNYYSPFLSGYVTEIYSCEKNRLHYFLYFECNKEKYESIILCSALNLSNLLTFKKLRLHESVIVVEKSFESFIYRIHLENLIYDYNKTKKIPEKWKKSIKNYINFYDEIAAKKITDDVIKKGIKNESNKTHLAIFIKNTQPDEKLIEESKGKLDWLYISQYSLLSEKFIRRYSDQLDWQILSVHQKMSEQLIQDFQDKVCWREISAHQKLSGKFIHKFTNQVSWVEISKHQKLSGDFLEKFRFKVHWYFIYSNSQIDEKIKQNGKAGE

SEQ ID NO: 2423 - DNA, 771 bp, Unknown
  Obtained from environmental sample
  misc_feature (1)..(771): n is a, c, g, or t
atggtcggatgtgataaagtaaccctgttatcacaatatataggcgattgccatccgctggcccaggtaaatggtttggtaggttctaatttaattgcttttatttgcagaaggaattcagctacttttaatgctacttcttcattatatatcatggagcaaatgtataaagtttttataaaagcgaacttattatatatctcaaacacgccattaaagaatcaaaaagggtataaaaaggtaacgaatatcgaatttgtcgatgattctgtttttgacagcctgatccctgtactggaggctgaatataatgaacctgtatgttattgcctgttcggggctgatcctgtatttatctggcggcgctaccgaaagcaatataaattagtggtagccggaggaggtttggtaagaaacgaaaaaaataaaattctttttatttatagaaatggtcgttgggatttacccaaaggcaaagccgaatatgccgaattaattgaagatacttcattacgggaagtaaaagaagaatgtgggctaaccaacctgattttagtcgaccatttgatagatacttatcatacctatgatctaaaggggtccagaaaactgaaaaaaacatattggtatttgatgtattctgatgatcagaccttgattccacaaacagaagaaggaattaccaagattaaatgggtaaaggaagataagctggagaaaattattccaatacatatcccagtattatggatgtactggaggtcgcattaa

SEQ ID NO: 2424 - protein, 256 aa, Unknown
  Obtained from environmental sample
  DOMAIN (129)...(254): NUDIX domain
  misc_feature (1)..(256): Xaa is any amino acid
MVGCDKVTLLSQYIGDCHPLAQVNGLVGSNLIAFICRRNSATFNATSSLYIMEQMYKVFIKANLLYISNTPLKNQKGYKKVTNIEFVDDSVFDSLIPVLEAEYNEPVCYCLFGADPVFIWRRYRKQYKLVVAGGGLVRNEKNKILFIYRNGRWDLPKGKAEYAELIEDTSLREVKEECGLTNLILVDHLIDTYHTYDLKGSRKLKKTYWYLMYSDDQTLIPQTEEGITKIKWVKEDKLEKIIPIHIPVLWMYWRSH

SEQ ID NO: 2425 - DNA, 423 bp, Unknown
  Obtained from environmental sample
  misc_feature (1)..(423): n is a, c, g, or t
ttgaaccttgtttttatgaacaaggtgttcaggtatggtaaagaaaattattcgcctaaaattagactctttaataagtacaaaggtacttgggatggagctatggttcatgaaacggtgattgtaaaaggccccgtaaaaaaattaaagaacaaaatattccactatagctataacagttatagccagtttctaaaaaaaatcgatttgtattctggactgagcgcaaaaaaattattggcaaaaaagaagcaaaaaagcagattcattattatccttgggcttcctttcaattttttaaaatactacatcattgaccgcaatttcttgaacggttaccaggggtttgcctgggctgtactgaactctttgtatcattttgtaaaatacctgaagctggaagagatgagatcgaaggtatag

SEQ ID NO: 2426 - protein, 140 aa, Unknown
  Obtained from environmental sample
  misc_feature (1)..(140): Xaa is any amino acid
MNLVFMNKVFRYGKENYSPKIRLFNKYKGTWDGAMVHETVIVKGPVKKLKNKIFHYSYNSYSQFLKKIDLYSGLSAKKLLAKKKQKSRFIIILGLPFNFLKYYIIDRNFLNGYQGFAWAVLNSLYHFVKYLKLEEMRSKV

SEQ ID NO: 2427 - DNA, 711 bp, Unknown
  Obtained from environmental sample
  misc_feature (1)..(711): n is a, c, g, or t
ttggatatttacaaaaaaagggaactgcccaggtatttgcatgcccttgcagacatagaaggcctgaatgggataagattacattacgcttatccctcaaagtttccgatggaaataattgatgtaattaagcagcgggaaaatatttgtaagtatctcgatatgcctttgcaacatgccagtaacaggatgttgaaagcaatgaaaaggcaaatcacgagggaagaaatggaagatatcatcaatgaaataaaaaataaaataccaggcatctgtttacggacaactttaatcagtggtttccccggggagacacaggatgatgttgaagaattgaaatctttcctgcaaaaaattaggtttgacagggttggtattttttcttattctcatgaagaacgaacttctgctttcgatttaaaagacgatgtttcatctgaaacaaaagaaagaagagctcaggaaattatggaagttcaacaggaaatttcttatcaaaaaaatgttgaaaaagtcggtcagatttttaaagttatcatcgataaaaaagaagctggcagatacttaggccgtactgagtttgacagcgtagaagtagataatgaagtgatcgttagaagtgataaaaaattacacccaggcagttttgttcaggttaaaatcaccaatgcgtatgattatgacctggagggtgaagtaatttcttcttaa

SEQ ID NO: 2428 - protein, 236 aa, Unknown
  Obtained from environmental sample
  DOMAIN (169)...(235): TRAM domain
  misc_feature (1)..(236): Xaa is any amino acid
MDIYKKRELPRYLHALADIEGLNGIRLHYAYPSKFPMEIIDVIKQRENICKYLDMPLQHASNRMLKAMKRQITREEMEDIINEIKNKIPGICLRTTLISGFPGETQDDVEELKSFLQKIRFDRVGIFSYSHEERTSAFDLKDDVSSETKERRAQEIMEVQQEISYQKNVEKVGQIFKVIIDKKEAGRYLGRTEFDSVEVDNEVIVRSDKKLHPGSFVQVKITNAYDYDLEGEVISS

SEQ ID NO: 2429 - DNA, 837 bp, Unknown
  Obtained from environmental sample
  misc_feature (1)..(837): n is a, c, g, or t
atgaaatattgcctgattttattttctattgtaaacagcctgtttacaaatgcccagcttagtaaagaacagtggcgggaagacatacagtacatggtcaaaaaagtccatgaaattcacccgaacccttattacaaatactcccgggccacgctggataaggccgaggaccggcttttaaataatataaataactgggaacccgaaaagattatagcgaatatctcccggtaccttgccatgatccaggatgggcatacccaattaatccccgtattgcggggagaatcaaaactagaactgcactacctgccttttttctttaaagtttttgatgatggtgtttatataagagtaacgactgattcagcttattcttatttaattggagccaggctcctgcagctgggaaaaattccggtaaaaaaaatcctggaaactttaaaagattatgcctctggcgataacgactattcaaaaaaaattcaaatccctatgggattaagctgtattgaaatattaaaaggttcgggcctgctaaccggcaataagcctgaattaaaattccaaaccagggacaatagagttattaccatagaaccaactatcgttaacactcccccgtttcgtcatgacatacgggaaagaatctccagttcagcaccgttgtacaaacaaaaccaggacaaagcatattcaattaattatctcccaggtgaaaaacttttataccttaattacaggcaaattgcctctgatccgtcactccccgtgcgaaaacttggtgataccatcaactatttaagtgaaaagaagatgttcaaaaattcgttgtga

SEQ ID NO: 2430 - protein, 278 aa, Unknown
  Obtained from environmental sample
  SIGNAL (1)...(18)
  misc_feature (1)..(278): Xaa is any amino acid
MKYCLILFSIVNSLFTNAQLSKEQWREDIQYMVKKVHEIHPNPYYKYSRATLDKAEDRLLNNINNWEPEKIIANISRYLAMIQDGHTQLIPVLRGESKLELHYLPFFFKVFDDGVYIRVTTDSAYSYLIGARLLQLGKIPVKKILETLKDYASGDNDYSKKIQIPMGLSCIEILKGSGLLTGNKPELKFQTRDNRVITIEPTIVNTPPFRHDIRERISSSAPLYKQNQDKAYSINYLPGEKLLYLNYRQIASDPSLPVRKLGDTINYLSEKKMFKNSL

SEQ ID NO: 2431 - DNA, 345 bp, Unknown
  Obtained from environmental sample
  misc_feature (1)..(345): n is a, c, g, or t
atggctgactccggggagcgttggcccttccattggaataccaacaacaacattggaataatagtcactacctgcgtatctcttatcggaaagaccatcccattttttaaagtcaagttcaaagccgcgatagtcataagacttgattccgatttttgcaatttcggatgtatagcttttacccccgtgaacttcttcaggagtaagccactcacccattctgcgataggcttcaaacatattggcacttccctgtgtacgaggcaccattttatttgccctattgtcaagtccgaaaaggaatttctggcctgcaaggaacaaaaatttattgctacgttttag

SEQ ID NO: 2432 - protein, 114 aa, Unknown
  Obtained from environmental sample
  misc_feature (1)..(114): Xaa is any amino acid
MADSGERWPFHWNTNNNIGIIVTTCVSLIGKTIPFFKVKFKAAIVIRLDSDFCNFGCIAFTPVNFFRSKPLTHSAIGFKHIGTSLCTRHHFICPIVKSEKEFLACKEQKFIATF

SEQ ID NO: 2433 - DNA, 819 bp, Unknown
  Obtained from environmental sample
  misc_feature (1)..(819): n is a, c, g, or t
atggccgaagacactgacacaggtggcgttactcaactaccacttttaccacttcgagatttaatcgtttttccacatatgatgatgccactttttgtcggtcgcgagaaaagcatcaatgccctcgaagaggtcatgagcaagcgtacagatatcgtaatggccgcgcaacgggatgcgaaagtaaacaaccccgaagccactgacatttacgatgtaggtactcgcggtacgatcattcagttgctgagacttccggatggaaccgtgaaagtcctcattgaaggaaaaaaacgggttcgaatcaaaaaattcgttccaaacgacaaattctatattgttgaagtcgaggagctagctgagatcaccgaaagcccggctgaaactgctgctctcatgcgttcggtcaaatcgacgtttgagacttacgtgaagctcaacaaaagaattccgccagaaattcttatgcgggtcgcgagtattgaagatgctggggaattagctgacatcatcgtcgcccagctcaatttgaaattagaagataaacaaaaaactcttgagatttcggatccgaataagcgtcttgaagaattgttgaacatgatgagcggtgaaatcgaaattctcgaagtcgagaaaaagatccgcacacgggttaagaagcaaatggagcgctcccaaaaagagtactacctcaacgagcagatgcaggcgattcanaaagagctcggcgaaaaagatgattttcaggctgaagtaaaagaactcgaagctcagcttaaaaagaaaaaatgtcttaagaggccactgataaagtga

SEQ ID NO: 2434 - protein, 272 aa, Unknown
  Obtained from environmental sample
  DOMAIN (12)...(204): ATP-dependent protease La (LON) domain
  misc_feature (1)..(272): Xaa is any amino acid
MAEDTDTGGVTQLPLLPLRDLIVFPHMMMPLFVGREKSINALEEVMSKRTDIVMAAQRDAKVNNPEATDIYDVGTRGTIIQLLRLPDGTVKVLIEGKKRVRIKKFVPNDKFYIVEVEELAEITESPAETAALMRSVKSTFETYVKLNKRIPPEILMRVASIEDAGELADIIVAQLNLKLEDKQKTLEISDPNKRLEELLNMMSGEIEILEVEKKIRTRVKKQMERSQKEYYLNEQMQAIXKELGEKDDFQAEVKELEAQLKKKKCLKRPLIK

SEQ ID NO: 2435 - DNA, 684 bp, Unknown
  Obtained from environmental sample
  misc_feature (1)..(684): n is a, c, g, or t
atgaaaaaaaagattaattatattgcttttatcatcttattaatttgcagtgtacctgcatttacgactgttcgatttgctcacgtaacagatttgcatatctttgaagataacaatcggaactttgaagccaaaatttcagcagatgatttttttaaatcaatttataaaatcaatgatatttcaaaaaacttcaaagaaccattagattttgttttgttaagtggtgatataggcattggaaaacttcttaagttagatcgctcatcaacaaaaggcaaaccatcattttccttgcataaagatccccaaagatggtacgcggctctaacctctattgcacaaattttaaaatactctcgcattaaaatatggttgtttctgcctggcaataacgatctttacaatgaacggcatgatactattcaattttttcatgaatttttgcaagaattacaagccatgcctganatcaaaaaagcaggccttaaacttgtcgactttcgcttagaatcttctcaaaaaatccagccacaatctccaccaggtatttttgtcttaaaaaatttgttatttgtagggtgggataattctttttttaaacataacaactcagtacgggactattttgataagacaataaacttataccctatgataaaaccccagattatcaaagtataa

SEQ ID NO: 2436 - protein, 227 aa, Unknown
  Obtained from environmental sample
  SIGNAL (1)...(20)
  misc_feature (1)..(227): Xaa is any amino acid
MKKKINYIAFIILLICSVPAFTTVRFAHVTDLHIFEDNNRNFEAKISADDFFKSIYKINDISKNFKEPLDFVLLSGDIGIGKLLKLDRSSTKGKPSFSLHKDPQRWYAALTSIAQILKYSRIKIWLFLPGNNDLYNERHDTIQFFHEFLQELQAMPXIKKAGLKLVDFRLESSQKIQPQSPPGIFVLKNLLFVGWDNSFFKHNNSVRDYFDKTINLYPMIKPQIIKV

SEQ ID NO: 2437 - DNA, 396 bp, Unknown
  Obtained from environmental sample
  misc_feature (1)..(396): n is a, c, g, or t
atggggttttcaggaactaatagcggcatagcttattttacgggcaaacctttttatgatgcaactaaaaaaatgatcgaagtaaaagatattgatttcgatgtaaaaacaaaaagccttttattgaaatcagctgattggctttttaataaacgtatcatcaacgaaattgccagggtgtcaaaatttgatctttctacttatatcgatactgcaaaaattttgatcaataagcaattaaatgcagaatggatcaatggtgtaaaaagtattggctcaattaatgatctgaaaatttcaggcttctatccattaactgactatttcattatccgcagcaacgcaagcggtaacctggtgataaaagtggatgcaatgaattttaatttgcaatga

SEQ ID NO: 2438 - protein, 131 aa, Unknown
  Obtained from environmental sample
  misc_feature (1)..(131): Xaa is any amino acid
MGFSGTNSGIAYFTGKPFYDATKKMIEVKDIDFDVKTKSLLLKSADWLFNKRIINEIARVSKFDLSTYIDTAKILINKQLNAEWINGVKSIGSINDLKISGFYPLTDYFIIRSNASGNLVIKVDAMNFNLQ

SEQ ID NO: 2439 - DNA, 879 bp, Unknown
  Obtained from environmental sample
  misc_feature (1)..(879): n is a, c, g, or t
ttgaataaacccgattcccaaaccggaagcatttactatgaaatgaagaatattcctgggttgcgagatgaggtttatatggatgcgccgaaagattatctgcaaagggtaaactttcaactatcgggttttactgattatgctggaaagcataaagtaaatactacctgggctcaattagcgttagagttatctactgaaaaaatgttcggtggtcagatcaataagtcgctgccagatttggggccggttaagacattgtgggaaagtactgcatctacttttgcaaaaatgaaacttatacatgaatatgtacggtccaatatggaatggaacaatatttactcccgatatgcagaacataatattaaagaagtatgggaaaagaaaaaagggaacgccgcagaaattaaccttatactgcttaatttattaaaagatgccggtttggaaagctatccattattagtaagtgaaagagatcatggaaaagtagatactgtttatcccttcctggaccagtttaataaagtggtggcttatgttgttatcgatggtaaccaatatattcttgatggtacggatagacaaactccttcttatttgattccatttgccttgttaaataccaagggatttatagtggatagaaaaaagaaaagttttataacgatagcagatacaaaggcaaaaagttttagtgtagtagaggtcaatggaaagattggggcaacaggaaaattaaatggcattgccaaaatcagcaattacgattatgcaaaaattaataagaaggaacagtatatgtctggtaaaaataaatatgaggaagagtttgcaaaatcttacggtgattttgaaatgattcatttactgtaa

SEQ ID NO: 2440 - protein, 292 aa, Unknown
  Obtained from environmental sample
  misc_feature (1)..(292): Xaa is any amino acid
MNKPDSQTGSIYYEMKNIPGLRDEVYMDAPKDYLQRVNFQLSGFTDYAGKHKVNTTWAQLALELSTEKMFGGQINKSLPDLGPVKTLWESTASTFAKMKLIHEYVRSNMEWNNIYSRYAEHNIKEVWEKKKGNAAEINLILLNLLKDAGLESYPLLVSERDHGKVDTVYPFLDQFNKVVAYVVIDGNQYILDGTDRQTPSYLIPFALLNTKGFIVDRKKKSFITIADTKAKSFSVVEVNGKIGATGKLNGIAKISNYDYAKINKKEQYMSGKNKYEEEFAKSYGDFEMIHLL

SEQ ID NO: 2441 - DNA, 465 bp, Unknown
  Obtained from environmental sample
  misc_feature (1)..(465): n is a, c, g, or t
gtgaagggcaggcgattgttccccatcatgaataatattggttatgatatcatgttgcctggtaattgggaggtggtgtacggaaaggagatgatgatgaaagacatgttcgcatatgatggaataaaagtttgcgcgaacatgttccacgattcaaaggatgaactgaaaggtgagctcatcttccctccttatttcatcaaacatattgccggaatcaagatcggcttcatcgggtataatgacccactcacaccgaaacgccagtcgcccggatacagcaaacggatcaaattcaccttcccggaactgaatgttgcacaatatgtgaaggtcctgaatgaatatgaaaagtgtgagatggttttcctacttacacatatgtggactggcacagcagatcggattatcgaatgcgccccagatcaatggggtggattatatcctgggtgcagatacgcatga

SEQ ID NO: 2442 - protein, 154 aa, Unknown
  Obtained from environmental sample
  misc_feature (1)..(154): Xaa is any amino acid
MKGRRLFPIMNNIGYDIMLPGNWEVVYGKEMMMKDMFAYDGIKVCANMFHDSKDELKGELIFPPYFIKHIAGIKIGFIGYNDPLTPKRQSPGYSKRIKFTFPELNVAQYVKVLNEYEKCEMVFLLTHMWTGTADRIIECAPDQWGGLYPGCRYA

SEQ ID NO: 2443 - DNA, 468 bp, Unknown
  Obtained from environmental sample
  misc_feature (1)..(468): n is a, c, g, or t
ttgtatatgaaaaatgttaataaaactataaaagatcaagaggctcagtatgtttcaacctatgagaaggatatgttcggttttagatttcaaaaactagccgaagaattagatacaaaaattgaacaaaacaaggctgaacacgaactctttgttgctaacaataaaatttttcttgatagacttaataataccgaaattagaacagatcgattaagtaaaagtatagataacttagcgactataactgcaagaaattttgaattagttaatagtcgaattgacagattagagttaagattccagaacttagagaataaaatcgataagatctttggagttttattagaaaagattggagatttatctgacaaatttgataatctatctggaagagtagatagcttatcagttagagtagatgatttgtttaaaaagttgatacctatctcgatactacattcttga

SEQ ID NO: 2444 - protein, 155 aa, Unknown
  Obtained from environmental sample
  misc_feature (1)..(155): Xaa is any amino acid
MYMKNVNKTIKDQEAQYVSTYEKDMFGFRFQKLAEELDTKIEQNKAEHELFVANNKIFLDRLNNTEIRTDRLSKSIDNLATITARNFELVNSRIDRLELRFQNLENKIDKIFGVLLEKIGDLSDKFDNLSGRVDSLSVRVDDLFKKLIPISILHS

SEQ ID NO: 2445 - DNA, 837 bp, Unknown
  Obtained from environmental sample
  misc_feature (1)..(837): n is a, c, g, or t
ttgattgatgtacgtcacgattatttgacattaaaattaaaatgcttaggatattacataccaaaaacaaagtttgcatttggatacagttatttgaagagggttgattacttcaaccttacctcattcaaattttcatacggctataaatggaaagaaaacattaaaaaagatcatgaactgaatccagtcaatattaattatacaaggataagcaataagtcacaacggtttaatgcattgcttgaaagcaatcccttcctgaaaaagagttatgaagaacaattcattgcaggtatgacttatgcctttacctttaatgaacaggtaattgaaaaacaaaagagtcagttttatcttaatactacagctgaactttcagggaatgcactttcccttattaagaaaacattctatggtcaaactcccaatcctgatgatcctcttcgtgtggcaggatcgatttattcacaattcgcaagaggcactattgatatccgtaactatttcaattttaaaaataagaataaaattgctgtaagattttacacaggcattggaaaagcctatggaaattcttctacattaccctatataaaacaatttttcagtggtggccccaacagtataagggcatttcttatcaacagcgtaggcccgggtacccattacgaagctgaaaataatgaactggctttccttgaacagggtggcgacctgaagattgacggaaatgcagagtacagatgcaacctggtaagcattcttaaaggcgctgttttcattgatgcaggcaacatatggctgctcgacagtaatcctgccatcacgaagtaa

SEQ ID NO: 2446 - protein, 278 aa, Unknown
  Obtained from environmental sample
  DOMAIN (7)...(278): Surface antigen
  misc_feature (1)..(278): Xaa is any amino acid
MIDVRHDYLTLKLKCLGYYIPKTKFAFGYSYLKRVDYFNLTSFKFSYGYKWKENIKKDHELNPVNINYTRISNKSQRFNALLESNPFLKKSYEEQFIAGMTYAFTFNEQVIEKQKSQFYLNTTAELSGNALSLIKKTFYGQTPNPDDPLRVAGSIYSQFARGTIDIRNYFNFKNKNKIAVRFYTGIGKAYGNSSTLPYIKQFFSGGPNSIRAFLINSVGPGTHYEAENNELAFLEQGGDLKIDGNAEYRCNLVSILKGAVFIDAGNIWLLDSNPAITK

SEQ ID NO: 2447 - DNA, 582 bp, Unknown
  Obtained from environmental sample
  misc_feature (1)..(582): n is a, c, g, or t
atggatctgagcgccgagtattggaccaaacgttacgttgaaggagattttccgtgggacgccggcggcgttactactccgttgaaagaatacattgatcagctaaacgacaagaacatttcaattctcattcccggcgccggaaacgcgcatgaagctgaatacctcgttgacaaagggttcccgaatgtcaccgtccttgatctttcagatgcaccgcttaaacaattaaagaaaagatgtccttctataaatgacgagaaccttattcaacaggatttctttttacacgaaaaaaaatacgatctcatcattgaacaaactttcttttgcgccatcgacgtgaatttaagggcggcttatgccaaacaggctcattcgcttttgaaaccgggaggaaaattggtcggcattttattcgattgcgtattcgagaaacaaggtccgccctttggaggcagtaaagatgaatacctcaattattttgatccttattttgaatgcaaaattatggagaagtgttataactcaataaaaccccgcgagggaagagagttatttattaatttactcaggaaatga

SEQ ID NO: 2448 - protein, 193 aa, Unknown
  Obtained from environmental sample
  DOMAIN (3)...(193): Thiopurine S-methyltransferase (TPMT)
  misc_feature (1)..(193): Xaa is any amino acid
MDLSAEYWTKRYVEGDFPWDAGGVTTPLKEYIDQLNDKNISILIPGAGNAHEAEYLVDKGFPNVTVLDLSDAPLKQLKKRCPSINDENLIQQDFFLHEKKYDLIIEQTFFCAIDVNLRAAYAKQAHSLLKPGGKLVGILFDCVFEKQGPPFGGSKDEYLNYFDPYFECKIMEKCYNSIKPREGRELFINLLRK

SEQ ID NO: 2449 - DNA, 846 bp, Unknown
  Obtained from environmental sample
  misc_feature (1)..(846): n is a, c, g, or t
ttgctgacacaggtaatgaaggagatatccaatatagtggtcataaccgataaagaccagaagatcacctgggtaaatgacagtttcacccgcgccagcggttataccccggaagaagcaataggcaacagaccttcagcgctgttgaaaggacccgacaaggatcccaatgaagtcagcaaaatttcacaagccttaaaacgaggtgttcccgtgcagggggagatcctgaactacgcgaaatcgggaagggcttactggtgcgactataatatccacccggttcgggatgaaaatggtgaggtctgcaagtttttctccatccagcgcgacgtaacggaatttaaatcagcacaggaagagatacaaagacagaaaatagagtatcaccagaagattgcgacggcaaaactgaaagcccaggaagaaaagcaaacacagatcgggcaggagttgcacgacaatatcaaccagatccttgcagtctcacagttatataccggaatgatcgagcagggaaaaggagatttgaagaaaaatgcagctcttgttggtaagtatatccggatggccatcagtgaaatccgcagcctctcgcaccagcttgtcgagtctcgattcaatgagcgccctttttccgaaatatgcaaatccatatttaaaaatgtcgcgcncggaacccgtgtntcttttaatatggatatcgataaagaacagttggtgtcgcaggaaatcaaactcactttgtacaggatcatccaggagcaattcaataatattcataaatacgcgaaggcaaagaccaattaccttgcctttaaggaagaagcagtttccatcgaatga

SEQ ID NO: 2450 - protein, 281 aa, Unknown
  Obtained from environmental sample
  DOMAIN (73)...(115): PAC motif
  misc_feature (1)..(281): Xaa is any amino acid
MLTQVMKEISNIVVITDKDQKITWVNDSFTRASGYTPEEAIGNRPSALLKGPDKDPNEVSKISQALKRGVPVQGEILNYAKSGRAYWCDYNIHPVRDENGEVCKFFSIQRDVTEFKSAQEEIQRQKIEYHQKIATAKLKAQEEKQTQIGQELHDNINQILAVSQLYTGMIEQGKGDLKKNAALVGKYIRMAISEIRSLSHQLVESRFNERPFSEICKSIFKNVAXGTRVSFNMDIDKEQLVSQEIKLTLYRIIQEQFNNIHKYAKAKTNYLAFKEEAVSIE

SEQ ID NO: 2451 - DNA, 606 bp, Unknown
  Obtained from environmental sample
  misc_feature (1)..(606): n is a, c, g, or t
ttggtaccaggagttttacaacatatttcccggtacatattagcaaaacttacagaagaattatataaaccggaatactcaaaatccaacagctcaagtgaggtttttggtacaacatatgggattaccttaatttttaaaagtgaatttatccctattgttaaatataacctgcctatactaagtgattatattgatactgccttatgcctggatgcaaacctttttttcctgaatgcccttatcctggaaaaaaactctgatgtaaaaaaacatacagatacttcaatggcaagatataacccgggaaaaataaactttcccttaagggtaagcgtcctttatgttgattttcctgaaatggagggaggagagctctgcctctataaaacaaactcttcagagatttttaaaaaaataaaaccggaaaaaggtaaactgctttttttcaaaggcactctaccacacgaagtaacacaaattaccaatataatgactcccgataaaggcaaaagattaagtgtggtttgcgaacaatatcatgtggacgcggaaggattaattccgattaccgggttttcatccgatctgccgataaagttatga

SEQ ID NO: 2452 - protein, 201 aa, Unknown
  Obtained from environmental sample
  misc_feature (1)..(201): Xaa is any amino acid
MVPGVLQHISRYILAKLTEELYKPEYSKSNSSSEVFGTTYGITLIFKSEFIPIVKYNLPILSDYIDTALCLDANLFFLNALILEKNSDVKKHTDTSMARYNPGKINFPLRVSVLYVDFPEMEGGELCLYKTNSSEIFKKIKPEKGKLLFFKGTLPHEVTQITNIMTPDKGKRLSVVCEQYHVDAEGLIPITGFSSDLPIKL

SEQ ID NO: 2453 - DNA, 351 bp, Unknown
  Obtained from environmental sample
  misc_feature (1)..(351): n is a, c, g, or t
gtgaagaatatttgtcttattcttgagtatgacggcaccgccttcaatggtttccagaaacagcctgataaaagtctcagaacaattcagggtgaattagaaaaagcgatattaaaaatcacgggaagtgaaattaatattaccggtgccggcaggactgactcaggggttagcgcctctgaacagtttgttaatttttttacggatgttaatatccctccggaaaaattctgcatggcactgaatacaaaacttccgccggaaattagcatttacaaatcatttgaagtgccgattgattttaatgcccggtattcagctatccgcaggacttaccggtataaaatttaa

SEQ ID NO: 2454 - protein, 116 aa, Unknown
  Obtained from environmental sample
  DOMAIN (6)...(106): tRNA pseudouridine synthase
  misc_feature (1)..(116): Xaa is any amino acid
MKNICLILEYDGTAFNGFQKQPDKSLRTIQGELEKAILKITGSEINITGAGRTDSGVSASEQFVNFFTDVNIPPEKFCMALNTKLPPEISIYKSFEVPIDFNARYSAIRRTYRYKI

SEQ ID NO: 2455 - DNA, 423 bp, Unknown
  Obtained from environmental sample
  misc_feature (1)..(423): n is a, c, g, or t
atgtttatcgaagttggtgatgatattaagaaaactgtattggactattttggtctgaaatcttatgtagactttagattagccgaaatatttaatgattcagctatccataacatagatggagatagcgatgcatcgcaaaatggggaccaggtgttttggaataatgcgataaataaaaaaattcaggcaggggataagatcaggttgtatggatctcagatctcttcgtggtttccacgcaaaccaggcttgtattggaccaaagacgccaagaaggccagggaatatgccatgaaacaccatcgggaaaaagtccacccagatggtattgtattggatgttgttcgggtaaaatcttatgaccgaattaggccgagttggatgtgtgaattttaccaaaagatcgtgatgaagttttaa

SEQ ID NO: 2456 - protein, 140 aa, Unknown
  Obtained from environmental sample
  misc_feature (1)..(140): Xaa is any amino acid
MFIEVGDDIKKTVLDYFGLKSYVDFRLAEIFNDSAIHNIDGDSDASQNGDQVFWNNAINKKIQAGDKIRLYGSQISSWFPRKPGLYWTKDAKKAREYAMKHHREKVHPDGIVLDVVRVKSYDRIRPSWMCEFYQKIVMKF

SEQ ID NO: 2457 - DNA, 774 bp, Unknown
  Obtained from environmental sample
  misc_feature (1)..(774): n is a, c, g, or t
atgttaaatgtttttcctagtgcaaaagtttttcctattccgccaactttagccgatctaatttggaacaggattcatgttttgcctatagaaaaacttttgggaaaaattgacgttattcatacttccgactggaccgaacctccttctagtgcatttaaagttactactgtccacgatctggcaccttttttgtatcccaacctttttcctaaagatatggttagaaatattgtaaatactcataaatttaagctaagtttggtgaaaatggaatgcaacagagtaattgttcccacaaatgcaaccaaaggcgatttaataaatcttgggtttaatagtgaagttataagagtaatacccgaagctgtctccgagaattttaaaagagctcaggataatgaaattgatattgttaaaaagaaatataacattcacggaaagtatttacttgttgtgggaacagatcccagaaagaatgtaattagaataattaaagcttttgaacacgcttcggctggtcgtgatgtaaaacttgtatttattgggcaatcaaagtatttaacaattaaagacagtagaaatattcgcatattgggacacgtagcagcaagttctctccctgcactttattccggcagtgaagcgttggtttatccatcgctttacgaaggattcggcttgccaattttagaagctatgtcttgcggatgttctgttataacttcagatatttcttctatgaaagaagttcgggtgnngcagcgattttag

SEQ ID NO: 2458 - protein, 257 aa, Unknown
  Obtained from environmental sample
  DOMAIN (136)...(257): Glycosyl transferases group 1
  misc_feature (1)..(257): Xaa is any amino acid
MLNVFPSAKVFPIPPTLADLIWNRIHVLPIEKLLGKIDVIHTSDWTEPPSSAFKVTTVHDLAPFLYPNLFPKDMVRNIVNTHKFKLSLVKMECNRVIVPTNATKGDLINLGFNSEVIRVIPEAVSENFKRAQDNEIDIVKKKYNIHGKYLLVVGTDPRKNVIRIIKAFEHASAGRDVKLVFIGQSKYLTIKDSRNIRILGHVAASSLPALYSGSEALVYPSLYEGFGLPILEAMSCGCSVITSDISSMKEVRVXQRF

SEQ ID NO: 2459 - DNA, 837 bp, Unknown
  Obtained from environmental sample
  misc_feature (1)..(837): n is a, c, g, or t
atgaaactattatttgatcatctgtcgagtgaggtatgtaaaataaccacacgaacgtatagtaccagtttttcccttggtatttattttttaaataatcgcctgcgaaattctatttattctatctatggctttgtacggctggcagatgaaattgtagatagttttgaaggttacaacaaaaggtatttactcgcaaaatttaagcaggatacttacgaagctattgagcatcgcatatcctgtaaccctatgctcaatgcatttcaggatgtggtttaccggtatgacattgatattgtcctggtagaaacttttttaaagagcatggaaatggacctcgaaaaacagtgctacacaactgaaaaatacgaggagtatattttaggctctgcggaagttgttgggttaatgtgcctgcatgtatttaccgaaggtgataaaaaaatgtttgaagagttaaaaccttacgcgatgaaattgggcgctgcttatcaaaaagtaaattttttaagagacatgaaggatgacttccatattttaggaaggatttattttcccggagttgacatgagccagtttaactctaagacaaaacaaaaaatagaaactgaaattgaacaggatttcatgattgctcttcagggtatcaaaaaattaccttcttcctctaaaggaggtgtttatctctcatatgtatattatcaatcgctattcaataaaatcaaaaaattacgagctcatcaaatattaaaaaaacgtatcaggataagtaatagcaaaaaattgcaattaatggtcaacagtttgctggagtataaaatgaatatgatatga

SEQ ID NO: 2460 - protein, 278 aa, Unknown
  Obtained from environmental sample
  DOMAIN (17)...(275): Squalene/phytoene synthase
  misc_feature (1)..(278): Xaa is any amino acid
MKLLFDHLSSEVCKITTRTYSTSFSLGIYFLNNRLRNSIYSIYGFVRLADEIVDSFEGYNKRYLLAKFKQDTYEAIEHRISCNPMLNAFQDVVYRYDIDIVLVETFLKSMEMDLEKQCYTTEKYEEYILGSAEVVGLMCLHVFTEGDKKMFEELKPYAMKLGAAYQKVNFLRDMKDDFHILGRIYFPGVDMSQFNSKTKQKIETEIEQDFMIALQGIKKLPSSSKGGVYLSYVYYQSLFNKIKKLRAHQILKKRIRISNSKKLQLMVNSLLEYKMNMI

SEQ ID NO: 2461 - DNA, 753 bp, Unknown
  Obtained from environmental sample
  misc_feature (1)..(753): n is a, c, g, or t
gtgatcgtgtgccgtaccgaagagccgctcaaccaggacatcaaacgcaagattgcccagttctgcaacgtaaaagtagaagcggtgatcgaggcaccggacgccagcaccatctacgaagtgccccttttaatgatgaatgaaaagctggacctgatcgtactgaaaaaattgaacatcacaaagttccatgaacctgatctaagccgctggaaggaatttctggacaagctgaaataccccaaagcccgcatcaccattggtttgatcgggaaatatgtagagttacaggatgcttataaatccatcctcgaagcatttgttcatgccggggcgatgaacgagtgcaaagtgcaggttgtatctatccattcggaatttattacaccggaaaacgtagcggaaaaattatcaaacctcgacggattactggtagctcccggttttggtcaccgcggtatcgaaggaaaaataaccgccgtgcaatatgcaagggaaagtggcctgccattttttggtatttgcctgggaatgcagatggccgtgatcgagtacggtcgtcatgtgcttggcatcaatgaggcgcagtcaacagagatggacccgaatgccaccgaacccgttatagacatgatggaagaaccaaaaaaagatcccggcaaaaggaggaaccatgcgctttggttcttatccctgcgagatcaggcagggctcactggcacagaagatctacggcaccttaaacatcaatga

SEQ ID NO: 2462 - protein, 250 aa, Unknown
  Obtained from environmental sample
  DOMAIN (1)...(73): CTP synthase N-terminus
  misc_feature (1)..(250): Xaa is any amino acid
MIVCRTEEPLNQDIKRKIAQFCNVKVEAVIEAPDASTIYEVPLLMMNEKLDLIVLKKLNITKFHEPDLSRWKEFLDKLKYPKARITIGLIGKYVELQDAYKSILEAFVHAGAMNECKVQVVSIHSEFITPENVAEKLSNLDGLLVAPGFGHRGIEGKITAVQYARESGLPFFGICLGMQMAVIEYGRHVLGINEAQSTEMDPNATEPVIDMMEEPKKDPGKRRNHALWFLSLRDQAGLTGTEDLRHLKHQ

SEQ ID NO: 2463 - DNA, 795 bp, Unknown
  Obtained from environmental sample
  misc_feature (1)..(795): n is a, c, g, or t
atggcaaagacatctaagaatgtcctcaagtttctaaatagtcttcaggaaaaactaaaacaaagaaatacaattgacttaaagaaactcttggacttcaagaaaaccattattcccaatgccagtcaactcaatgcatgggacctacgttttctctcttatcaacttaaaaagaaggactatcaactcgatgatgaaaagatcagagaatatttcccaactcacactgtcatcgaaggactttttaaagtttattccaatcttctgggtgttgaatttaccccagtcctagatgcaaaaacttgggctgacggagttcaactctatcaaattcgagatcaggatgatcactcccttttgggatacttttttaccgactttatcccgagaaaaggaaaatatggacatgccgcagccttcactctccattcaggtaaaatattaaacgatggaaagtattcccacccaatttcagctattgtggctaactttacgccacctgaagcagggaagcctgttttactaactcataatgaagtagaaacattatttcatgaatttggccatatcatgcaccaaactctcactcgtgcaccttttgcaagcttgtctggatcaaatgtcgatcaagactttgtagaagcaccttctcaaatgttggaaaactgggtttattcccctgagattctaaccttattgtcaggccactataaaatgcccgataaaaaacttcctattgaactcattcaacaaatcgtaaaagctcgcgatttcaccaaggatattttatactag

SEQ ID NO: 2464 - protein, 264 aa, Unknown
  Obtained from environmental sample
  DOMAIN (1)...(264): Peptidase family M3
  misc_feature (1)..(264): Xaa is any amino acid
MAKTSKNVLKFLNSLQEKLKQRNTIDLKKLLDFKKTIIPNASQLNAWDLRFLSYQLKKKDYQLDDEKIREYFPTHTVIEGLFKVYSNLLGVEFTPVLDAKTWADGVQLYQIRDQDDHSLLGYFFTDFIPRKGKYGHAAAFTLHSGKILNDGKYSHPISAIVANFTPPEAGKPVLLTHNEVETLFHEFGHIMHQTLTRAPFASLSGSNVDQDFVEAPSQMLENWVYSPEILTLLSGHYKMPDKKLPIELIQQIVKARDFTKDILY

SEQ ID NO: 2465 - DNA, 945 bp, Unknown
  Obtained from environmental sample
  misc_feature (1)..(945): n is a, c, g, or t
gtgatcaagaatgtgcacgacagaccattgctaaaacaatatgttgctgaccgaaaggcagaccttgaattaattgcgaaagattatgaaatactattgaaggttgctaccaaaaataaattcaacattaaagaaccattcaagtattcaatgataagaatatttgcagaagcctccggcttatctgcaaaaggaaagaaaaacttatcaaataagttctttacagatattgtacgcaaacgagaaaaagacggcaacccatttaccatagagtacataattaaccgttccacttccgttgactggtcaatacttgacttgttttatcaactcaatggcttccgccattttcgtgatatgtacgcaatggctcaaaatggaactgatgaaggtcctatctgcaatttgggtttaatcactcaatacatttcccgattcatggaggagtattctactgttatcacagcatcctacatgagtgaagaaaaattttctcacagcttattttcttcatacacctatgctttgtatcgcttaggtgaagcagagtatgaagatgcagacgacccatttccgaaaggacgtatttcatttcttaccattcaccaatcaaaagggttggagtttccggtagtggttttaggtagtgtagataaaagagaaagagcagcagaccaaaaagaattgatagtaagggaactgttaaacaaggaaggtgagccattggagaaaatttccaagtttgataatatgagaatgttttatgtggcattgagtagagcaaagaatttattagtgctaacaagaattacaacaacaagaagtgaaaacacagttccaagagcagaaccgncttatgctactgatgaatttaaaccttctttactacgaatagtttacagntattnccgatttgatataagcacaatacaagcacagcattga

SEQ ID NO: 2466 - protein, 314 aa, Unknown
  Obtained from environmental sample
  misc_feature (1)..(314): Xaa is any amino acid
MIKNVHDRPLLKQYVADRKADLELIAKDYEILLKVATKNKFNIKEPFKYSMIRIFAEASGLSAKGKKNLSNKFFTDIVRKREKDGNPFTIEYIINRSTSVDWSILDLFYQLNGFRHFRDMYAMAQNGTDEGPICNLGLITQYISRFMEEYSTVITASYMSEEKFSHSLFSSYTYALYRLGEAEYEDADDPFPKGRISFLTIHQSKGLEFPVVVLGSVDKRERAADQKELIVRELLNKEGEPLEKISKFDNMRMFYVALSRAKNLLVLTRITTTRSENTVPRAEPXYATDEFKPSLLRIVYXYXRFDISTIQAQH

SEQ ID NO: 2467 - DNA, 309 bp, Unknown
  Obtained from environmental sample
  misc_feature (1)..(309): n is a, c, g, or t
atgagttttgacgaaaactgtttgtctttacttccgaaacaattttcttttttaattaatccattaaattcacaaactatttcatttgacaacgcttcaaaagtaagagtgaagacactttttgaaactctgaataacatattgaattcggagaaggacgaaaaaaacggcgaggttattttagcatatcttaattcactcctgacagagatcaacagtgcctattttaaaactgttgtgaaggagaatttaatgcctcataaactttctaaatacattgaatttaagacgacggtgaaactaatttaa

SEQ ID NO: 2468 - protein, 102 aa, Unknown
  Obtained from environmental sample
  misc_feature (1)..(102): Xaa is any amino acid
MSFDENCLSLLPKQFSFLINPLNSQTISFDNASKVRVKTLFETLNNILNSEKDEKNGEVILAYLNSLLTEINSAYFKTVVKENLMPHKLSKYIEFKTTVKLI

SEQ ID NO: 2469 - DNA, 792 bp, Unknown
  Obtained from environmental sample
  misc_feature (1)..(792): n is a, c, g, or t
gtggcaaaaacatcgatgattcggattgttacacacattacagcagctgacagcggcgaggtgttgcttaacaacgagccgttacgcgaagatcattctgcaatcatcggttacatgccggaagagcgcggtctgtataaaaaaatgaaagtgtgggaacagctcgtttacctcgcacgattgaaaggtttgtcgaacacggatgcacgagcgaaggtgtcatactggatggaaaagctgaacatcaaagagtggtggaacaagaaggtagaagagttgtcaaaaggcatgggtcagaaaattcagttcatctccaccgtggtacatgatccaaagcttatcattctcgacgagccgttctccggtcttgatcctatcaacgcaaacctgattcaaaacgagatttacgagttgaagcaaaaaggtgcgacggttattttctccacgcaccgcatggaacaggtggaagaaatctgtgagaacatcgcgctgatcaataaaggaaaaataattttgagcggcaatgtatctgagatcaagcaccgttttaaagaagacattttcaaagtagagtttgaaggctctgcaccgcaactgcgcgaagattatttcccggtacaacatcagaatgaatgctcgcttctgctcaagatgaaccacggcgctacgctgcgcgatttactcaaaacactggccgaccaggatgttcacgtaacgagtttccgcgaaatcctgccgtcgctcaacgaaatttttattcaacaagtaacagccgctaaagcccatgcgtaa

SEQ ID NO: 2470 - protein, 263 aa, Unknown
  Obtained from environmental sample
  DOMAIN (3)...(168): ABC transporter
  misc_feature (1)..(263): Xaa is any amino acid
MAKTSMIRIVTHITAADSGEVLLNNEPLREDHSAIIGYMPEERGLYKKMKVWEQLVYLARLKGLSNTDARAKVSYWMEKLNIKEWWNKKVEELSKGMGQKIQFISTVVHDPKLIILDEPFSGLDPINANLIQNEIYELKQKGATVIFSTHRMEQVEEICENIALINKGKIILSGNVSEIKHRFKEDIFKVEFEGSAPQLREDYFPVQHQNECSLLLKMNHGATLRDLLKTLADQDVHVTSFREILPSLNEIFIQQVTAAKAHA

SEQ ID NO: 2471 - DNA, 912 bp, Unknown
  Obtained from environmental sample
  misc_feature (1)..(912): n is a, c, g, or t
ttgacatataaccagttggtatcaattacatttgatgcacattttcgcattactgcctgtagggaatacttagataaaaaactaaataacagtgatcattttttttatggcattaatactggctttggctatttacaaaatgtaaaaattgatactgatcaactgcaagaattacaaagcaacttaattaaatcgcatgcttgtggcctaggagaagaagtaccaaaagagatagtaaaattaatgatgatgttaaaaatcaaatcattaagttatgggcattcgggtgtacaaattgatacggtaaagcgattgatggatatgtataataatgatgtacttcctgtaatttatacgcaaggttctttaggagcatcaggagatttagcaccattgagccatttaagcttaccattgttaggtttaggcgaagtctgtcacgaaggaaaaaaaatgcaatcagccgatgcattgaaaaaatttgattggaaacctatacaattacaaagtaaggaaggactggctttaattaatggcactcagtttatgagtgcatatggattatataatttaatgcaggcagatcgattattaaaatgggcagatattattgctgccatttcatttgatgcatttaattgtactattgaaccactgcatgaaaaaatacattcgataaggtctcacaaagggcaggtacataccgcagcaagattaagggaattattaaaagatagcaaaattgctgctcaaaaaaaatcacaggtacaagacccttattcatttagatgtataccccaggtgcatggtgctacaaaagatacatttaattatgtattaagtgtttttatgaaagaagtaaattcggtaaccgataatcctaatgtttttcctgaggaagacctaatgtaa

SEQ ID NO: 2472 - protein, 303 aa, Unknown
  Obtained from environmental sample
  DOMAIN (1)...(301): Phenylalanine and histidine ammonia-lyase
  misc_feature (1)..(303): Xaa is any amino acid
MTYNQLVSITFDAHFRITACREYLDKKLNNSDHFFYGINTGFGYLQNVKIDTDQLQELQSNLIKSHACGLGEEVPKEIVKLMMMLKIKSLSYGHSGVQIDTVKRLMDMYNNDVLPVIYTQGSLGASGDLAPLSHLSLPLLGLGEVCHEGKKMQSADALKKFDWKPIQLQSKEGLALINGTQFMSAYGLYNLMQADRLLKWADIIAAISFDAFNCTIEPLHEKIHSIRSHKGQVHTAARLRELLKDSKIAAQKKSQVQDPYSFRCIPQVHGATKDTFNYVLSVFMKEVNSVTDNPNVFPEEDLM

SEQ ID NO: 2473 - DNA, 366 bp, Unknown
  Obtained from environmental sample
  misc_feature (1)..(366): n is a, c, g, or t
ttgctgatctatgcgccggggagaaatacaaaactgcttcctttcgatcatttgggcatcattgctaccgacgaacagatgcaggttttcaaaccagtatttgataccgctgaaaaaattgaccctaaagaatataacatagaagatattattgtacaaaaaatagtggtagatgagcataataaacttaagggacaaacaatacgcggatcaggcataagagaacgcactaacggcctggtagtaggaattgaaagaaataaagaaagaatgctcaatcctgactcaactaccgtattggaatggggcgatattgtatggatagtaggggaaagaaaaaagatacagcaattgaataaaggttga

SEQ ID NO: 2474 - protein, 121 aa, Unknown
  Obtained from environmental sample
  DOMAIN (52)...(120): TrkA-C domain
  misc_feature (1)..(121): Xaa is any amino acid
MLIYAPGRNTKLLPFDHLGIIATDEQMQVFKPVFDTAEKIDPKEYNIEDIIVQKIVVDEHNKLKGQTIRGSGIRERTNGLVVGIERNKERMLNPDSTTVLEWGDIVWIVGERKKIQQLNKG

SEQ ID NO: 2475 - DNA, 342 bp, Unknown
  Obtained from environmental sample
  misc_feature (1)..(342): n is a, c, g, or t
ttgataaaggaaaaagttgctgtgctggtagccgtgaccccggagaaacctgaacaggttgccaaaacaatcgaaaaaacaaaggctgagtttccgattctttatgatgaagggctgaaaatcatgaaagcttacgaagtagaattcgagttgcaggaaaatactattacccgttaccggaattccggtattgacctcgaaaagatcaatggaaaggattggaagtttttaccagtgccggctgtctacattatcgataaagagtcaaatattacctatcgcttttttgatacggattataaaaaacggccgagtgtgcaggatatccttgccaatctataa

SEQ ID NO: 2476 - protein, 113 aa, Unknown
  Obtained from environmental sample
  misc_feature (1)..(113): Xaa is any amino acid
MIKEKVAVLVAVTPEKPEQVAKTIEKTKAEFPILYDEGLKIMKAYEVEFELQENTITRYRNSGIDLEKINGKDWKFLPVPAVYIIDKESNITYRFFDTDYKKRPSVQDILANL

SEQ ID NO: 2477 - DNA, 402 bp, Unknown
  Obtained from environmental sample
  misc_feature (1)..(402): n is a, c, g, or t
gtgatttttttctctgatcttgttcgaatgattgatctgccggtggagtttgattttatccgcgcttcttcttatggaaatgaattatcatcctcgggggatgtgaaaatttccaaggatctttcaggatccatcagtgacaagcatgttcttgttattgaggatattatcgacaccggaattacactcaacttcttgctggatctttttaaatctcgcaatcccaaatccatcaagctctgcgctttacttcacaaaccttccaacaaagttaaagatgttaaaattgattatcttggcttcaccattgataatcattttgtagttggatatggcctggacgccgccgaaaagtaccgcaatcttgattttgttggaatttataaaaatccaagcaactaa

SEQ ID NO: 2478 - protein, 133 aa, Unknown
  Obtained from environmental sample
  DOMAIN (1)...(104): Phosphoribosyl transferase domain
  misc_feature (1)..(133): Xaa is any amino acid
MIFFSDLVRMIDLPVEFDFIRASSYGNELSSSGDVKISKDLSGSISDKHVLVIEDIIDTGITLNFLLDLFKSRNPKSIKLCALLHKPSNKVKDVKIDYLGFTIDNHFVVGYGLDAAEKYRNLDFVGIYKNPSN

SEQ ID NO: 2479 - DNA, 492 bp, Unknown
  Obtained from environmental sample
  misc_feature (1)..(492): n is a, c, g, or t
ttggttaaacttgaattgaatcgaaaactaaaatggacttccattgatggttttggaaatcctgatcttgcacctggtgaaattgccagccttggaaaactcaacggtaaggcctattttacgggaactttcctaagcacacttccgtttgcttacaattatggattgattaaagattcccctttgtatttggaattcaaagataatgagatcatccatagcaaaggaatctctaaagactttgaggagcaattttctgattttttaaaataccgattgtcgaatcgaaaggttgaagaagtaggtattggtaccaatccatccgtgcgacttcatgcgattaatgctggctttgaagaacgacatgttggtctgcatttggggctgggcggagctgaggctggcagcaaccatgtagacttaatttttcaagagggtgaaattttgttcgatgacaaagttattattcgcgatgaaaaaatcttgatttag

SEQ ID NO: 2480 - protein, 163 aa, Unknown
  Obtained from environmental sample
  misc_feature (1)..(163): Xaa is any amino acid
MVKLELNRKLKWTSIDGFGNPDLAPGEIASLGKLNGKAYFTGTFLSTLPFAYNYGLIKDSPLYLEFKDNEIIHSKGISKDFEEQFSDFLKYRLSNRKVEEVGIGTNPSVRLHAINAGFEERHVGLHLGLGGAEAGSNHVDLIFQEGEILFDDKVIIRDEKILI

SEQ ID NO: 2481 - DNA, 402 bp, Unknown; identical to SEQ ID NO: 2477
  Obtained from environmental sample
  misc_feature (1)..(402): n is a, c, g, or t

SEQ ID NO: 2482 - protein, 133 aa, Unknown; identical to SEQ ID NO: 2478
  Obtained from environmental sample
  DOMAIN (1)...(104): Phosphoribosyl transferase domain
  misc_feature (1)..(133): Xaa is any amino acid

SEQ ID NO: 2483 - DNA, 924 bp, Unknown
  Obtained from environmental sample
  misc_feature (1)..(924): n is a, c, g, or t
atggacggcgtttggaggtgcggtgggatcagaagctcggtttatgatatgctgaaatttctcgcagcacaaatgggtctgaccatatcgccgttgaaagatgctattgagctcacgcaggtcccccggcatgacaaagcaggcaacacaagggttggcctgggctggcatatttcaaagagctttgacggagacatcgtttggcacaatggtgctacaggtggatatacttcgttcgcaggttttaataagaaaacaggcaagggtgttgtagtcctgacaaattcaaacgcatccgttgatgacattggatttcatttgctcgatcctgattcaccattgaaacctgtgttgacacatgtttctgtattgctgaaagatatcatcgatgtagaaggttgtgcaggtctcgtgtcaggctatgataaaatcaaaaaagaacatccggacaaatatgattacagcgaaaccggcctgaatgagcttggctattattacctgcgccgtaaacagtttaaagatgcacaatctgtttttttactcaacatccgcgaatatcccaattcggcaaatgtctatgacagctatgcagaatcgctgatcgaggacggacagaaggagcaggccattgaattctacaataaatcccttgagattaatcccggcaatatcaatgccatcgagatgctggcgaagatgggcgtgaaaaaggaatttgcagtcattcaggttgataccgctatcctcgaatcctatgtcggcatctaccaactagtacccggatttgatatcaccatttccaggaaggaagatcgtttgttagcccgcgcttccggtcaatccgaatatgagatatttccgaaaaacggaaatgagttttattacaaagaagtggatgcgcagaatgtcttttataaaaaatga

SEQ ID NO: 2484 - protein, 307 aa, Unknown
  Obtained from environmental sample
  misc_feature (1)..(307): Xaa is any amino acid
MDGVWRCGGIRSSVYDMLKFLAAQMGLTISPLKDAIELTQVPRHDKAGNTRVGLGWHISKSFDGDIVWHNGATGGYTSFAGFNKKTGKGVVVLTNSNASVDDIGFHLLDPDSPLKPVLTHVSVLLKDIIDVEGCAGLVSGYDKIKKEHPDKYDYSETGLNELGYYYLRRKQFKDAQSVFLLNIREYPNSANVYDSYAESLIEDGQKEQAIEFYNKSLEINPGNINAIEMLAKMGVKKEFAVIQVDTAILESYVGIYQLVPGFDITISRKEDRLLARASGQSEYEIFPKNGNEFYYKEVDAQNVFYKK

SEQ ID NO: 2485 - DNA, 657 bp, Unknown
  Obtained from environmental sample
  misc_feature (1)..(657): n is a, c, g, or t
ttgcaccgtgttacacggcttggaatggttttcgcatacaccgtgaacatcagcaggcgtatcatgaatcccaacatcaaaaagtggctcatccggccgctcatcattctttcgatttcgatcaccacacttttggcgattacttttatcctagtttccctagaacaagatcgacttgttaatattgccgttcacgaactcaacgaaaacttcaagggcgagcttacggtcgaagaaaacgagatttcccttttcaaacattttccttacgtttccatcgcactccaccatggaaaattctttcccgacaaatcgaaagctcaaaaaccgatctgcgaattcgaacaactatacgtagggtttaacctgcatgagttgattcagcaccactacaatgtcaaagtcctgtatgtgcaaaacggatatgtagatctggtccaagatgaaaaaggtaaaatcaacctgcttgaagccgaaaaatcagaacctttgccttctactaccacctccaaaaaagatacctcgtcctccatcgcgatcaatctcgacaagatcgtgtttcgcagtatgaagatctcttatctccatgttagcagcggtcaaaaagtaagtgcgcgcatcgaaaaactttcctcctctttcaaatcgacagtctaa

SEQ ID NO: 2486 - protein, 218 aa, Unknown
  Obtained from environmental sample
  misc_feature (1)..(218): Xaa is any amino acid
MHRVTRLGMVFAYTVNISRRIMNPNIKKWLIRPLIILSISITTLLAITFILVSLEQDRLVNIAVHELNENFKGELTVEENEISLFKHFPYVSIALHHGKFFPDKSKAQKPICEFEQLYVGFNLHELIQHHYNVKVLYVQNGYVDLVQDEKGKINLLEAEKSEPLPSTTTSKKDTSSSIAINLDKIVFRSMKISYLHVSSGQKVSARIEKLSSSFKSTV

SEQ ID NO: 2487 - DNA, 393 bp, Unknown
  Obtained from environmental sample
  misc_feature (1)..(393): n is a, c, g, or t
ttggcactgagcctggcgttggaagaacttccacatgatagcgcaacaaaaattgtttttattgcgccggctgcagaaactaaaaccgctattgataacttttttaaactgttacagttaaatggcgatgtgcggaaagattttgatgatatcattgaagaaaccggtggcaaacctccggagtggtactctttttcgagggtggcggcgaaaataaaggggcaggtactattcttgcaggataaagatgatcacatgacgcccctatccgatgtaaaaccgatcatgaatagaaactattccaattttcattttgttatttccgaagggttgggccaccgaagaatttaccgcgatgaacaatccttggagaaaataatagacttcttgtaa

SEQ ID NO: 2488 - protein, 130 aa, Unknown
  Obtained from environmental sample
  misc_feature (1)..(130): Xaa is any amino acid
MALSLALEELPHDSATKIVFIAPAAETKTAIDNFFKLLQLNGDVRKDFDDIIEETGGKPPEWYSFSRVAAKIKGQVLFLQDKDDHMTPLSDVKPIMNRNYSNFHFVISEGLGHRRIYRDEQSLEKIIDFL

SEQ ID NO: 2489 - DNA, 672 bp, Unknown; identical to SEQ ID NO: 321
  Obtained from environmental sample
  misc_feature (1)..(672): n is a, c, g, or t

SEQ ID NO: 2490 - protein, 223 aa, Unknown; identical to SEQ ID NO: 322
  Obtained from environmental sample
  misc_feature (1)..(223): Xaa is any amino acid

SEQ ID NO: 2491 - DNA, 888 bp, Unknown
  Obtained from environmental sample
  misc_feature (1)..(888): n is a, c, g, or t
ttgatattccccgttccaaaatggttgaaaaaatctttggaactgtttccccggttgcgaagatttaaaattttattcggatttcaaaaggcatcagagcttcaacaagccgtaaaattcagagagtattatcatccattaaaattgtgggtagaaataaatgcatatgccattgaaggcagtttgtctattttttttaaagacgttacttttcaaaaagagcaggagagaaaaattcgggaactgaatgagcgctattcccacataatggattttatttctgaggccatctgggagtggaagattggtgagcccactgcaacctggtttggaaataacctttcaaaacttttggactggaattcgtctgattgcggatccgtgaaaacatgggaggatgctattcatcccgatgatgtacaaagagtaaaaaatagatttgaatctgcggttagtaacggtgaaatttattactcccaggaataccggcttatgaaaggaaacggtgattttatttatgtccgcgacagggcacatatcattagaaacaaggagggagtttgcattaaagtaattggtgtaacagatgatatttcggatcaaaaaaagtttcaggatgttttattagaaagtgtaaccaaggtggctatagcctcgcaggaaaaggaaagaaccaggctgggcagggaattgcacgataatgtaaaccagatactaaccgcttccaaacttttttttgaaaatgttgaatttcatcctgaaaagagagaagaatttacaggtatgggaattgaacttctgaaaaacgccatcagcgaaatcaggattttatcaaaatcgctggtaacgccctgcctgaatagttccaattttaatgagacgatttaa

SEQ ID NO: 2492 - protein, 295 aa, Unknown
  Obtained from environmental sample
  misc_feature (1)..(295): Xaa is any amino acid
MIFPVPKWLKKSLELFPRLRRFKILFGFQKASELQQAVKFREYYHPLKLWVEINAYAIEGSLSIFFKDVTFQKEQERKIRELNERYSHIMDFISEAIWEWKIGEPTATWFGNNLSKLLDWNSSDCGSVKTWEDAIHPDDVQRVKNRFESAVSNGEIYYSQEYRLMKGNGDFIYVRDRAHIIRNKEGVCIKVIGVTDDISDQKKFQDVLLESVTKVAIASQEKERTRLGRELHDNVNQILTASKLFFENVEFHPEKREEFTGMGIELLKNAISEIRILSKSLVTPCLNSSNFNETI

SEQ ID NO: 2493 - DNA, 618 bp, Unknown
  Obtained from environmental sample
  misc_feature (1)..(618): n is a, c, g, or t
atgaatcccggcttgcttgatcttatcctgttttcagagaagagaaaagattttctcctgctcctgaaagaaggccctaagaatattgaagagatacttgagaagcttcaggtgcctaggacagctcttcttccacaggtaaagaagttgaaagaagaggatctggtaatacgtgaagaaggaatataccggctcagcacgataggggaaattgttgtagaaaaaatgcagcccctgcttgatactttgtcagtatttgagacaaatgaagagttttgggccgatagaaagcttgcccctattccaccccacctcataaaaaggattagtgagcttggagattatcgcgttatagaaccggacctcagccacacttttgacctgaacgaagaatttgtaaaaaatctttccagttcaagctatgtgcacatgttttgttcttatttccatcctcattttccgactctttttctcaaccttgcaagaaaaggtattgaagtttcccttattttgagtgaagctgtatacttacggctcgtagaagatttcaaagaagagggaaaagaactcctcagtacaaaaaattcaagcctttatattctggaaaaaaaaaagtga

SEQ ID NO: 2494 - protein, 205 aa, Unknown
  Obtained from environmental sample
  misc_feature (1)..(205): Xaa is any amino acid
MNPGLLDLILFSEKRKDFLLLLKEGPKNIEEILEKLQVPRTALLPQVKKLKEEDLVIREEGIYRLSTIGEIVVEKMQPLLDTLSVFETNEEFWADRKLAPIPPHLIKRISELGDYRVIEPDLSHTFDLNEEFVKNLSSSSYVHMFCSYFHPHFPTLFLNLARKGIEVSLILSEAVYLRLVEDFKEEGKELLSTKNSSLYILEKKK

SEQ ID NO: 2495 - DNA, 657 bp, Unknown
  Obtained from environmental sample
  misc_feature (1)..(657): n is a, c, g, or t
ttgagcccagaaatttccccgcttttgaaattcaccgataccgtaaaattagcgctcaactctataaaggtaaataagctgcgcacagtaatcaccagccttattatagctattggtattactgcgctggtgggcatactatcctccattgatgccatgaaaagctaccttagccagagtttttctgaaatgggggccaatacctttaatattaaaaaccgggcggggcagatacgcattggcggcaacagggccaagcgcaacgtggtatataaaaccattacgtttgatgaagcggtgaagtttaaaaaccagtttgtatttccttccgcgctcacttccatatccgtaaatgtttcttttgccagcacggtaaaatacggtactgaaaaaaccaatcccaacacgcttatcattggtatagacgagaattacctcacggtatcgggctataagctggccgagggccgcaatttcagccccggagatatggaaatgaattcgccggtgaccattataggtactgatatagtgaacaaggtttttaaaggggtgaaccccgtgggcaaagaaatatcggcaggaggggtgaagctgcaggtggtgggtgtgcttgaatctaaaggaaaatcagcgggggtttggcggcggcaataa

SEQ ID NO: 2496 - protein, 218 aa, Unknown
  Obtained from environmental sample
  misc_feature (1)..(218): Xaa is any amino acid
MSPEISPLLKFTDTVKLALNSIKVNKLRTVITSLIIAIGITALVGILSSIDAMKSYLSQSFSEMGANTFNIKNRAGQIRIGGNRAKRNVVYKTITFDEAVKFKNQFVFPSALTSISVNVSFASTVKYGTEKTNPNTLIIGIDENYLTVSGYKLAEGRNFSPGDMEMNSPVTIIGTDIVNKVFKGVNPVGKEISAGGVKLQVVGVLESKGKSAGVWRRQ

SEQ ID NO: 2497 - DNA, 621 bp, Unknown
  Obtained from environmental sample
  misc_feature (1)..(621): n is a, c, g, or t
ttgcttcagaattacaagagcaagaaaaaacagcaaacgaacaatcaaaagaacatcaaagtgtcaataccgcctgatgttcttgcagaactaaaaaaaccattaggaaagttaattccagatagcgatatcacagaaagaaaaattagaaaagaaattgcaggcattaaacacaaaataataacggtaggtgaccgttctacggagagacttatttcctttgatatatatcctgacttggcgataattgacggagttgagagaaggcaagaaaaaggtactaatttggctgatagaatgattggtttgaaagctaaagatgtaattagaatttcatgtattaatcctgcaggaaccattacaccggaagcaattactaaaattagatttgccctttcaaatgagaagaattttatcttgcaggttgtcggggaggaggatttattgacacttcccgtatgtttttttgcacctactaactcactagtgtgttatggtcaaccattggaagggctagttcttatcaaggttaataattctatgaggcgaaaagctaaagaattaatgaaatcaataaataataaactatcaacggggtatgatgatgtggtggctgtttga

SEQ ID NO: 2498 - protein, 206 aa, Unknown
  Obtained from environmental sample
  DOMAIN (23)...(195): Protein of unknown function (DUF359)
  misc_feature (1)..(206): Xaa is any amino acid
MLQNYKSKKKQQTNNQKNIKVSIPPDVLAELKKPLGKLIPDSDITERKIRKEIAGIKHKIITVGDRSTERLISFDIYPDLAIIDGVERRQEKGTNLADRMIGLKAKDVIRISCINPAGTITPEAITKIRFALSNEKNFILQVVGEEDLLTLPVCFFAPTNSLVCYGQPLEGLVLIKVNNSMRRKAKELMKSINNKLSTGYDDVVAV

SEQ ID NO: 2499 - DNA, 765 bp, Unknown
  Obtained from environmental sample
  misc_feature (1)..(765): n is a, c, g, or t
gtgggtctttcgggactctcaggtaacagcgcctttttttatgtccggagggtcatgagacaggaagtggcaacactggagaaaggaacacatgaaaaggtgtcattcgattttccgcttgagataaccaagcaatcggaaaccgaaggcgagttccatattgtcggctacgccgccaccaccgattttgaccttcaaggcgacgtcataacggaagaagccctcaaagaatcctctctcgatctcatcaagaattccaccgtccttttaaaccacgacatcaaacgcgccatcggcaaagtcacaaaggccgagttcgacaagaacggccttcttattgatgtcctcatctctcaaaccgaacccgaaatcatccagaagatcaaagagggcgtccttaacaaattttccattcgaggccaggtgctggagcgtgagaagaaatacatgcccgatctggaccgggtggtgaacgtcatcaagcgtatggcgctcgtggaagtgtcgctcgtgtccgtccccgccaatcccgaagctcgcgccatcggctggtacgtccagaaagcgctcgatgaaatcgattctcaacacacaggaggaaatcccatgtctcaggaagaaaccattattgaggagataaagccggaagacgaaaagcccgctgacggctcggctccccaggataaaccggcggacgccaaaccgaaacaccgccccagataccccaacgccgccagaatcagccgccgaaaaattcgccggtaa

SEQ ID NO: 2500 - protein, 254 aa, Unknown
  Obtained from environmental sample
  DOMAIN (37)...(208): Caudovirus prohead protease
  misc_feature (1)..(254): Xaa is any amino acid
MGLSGLSGNSAFFYVRRVMRQEVATLEKGTHEKVSFDFPLEITKQSETEGEFHIVGYAATTDFDLQGDVITEEALKESSLDLIKNSTVLLNHDIKRAIGKVTKAEFDKNGLLIDVLISQTEPEIIQKIKEGVLNKFSIRGQVLEREKKYMPDLDRVVNVIKRMALVEVSLVSVPANPEARAIGWYVQKALDEIDSQHTGGNPMSQEETIIEEIKPEDEKPADGSAPQDKPADAKPKHRPRYPNAARISRRKIRR

SEQ ID NO: 2501 - DNA, 741 bp, Unknown
  Obtained from environmental sample
  misc_feature (1)..(741): n is a, c, g, or t
gtggagttcgaaaagcacttccccagcgcccgcgttatcaagctcaatctcaattaccggagtacggatcacatcgtcggggccagcaatgaagtgatcaaacacaacaagttccgcattgacaaggatgtgcagtccaccaagcgctccgagcacaagattgtcgtctacactgggaatgatgaaatggacaatgttgaattttgcgtaaagaccatccaggagttgactgaccagggaattgctcctgaagagatactcatcctttatcgcaacactaaaatgtttcgtccttctcattacagtgataagccatcacttgctaaggctctgcttaataaagatttaaaggttcaggcaaaaacgattcacagtgcaaagggcctcgaagcacaggtagtctttatccttgggctgaccgagggctcgggaggcttccctgatgtctggatggaggatcggttattccaaatcgtaaaaaaatcggataaggatcagttgatcgaagaagagcgcaggctattctatgttgcgcttacccgcgcaaaggaaaagctctacctgattaccgagaagggaaatgaatcgaagttcctcaaagagattcctgaaacttatactgtcagaaccagtgagcctatcaagcccgttgtctctgttattccaacctgcaccaagtgctttagtcaactggagaagttatgggtggtgtgtccgtattgtggtgagaaagtttactga

SEQ ID NO: 2502 - protein, 246 aa, Unknown
  Obtained from environmental sample
  misc_feature (1)..(246): Xaa is any amino acid
MEFEKHFPSARVIKLNLNYRSTDHIVGASNEVIKHNKFRIDKDVQSTKRSEHKIVVYTGNDEMDNVEFCVKTIQELTDQGIAPEEILILYRNTKMFRPSHYSDKPSLAKALLNKDLKVQAKTIHSAKGLEAQVVFILGLTEGSGGFPDVWMEDRLFQIVKKSDKDQLIEEERRLFYVALTRAKEKLYLITEKGNESKFLKEIPETYTVRTSEPIKPVVSVIPTCTKCFSQLEKLWVVCPYCGEKVY

SEQ ID NO: 2503 - DNA, 477 bp, Unknown
  Obtained from environmental sample
  misc_feature (1)..(477): n is a, c, g, or t
atgatttcaaaatccatttttagtgatcctgaagtggtcaaatatttcaagaaaggcaatacttatacagagcaagaaataatgactgaaacacaagaatgcgtagaattgtggaaaagtaaaataccttttagcaggtttagtgtgttcagagatgatagtcttgttggagaagtagaattaagagaaacagcccagcctggtgaagcagaaataagttatgcatttgctaaaaacgcgcaaggacaaggtgttggaactcgttcagttaaagcagttggcataaattatgcgtttgagcttgccaaacgtaaatatgaaattaatggtcaaccgttttccactatgatagcctctgttcatccggaaaacataggttcagagaaaatactacatgaaaaattagaaatggcatttaaagagcaaatccctaaatttggtagtgtaaggaatatttattgtaagaaagttgtttaa

SEQ ID NO: 2504 - protein, 158 aa, Unknown
  Obtained from environmental sample
  misc_feature (1)..(158): Xaa is any amino acid
MISKSIFSDPEVVKYFKKGNTYTEQEIMTETQECVELWKSKIPFSRFSVFRDDSLVGEVELRETAQPGEAEISYAFAKNAQGQGVGTRSVKAVGINYAFELAKRKYEINGQPFSTMIASVHPENIGSEKILHEKLEMAFKEQIPKFGSVRNIYCKKVV

SEQ ID NO: 2505 - DNA, 351 bp, Unknown
  Obtained from environmental sample
  misc_feature (1)..(351): n is a, c, g, or t
atgtcttttattataacaaacttacactatctttacaactttccaaataaatattttaatacctgggaaataacttgcttgagaattttatctccggaataccgccactccaggtttgatatttgtaatttatcctacatgaaaaaacggcttaataacaatcaagcatttgggaaggcaaggccgaaagtaatttttcttaatagtttactttcttttaaaaaaattgtctgtcaaaaaatttttctaatgttttccaaatcaacggaatatgccctggaaagccacctttatattccgcttcaaaagggaaccaaagatcctaagaatggaaataaaaaaaatttctaa

SEQ ID NO: 2506 - protein, 116 aa, Unknown
  Obtained from environmental sample
  misc_feature (1)..(116): Xaa is any amino acid
MSFIITNLHYLYNFPNKYFNTWEITCLRILSPEYRHSRFDICNLSYMKKRLNNNQAFGKARPKVIFLNSLLSFKKIVCQKIFLMFSKSTEYALESHLYIPLQKGTKDPKNGNKKNF

SEQ ID NO: 2507 - DNA, 780 bp, Unknown
  Obtained from environmental sample
  misc_feature (1)..(780): n is a, c, g, or t
gtgggagttatggtaagtgcagttgctaatggacctaaaacagttgctctgtactctgagaaaacagccgagataaaaacattgaaaatcggtccctggatcaaagaacgtattcttcttgttgatcttggtttttataaaactcaaatgtttgcaagagttgaggaaaatgggggatattttgtctcaaggattaagaagaatatggatcctattcttatttctgttgaagagggactttctaagacaaaaagcaaagagttcgctggaaaacctgttagtgagtgtattaagcaactttcaggaaaagatattgatgctgttgtgaaaataaagtttaaaagaagagcatataaaggcaagcaaaaacaggatgatatgagtgtacgccttgttgcggtatataatgatgaagatgaaaagcaccacatatacatcacaaatattcagaaagatgttttgagtgcaaaagacattgcaaaattatatggagcaagatgggacatagaactgttgtttaaggagttaaaaagcaaatacgcgcttgacgttctggatacaaagaatgaacaggtaattgaaactctaatctggacagcaatgttgacattaatcgttagcagaagaatttattctcttgtaaagaacaatactgctcatcctgaaaaaatggttcgctatactcaagaaagatggagcataatatttgctgnaaatgcatcaaatttattgacagtgattctgcatagatgtggaattgaaagaactttgaaacagtga

SEQ ID NO: 2508 - protein, 259 aa, Unknown
  Obtained from environmental sample
  DOMAIN (2)...(206): Transposase DDE domain
  misc_feature (1)..(259): Xaa is any amino acid
MGVMVSAVANGPKTVALYSEKTAEIKTLKIGPWIKERILLVDLGFYKTQMFARVEENGGYFVSRIKKNMDPILISVEEGLSKTKSKEFAGKPVSECIKQLSGKDIDAVVKIKFKRRAYKGKQKQDDMSVRLVAVYNDEDEKHHIYITNIQKDVLSAKDIAKLYGARWDIELLFKELKSKYALDVLDTKNEQVIETLIWTAMLTLIVSRRIYSLVKNNTAHPEKMVRYTQERWSIIFAXNASNLLTVILHRCGIERTLKQ

SEQ ID NO: 2509 - DNA, 705 bp, Unknown
  Obtained from environmental sample
  misc_feature (1)..(705): n is a, c, g, or t
ttgtttaatattattcatttccattgcctacaggtaaatagaattaaaagtgaaacagacgactgcgtgtctataagttttcacgttcatgaagaattgaaagatgcctttcaattcaggcaagggcaaaatctcaccattcgcaaaaaaatcaatggcgaagagatgcgacgtaactattcaatttgtaccagcccttttgacaaagaattaaaagtagctgtgaaaaaagtagatggaggtttgttttccacttatgctaatgaagaattgaaggagggagattttttagatgtcatgcccccaaccggtaagttttatacagagctttatccatcccaacaaaagtcttatgtggcctttgcagccggcagcggtataacaccagttcttttcattattaaaaccactttgctgaccgaactcaaaagcaattttactttagtatatggcaatcgcacaaaagcttctattatttttaaagaagaattggaagcgctgaaagataaatttattgatcgctttcgcatctaccatgttctaagccgggaaaaaacggatgcgctgattaatgaaggcagaattgacgcagaaaaatgcgaacttctttttacaagactcataaacataaaaaccaccaatgaattctttttatgtggccctgaacaaatgattttttgcataaaaggaattgctggaaattaa

SEQ ID NO: 2510 - protein, 234 aa, Unknown
  Obtained from environmental sample
  DOMAIN (9)...(107): Oxidoreductase FAD-binding domain
  misc_feature (1)..(234): Xaa is any amino acid
MFNIIHFHCLQVNRIKSETDDCVSISFHVHEELKDAFQFRQGQNLTIRKKINGEEMRRNYSICTSPFDKELKVAVKKVDGGLFSTYANEELKEGDFLDVMPPTGKFYTELYPSQQKSYVAFAAGSGITPVLFIIKTTLLTELKSNFTLVYGNRTKASIIFKEELEALKDKFIDRFRIYHVLSREKTDALINEGRIDAEKCELLFTRLINIKTTNEFFLCGPEQMIFCIKGIAGN

SEQ ID NO: 2511 - DNA, 921 bp, Unknown
  Obtained from environmental sample
  misc_feature (1)..(921): n is a, c, g, or t
atgaattttgacgaagaagacaggcaggatagccttgcaaaactttctgtaaaatggctgcatggtgctattgcaaaaaatttatatgcttcggtaaatgtcatagtcaatcaaacaaaaacaatatttggaaagtttaaagcttacgagttcgattctccaatacgcagttattattcagatgaaatggaagtatggggcggcaatcttaatgataagggtgaagccattatcaatactgatctggcagtaggacaaactgcacccggcatgttacgtgccacctatattacaaaagtatttgaagaaggcggggattttagcattgatcgctataatatgttatattctccttacaaaacttatgtgggtattcatacgccagaaatcaaaggatacgataacaatttagaaacgggaaaagaatacatatacgatattgcaactgtaaacgaacagggaaaagctgtaactgccagtaagctgcaggtgaagatttataaacttcagtggcgctggtggtatgaaaaagaaaaagaagatattgccagttatatttcgaaaacaggtaccctcattttaaaagacactctggtcaaaacttatgaaggaaaaggcagcttcaaatttaaagtaaattatcctgaatatggtcgttatttaattacagttactgatttggaagggggtcatcagaccgggaaagtaatttacattgactggccttattggagccgggctaaccgaaagtataacgagaatgctaccatgttgaattttgcctgtgataaggagaaatatacaaccggtgaaaatattaaattgtcttttccttctcctgccgatggtatggcccttatcagcgtgnaaaatggttcgcgtattgtgaaaaaaattctggataccaaccaaaaaaggtga

SEQ ID NO: 2512 - protein, 306 aa, Unknown
  Obtained from environmental sample
  misc_feature (1)..(306): Xaa is any amino acid
MNFDEEDRQDSLAKLSVKWLHGAIAKNLYASVNVIVNQTKTIFGKFKAYEFDSPIRSYYSDEMEVWGGNLNDKGEAIINTDLAVGQTAPGMLRATYITKVFEEGGDFSIDRYNMLYSPYKTYVGIHTPEIKGYDNNLETGKEYIYDIATVNEQGKAVTASKLQVKIYKLQWRWWYEKEKEDIASYISKTGTLILKDTLVKTYEGKGSFKFKVNYPEYGRYLITVTDLEGGHQTGKVIYIDWPYWSRANRKYNENATMLNFACDKEKYTTGENIKLSFPSPADGMALISVXNGSRIVKKILDTNQKR

SEQ ID NO: 2513 - DNA, 555 bp, Unknown
  Obtained from environmental sample
  misc_feature (1)..(555): n is a, c, g, or t
ttgcaaaagcaaaatcattattgcaataaaattaattttttaacccctaaatcttttaccatgaaaaaagtacttatagcaattgactataatcctaccgcacagaatattgcaaaaaagggatacgagttggcgaggtcaatgaatgctcaaacaatactattacacgtggtagctgattacacgtattattcttcactggattattcaccgataatgggttttgatagcttcagcaacctgggcatattacagaccgatactgttactgaactacataatgccgcgcaggattaccttaacaaaacaaaacaatatcttggtggtgaagacaacatacagaccctggttaaagatggcgattccgggcaggctattatagacgctgcaaaagaaatggaggcagatgtgatagttatgggaagccacagcaggcgtggattagagaagatattgatgggaagtgtagccgagaaagtactgcgtaacagcagttggcccttgtttatcatcccggtggttgagaacgaaaagaatgagaacgaaaagaaatag

SEQ ID NO: 2514 - protein, 184 aa, Unknown
  Obtained from environmental sample
  DOMAIN (21)...(172): Universal stress protein family
  misc_feature (1)..(184): Xaa is any amino acid
MQKQNHYCNKINFLTPKSFTMKKVLIAIDYNPTAQNIAKKGYELARSMNAQTILLHVVADYTYYSSLDYSPIMGFDSFSNLGILQTDTVTELHNAAQDYLNKTKQYLGGEDNIQTLVKDGDSGQAIIDAAKEMEADVIVMGSHSRRGLEKILMGSVAEKVLRNSSWPLFIIPVVENEKNENEKK

SEQ ID NO: 2515 - DNA, 495 bp, Unknown
  Obtained from environmental sample
  misc_feature (1)..(495): n is a, c, g, or t
gtgaaaggttatggatggaaatgcccaaaatttcattcacatctacatttacctaactggatttcagacctagggtcaccagctaattacaacactcagtgttttgagagtaaccacaagataattgtgaaaaatgttgcaaacaatgttcaaaaatgggggaatgggaaatttctagtgcaaattgcaattaggggatatgaaaggcaaattttaactattgcaatgaagaaattaaaaattgaacctgttacaacaccatatgaatgttctaatacaatcatggtcaatggtaataagcaagcatctcaagatttgtggtataccaataaagctactaaatttacactcacagtacatcagaatggagatgtaatacaaaagtggcaacattcaagatctgtctctttgtacctacaaattcaacccatagtgtgctcattcatatcctcccaatatagatcagaccaaaggaaactattattggatgtgtaa

SEQ ID NO: 2516 - protein, 164 aa, Unknown
  Obtained from environmental sample
  misc_feature (1)..(164): Xaa is any amino acid
MKGYGWKCPKFHSHLHLPNWISDLGSPANYNTQCFESNHKIIVKNVANNVQKWGNGKFLVQIAIRGYERQILTIAMKKLKIEPVTTPYECSNTIMVNGNKQASQDLWYTNKATKFTLTVHQNGDVIQKWQHSRSVSLYLQIQPIVCSFISSQYRSDQRKLLLDV

SEQ ID NO: 2517 - DNA, 333 bp, Unknown
  Obtained from environmental sample
  misc_feature (1)..(333): n is a, c, g, or t
ttggttttcttccatataagcatcccactatccacccccctttttattgaaagattcatacatgacaaagctttcccgctatattcccaaatgatctattgcttgaatggtcttggaaaatatttcaaaatggaaccatcttttataatgatattccgaaaaaaatttcttttgattgattttgaaaaaaatgacaaccaaggccgattgaaaattaggccaaaaaaaaaaaattccatccttccccgaaattttcttccaaagttgaaaaccctttctctaatggaaacaggaaattcaatttgcgaaacgctttgtggaaaaatttcttag

SEQ ID NO: 2518 - protein, 110 aa, Unknown
  Obtained from environmental sample
  misc_feature (1)..(110): Xaa is any amino acid
MVFFHISIPLSTPLFIERFIHDKAFPLYSQMIYCLNGLGKYFKMEPSFIMIFRKKFLLIDFEKNDNQGRLKIRPKKKNSILPRNFLPKLKTLSLMETGNSICETLCGKIS

SEQ ID NO: 2519 - DNA, 381 bp, Unknown
  Obtained from environmental sample
  misc_feature (1)..(381): n is a, c, g, or t
atgaacagtgagaagttaatgcaaaaggagaacataatttgcaatagcatgttgaaaccatatgatcaatatattgcttccaagacagtaaatgaatctcaggatgcatatcagtttcaatatgccatgaaacaactgattttaaatccaacaaaagatattattataggtgttgatatttatgctgattctacatggtgtgatgtgcttgataaatataattgtgaacctgttgttgcaacactctctattttcagagggaacatacatcatactcccaatgctcaagtattactgtgctttattacagacatggatcacaaaagcagtgctgaaggcagttgtgcagtcaaggactctatgtttaagggaattaaataa

SEQ ID NO: 2520 - protein, 126 aa, Unknown
  Obtained from environmental sample
  misc_feature (1)..(126): Xaa is any amino acid
MNSEKLMQKENIICNSMLKPYDQYIASKTVNESQDAYQFQYAMKQLILNPTKDIIIGVDIYADSTWCDVLDKYNCEPVVATLSIFRGNIHHTPNAQVLLCFITDMDHKSSAEGSCAVKDSMFKGIK

SEQ ID NO: 2521 - DNA, 333 bp, Unknown
  Obtained from environmental sample
  misc_feature (1)..(333): n is a, c, g, or t
ttgcaaacagttttgcataaagaagtcagttatggtcattcaaatggatggattcaaaacaagaatgacatcttaaatgactttacaagtggcaaactgatctataataaaattgacaataacagctcggcgatagttgtgataagtaagaaatatgccactgtgaaaacgaatacaaatgcggaggggatggtgaatggggccccatttaatttaaaactgcatatcatgcagttttggataaaaaccaaaaggggttggcaattgctgcgtattttctcatcgaacttgagtttttgggcgggcggcagcacctgggagaggttccggtga

SEQ ID NO: 2522 - protein, 110 aa, Unknown
  Obtained from environmental sample
  misc_feature (1)..(110): Xaa is any amino acid
MQTVLHKEVSYGHSNGWIQNKNDILNDFTSGKLIYNKIDNNSSAIVVISKKYATVKTNTNAEGMVNGAPFNLKLHIMQFWIKTKRGWQLLRIFSSNLSFWAGGSTWERFR

SEQ ID NO: 2523 - DNA, 705 bp, Unknown
  Obtained from environmental sample
  misc_feature (1)..(705): n is a, c, g, or t
atgaaaaatggagcaatagatgtaattgatgcgtttaaagaagtggtaggagaggaaggaactttagtgtttcctacttttacaatcagcaactccatgtatgaaacattaaccgataaagaacaattttttgatgttaatttgagcaaatcaactgtaggtgcaattacaaattgttttttgcaacaggataatacatacagaagtgtgcatccaacacattcggttgcagcttggggtaaacacgcttcgtttatagttaaagatcattttgtagcggaaaccaattttggtaagggaacaccgtttggaaaaatgatggaactaaacggtaaaattgtaggtttaggaattagttacgggcctgttacttactaccatgtttatgaagatctgaatcttaacttgtttcctaacgtatattttccggatagaattaaagtcaagtgcagagatagcaagggcttaattcaggagtccgattttttatgtcataatcctgagttccataaaaaaaggatagataaagatgcagaaatcgaatcttttttttctgattatttcgagaaaaaaaatatttctaaaaaaacaaaaatagggcagggaagcgtttggtggatgaatgcagagaatttgataactgaattaacttcgcttcataaaaaaaatatcacgatttactccgtaaaaaatgggcaaaaataa

SEQ ID NO: 2524 - protein, 234 aa, Unknown
  Obtained from environmental sample
  DOMAIN (1)...(222): Aminoglycoside 3-N-acetyltransferase
  misc_feature (1)..(234): Xaa is any amino acid
MKNGAIDVIDAFKEVVGEEGTLVFPTFTISNSMYETLTDKEQFFDVNLSKSTVGAITNCFLQQDNTYRSVHPTHSVAAWGKHASFIVKDHFVAETNFGKGTPFGKMMELNGKIVGLGISYGPVTYYHVYEDLNLNLFPNVYFPDRIKVKCRDSKGLIQESDFLCHNPEFHKKRIDKDAEIESFFSDYFEKKNISKKTKIGQGSVWWMNAENLITELTSLHKKNITIYSVKNGQK

SEQ ID NO: 2525 - DNA, 846 bp, Unknown
  Obtained from environmental sample
  misc_feature (1)..(846): n is a, c, g, or t
ttgctcccttatcgacttgtagatattggtgttaaattaaaaaaagactttcccgatttaaacttaattatagatattagagacccctggaatatacatgcggacgattgggggcaaaaatacttgataaaaaaacgcaaagactttgaacttaaaagtgaattagaagcaattaaaactgctaataaagtaattagtgttacacaaagcagtattgatttttatacggaacatttccctgccagaaaaaatgattttgtttttattcccaatggatttgatgatgaggaaatttttaaaggaaatagcacagagaataaaagcaatgtaaaatactttatttatgctggcgtattatatgatgtttctgttgatttattcgaagaatttgtaattgagctaaaggaaattaatttagttaattccaagcttattgaaaatattgagtttcatttttacatacctaaaatagatttttttaaaaaaattgtagataaacacgaggtaactcaaattaaattttttgagcaagtagatctggatcaaattcaaaagaatatctataattcaataggcacaatgctgtttttacctccacaatatgagtttagtttaagcacaaagttttacgagtatgtatcgcagaataaaaaaatactcgtgttttctaatcctggcgaagttgccgagttggttgaaaaacactttttaggctatgcaatgcttcatggaaaaatgaaaaaaatgcttatcaaagcaatagaagatctgtcatcaggcaaagaacttcccaagcatacatttaatttaaaacaatttgagatccaaaatttagctgaaaaataa

SEQ ID NO: 2526 - protein, 281 aa, Unknown
  Obtained from environmental sample
  misc_feature (1)..(281): Xaa is any amino acid
MLPYRLVDIGVKLKKDFPDLNLIIDIRDPWNIHADDWGQKYLIKKRKDFELKSELEAIKTANKVISVTQSSIDFYTEHFPARKNDFVFIPNGFDDEEIFKGNSTENKSNVKYFIYAGVLYDVSVDLFEEFVIELKEINLVNSKLIENIEFHFYIPKIDFFKKIVDKHEVTQIKFFEQVDLDQIQKNIYNSIGTMLFLPPQYEFSLSTKFYEYVSQNKKILVFSNPGEVAELVEKHFLGYAMLHGKMKKMLIKAIEDLSSGKELPKHTFNLKQFEIQNLAEK

SEQ ID NO: 2527 - DNA, 678 bp, Unknown
  Obtained from environmental sample
  misc_feature (1)..(678): n is a, c, g, or t
atgaaaattttgattgtagaagacgagaaagaattatcgcaaagtatttgcacttatttaagcgacgaacagtttaggtgcgagcaggctttcgattatcctactgcaatagaaaaaatttcattgtatgattatgcctgtattgtcttagatataacgctgactggcggaagtggaatggatattttgaaagaattgaaaaaggaaaacaaactggatggcgtattgatcatttctgcgaaaaattctcttgacgataaagtgcatggactcaaagcgggagcggatgattatctcacgaagccgtttcatcttcctgaactggcagcaagaatagatgctattattaggcgtaagtcatttgatggaaagccacttattcattttgatgtgctacatgttgatttaaataaaaaagaagtttgcattcatgaaaagcctgtcgatcttaccaggaaagaattcgagttgttgatttattttataggcaacaaaggaaaagtgatcaacaaaaatgcgattgccattcatttgtggggagatgaaatggatgtagcgggtaactatgattttatttatacgcatattaaaaacctgcgcaaaaaacttttgcaggccggcgcaaaagactacataaaatcggtgtatggaatgggctataaattcacagaggcatga

SEQ ID NO: 2528 - protein, 225 aa, Unknown
  Obtained from environmental sample
  DOMAIN (145)...(222): Transcriptional regulatory protein, C terminal
  misc_feature (1)..(225): Xaa is any amino acid
MKILIVEDEKELSQSICTYLSDEQFRCEQAFDYPTAIEKISLYDYACIVLDITLTGGSGMDILKELKKENKLDGVLIISAKNSLDDKVHGLKAGADDYLTKPFHLPELAARIDAIIRRKSFDGKPLIHFDVLHVDLNKKEVCIHEKPVDLTRKEFELLIYFIGNKGKVINKNAIAIHLWGDEMDVAGNYDFIYTHIKNLRKKLLQAGAKDYIKSVYGMGYKFTEA

SEQ ID NO: 2529 - DNA, 465 bp, Unknown
  Obtained from environmental sample
  misc_feature (1)..(465): n is a, c, g, or t
ttgcggatttgggtggttgtgcagaaatacaaagcgagcatattgcggaggcgatacaatacagaaaccttgatcgtgaaagttgggctggatgattgttctcttttttctcgtcctcgcctgaggcgaggatgccaggaatattattgtataaataaatttttatcccaattaaaatgtctggtgaccgttactttattcgtgatcaaaatgctgtttactttctatccacactgtagtgcgttggctggatgtattacttcaatgaatcataaaacggtgggttgtgattcgttgaactattgcattgataaaaagggtttgaaatgtccctgcctggtggcctatgaaaaaatcatttggattttaattgcctcctcccaaaagatgggttttaacctgaacaattatcttttaaagaaattaaaaaaacatatttgcccaaaaaaattaataagggtttaa

SEQ ID NO: 2530 - protein, 154 aa, Unknown
  Obtained from environmental sample
  misc_feature (1)..(154): Xaa is any amino acid
MRIWVVVQKYKASILRRRYNTETLIVKVGLDDCSLFSRPRLRRGCQEYYCINKFLSQLKCLVTVTLFVIKMLFTFYPHCSALAGCITSMNHKTVGCDSLNYCIDKKGLKCPCLVAYEKIIWILIASSQKMGFNLNNYLLKKLKKHICPKKLIRV

SEQ ID NO: 2531 - DNA, 324 bp, Unknown
  Obtained from environmental sample
  misc_feature (1)..(324): n is a, c, g, or t
ttgcaaaacagctggaattgcattgccacttcgcggtgtgacaattttgtatttgagtggctgcgttttatttattcaatttatattatggaaaccactttttatatagttctaagtatgcgtacgatcgatggattcgagactttcggtaaattttttgttggcaacgaaagggattttgcttatagcatttttagtaaactaaagggaaagaagcataccaacgaaaaaaatctgctgcttgtggaactaatggaaaccagatacgaacttcctttaaatgtaaaaatgcttggtgttcgctcgaagaatnggagaaaatga

SEQ ID NO: 2532 - protein, 107 aa, Unknown
  Obtained from environmental sample
  misc_feature (1)..(107): Xaa is any amino acid
MQNSWNCIATSRCDNFVFEWLRFIYSIYIMETTFYIVLSMRTIDGFETFGKFFVGNERDFAYSIFSKLKGKKHTNEKNLLLVELMETRYELPLNVKMLGVRSKNXRK

SEQ ID NO: 2533 - DNA, 414 bp, Unknown
  Obtained from environmental sample
  misc_feature (1)..(414): n is a, c, g, or t
atgtataaaacagagccaacaataattgacgctagtggtcttaaaggttttattggcggcaaaaaattgaacggctttaatgttaaggttaacactttcgcagacacaataaaagaaactaaatctaataaatccgagacagtttcagtcgttgcacaggaaattaaatcagtacaaaaaactgagacaacttcttctccttcaaagaaagtacaatctgcttcacaattatcaaaagctcttggtgtttcgcaggctgacataactaatattatgcaacaatatggctttatcaacggtgacaaaattacttctgccggacttgcaaaaggacttgtaataaaaaactacatgggtaaagactacattgcgtatcccgacaacttagacgaattaaataaaataaaaaaataa

SEQ ID NO: 2534 - protein, 137 aa, Unknown
  Obtained from environmental sample
  misc_feature (1)..(137): Xaa is any amino acid
MYKTEPTIIDASGLKGFIGGKKLNGFNVKVNTFADTIKETKSNKSETVSVVAQEIKSVQKTETTSSPSKKVQSASQLSKALGVSQADITNIMQQYGFINGDKITSAGLAKGLVIKNYMGKDYIAYPDNLDELNKIKK

SEQ ID NO: 2535 - DNA, 414 bp, Unknown; identical to SEQ ID NO: 2533
  Obtained from environmental sample
  misc_feature (1)..(414): n is a, c, g, or t

SEQ ID NO: 2536 - protein, 137 aa, Unknown; identical to SEQ ID NO: 2534
  Obtained from environmental sample
  misc_feature (1)..(137): Xaa is any amino acid

SEQ ID NO: 2537 - DNA, 501 bp, Unknown
  Obtained from environmental sample
  misc_feature (1)..(501): n is a, c, g, or t
atggtatgcagtttatacacggcccagatgggaaaaaaaagtaaatgggttgctttgcaaaaaggaattgaagcgtattgtccgttgaacaaagtacgccgcaaatggagcgaccgcatcaaaaccgttgaagaaccacttttcaagtcttacgtgtttgtaaaaattaatgatgaggatcgcacttctgtccggatgacaaacggtatcgtaaattttgtttactggaatggcaagcctgccgttattaaagaaaaagaaattcaaacgatcaaacgctttcttgacgaatatgaaaatgtggaagtcatgaagatggagttagcggaaggtgacagggtgcaggtaattgcaggtcctatgatggataaggaaggaaaaattttggaagtaaaaaataaaacagcaaaagtctgtatcgatagtcttggttacatgcttattgcttatattgataagactaagctgctccctgttcaacagacaaaccaccagagatga

SEQ ID NO: 2538 - protein, 166 aa, Unknown
  Obtained from environmental sample
  DOMAIN (108)...(141): KOW motif
  misc_feature (1)..(166): Xaa is any amino acid
MVCSLYTAQMGKKSKWVALQKGIEAYCPLNKVRRKWSDRIKTVEEPLFKSYVFVKINDEDRTSVRMTNGIVNFVYWNGKPAVIKEKEIQTIKRFLDEYENVEVMKMELAEGDRVQVIAGPMMDKEGKILEVKNKTAKVCIDSLGYMLIAYIDKTKLLPVQQTNHQR

SEQ ID NO: 2539 - DNA, 444 bp, Unknown
  Obtained from environmental sample
  misc_feature (1)..(444): n is a, c, g, or t
ttgaaaataacatactcttttgcttcacggtcacggcctcaaaagttttttgctgccttagataatattcgtgaaatgtgcgtttcgtgtgattacgaggttatagcaaaactagattatgatgatccatcaatgaataattttcatactgtaaaacgcattatggattttttccccggtacaaaaatagaatggggttattcaaaaaacaaagtacacgccattaacaggggtttagaaaacattaccggggatattatttgctgtcattcggatgatatggttttcataaaaaaaggttttgatgatattatcaggcgtgaaatggagaaagatttttacctgcactttcccgatggttatgcaaacgaaagattaagcacgtattcaataatgcacatagattactacaagcggtttaactacatctatttccctcaataa

SEQ ID NO: 2540 - protein, 147 aa, Unknown
  Obtained from environmental sample
  misc_feature (1)..(147): Xaa is any amino acid
MKITYSFASRSRPQKFFAALDNIREMCVSCDYEVIAKLDYDDPSMNNFHTVKRIMDFFPGTKIEWGYSKNKVHAINRGLENITGDIICCHSDDMVFIKKGFDDIIRREMEKDFYLHFPDGYANERLSTYSIMHIDYYKRFNYIYFPQ

SEQ ID NO: 2541 - DNA, 324 bp, Unknown
  Obtained from environmental sample
  misc_feature (1)..(324): n is a, c, g, or t
atgagactttccattttaataccatctattccctcacgctttgaacgtgctgttaagttgtacaatgagattttagaaatgtgcgaagggttagacattgaggttttgatgttaaccgataataaaaaaagaaccataggcgaaaaacgtgaagtactgaaaaacctttccaaaggaaaatacttcatgtttgtggacgacgacgacacattgttgagcgttaaagaaatttatgaagccaccgagaaagatgttgacgtaattactttctggcaaattgcaccaacaaagacggatcggaatattttattgattttggattag

SEQ ID NO: 2542 - protein, 107 aa, Unknown
  Obtained from environmental sample
  misc_feature (1)..(107): Xaa is any amino acid
MRLSILIPSIPSRFERAVKLYNEILEMCEGLDIEVLMLTDNKKRTIGEKREVLKNLSKGKYFMFVDDDDTLLSVKEIYEATEKDVDVITFWQIAPTKTDRNILLILD

SEQ ID NO: 2543 - DNA, 696 bp, Unknown
  Obtained from environmental sample
  misc_feature (1)..(696): n is a, c, g, or t
atgaaaaataaaaatgtaagtttatacaaatcaatatctcaatattttattgtcgaagaaatgaaaaatgaaacgactatgtggtatgttgccgcaggacttcttttacaatacttaaactcaaagcacaataattttggtgctttaaaatcaaaaatcggatacaaagattcaataaaaaatcaaattgaaatcttggacgtatgtagcggtccagccacttttgcaaattatttgagtttggcagttccaaatctaaaagcagtttgcgttgatttggatgatgattttattgattacggaaaaaagcatttcaaaagatggaaatttatcaaagccaacgccgtttcgatgaaattaaaaagaaaatttgatgttatcaccattagctctggttatcatcatattaaagatagtcaaaagaaatctttcttaaaaaatctttctcggcacctttctccaaaaggagtgattatcctttgtgataactttttgcctatttacaaaagccaaacagagcgaataggatcagtaaaagcctactatgaaagcttaaaaaaatattacgtaaaaggaaacgggtcactgagagctttncaagcattaaatgaggttgaaaaaagggatttaaataaagaagatgagtataaaacatccttcgaaatatttaaacacatatntttcagacnagactga

SEQ ID NO: 2544 - protein, 231 aa, Unknown
  Obtained from environmental sample
  misc_feature (1)..(231): Xaa is any amino acid
MKNKNVSLYKSISQYFIVEEMKNETTMWYVAAGLLLQYLNSKHNNFGALKSKIGYKDSIKNQIEILDVCSGPATFANYLSLAVPNLKAVCVDLDDDFIDYGKKHFKRWKFIKANAVSMKLKRKFDVITISSGYHHIKDSQKKSFLKNLSRHLSPKGVIILCDNFLPIYKSQTERIGSVKAYYESLKKYYVKGNGSLRAXQALNEVEKRDLNKEDEYKTSFEIFKHIXFRXD

SEQ ID NO: 2545 - DNA, 348 bp, Unknown
  Obtained from environmental sample
  misc_feature (1)..(348): n is a, c, g, or t
atgcaaacaggccagcgtctctggacaaaagaagagttaatacttgcattgaacctatacctcaaactaccattcggaaaattggatgcaaggactccggagattgttcatttagcaaaaattattggacgaaatgcaaatgcggtttcaatgcgattaaacaattttgcaagtgttgatccgtatcaccaaaagcgaggtataaaaggtctagtaggtggaaagaaacaagttcaaccaatatgggacgaatttataaacaacaaggaagagttgatttatgaaagtggaaggattcttgccaacaaagaacatacttcaatagagaaaaatactcagatgcactaa

SEQ ID NO: 2546 - protein, 115 aa, Unknown
  Obtained from environmental sample
  misc_feature (1)..(115): Xaa is any amino acid
MQTGQRLWTKEELILALNLYLKLPFGKLDARTPEIVHLAKIIGRNANAVSMRLNNFASVDPYHQKRGIKGLVGGKKQVQPIWDEFINNKEELIYESGRILANKEHTSIEKNTQMH

SEQ ID NO: 2547 - DNA, 906 bp, Unknown
  Obtained from environmental sample
  misc_feature (1)..(906): n is a, c, g, or t
ttgtttgatgaagtaaaaggttattttacttcaaggtttaaaattgaaaggacaccgaggaaggctattggccctaagctgaattattatcctctaagtcattttaaggagaaagatttagtcgaagtagtaagtaagagagataaagtcctaaaggtagaaacatcatttgaaattaatcaaaagattgctaccaatctcctagaaatttgctttggacatcctaaatgtgtttcaatgatccttgatatcgaaagcccttctccaagattagagaagggaagacttgtaaatgagaaaaagttatttgtaaatatagttgataaagtaatcaattcggagatactcaataacatcaccggttatatttctgttgatgcattaataagcttgtgtacgtttagatatattagccctgacttgatatatttgatacgagatgaggaaagtctaaaaaagtatgacctgtctactgttttaaagtgccgagaatttgtccgtacgcatctttcacccaccggtttattctccagtcctgcatccaaacgcagtaatggaccgcttcaaatgtatggaactgatccagttgtaagaaattttcttggaatgaagctaaagtgtgataacttgncaaggtacatttatttgcaaaacgaagctgagaattactggctgagcatcttcaatggcaataatgtaagagacgattataaaccaagagggtcacaacaaatcgcgattatttcagaaatgctttaccattattgtagaattcttgctgcaaatcatttcgatgaaaatgacgctcagaaggcattggaaacgaaacttaaagagtggagtgcgggttgggctcctgaagggtatatttcttttaaagattataaagaaccatttagaaggtaa

SEQ ID NO: 2548 - protein, 301 aa, Unknown
  Obtained from environmental sample
  misc_feature (1)..(301): Xaa is any amino acid
MFDEVKGYFTSRFKIERTPRKAIGPKLNYYPLSHFKEKDLVEVVSKRDKVLKVETSFEINQKIATNLLEICFGHPKCVSMILDIESPSPRLEKGRLVNEKKLFVNIVDKVINSEILNNITGYISVDALISLCTFRYISPDLIYLIRDEESLKKYDLSTVLKCREFVRTHLSPTGLFSSPASKRSNGPLQMYGTDPVVRNFLGMKLKCDNLXRYIYLQNEAENYWLSIFNGNNVRDDYKPRGSQQIAIISEMLYHYCRILAANHFDENDAQKALETKLKEWSAGWAPEGYISFKDYKEPFRR

SEQ ID NO: 2549 - DNA, 441 bp, Unknown
  Obtained from environmental sample
  misc_feature (1)..(441): n is a, c, g, or t
atgtcgaagatcaatatatccaataaaaaagcaactttcgagttcgagataattgataaatntacggcgggaattatgcttaccggaacggaaataaaatccatccgcgagggaaaagcaaatatgagcgatgcgtattgttccttcaccagcggcgaattatttgtgcgaaacctgcatatttccgagtatgatatgggaacgcattataaccacgaacccaaacgcgcacgtaagctgctattgcaaaaaaaagaactcaaaaaactcaatacaaaagttaaagaaaaaggccttaccattgttcctttaaagatatttttaagcggaacaggatatgcgaaaatggatatcgcgttagcaaaaggaaagaaaacatttgataagcgcgaaagcataaaagagcgcgatgtaaaaagagatatggaaagaagctattaa

SEQ ID NO: 2550 - protein, 146 aa, Unknown
  Obtained from environmental sample
  DOMAIN (3)...(70): SmpB protein
  misc_feature (1)..(146): Xaa is any amino acid
MSKINISNKKATFEFEIIDKXTAGIMLTGTEIKSIREGKANMSDAYCSFTSGELFVRNLHISEYDMGTHYNHEPKRARKLLLQKKELKKLNTKVKEKGLTIVPLKIFLSGTGYAKMDIALAKGKKTFDKRESIKERDVKRDMERSY

SEQ ID NO: 2551 - DNA, 303 bp, Unknown
  Obtained from environmental sample
  misc_feature (1)..(303): n is a, c, g, or t
ttgcccaaacaagaattacatcgaaacattgaaaaacgtgtcgataaaatgatagagttgggattagtggaagaagttcaatctttaattccttaccagcatttgaatgctttacatacggtagggtacaaggaattgtttgattatttcaatggtgaaattgagctgacaagcgcagttgatttaatcaagagaaatacaaagcagtatgccaaacgccagatgacatggtttagaaaggataaagattatgtttggttgaatccgaaagaatttcattttaatcatattgggttatcctaa

SEQ ID NO: 2552 - protein, 100 aa, Unknown
  Obtained from environmental sample
  DOMAIN (1)...(90): IPP transferase
  misc_feature (1)..(100): Xaa is any amino acid
MPKQELHRNIEKRVDKMIELGLVEEVQSLIPYQHLNALHTVGYKELFDYFNGEIELTSAVDLIKRNTKQYAKRQMTWFRKDKDYVWLNPKEFHFNHIGLS

SEQ ID NO: 2553 - DNA, 450 bp, Unknown
  Obtained from environmental sample
  misc_feature (1)..(450): n is a, c, g, or t
ttgcattgggcgagaatgaaatacgttcgtaaactggtggaattacatttgcgaccaattagtttaaccaatgaaaatattacggattctgccattcgacgtttattgtttgatgccggccaggatattgacgacctgatgatcctttgtgaaagtgacatcacctccaaaaacaaactaaaggttaagcgttacctggccaattttgaaatggtacgtgaaagatgcaaagaagtggaagaaaaagaccacatccgtaactggcaaccgcccatcaccggaaatatcatcatggaagtatttggaattcctccttcaaagcccgttggcattatcaaggacgcaatcaaggatgcaattttggatggaatcattaccaacgactacgaaacggcgtatcaatatatgctggaaaaaggtaaggaatgcggcctaaagcctgttcactga

SEQ ID NO: 2554 - protein, 149 aa, Unknown
  Obtained from environmental sample
  misc_feature (1)..(149): Xaa is any amino acid
MHWARMKYVRKLVELHLRPISLTNENITDSAIRRLLFDAGQDIDDLMILCESDITSKNKLKVKRYLANFEMVRERCKEVEEKDHIRNWQPPITGNIIMEVFGIPPSKPVGIIKDAIKDAILDGIITNDYETAYQYMLEKGKECGLKPVH

SEQ ID NO: 2555 - DNA, 462 bp, Unknown
  Obtained from environmental sample
  misc_feature (1)..(462): n is a, c, g, or t
ttgacgtttaaccaaccgtacagattcatggccattttgaaattcagaatttatttggaagaagatgatagcgtttacagggatgttgtgatccggcatacccaaagttttcaggaattacatgaaacaatactgaaggcatttgagtttgatagcaaacaccaggcaactttttatcgaagcaatgacaactggcaaaggggcagggaaatttcattagagaaatatgacagggcttacaaagctcctccattattaatgaaggaaacaaccatcggttccgaaataaaagatccaaatcaaaaatttatctacgtttatgattttgccaagaactggacttttttagtggaactgataaacgttttcaaggaagaaaatccaaaactcacctatccttctatgataagaaaagaaagaattgctccaagccagtatggtactaaaagccctgctgggtga

SEQ ID NO: 2556 - protein, 153 aa, Unknown
  Obtained from environmental sample
  misc_feature (1)..(153): Xaa is any amino acid
MTFNQPYRFMAILKFRIYLEEDDSVYRDVVIRHTQSFQELHETILKAFEFDSKHQATFYRSNDNWQRGREISLEKYDRAYKAPPLLMKETTIGSEIKDPNQKFIYVYDFAKNWTFLVELINVFKEENPKLTYPSMIRKERIAPSQYGTKSPAG

SEQ ID NO: 2557 - DNA, 825 bp, Unknown
  Obtained from environmental sample
  misc_feature (1)..(825): n is a, c, g, or t
gtgttcctcgccggtttgaggtgcttgggtgatgactacgacacagtggatgcaaaaggattttcggagatggcattgaattccaaactcatccatcaacctggggaaaaatatagttattccaatgtcggatacagtctccttggaatcatcgttgagaacgtcagcggaaaaagctatgagcagtttcttcgtgatgaattatttgtcccctcaggaatgctaaagacgggctatttgattccggaatttaaaaaagaacagcttgctgtcggctataaaaatggcaagcgctggggaaccgcaatggatcatgcatggaaaaaaggaggtcccggctggcacctgcgcgcaaatggcggaatcctttccacggcgggcgacatgtttaaatggtatcagtcgcttcgcagcaataccgtcctgcccaaagcgcaaacggaaaaaatgtttacgccgcatgttgacgaaggccagggaggaatcagtttttatggttatgggtgggtggtaatgcctgcgggagatgttaaaatcatctggcataacggcggtaacggggtttacaatgcctatgccggttttgacccacagcaggatatttttattttcgtttcgagcaattcaaacgataagatcagcgacgatatagctgcggcgctttataatatcgtttccgaaaaaaagaaaatacagcttgcggcgaacgagcctgattacaggaatcatcctgtcacgcgtaaaatcttatcctccattatgcagcatggtgccgaatatttttccgcacattcaaaaacaatcatcactgaatcccggatttga

SEQ ID NO: 2558 - protein, 274 aa, Unknown
  Obtained from environmental sample
  DOMAIN (2)...(228): Beta-lactamase
  misc_feature (1)..(274): Xaa is any amino acid
MFLAGLRCLGDDYDTVDAKGFSEMALNSKLIHQPGEKYSYSNVGYSLLGIIVENVSGKSYEQFLRDELFVPSGMLKTGYLIPEFKKEQLAVGYKNGKRWGTAMDHAWKKGGPGWHLRANGGILSTAGDMFKWYQSLRSNTVLPKAQTEKMFTPHVDEGQGGISFYGYGWVVMPAGDVKIIWHNGGNGVYNAYAGFDPQQDIFIFVSSNSNDKISDDIAAALYNIVSEKKKIQLAANEPDYRNHPVTRKILSSIMQHGAEYFSAHSKTIITESRI

SEQ ID NO: 2559 - DNA, 666 bp, Unknown
  Obtained from environmental sample
  misc_feature (1)..(666): n is a, c, g, or t
atgcgtcttttggggtttgaaactttcctggagaaaaatccccggtttcacaaaaaagtatcgctgatattaaatacccagccttcgaggactgaaatcggtgattaccagtcaatgaaggaagaagttgatgaaattgtcgggcggataaacggcaaattcggcgacattgaatggacgccgataatgtaccaatacacctcgcttgactttgaggacatggttgtgaggtatatggtttccgatatagccctggtaactccattaagggacgggatgaaccttgtctcaaaagaatttatcgcctgtaaacaggataaaaaaggatcccttattttaagtgaaactgccggatctgcaaaagaactaaaccaggcaatcttaattaacccgaataacaccgacgaaatcgccgaagccatcaaaaaagcgctgacaatgagcctgcctgaacaatcaaaaaggatgcggcaaatgattgaggttgtggaacactttaactccgactggtgggccaaagaatctgtagacagaattatgcaggccaataaatcgcanaaattatccccccaactgactcttaactcacgctatagaaaacaactcttaaacgattatatgagggccgaaagaagcttttacttttggattatgacggaacactag

SEQ ID NO: 2560 - protein, 221 aa, Unknown
  Obtained from environmental sample
  DOMAIN (1)...(181): Glycosyltransferase family 20
  misc_feature (1)..(221): Xaa is any amino acid
MRLLGFETFLEKNPRFHKKVSLILNTQPSRTEIGDYQSMKEEVDEIVGRINGKFGDIEWTPIMYQYTSLDFEDMVVRYMVSDIALVTPLRDGMNLVSKEFIACKQDKKGSLILSETAGSAKELNQAILINPNNTDEIAEAIKKALTMSLPEQSKRMRQMIEVVEHFNSDWWAKESVDRIMQANKSXKLSPQLTLNSRYRKQLLNDYMRAERSFYFWIMTEH

SEQ ID NO: 2561 - DNA, 546 bp, Unknown
  Obtained from environmental sample
  misc_feature (1)..(546): n is a, c, g, or t
gtggatacacagtatattctggagaatatttcagaatataaggctgcacaacaacagctcgatcagatctccattaactggcaaaaagaaattgaggctaaatatgccgtcattgataagttatataaagattaccaggctgaacagatcctcttgactgaagaaatgaagcgtaagcgtgaagcagaaataactgctaaggaaaaggaagtaaaagaattccagaaacaaaaattcggttatgatggcgaactgttcaaaaagaagcaggagctggttaaaccattacaggataaaatatacaatgctgtaaagaaacttgctacagaacaaagctatgcagtaattttcgacaaatccagtgacctaatcatgctttatactaatccgaaatacgacaaaagcgatgacatccttttgtctatgggatataaggcaggcagcaagaatacaggaactgataagactccgacttcacccggcaataccggaacacagataaacaagcagggaagcgaagatgaaagaccatccgaaagaaaataa

SEQ ID NO: 2562 - protein, 181 aa, Unknown
  Obtained from environmental sample
  DOMAIN (1)...(143): Outer membrane protein (OmpH-like)
  misc_feature (1)..(181): Xaa is any amino acid
MDTQYILENISEYKAAQQQLDQISINWQKEIEAKYAVIDKLYKDYQAEQILLTEEMKRKREAEITAKEKEVKEFQKQKFGYDGELFKKKQELVKPLQDKIYNAVKKLATEQSYAVIFDKSSDLIMLYTNPKYDKSDDILLSMGYKAGSKNTGTDKTPTSPGNTGTQINKQGSEDERPSERK

SEQ ID NO: 2563 - DNA, 372 bp, Unknown
  Obtained from environmental sample
  misc_feature (1)..(372): n is a, c, g, or t
atggctaaagcttttgtcgcaaaaggctatggcattatcagtggcggcacagacaatcatttaatgttgattgacctgcgtaataaaaacattacgggtaaaaaagcgcaggaaactttagaccgggcacacatcacactgaataaaaatgcagtgccttttgatgacaaaagcccctttgttacttctggcattcgtgttggcgttcctgcagttaccacaagaggtatgaaggaagaacatatgcaacctgtggttgacatgattgataaagtgctgatgaatattgatgatgaaaacctggtaaaacaaacatccggtgaagtacattcatttatggagcagtttccactttatcctgagttgggttga

SEQ ID NO: 2564 - protein, 123 aa, Unknown
  Obtained from environmental sample
  misc_feature (1)..(123): Xaa is any amino acid
MAKAFVAKGYGIISGGTDNHLMLIDLRNKNITGKKAQETLDRAHITLNKNAVPFDDKSPFVTSGIRVGVPAVTTRGMKEEHMQPVVDMIDKVLMNIDDENLVKQTSGEVHSFMEQFPLYPELG

SEQ ID NO: 2565 - DNA, 636 bp, Unknown
  Obtained from environmental sample
  misc_feature (1)..(636): n is a, c, g, or t
atgctttgggaagcggtagattcttatgctccacctttttatcgtggaaaaacattagttagtagtgagggttcttataaagttgtcgctatgcctaatgtcttagacacatcagggaccatgaatcctaaaaatttttcttattcttgggaaaaagacaacaaagatcaaataagttcttctggttgggggaaaaataactttatcttcaaaaaaagttttttagacaccattaatcaagtggctgttaaaatatctagtttaaacaatacgattaacaccggtggtaaaataattttaagaaataacattcctaagattgttttttaccaagaagatccactatttgggatacaaacacaagaatctttgaaaaatggtttcaatgtaaataatgatggagtggttattgtggcaataccttattttatgccaacgaaagatggcaaggttgataatctagaattcagctggagtgtaggggatgctcctattccagtacaaaagccaaaaaacaaaattgcagtaaagcctgataataatcaaaagggtaatactgtaatcaaagtagaggcaaataactttaatagtgtggcttctcctgcaatatccagacttatttctgtaagcttttaa

SEQ ID NO: 2566 - protein, 211 aa, Unknown
  Obtained from environmental sample
  misc_feature (1)..(211): Xaa is any amino acid
MLWEAVDSYAPPFYRGKTLVSSEGSYKVVAMPNVLDTSGTMNPKNFSYSWEKDNKDQISSSGWGKNNFIFKKSFLDTINQVAVKISSLNNTINTGGKIILRNNIPKIVFYQEDPLFGIQTQESLKNGFNVNNDGVVIVAIPYFMPTKDGKVDNLEFSWSVGDAPIPVQKPKNKIAVKPDNNQKGNTVIKVEANNFNSVASPAISRLISVSF

SEQ ID NO: 2567 - DNA, 474 bp, Unknown
  Obtained from environmental sample
  misc_feature (1)..(474): n is a, c, g, or t
gtggatattataaaggcttcagacactgtaagagtttttaacatacacctgcaatcattaaaattcagcgcaaattatttaaactatatagagaatccttcgattaaagatgaagcagatatacaaaaatcaaaaaacattatcagtaaattaaaagcaggatttataaaaagaaaaattcaggcagaaagaataaaggatgaaatgaataaaagcccttatcctgtgatagtttgcggcgactttaatgatgtgcccaacagttatgcttataatattattggcaggagattaaaaaatgcttttgtggaaaaaggtgccgggctgggtagaactttcagtagtatttcaccaactttacgcattgataatatatttgttgacagtgaattttccgtggatcagtatacaagaataagaaaaaaattaagcgatcattttcctattatagcagatgttgctttgaagcgttaa

SEQ ID NO: 2568 - protein, 157 aa, Unknown
  Obtained from environmental sample
  misc_feature (1)..(157): Xaa is any amino acid
MDIIKASDTVRVFNIHLQSLKFSANYLNYIENPSIKDEADIQKSKNIISKLKAGFIKRKIQAERIKDEMNKSPYPVIVCGDFNDVPNSYAYNIIGRRLKNAFVEKGAGLGRTFSSISPTLRIDNIFVDSEFSVDQYTRIRKKLSDHFPIIADVALKR

SEQ ID NO: 2569 - DNA, 771 bp, Unknown
  Obtained from environmental sample
  misc_feature (1)..(771): n is a, c, g, or t
atgcctgaaattccagatatcgaagtgttctccaggaacctgaaaagctttttagcgggtaagcaggtagcaaaagtaaaagttgtcaacggaaaaaaattaaaggatacagctaaagaactttcacaagctctggaaggtaaaaaaatcatggatgtgtttcgttcaggtaaggagctgcgctttaatttttctaaaaaagttatactgggcattcacctcatgctgaccggcgacttacatttctttgaagaatcaaatgagcggaaatcgaccattgtagagttgcggtttaaagatggcaccggcctggcgcttactgaccgtatgaaaaatgctaacgttaaattgaatcctgttgacaaagcgggcattgatgcacttgacatcaattataaaacgctcaaagaaattttaaaccgaaaagcggtcatcaaaaatgttcttttagaccaggatatcatacaaggcatcggcaattcttattccgacgagattttgtggcaaacaagaatttcaccattctcaaaagcgaatgccatacctgatgaaaaaattaaggaattggctaccactataaagagagttttaaaagcggccactgaaaaaatttacaaaaatcatcctggcaagattaatagcgaggtgaaagactatctgcaaatccacactaagaagaaagcagaaagccccaccggcaaaccaattttaactgcagaacggggcatgcttttgacttactatacggatgagcagattttgtatgagtga

SEQ ID NO: 2570 - protein, 256 aa, Unknown
  Obtained from environmental sample
  DOMAIN (1)...(118): Formamidopyrimidine-DNA glycosylase N-terminal domain
  misc_feature (1)..(256): Xaa is any amino acid
MPEIPDIEVFSRNLKSFLAGKQVAKVKVVNGKKLKDTAKELSQALEGKKIMDVFRSGKELRFNFSKKVILGIHLMLTGDLHFFEESNERKSTIVELRFKDGTGLALTDRMKNANVKLNPVDKAGIDALDINYKTLKEILNRKAVIKNVLLDQDIIQGIGNSYSDEILWQTRISPFSKANAIPDEKIKELATTIKRVLKAATEKIYKNHPGKINSEVKDYLQIHTKKKAESPTGKPILTAERGMLLTYYTDEQILYE

SEQ ID NO: 2571 - DNA, 708 bp, Unknown
  Obtained from environmental sample
  misc_feature (1)..(708): n is a, c, g, or t
atgaaaaaattaaagttattaaccctttcgtccctggccttcctttcaacagttcctgtctttgcccaggacgccgacgagattatatctaaatatatcagcgctatcggcggtgctactaactggggtaaagttaatacgatctattacgaaggaaatttcgaagcacatgggacaaaggtccaaatttataagacgatctggaataataaaggaatgcgattaaatatgatagctcctcagattaatgcttttgaaatagtgactccggcagaaggttgggagttcaaacccttcttaggacaggataagcccgtggctttgacaagggaaaggttagcgaaagatgctgatcaatatgatgcgcagggaatctttattgattataaagcgaaaggtcatcgtatggaatatgcaggaactgccactatcaacggcaagcagtgttataaaattgatgtaacccataagagtggaaaatttgaaaccgtttactttgacgctacatcttatttcttaattcgcagcgtaggcaatctacctggaatgggagatgtagtaacagatttcgatcaatatactttattgccagaaggcatatggttccctatgagtatctccacaaatcccggaaccggtgatgtaattatcagtaagattgaaattaataaatctgttaaggaaactatctttaaacccgtcaactaa

SEQ ID NO: 2572 - protein, 235 aa, Unknown
  Obtained from environmental sample
  SIGNAL (1)...(20)
  misc_feature (1)..(235): Xaa is any amino acid
MKKLKLLTLSSLAFLSTVPVFAQDADEIISKYISAIGGATNWGKVNTIYYEGNFEAHGTKVQIYKTIWNNKGMRLNMIAPQINAFEIVTPAEGWEFKPFLGQDKPVALTRERLAKDADQYDAQGIFIDYKAKGHRMEYAGTATINGKQCYKIDVTHKSGKFETVYFDATSYFLIRSVGNLPGMGDVVTDFDQYTLLPEGIWFPMSISTNPGTGDVIISKIEINKSVKETIFKPVN

SEQ ID NO: 2573 - DNA, 477 bp, Unknown
  Obtained from environmental sample
  misc_feature (1)..(477): n is a, c, g, or t
atgcgaaaaaaatggctggagatcctggtgaatattttcttctgggtggcaacgacctggttgttcctaagcaccttctccattatatcaaaaaatattcaaatcgttaacgggaaagaagtagtcagtcttttttataatcgtcagctatctttacaactagtcacctgcattttattttcagcatgtcttttctatagcaacttatggttattcctaaagtaccaggatagaaaaggaaaaaacacactggtcttaaaaacagccctgttatttattgtgacagtattgttctactacctgttgcaaaaaattatccgccctgtacccgcattgatgcccggggtaatagtcggaatttttattttttattttacgatctccattacatatgcaactgcaaaattgtggctacgtactataactcataataaaattttgagactggaaaaaaagaaactgaattgtcgatgctga

SEQ ID NO: 2574 - protein, 158 aa, Unknown
  Obtained from environmental sample
  misc_feature (1)..(158): Xaa is any amino acid
MRKKWLEILVNIFFWVATTWLFLSTFSIISKNIQIVNGKEVVSLFYNRQLSLQLVTCILFSACLFYSNLWLFLKYQDRKGKNTLVLKTALLFIVTVLFYYLLQKIIRPVPALMPGVIVGIFIFYFTISITYATAKLWLRTITHNKILRLEKKKLNCRC

SEQ ID NO: 2575 - DNA, 666 bp, Unknown
  Obtained from environmental sample
  misc_feature (1)..(666): n is a, c, g, or t
atgacgaacctgataacggaaaagaaattccgctttgatatatccgggggtaaaaaaaaagaacgcctagatacctttcttacttcaaaaatagagaatgctacccgcacaagaattaaaaagcttgttgaggccgggtatgtcctggttaataataaagttgtaaaagcaagtcacctgatacagcccggagatattgtcgatgttacaattcctgtttctccgcatccttctgaagctgaacctgaagatattccacttgaaataatttttgaagatgattatctaataattataaataaacctgcaggtatggtggtgcatcccgcttattctaactggactaaaactcttgttaatgctctccttttctattcaaaaaatttaagcaaatataatactcccgagcgccccggtatcattcacaggattgataagaataccagcggtcttctggtaattgccaaggatgaatggactcatgctcagatagctgctgattttgccaggcataatattgaaagggaatactggactgtcgcggtgggtctctttaaggaaaagaaaggtggaatttacccggaacatttgcaggagcaaatcccaacggaaaaaaattttctgtttctgcttcaaaagggaaaaactgcagttacctttatataa

SEQ ID NO: 2576 - protein, 221 aa, Unknown
  Obtained from environmental sample
  DOMAIN (21)...(67): S4 domain
  misc_feature (1)..(221): Xaa is any amino acid
MTNLITEKKFRFDISGGKKKERLDTFLTSKIENATRTRIKKLVEAGYVLVNNKVVKASHLIQPGDIVDVTIPVSPHPSEAEPEDIPLEIIFEDDYLIIINKPAGMVVHPAYSNWTKTLVNALLFYSKNLSKYNTPERPGIIHRIDKNTSGLLVIAKDEWTHAQIAADFARHNIEREYWTVAVGLFKEKKGGIYPEHLQEQIPTEKNFLFLLQKGKTAVTFI

SEQ ID NO: 2577 - DNA, 411 bp, Unknown
  Obtained from environmental sample
  misc_feature (1)..(411): n is a, c, g, or t
gtgttggaaaacgaagatacactggcattgtcgccatatgataacttcttgtatgctttgaaggcagaggcaactaagcggcaatacccacgcaaactcgaaaggtttctttcttttatagggttggaaggatcaattcaagaaaagtgcaaaaagttatttgaaattagcggcaataaagaattattccaatcgcatctaattcgattcattaatttccaaaaagaaagaatacaagataaagagatttcagaagcaacacttggcaactatgttaaaacgatcaagttattttgctcaatgaatgacattgtaataaactggaaaaaaatctcaaagggtatgccgcctgtaaaaagttactctgacgacagagttcctactgttgaggaaatacaaagattactttga

SEQ ID NO: 2578 - protein, 136 aa, Unknown
  Obtained from environmental sample
  misc_feature (1)..(136): Xaa is any amino acid
MLENEDTLALSPYDNFLYALKAEATKRQYPRKLERFLSFIGLEGSIQEKCKKLFEISGNKELFQSHLIRFINFQKERIQDKEISEATLGNYVKTIKLFCSMNDIVINWKKISKGMPPVKSYSDDRVPTVEEIQRLL

SEQ ID NO: 2579 - DNA, 426 bp, Unknown
  Obtained from environmental sample
  misc_feature (1)..(426): n is a, c, g, or t
gtgggagctatatttggaacaatttcacttattgcgataaagatagccactaacataaaagaacgtctcaaaaattctacaaatgaaaatcataagaaaattgtatctatcattgatgattatgttttaccaattctacaaacaggcaacgaattcgtagacaaaacaaagaatcaagaagagaaattaaaagaatttggtaatatcatttatgatttcatgggaccagaagcagacaagattacagaaaaaccaaaagtacagatcgttaaattagagcaagacgtcacaaaagcaaatatccaagcagaagaatatgcaaagaaactagaaagattaatggttataatgaatgaattgaaaggagaaccagaaaaaacaatgggacaggcaaaagctcaaactccaccagtctttaataaataa

SEQ ID NO: 2580 - protein, 141 aa, Unknown
  Obtained from environmental sample
  misc_feature (1)..(141): Xaa is any amino acid
MGAIFGTISLIAIKIATNIKERLKNSTNENHKKIVSIIDDYVLPILQTGNEFVDKTKNQEEKLKEFGNIIYDFMGPEADKITEKPKVQIVKLEQDVTKANIQAEEYAKKLERLMVIMNELKGEPEKTMGQAKAQTPPVFNK

SEQ ID NO: 2581 - DNA, 786 bp, Unknown
  Obtained from environmental sample
  misc_feature (1)..(786): n is a, c, g, or t
atgaatcccggcttgcttgatcttatcctgttttcagagaagagaaaagattttctcctgctcctgaaagaaggccctaagaatattgaagagatacttgagaagcttcaggtgcctaggacagctcttcttccacaggtaaagaagttgaaagaagaggatctggtaatacgtgaagaaggaatataccggctcagcacgataggggaaattgttgtagaaaaaatgcagcccctgcttgatactttgtcagtatttgagacaaatgaagagttttgggccgatagaaagcttgcccctattccaccccacctcataaaaaggattagtgagcttggagattatcgcgttatagaaccggacctcagccacacttttgacctgaacgaagaatttgtaaaaaatctttccagttcaagctatgtgcacatgttttgttcttatttccatcctcattttccgactctttttctcaaccttgcaagaaaaggtattgaagtttcccttattttgagtgaagctgtatacttacggctcgtagaagatttcaaagaagagggaaaagaactcctcagtacaaaaaattcaagcctttatattctggacaaaaaagaagtgaacactcctgcgctcgttgctgccgctaacaggctactaagtctgggaatatttaacgagagcggaagatttgaccgccagtacgttgataagtttcaaccgggaacagtaaatggggagaaaactgctccattattccgggatttaacccggaaatccattaagtaa

SEQ ID NO: 2582 - protein, 261 aa, Unknown
  Obtained from environmental sample
  misc_feature (1)..(261): Xaa is any amino acid
MNPGLLDLILFSEKRKDFLLLLKEGPKNIEEILEKLQVPRTALLPQVKKLKEEDLVIREEGIYRLSTIGEIVVEKMQPLLDTLSVFETNEEFWADRKLAPIPPHLIKRISELGDYRVIEPDLSHTFDLNEEFVKNLSSSSYVHMFCSYFHPHFPTLFLNLARKGIEVSLILSEAVYLRLVEDFKEEGKELLSTKNSSLYILDKKEVNTPALVAAANRLLSLGIFNESGRFDRQYVDKFQPGTVNGEKTAPLFRDLTRKSIK

SEQ ID NO: 2583 - DNA, 750 bp, Unknown
  Obtained from environmental sample
  misc_feature (1)..(750): n is a, c, g, or t
ttggatgaagaaacagtgttaagcgcattacgcaattcgagtccccaaataagaaaagctggaattcgattaagcgaacaatatattttgaacggagatcaggagattctgaaaaggttgttctcgatgaaaaatgacgagagcaaagaagtgatcgggcagttggttgtttcattaaaccaacaaggcaatgctttcgctaaggaacaggttgaggacatactccaggggtacaaaaatcatgctttgctatcccgtataaaaaacatgttggtatcgaacgaagaaaaaagaaagttcggcgcaaagatggtagcgctgcatgaggatgccaggaaaagagtcatcaagggcgcagaaattttcagctcgctatgtgcttcatgtcatgggccaaagggagttggtttaccaaataaaattgctcctccattaattggcaaaatcaaattgttgaataatagagaagcgacgataaagatcctgttgcatggattgaaaggccccgttgagggagtctcctatccagacatcatggtgcctatgaaaagttatgacgacgaatggatcgcttcagtattaaattatgttcgcttcgaattgagcatgcaaagtttccctgacctgccggagaagtattttaattcattggcgataactcccggcgaagtcgaagcattgaggaaacagtatgcgaaccgcaaggaaccatggacgtgggaggagttgttactgaagaaaaagaaatga

SEQ ID NO: 2584 - protein, 249 aa, Unknown
  Obtained from environmental sample
  DOMAIN (116)...(201): Cytochrome c
  misc_feature (1)..(249): Xaa is any amino acid
MDEETVLSALRNSSPQIRKAGIRLSEQYILNGDQEILKRLFSMKNDESKEVIGQLVVSLNQQGNAFAKEQVEDILQGYKNHALLSRIKNMLVSNEEKRKFGAKMVALHEDARKRVIKGAEIFSSLCASCHGPKGVGLPNKIAPPLIGKIKLLNNREATIKILLHGLKGPVEGVSYPDIMVPMKSYDDEWIASVLNYVRFELSMQSFPDLPEKYFNSLAITPGEVEALRKQYANRKEPWTWEELLLKKKK

SEQ ID NO: 2585 - DNA, 708 bp, Unknown
  Obtained from environmental sample
  misc_feature (1)..(708): n is a, c, g, or t
atgcgccaggaaggatatgaacttactgtaggacagccaacggttatccttaaagagatcaatggcaagaaatgtgaaccatatgagaccttgttagtggatgtgccacaggaattcagcggtaaggtaatagacctggttacccagcgcaaaggggaaatgctggttatggaaacaaagggtgatatgcaacaccttgagtttgatatcccatcacgtggattgatcggtttacgcagcaatatgcttacaaatacggctggtgaggccataatggctcaccgatttacagaatataagccctggaaaggtgccattcctggaagaaataatggagtattattatccaagaatacggaaaggaccacggggtattctattgacaagctgcaggacaggggccgattctttgttgacccgggtgaagatgtttatgccggacagatcatagcagagaatatcaagcctggggacctggtggtgaatgcaacagaacccaagaaactgactaaccaccgcgccagcggaagtgacgatgcgtcacgtattgcgcctaaaacattgatgacgcttgaagaatgtatggaatatatccagcatgatgaatgcattgaagtaactcccaaggccatccggatgcgtaaagtgatactcgacgaagacgagagaaagaaggtcagtaagaagatgagcacggaagcggcctaa

SEQ ID NO: 2586 - protein, 235 aa, Unknown
  Obtained from environmental sample
  DOMAIN (23)...(110): Elongation factor G C-terminus
  misc_feature (1)..(235): Xaa is any amino acid
MRQEGYELTVGQPTVILKEINGKKCEPYETLLVDVPQEFSGKVIDLVTQRKGEMLVMETKGDMQHLEFDIPSRGLIGLRSNMLTNTAGEAIMAHRFTEYKPWKGAIPGRNNGVLLSKNTERTTGYSIDKLQDRGRFFVDPGEDVYAGQIIAENIKPGDLVVNATEPKKLTNHRASGSDDASRIAPKTLMTLEECMEYIQHDECIEVTPKAIRMRKVILDEDERKKVSKKMSTEAA

SEQ ID NO: 2587 - DNA, 783 bp, Unknown
  Obtained from environmental sample
  misc_feature (1)..(783): n is a, c, g, or t
ttggattttcgaatcactaaaaaggacaatctagaaatgaaatcttcgatcaagaatactaaaccaggcagtcatattcacatgatgggaatttgcggaacagcgatggcgtcattagctggtttattaaaagatcgcggatttaaagtaactggcagtgatgcgaacccttacccgccgatgtcgacgcaaattgaatcgatgggtattaatattcaacgtggctataaaaaagaaaacttaaaccctaagccggattttgttgttatcggcaacgtaatttcagctagcaatgaagaggcacaagaagtaaatcgtcttgaacttccatactgttcgttacctgaagctatgggagaactaatcatcgctgaccgtgattcttttgttgtgtcggggactcatggtaaaacaacgacgacgtcacttttaagttgggtcgcagaaaattgtggaaagcagcctgggtttttaattggtggtattccgaaaaatttctcgcaaagttttagaaatccgaaagctaatacttttgtgattgaaggtgatgaatacgatacagcctattttgataaggttccaaaatttattcattacaaacctaagcacgttattttaacttcagtcgaatttgaccacgctgatatctacaaagattttgatgcggttaaagctgcgtttaagcgcttggcggggttgattccagctgacggatcactcgtgtactggggtgatgattcacatgtaactgatattgccaaattatcagtgggtaaaaattaa

SEQ ID NO: 2588 - protein, 260 aa, Unknown
  Obtained from environmental sample
  DOMAIN (61)...(259): Mur ligase family, catalytic domain
  misc_feature (1)..(260): Xaa is any amino acid
MDFRITKKDNLEMKSSIKNTKPGSHIHMMGICGTAMASLAGLLKDRGFKVTGSDANPYPPMSTQIESMGINIQRGYKKENLNPKPDFVVIGNVISASNEEAQEVNRLELPYCSLPEAMGELIIADRDSFVVSGTHGKTTTTSLLSWVAENCGKQPGFLIGGIPKNFSQSFRNPKANTFVIEGDEYDTAYFDKVPKFIHYKPKHVILTSVEFDHADIYKDFDAVKAAFKRLAGLIPADGSLVYWGDDSHVTDIAKLSVGKN

SEQ ID NO: 2589 - DNA, 987 bp, Unknown
  Obtained from environmental sample
  misc_feature (1)..(987): n is a, c, g, or t
ttggaccaggatagagtattacaggagaaagaacttggtattaagaaagtcgatctcgagcaactcgaacaacaccaggaacaaactaaggaacaaattcttcaaacacaatctgcactcgaaacgcttcgcaatgaattagcaatagaaaatagaaaacttgatgcaaagaagaacgagcatgatttgttgaagagcatgatcgattcaatggaaggctaccctgatagcgtaaaatttcttcacaacaatgaaggttggaaccacgcgtcacctatcctgtctgatataatctatgtaaaggaagagtatcgtactgccctggagaatgtacttgagccctatctcagctattacgtggtgaatgatctacgcgagggtttgcaggctgtacacctgctggatgataataaaaaaggaaaggcaaatttcttcctgcttgataaggtgtcagaacattctgctggtcttccgtcacatggccttgaaggcgcaattcctgcattgtcagttattgaggtagaagataagtatcgcaagctgacagaacacctcctcgcaaatgtgttcattgcagatagtgaagatgcattggaaaatagcaatggtttcaccatcattgagaagaatggtaagtatgtaaaaggaaaatattcccttaccggaggtagtgttggtctgattgaaggaaagaagataggtagagcaaaaaatctcgagaagctacaggaagaaatcgctatacaggataaagttgcggaagaacttcgtgctcagatacaggccaggcataatgaagtcattgccttcaatgaagatcttcgggaaattgcgctacgtgagacagagcatgaaattcaacagttaacaaaccaggtgttctcgcttcataaacaaattagagaatccccattcattggcgaccagcagccaacaacggcttggaaaacttcacacatcaggttcagaaaacacaaggtctgttga

SEQ ID NO: 2590 - protein, 328 aa, Unknown
  Obtained from environmental sample
  DOMAIN (90)...(224): SMC proteins Flexible Hinge Domain
  misc_feature (1)..(328): Xaa is any amino acid
MDQDRVLQEKELGIKKVDLEQLEQHQEQTKEQILQTQSALETLRNELAIENRKLDAKKNEHDLLKSMIDSMEGYPDSVKFLHNNEGWNHASPILSDIIYVKEEYRTALENVLEPYLSYYVVNDLREGLQAVHLLDDNKKGKANFFLLDKVSEHSAGLPSHGLEGAIPALSVIEVEDKYRKLTEHLLANVFIADSEDALENSNGFTIIEKNGKYVKGKYSLTGGSVGLIEGKKIGRAKNLEKLQEEIAIQDKVAEELRAQIQARHNEVIAFNEDLREIALRETEHEIQQLTNQVFSLHKQIRESPFIGDQQPTTAWKTSHIRFRKHKVC

SEQ ID NO: 2591 - DNA, 804 bp, Unknown
  Obtained from environmental sample
  misc_feature (1)..(804): n is a, c, g, or t
atgatcagcagaagaaatatccgggtaaaagtgatgcagacgctgtacaacataactacccttgaacccaacgcaaaaccaggagaaccgcaaaagatccttcaaaaccattttgaccagacccgccagctttttgttcacctcacgtattttttaactgaagtgtgtcgctatgcagaaaccgattcgcatcaacgttcgggcaagcaccttcctacttacgaagatctccatgtaaataccaaactatcgggtaataaaatattatggagaatattgcaggacgcctcctttaaagaagcactggcaaaactgaagcctcaacaagctataaacaaagatttagtacgcaaactttacctcaaccttgccgagactgctgaatacaagacgtacattaacaaagaaggaagagataacagggaagaaaaagaaatactggaatttatcctggataaactgatgctcgcgaatgagaattttacttcctatatcgaagaacttttttcaaactgggatgatgatggtgagatggtgatccagcttcttgtaaatcttttacaaaaaccaggaagtatggattttaaggaaatgatcaatggtgaaaaaaaagattttgcaatgaatctgttgaaaacagtacatgaaaaaagtgatcacctgcaaacgctgattattccaaaactaaaaaactgcgatcccgaacggatcgcattattggatatgatattgatgacactgggggtatcagagtttctttactttgaaagaataccaccaaaggtcactattatgaatttctag

SEQ ID NO: 2592 - protein, 267 aa, Unknown
  Obtained from environmental sample
  misc_feature (1)..(267): Xaa is any amino acid
MISRRNIRVKVMQTLYNITTLEPNAKPGEPQKILQNHFDQTRQLFVHLTYFLTEVCRYAETDSHQRSGKHLPTYEDLHVNTKLSGNKILWRILQDASFKEALAKLKPQQAINKDLVRKLYLNLAETAEYKTYINKEGRDNREEKEILEFILDKLMLANENFTSYIEELFSNWDDDGEMVIQLLVNLLQKPGSMDFKEMINGEKKDFAMNLLKTVHEKSDHLQTLIIPKLKNCDPERIALLDMILMTLGVSEFLYFERIPPKVTIMNF

SEQ ID NO: 2593 - DNA, 342 bp, Unknown
  Obtained from environmental sample
  misc_feature (1)..(342): n is a, c, g, or t
atgtatatctatttcttagctgatcccccggcaccaggcccatttggcggcggtacgacgacccttgtatttatggcgatgatcattcttgtcttctggttgttttttataagaccgcaaactaaaaagcaaaagcaacaaaagaaatttattgacgacctgcaaaagggaacaaaggttgttacaatagcagggattcacggtacggttaataaaataaacgaagacgggaccatcaatcttgaagttagtcctggcagttatataaaaatggagaaagcttccataagtatggaaatgacagccgcaatcaataaagctgttacaactgagaaaaagtag

SEQ ID NO: 2594 - protein, 113 aa, Unknown
  Obtained from environmental sample
  DOMAIN (17)...(100): Preprotein translocase subunit
  misc_feature (1)..(113): Xaa is any amino acid
MYIYFLADPPAPGPFGGGTTTLVFMAMIILVFWLFFIRPQTKKQKQQKKFIDDLQKGTKVVTIAGIHGTVNKINEDGTINLEVSPGSYIKMEKASISMEMTAAINKAVTTEKK

SEQ ID NO: 2595 - DNA, 429 bp, Unknown
  Obtained from environmental sample
  misc_feature (1)..(429): n is a, c, g, or t
ttgagcaaggaacgcaccaaattatcaaaacaggttactagggacgttagaattcaaaatcctcaagctgctatcgaaaatgcgtttacacattttgaagactctttacgaaaacgtatcgntggtgattacaaattgtatagcaacaatttgataaaagccgcatacggaaaagaagaagttcgtctgttgtttatattcgatggaaaaaactctactgagcatctttattatctgatgtctggtgcctattcactttttcgtaatccccgtcatcacaaaatcatcgacgacggtgaacaaaaagcgcaggtaataatttcattggcagagttactaatggagtttgtcgatgcatctgaggatagaacaaccaatttgcaaaacttatcgaaagtacatgctatagatcaaaagagtctggattga

SEQ ID NO: 2596 - protein, 142 aa, Unknown
  Obtained from environmental sample
  misc_feature (1)..(142): Xaa is any amino acid
MSKERTKLSKQVTRDVRIQNPQAAIENAFTHFEDSLRKRIXGDYKLYSNNLIKAAYGKEEVRLLFIFDGKNSTEHLYYLMSGAYSLFRNPRHHKIIDDGEQKAQVIISLAELLMEFVDASEDRTTNLQNLSKVHAIDQKSLD

SEQ ID NO: 2597 - DNA, 906 bp, Unknown
  Obtained from environmental sample
  misc_feature (1)..(906): n is a, c, g, or t
ttgaaatttactggtgaacagattttagaaaagacaaaggctggagacattgtaaacaaagttggaagcataggtaaaatttatattaacggagttaaggttgcagaagaagaacggttcttattcagctataacataacacagctaacaagtgcaataaaaaaatctcttaaccgagaaagaacaaatgttggaagaacagcttatacagatagtgtaaagaaaatattacttgcctgtaagtcaacagatgttgcaaaaatattggctgacgatttacaaaatatcaattatggaacagcgcacgacgaactttcttggattgatgttcaagaacattcagttaaaatacttaatcaaaatgaaaaagttctttttgtttcctcaaccgatatcatgttgcacccagatatgatcgaagaggctaaagcaagtgggcttcaaataatttcaatccctgaaaatctgaaagaaaaaattagaggaggtttggatttatcaggaaaacctattgttgacatttctcaatttgtaacaacatacaatgatagcttttcgttcgaattcgtagctattgaaaatcttactaaaagggaacgtgaaatttttgatttaacaaatgacattttaaatcttattgatggcaaaccgagagctgttagggatattaagatttcaacaactatgcgaaaagacttttttgggcaagctgaaactcatggagtttgggagccaaatacaagttcaattattattcatcgcccaatgctaaactctataaaagattatgctggaactttaattcatgaagctatgcatgccaaatctggattaggagatattagtagaaatttcgcactgagtgcaatcttgatcactaggtcgggnnaccgnnncaaagcctag

SEQ ID NO: 2598 - protein, 301 aa, Unknown
  Obtained from environmental sample
  misc_feature (1)..(301): Xaa is any amino acid
MKFTGEQILEKTKAGDIVNKVGSIGKIYINGVKVAEEERFLFSYNITQLTSAIKKSLNRERTNVGRTAYTDSVKKILLACKSTDVAKILADDLQNINYGTAHDELSWIDVQEHSVKILNQNEKVLFVSSTDIMLHPDMIEEAKASGLQIISIPENLKEKIRGGLDLSGKPIVDISQFVTTYNDSFSFEFVAIENLTKREREIFDLTNDILNLIDGKPRAVRDIKISTTMRKDFFGQAETHGVWEPNTSSIIIHRPMLNSIKDYAGTLIHEAMHAKSGLGDISRNFALSAILITRSGXRXKA

SEQ ID NO: 2599 - DNA, 717 bp, Unknown
  Obtained from environmental sample
  misc_feature (1)..(717): n is a, c, g, or t
gtgcccagatttaatctggcaaatgcatctttattctcagctcacataaattctttagtactccaggttatttctcaaaagataatgacacgtcctttggagtttgttgatttcagcgactttaatgaactaccaataatttcaagttacctggaagcattattaaaagcagttcaggagaataagcccaagattcttcagaacattaaagcagcgtttggaaaagaaatagacgaatcggaaaaacaaatcatctggcaagatgtagaagagcagattgatgaatttgtttacagatttgacagagcttttgataaaatgcgaagtgattacagagaatcattaaaagagattcttgagatcaataaaatgaagattgaggataaagctcatgactttgtcctttcaagtcggagagaagcattagaaaagaggaacgaaaatataaagaatggcaaggaagaattttatgtatataggtatctaagtcaggttgggttcttgcccaattatgcatttcctcaaaaaattacttcaattaaattcctccaccagaaggaggaggaagaattagtaagagatcagaacgtagcaatcagagaatttgctccacacaatacgctttactacggagggttaaagtatgcagtgcaatacgtaagtaaagaaactgatcccaataaacgttataagtaccgcagtttgtcccgactgtga

SEQ ID NO: 2600 - protein, 238 aa, Unknown
  Obtained from environmental sample
  misc_feature (1)..(238): Xaa is any amino acid
MPRFNLANASLFSAHINSLVLQVISQKIMTRPLEFVDFSDFNELPIISSYLEALLKAVQENKPKILQNIKAAFGKEIDESEKQIIWQDVEEQIDEFVYRFDRAFDKMRSDYRESLKEILEINKMKIEDKAHDFVLSSRREALEKRNENIKNGKEEFYVYRYLSQVGFLPNYAFPQKITSIKFLHQKEEEELVRDQNVAIREFAPHNTLYYGGLKYAVQYVSKETDPNKRYKYRSLSRL

SEQ ID NO: 2601 - DNA, 471 bp, Unknown
  Obtained from environmental sample
  misc_feature (1)..(471): n is a, c, g, or t
ttgaaatcggtctctgtgctcttgaagattcaaactctaatttacaaaaggaaatttgacaatccggaagtagaatattcttccataatgcaaggacaaaaaaattacatactcgatttgatccctaaattaaaaaattatgatcaggtgagggttaataccaagaatttaatcgatattttacagggcgaaagttttgatgttaaacttatgtctgattctaggcagaatgaaataagccagaataaactggatttaataataaagtttggactatctgacaacagagatgagttgactgcacttttgcagaggtttgcaataaatctttcatctatgaaggtgaaggaaacatctgaaaaattagacttgcatttggttcaagccgtcaacacattagacgagttggatgaaataataaataccaatcagtacgaggattcgcgaatggtacggtctccattttcctga

SEQ ID NO: 2602 - protein, 156 aa, Unknown
  Obtained from environmental sample
  misc_feature (1)..(156): Xaa is any amino acid
MKSVSVLLKIQTLIYKRKFDNPEVEYSSIMQGQKNYILDLIPKLKNYDQVRVNTKNLIDILQGESFDVKLMSDSRQNEISQNKLDLIIKFGLSDNRDELTALLQRFAINLSSMKVKETSEKLDLHLVQAVNTLDELDEIINTNQYEDSRMVRSPFS

SEQ ID NO: 2603 - DNA, 450 bp, Unknown
  Obtained from environmental sample
  misc_feature (1)..(450): n is a, c, g, or t
atgaatgccaaattcatttatcagatgttccgggaattggagcaacagtcgacaataaattccttgagaactgccagaaagaaatcttcactgcctgaatttacattcttacctttgtgttgtatggtagaagacatacatacgttggtaatacccacgttcatttttgatccggcgacgctttatatcctggatgcgaatgaacgctttactgaattgtacggctattcgcttgaagagctgaaacatatgcgtatctaccagctgcgtcctccggaggaaaaacaaaatgcgctaaagcttattgagtccacccgcggacatgtaatctattccggagaatccacgcatcagaaaaagaacggacagaaaattcctgtgcaggtttttggaaagcgctttcatcttcataacagggatttttttctggcgaagatcaaagtgaaatag

SEQ ID NO: 2604 - protein, 149 aa, Unknown
  Obtained from environmental sample
  misc_feature (1)..(149): Xaa is any amino acid
MNAKFIYQMFRELEQQSTINSLRTARKKSSLPEFTFLPLCCMVEDIHTLVIPTFIFDPATLYILDANERFTELYGYSLEELKHMRIYQLRPPEEKQNALKLIESTRGHVIYSGESTHQKKNGQKIPVQVFGKRFHLHNRDFFLAKIKVK

SEQ ID NO: 2605 - DNA, 501 bp, Unknown
  Obtained from environmental sample
  misc_feature (1)..(501): n is a, c, g, or t
atgcctgtataccagttacacaatacttctgtgcctttgcaaacttattttgatgttaagataaaagcaaccattccaccgccctataacaataagatggtgatgaaaagattctctggcagtaaggaagattacgttaaagcagagccggtaagtatgggcagagaaacagggtggtataaagctgctttccgcgaatttggtaatttccagttactgatagattccattccccctgtagtaacagccattggcctccgcaatgggatgaatgcggcaaggcttagccgtataatttttacagtaaaagacaatacagaagaaataaaaaaattcacagcattgctggatggtaaatggctacgcttcagtaatgacaagggcaggaattttatttataattttgatgcatattgccccccaggtgcacatgaattattgataactgtggaggaccaggcaggaaatatcacagaaaaaaaatacaatttcacccgttaa

SEQ ID NO: 2606 - protein, 166 aa, Unknown
  Obtained from environmental sample
  misc_feature (1)..(166): Xaa is any amino acid
MPVYQLHNTSVPLQTYFDVKIKATIPPPYNNKMVMKRFSGSKEDYVKAEPVSMGRETGWYKAAFREFGNFQLLIDSIPPVVTAIGLRNGMNAARLSRIIFTVKDNTEEIKKFTALLDGKWLRFSNDKGRNFIYNFDAYCPPGAHELLITVEDQAGNITEKKYNFTR

SEQ ID NO: 2607 - DNA, 774 bp, Unknown
  Obtained from environmental sample
  misc_feature (1)..(774): n is a, c, g, or t
atgaaagaaatgttaatttgtttgatntcaagaatgtttcttgtttcaaaaaatgaaagatgtacaattcttgttcaaggaaattcaggaagtggaaaaacaattttattgcattgtattgaaaattattttattgaaagattaatttcaaaatattcaaataactcaaaagcaccttcatttgcaaatagtgaagatgatggaacaataattccaattagaattgaattgggaagatatgaacaaacaagtgatttgttgaatagttttatgagattgaatggattgacttatgatgattttgatttctcagaaaatgtaaaatatttgattattttggatggagttgatgaaataaatcaaacaacagcaagattacttgaatcaaatccatttttaaaacaattaaattcagtgataatatttggatgtagaacagaacatcttattccaatgaaatcattttatcttgaattttttactccaaattacaattatagcaaaccttcttcagaatcaaaaatagaaaatatttcaataacacatcaaaatgaaaaagaagaaaatgaaaaagaaaaatgggaagaaataaatgaaaatgaaaaatgggaagataattgggaagatgatgaagaaaataatgaaaaaaatatttcaaaagatgcaaataaaaatgaaataattgattttcatctttctcaaaatccagaatcaaaaataaaaagaaacccagaaaatgaagaacttttaaatatgaaagagaaagaaggttaa

SEQ ID NO: 2608 - protein, 257 aa, Unknown
  Obtained from environmental sample
  misc_feature (1)..(257): Xaa is any amino acid
MKEMLICLXSRMFLVSKNERCTILVQGNSGSGKTILLHCIENYFIERLISKYSNNSKAPSFANSEDDGTIIPIRIELGRYEQTSDLLNSFMRLNGLTYDDFDFSENVKYLIILDGVDEINQTTARLLESNPFLKQLNSVIIFGCRTEHLIPMKSFYLEFFTPNYNYSKPSSESKIENISITHQNEKEENEKEKWEEINENEKWEDNWEDDEENNEKNISKDANKNEIIDFHLSQNPESKIKRNPENEELLNMKEKEG

SEQ ID NO: 2609 - DNA, 813 bp, Unknown
  Obtained from environmental sample
  misc_feature (1)..(813): n is a, c, g, or t
atggcaaacgaatcgaataattttaatgaaatcattgcacactgcaaagagtacggttatatttttccttccagcgaaatctacgacggactaagtgcggtgtatgattacggccaaaacggcgcacagttaaaaaaaaatatccgtgattactggtggaaaagcatgacgcaaattcatgaaaatatagtgggaattgatgcggctatttttatgcatccactgacatggaaagctagcggacacattgataatttcagcgacccgatgattgacaacaaagacagcaataagcgttatcgcgttgatcatttgatagaaagtcatgcagaaaaactcgcacttgaaggaaagaaagaagaagaatttgcgttgctgaaaaagatggatgaattattgggcaaggatgattttgagggcttaaagaatttaattgaagaaaataaaattgtctgttctgtaagtggaacctgcaactggactgatattcgccagtttaatttaatgtttgacacacaactgggaagtgtggcaggtgaagcagataagatttacctgcgaccggaaactgcgcaggggatttttgtaaactttctgaacgtacaaaaaaccgggagaatgaaaatacctttcggcattgcacaaaacgggaaaggcgttttagaaatgaaaattgttgccccgccagttttatttttccgcatgaagagaattttgaacaaaatggaaatgccagttttttttgtggcgcccccggccacaaaaaaatggaattgggtacactttacctggaaaggccagaaaagaatttaa

SEQ ID NO: 2610 - protein, 270 aa, Unknown
  Obtained from environmental sample
  DOMAIN (33)...(246): tRNA synthetase class II core domain (G, H, P, S and T)
  misc_feature (1)..(270): Xaa is any amino acid
MANESNNFNEIIAHCKEYGYIFPSSEIYDGLSAVYDYGQNGAQLKKNIRDYWWKSMTQIHENIVGIDAAIFMHPLTWKASGHIDNFSDPMIDNKDSNKRYRVDHLIESHAEKLALEGKKEEEFALLKKMDELLGKDDFEGLKNLIEENKIVCSVSGTCNWTDIRQFNLMFDTQLGSVAGEADKIYLRPETAQGIFVNFLNVQKTGRMKIPFGIAQNGKGVLEMKIVAPPVLFFRMKRILNKMEMPVFFVAPPATKKWNWVHFTWKGQKRI

SEQ ID NO: 2611 - DNA, 681 bp, Unknown
  Obtained from environmental sample
  misc_feature (1)..(681): n is a, c, g, or t
atggaagcaagtggtgtgattacaagcggagggaaagtagaagaaatcgcaacaaagaataatttcgatgtgattcgtattcccggtggtatgcctccgcgtgcatgctttggctattcctttacgcaactgttttatatcctcggttttcacaaactgataggagaaaattttcataaggatctcagggaaacaatcacattactgaatgaatatgaacctgaaatcagaaaggaagccgattcacttgcggcaaaactgatcggcaagcttccggtgatttattccgaagcacgttatgaaggtgttgcaatccgttttcgtcagcagatcaatgaaaacagcaaaatgttatgctggcatcatgttcttccggaaatgaatcacaatgagcttgtaggctggaccgaaaaacatgaggagatttatgtaatccagctgcgtaatgcagatgattatttccggacccagaaaagaatggagatctcaagggatgttttcagtaagtatacccctaattattatgaattgcattcacgtggtgaaacacaacttcagcgttctctctttcttattcatttgtgcgactgggtaagctggtatattgcggataaaaagaaaattgattcaatggaagtaaaggtgatcgatcatctcaaaaccgaactgggcaaattatga

SEQ ID NO: 2612 - protein, 226 aa, Unknown
  Obtained from environmental sample
  misc_feature (1)..(226): Xaa is any amino acid
MEASGVITSGGKVEEIATKNNFDVIRIPGGMPPRACFGYSFTQLFYILGFHKLIGENFHKDLRETITLLNEYEPEIRKEADSLAAKLIGKLPVIYSEARYEGVAIRFRQQINENSKMLCWHHVLPEMNHNELVGWTEKHEEIYVIQLRNADDYFRTQKRMEISRDVFSKYTPNYYELHSRGETQLQRSLFLIHLCDWVSWYIADKKKIDSMEVKVIDHLKTELGKL

SEQ ID NO: 2613 - DNA, 978 bp, Unknown
  Obtained from environmental sample
  misc_feature (1)..(978): n is a, c, g, or t
ttgcataatatgcgcaccctcaatcacatgcctgtagatagacaaatcgtcatcgctcaagagactctcgatatttatgcgccactagcaaacagacttggtatcagctgggtaaaaatagaacttgaagatttaagtctacgctatttgaagccagaaatttattacaagttagtccaaaaggtctctaagaagaaaaaagaacgagaaaaatacatcaatgaagtcatcaacgacatcgaagcagatcttaaaaaagaaggcatcaaggcagaaattcacggcagaccaaaacatttctattcgatctataaaaaaatggaagccagtaacatcgattacgaacaagtttatgatgttttggctttccgcgttctcgtcaatagcgtcgtgcaatgttacgaagttttaggtgtcgttcataatctttggaagcccattcctggaagattcaaagacttcatcgccatgcccaaggctaataactatcaaagtttgcacacgacagtaattgggcccggaggcgagagagttgaaattcaaattagaacccatgaaatgcatctcactgccgagcgtgggattgccgcacactggaaatataaagagggtggtggcattgataaagaaacagaaaaacgatttgaatggctccatcaattattgcaatggcatcaacaactcanagatccttctgaatttttagagacaatcaagacagacttatttgccggtgacatttacgttttcacgcctcaaggcgatgtcatggaatttccatttggctctacagctttggacttcgcctacagtgtgcacacagatgtcggcaatcggtgtgtgggcgctaaaagtaacgggaaaatcgttcccttaaagcataaacttaaaaacggtgatttctatgagatcattacttcaaataatcaaaaagcaacaaaagattggctcangatggtgccacaccagtcgcgctaa

SEQ ID NO: 2614 - protein, 325 aa, Unknown
  Obtained from environmental sample
  DOMAIN (243)...(306): TGS domain
  misc_feature (1)..(325): Xaa is any amino acid
MHNMRTLNHMPVDRQIVIAQETLDIYAPLANRLGISWVKIELEDLSLRYLKPEIYYKLVQKVSKKKKEREKYINEVINDIEADLKKEGIKAEIHGRPKHFYSIYKKMEASNIDYEQVYDVLAFRVLVNSVVQCYEVLGVVHNLWKPIPGRFKDFIAMPKANNYQSLHTTVIGPGGERVEIQIRTHEMHLTAERGIAAHWKYKEGGGIDKETEKRFEWLHQLLQWHQQLXDPSEFLETIKTDLFAGDIYVFTPQGDVMEFPFGSTALDFAYSVHTDVGNRCVGAKSNGKIVPLKHKLKNGDFYEIITSNNQKATKDWLXMVPHQSR

SEQ ID NO: 2615 - DNA, 411 bp, Unknown
  Obtained from environmental sample
  misc_feature (1)..(411): n is a, c, g, or t
gtgccgcgcaattgcgtccttaacctggtccccaataaacacaaggtttttagcgaaatctaccgggtgctgaaaccgggaggacatttttccatctctgatattgttcttgaaggtgagcttcccgccaaatggagagatgtggcagaattatatgcaggctgcatttccggtgctatccaaaaagaagattacctgaagatcattaaagaagcaggcttcacttatatttttttacagaaagacaaacccatcaccatccctgatgagatccttgctaattatctgacgccccaggaaattgcagaatacaaggctggcaatacaaggataacgagtattacggtctatggtgaaaaaccatccaaggacgatcgcaaatgttgcgagcccggcagtggttgttgttaa

SEQ ID NO: 2616 - protein, 136 aa, Unknown
  Obtained from environmental sample
  misc_feature (1)..(136): Xaa is any amino acid
MPRNCVLNLVPNKHKVFSEIYRVLKPGGHFSISDIVLEGELPAKWRDVAELYAGCISGAIQKEDYLKIIKEAGFTYIFLQKDKPITIPDEILANYLTPQEIAEYKAGNTRITSITVYGEKPSKDDRKCCEPGSGCC

SEQ ID NO: 2617 - DNA, 1038 bp, Unknown
  Obtained from environmental sample
  misc_feature (1)..(1038): n is a, c, g, or t
gtgattcagttcaatcaaagtggtattgaaaacgtagtcgcttcttctggaacagctttaacgccagatcaaattcgtttggtaagtcgtttaaccaataatatgacggttttatttgatggtgatgcggcaggtttacgcgcttctattcgaggaatcgatttaattctggaagcaggaatgaacgtaaaagtttgtagtttccctgatggcgaagatccagatagttttgcaaagaacaattcatacgatgttttaaaacaatatttagacgaaaactccaaagattttattcagtttaaagccgatttattagttaaagaagccaacaacgacccaataaaaaaagctgaattaattagagatatggtcaacagtatttctaaaatttcggatacaattaaacgtgaagtttatataaaagagtgttctagaattatggatatttcggaagaagttctgtacaacactttggcacaaatgcttaaaaaagatatttctgatgcgaataaaaaattcacagaagagaaaaaagcatttgaggttgtaaaaaacaacgagaatttacaaccagaaaaaattgatagtcaatatatttttgaacaaaaaatcattgaaacgcttttaattaatggtttgaaaaccgaaacatttactgaaattttccaagtggaagatgaaaaaggtgaattagtagatgtaaaagaaaataatacgtataanatttacgaaaaaatatatttagcacttcaagaagacgaaattgaattgtcaaatccaatttttagaaatatttatgtagatattatcaattactacaatcagaatattgaatttgaaattgacaaatacatttctgaaactacaccagaaattacagataaaattactttcatttttatgttaaaagaacgtgatacgttacacaaatggcatttaagaaaaattgtggtagatgataaagatatcaattttagagccacatgttttcggaaaactatttttggccatatcggttttttttgcttaaccgaataa

SEQ ID NO: 2618 - protein, 345 aa, Unknown
  Obtained from environmental sample
  DOMAIN (1)...(69): Toprim domain
  misc_feature (1)..(345): Xaa is any amino acid
MIQFNQSGIENVVASSGTALTPDQIRLVSRLTNNMTVLFDGDAAGLRASIRGIDLILEAGMNVKVCSFPDGEDPDSFAKNNSYDVLKQYLDENSKDFIQFKADLLVKEANNDPIKKAELIRDMVNSISKISDTIKREVYIKECSRIMDISEEVLYNTLAQMLKKDISDANKKFTEEKKAFEVVKNNENLQPEKIDSQYIFEQKIIETLLINGLKTETFTEIFQVEDEKGELVDVKENNTYXIYEKIYLALQEDEIELSNPIFRNIYVDIINYYNQNIEFEIDKYISETTPEITDKITFIFMLKERDTLHKWHLRKIVVDDKDINFRATCFRKTIFGHIGFFCLTE

SEQ ID NO: 2619 - DNA, 552 bp, Unknown
  Obtained from environmental sample
  misc_feature (1)..(552): n is a, c, g, or t
atgtttgaagaggcgggaggcctcgggggctattacgatacttacaaaggtacctggccgcgaaatatttttaatgaattcaacattgctgatgtaacagtgccgatactggggggagacggagaaataaaaaatattattctacgtggtcagcttgataagatcgaaatgctcgagggttctggcgtgaatgtggtcgactataaaaccggtaaaccgaaaagtcggcgtgagattgaaggcgaaacagaatcttctgaggggaacattaagcgtcagctcgttttttataaaatcctgctcgacggcagtgccaagtctgatttcaaaatgaagtccggtgaaatcgactttgttgaaccaaatgatcgaggaatttacaagaaagagaagttcgaagttgccgatgcggaaattgcggaacttttagaggtaattaaaaaatcagctcaggagataatggggctgaccttttggaatgatgagtgtaaagatgatgaatgtgaattctgtgagatgcgaaagctgatgatgtcgcaggataattcctaa

SEQ ID NO: 2620 - protein, 183 aa, Unknown
  Obtained from environmental sample
  misc_feature (1)..(183): Xaa is any amino acid
MFEEAGGLGGYYDTYKGTWPRNIFNEFNIADVTVPILGGDGEIKNIILRGQLDKIEMLEGSGVNVVDYKTGKPKSRREIEGETESSEGNIKRQLVFYKILLDGSAKSDFKMKSGEIDFVEPNDRGIYKKEKFEVADAEIAELLEVIKKSAQEIMGLTFWNDECKDDECEFCEMRKLMMSQDNS

SEQ ID NO: 2621 - DNA, 318 bp, Unknown
  Obtained from environmental sample
  misc_feature (1)..(318): n is a, c, g, or t
atggagcttataaaagcaacaaagtacggcttcatcttgttctgcattttaaattctttacgtagagtttctcgtcaattatacgactcgattactcatcaaagtgttaataatactcttcgtcaaattgaaactaaattaaatattacacaaccttctgattggtacaaagtgccagtgaaagatgtgctgcaaatccctgaaggaacaagcttattgaaagaatataatcaatctataacagacatgctaaaatctttatatccaaactttcaatgggaatactcaaagtatttttgttcttccttttcatattaa

SEQ ID NO: 2622 - protein, 105 aa, Unknown
  Obtained from environmental sample
  misc_feature (1)..(105): Xaa is any amino acid
MELIKATKYGFILFCILNSLRRVSRQLYDSITHQSVNNTLRQIETKLNITQPSDWYKVPVKDVLQIPEGTSLLKEYNQSITDMLKSLYPNFQWEYSKYFCSSFSY

SEQ ID NO: 2623 - DNA, 309 bp, Unknown
  Obtained from environmental sample
  misc_feature (1)..(309): n is a, c, g, or t
ttgtttgaacaaccatcaatttcttcagaaagagaccctttagttgatatatcatctacagatagagaagtaaaagtcatagtagaaatgcctggtataaaaaaagaaaatataagnataaatgcttatgaaaactcagtagaaataataagtgatgatccacagagaaaatatcataaagtaatagatttgccaccagaagcagatattgaaactgttaaatctctatacaataatggaattctggaaatcgtttttaataaaaagaaacagacgaaatctaaaggaaaagaaattaaagtagaataa

SEQ ID NO: 2624 - protein, 102 aa, Unknown
  Obtained from environmental sample
  DOMAIN (16)...(102): Hsp20/alpha crystallin family
  misc_feature (1)..(102): Xaa is any amino acid
MFEQPSISSERDPLVDISSTDREVKVIVEMPGIKKENIXINAYENSVEIISDDPQRKYHKVIDLPPEADIETVKSLYNNGILEIVFNKKKQTKSKGKEIKVE

SEQ ID NO: 2625 - DNA, 792 bp, Unknown
  Obtained from environmental sample
  misc_feature (1)..(792): n is a, c, g, or t
atgggaaattcaggaacagtgctcgccaaagaagaaaatgcagtaagcggcgatgtgcttcagtcaagaaaagagattgagaattcaccgctaaaaaatctcgaattgcattacacggagtggagtgcatcgtatactcctgccgatcctattcatgatagctatcacgaagcagcatacgttcttcaaaaattaaagcaagtgggcagtgcggccaactccatgtcgtactgggtgttcactgatatttttgaagaacccggtccccgctttgaaccttttcacgggggcttcggtatgttaaccatccaaggcattaataaaccggtgttttattcttatcaatttttaaatcgtttaggaaatattgaattggcaaataaagatgccgcttcctggatttgtaaagattcttcaggaaatttgcaggcattagtttgggattatacgtacacacttcctgattccaccaacaaccagcagtattatatccgtgaccttccggcaaaatcaaaagggaaattaaacatcaaagtagccaacattcctgccggcaattatgcgcttgaagtgtatagagtaggatatcatagcaatgatgcttattcaacttatttatcaatgggaaaaccacggcagcttacaaagcaacaggtagagcaaattaaaaagcaaaatgatggctcaccggtgttaaaagaaatcatcactataaaagacgaagtttctttttccaaagacttagacattcgtgagaatgatgtttactttttgaatttaattaaattatga

SEQ ID NO: 2626 - protein, 263 aa, Unknown
  Obtained from environmental sample
  misc_feature (1)..(263): Xaa is any amino acid
MGNSGTVLAKEENAVSGDVLQSRKEIENSPLKNLELHYTEWSASYTPADPIHDSYHEAAYVLQKLKQVGSAANSMSYWVFTDIFEEPGPRFEPFHGGFGMLTIQGINKPVFYSYQFLNRLGNIELANKDAASWICKDSSGNLQALVWDYTYTLPDSTNNQQYYIRDLPAKSKGKLNIKVANIPAGNYALEVYRVGYHSNDAYSTYLSMGKPRQLTKQQVEQIKKQNDGSPVLKEIITIKDEVSFSKDLDIRENDVYFLNLIKL

SEQ ID NO: 2627 - DNA, 375 bp, Unknown
  Obtained from environmental sample
  misc_feature (1)..(375): n is a, c, g, or t
atgggcaaattttcgcccgccggaatcgttctggaatttgaatcgaaattcttgggcttcatcaaaagcggcgttaaggaaaaccgcatcgctctggacgaaatcctcgacgttaaattccgcaaaggctttttcaaaagaggcgcgaaaattgaaattcgcctgaaaagtttcacccgccttgctgaactgccgaacaacgacggcaagatcactctgaaaatcaagcgcgacgatttcgagatagcccgtgaagccgtcgaacgcctcaacaaagctatgaccgaacaccaatcaaacctgccgcccgcgcacacgccggtcagcgtgctttttgacgaatcggaagcggaaacgaaggaactgaacgagtaa

SEQ ID NO: 2628 - protein, 124 aa, Unknown
  Obtained from environmental sample
  misc_feature (1)..(124): Xaa is any amino acid
MGKFSPAGIVLEFESKFLGFIKSGVKENRIALDEILDVKFRKGFFKRGAKIEIRLKSFTRLAELPNNDGKITLKIKRDDFEIAREAVERLNKAMTEHQSNLPPAHTPVSVLFDESEAETKELNE

SEQ ID NO: 2629 - DNA, 480 bp, Unknown
  Obtained from environmental sample
  misc_feature (1)..(480): n is a, c, g, or t
atgacaataaagaaaaaccatcacatagttccgaaagtttatttgaaagaatttcttgacttcgaaagaccgaaaaactttcctgcaaataagccatttaacccatacatttggaaaattgacaaatttctcgaatctgaggctgtttcaaaatctcctgaaaagagttttggtaaaaacagattctataaacttgatagtgactcagagaaattccaagttattgaagaattgttgagcaaaattgagacttcttataatgcctcattacaaaagctaaaaaataaaatactattaactgacgaagaattaataaatctcattatatttatagaaacgctacaccaacgtactgaaactcaggtcgaacattggcaaggtcagtttaataaagtagaggaagtgttcaggcaagttgaccaacatcantataataatcaaaagcactcggacgagatttggcaggttctcacgaaatag

SEQ ID NO: 2630 - protein, 159 aa, Unknown
  Obtained from environmental sample
  misc_feature (1)..(159): Xaa is any amino acid
MTIKKNHHIVPKVYLKEFLDFERPKNFPANKPFNPYIWKIDKFLESEAVSKSPEKSFGKNRFYKLDSDSEKFQVIEELLSKIETSYNASLQKLKNKILLTDEELINLIIFIETLHQRTETQVEHWQGQFNKVEEVFRQVDQHXYNNQKHSDEIWQVLTK

SEQ ID NO: 2631 - DNA, 312 bp, Unknown
  Obtained from environmental sample
  misc_feature (1)..(312): n is a, c, g, or t
atgctttgtcaaaatcatgagcaaatcattaaaggtttttggggacaaacagttggtttggataaatcatttataaaaccaaatgtgcttatacttggcgaaaacaaagctgccaacgaagcacgttacattcacggagaatttggaaaaggaacttatactttttatagtggacatgaccctgaagattatgaacaccgagttgaagatccagcaacggatttaaatcttcatcccaactcaccaggttatcgcttgatcttaaataatattttatttcctgcagcgaagaagaaaaaacagaaaacataa

SEQ ID NO: 2632 - protein, 103 aa, Unknown
  Obtained from environmental sample
  misc_feature (1)..(103): Xaa is any amino acid
MLCQNHEQIIKGFWGQTVGLDKSFIKPNVLILGENKAANEARYIHGEFGKGTYTFYSGHDPEDYEHRVEDPATDLNLHPNSPGYRLILNNILFPAAKKKKQKT

SEQ ID NO: 2633 - DNA, 813 bp, Unknown
  Obtained from environmental sample
  misc_feature (1)..(813): n is a, c, g, or t
ttgaaaaaagtttctctggaaatgaaaaaactgaacaatgagctcaagcaaaaaaatcataagctcgaattgtacaataaagaactcgactcatttacctacattgccagccatgatttaaaggaaccgatcagaaaaatccttacctatagcgagcagatggaaatggaagattatggaaatttatccgacttgaacagaaagcaattaagccgcattaagcagtccgcccagcgcatgcaaaatcttttgaacgatcttttattatactcacatgtaaacatcagtgataaaacatttgaagaggtcgatctcaacaaaatcgttgacgatgtaatcgataatctcagggaagagataaccgaaacgcatacggagataaaagcagacaagcttcctgtgatcaaaagcatgccttttcagatcaagcagttatttgaaaaccttatcagcaattctataaaatacaaacaagatcatataccgccggcaattcttatagggggatacgtaatgaatgaaaaagatattaccgaaaaattttataaggaaagcgatcagtattacaagctgttttttcaagacaatggttccggttttgaacagatgtacgaagaaaaaatattcaagctttttcaacgtctccattctaaaacaaataaacctggaaccgggattggcctgacgatttgcaaaaagatcgtggataatcacaatggctttatcaaagcaaccagcgaaataaataaaggaaccaggtttgaaatttatctgccgatgaataaaccagccagctcaacggagaaatattga

SEQ ID NO: 2634 - protein, 270 aa, Unknown
  Obtained from environmental sample
  DOMAIN (28)...(96): His Kinase A (phosphoacceptor) domain
  misc_feature (1)..(270): Xaa is any amino acid
MKKVSLEMKKLNNELKQKNHKLELYNKELDSFTYIASHDLKEPIRKILTYSEQMEMEDYGNLSDLNRKQLSRIKQSAQRMQNLLNDLLLYSHVNISDKTFEEVDLNKIVDDVIDNLREEITETHTEIKADKLPVIKSMPFQIKQLFENLISNSIKYKQDHIPPAILIGGYVMNEKDITEKFYKESDQYYKLFFQDNGSGFEQMYEEKIFKLFQRLHSKTNKPGTGIGLTICKKIVDNHNGFIKATSEINKGTRFEIYLPMNKPASSTEKY

SEQ ID NO: 2635 - DNA, 360 bp, Unknown
  Obtained from environmental sample
  misc_feature (1)..(360): n is a, c, g, or t
atggtaacaagtatcaaacaatatgataaatataacagtaatacatttgtggattatctaaagcaggtacataaaagatttggtaaaattgtaattgttgttgatagagcaacaccacattgttcaaagattaccagaaagtttcttgattctaataaggatactatcagattggaatattttcctgttggttctccagagtttaacgcagtagaagaatgctggagacagggtaagtatcatatactttctacttattatccattgtttgattttctaaaagatacaatttcgtattattacagaattacaagattcaatctggatattgtaaaatatctgaccaggtctacgaattaa

SEQ ID NO: 2636 - protein, 119 aa, Unknown
  Obtained from environmental sample
  misc_feature (1)..(119): Xaa is any amino acid
MVTSIKQYDKYNSNTFVDYLKQVHKRFGKIVIVVDRATPHCSKITRKFLDSNKDTIRLEYFPVGSPEFNAVEECWRQGKYHILSTYYPLFDFLKDTISYYYRITRFNLDIVKYLTRSTN

SEQ ID NO: 2637 - DNA, 666 bp, Unknown
  Obtained from environmental sample
  misc_feature (1)..(666): n is a, c, g, or t
ttgttctatccatttagcataagtatagaaatggatttagctttgttatacatctttcaatatgtgccaaataaccctgttagactagaattatctactgtacagaaaaaggaattattttcattcatgaagagtactaaggataaagaggaatacagaagagcatctgccataaaacaaaagatggaaggagtaccttatagaacaatagccaaaaaccttggtgtcaattaccgtaatgtgtatgactggattaacaattacagaaaatatagtctggatggaataagaaacaatagaatgaatgcaggtagaaagccagtgatatctactgacaagaacaaggagatggtaaaagacatagtactgaacaaatcaccccatacatttggctatctcaaaaatacatggagtattaggctgttggccacatatctttcctcactactggaaatgaatgtcagtccaatgcagacatggagaataattcatgatatgggcatagtatacaaacagncaaaacttgaactagaaaaaggcatagattatgaggaaaagaaaggaaagatagacagatacaagaagatatcggcagctcttttaaaaaagatttactgggatttgagattaacatggttacatctgcaacatactaaccaggacnnt

SEQ ID NO: 2638 - protein, 222 aa, Unknown
  Obtained from environmental sample
  misc_feature (1)..(222): Xaa is any amino acid
MFYPFSISIEMDLALLYIFQYVPNNPVRLELSTVQKKELFSFMKSTKDKEEYRRASAIKQKMEGVPYRTIAKNLGVNYRNVYDWINNYRKYSLDGIRNNRMNAGRKPVISTDKNKEMVKDIVLNKSPHTFGYLKNTWSIRLLATYLSSLLEMNVSPMQTWRIIHDMGIVYKQXKLELEKGIDYEEKKGKIDRYKKISAALLKKIYWDLRLTWLHLQHTNQDX

SEQ ID NO: 2639 - DNA, 357 bp, Unknown
  Obtained from environmental sample
  misc_feature (1)..(357): n is a, c, g, or t
ttgatcttggatattccattatgtgttacttntctttattggtggaactattatgttgtttttggcgaaggagtgaaatcgggagaattgaattatgtggtgaagaaaggaaacatcttcaaaacctttgaggggaaactgatacaatccggctttagttcaaaaacaccgggtgctattcagtcgtatgaatttgaattttcagtagtgaatgacagtattgctcatgtattgatgaataatagcggcaatttttttgacctgcattataaagaatataaaggttctcttccctggagagggtatagtgagtttatagtagatagaattatttcaatgaagccagggattaaatag

SEQ ID NO: 2640 - protein, 118 aa, Unknown
  Obtained from environmental sample
  misc_feature (1)..(118): Xaa is any amino acid
MILDIPLCVTXLYWWNYYVVFGEGVKSGELNYVVKKGNIFKTFEGKLIQSGFSSKTPGAIQSYEFEFSVVNDSIAHVLMNNSGNFFDLHYKEYKGSLPWRGYSEFIVDRIISMKPGIK

SEQ ID NO: 2641 - DNA, 867 bp, Unknown
  Obtained from environmental sample
  misc_feature (1)..(867): n is a, c, g, or t
gtgaagttacttcgaatgcctgatggaaatacgacgatatcaatccagggcaaacgtcgtttcaagctcgatgaatgcatgcaggtcgatccttacattcgttgtaaagtcaagccattccctgaatccgcagcaagcgcaaacgacaaagaattcgtcgcacttgtcgcatcgttgaaagatctcgcattacaaattattcagaactcgccgaacattccgtcagacgcggcattcgcgattcgcaacatcgagagtcatacgttcctgattaatttcatctgttcgaatatgaatctcgacgtgtcgaagaagcaggaacttctcgagattgccgaccacaaagaaagggcaacgcgcgttctggaacatcttgacaaagaattgcaaatgctcgaactgaaaaatcagattcagagcaaggtgcgaaccgatatcgacaaacaacagcgcgaatattttctcaaccagcaattaagaaccattcaggaagaacttggtggtaatactcccgatcgcgaggtagctgaattaaaagagcgagctgcaacgaagaagtggagcaaagaagttgcagagacatttaaaaaagaatctgaccgtttatccagaatgaatccggcagcagctgaatactcggtgattctgaattatctcgaattgcttttggatcttccatggaatgattatacgaatgataatttcgatcttaagcatgcgcagaagattttagataaagaccattacggacttgaaaaagtcaaggctcgtattctcgaatatcttgctgtactcaaattaaaaagagacatgaagtctccgatcatgtgtttgtatggtccgccgggagttggaaaacttcattag

SEQ ID NO: 2642 - protein, 288 aa, Unknown
  Obtained from environmental sample
  misc_feature (1)..(288): Xaa is any amino acid
MKLLRMPDGNTTISIQGKRRFKLDECMQVDPYIRCKVKPFPESAASANDKEFVALVASLKDLALQIIQNSPNIPSDAAFAIRNIESHTFLINFICSNMNLDVSKKQELLEIADHKERATRVLEHLDKELQMLELKNQIQSKVRTDIDKQQREYFLNQQLRTIQEELGGNTPDREVAELKERAATKKWSKEVAETFKKESDRLSRMNPAAAEYSVILNYLELLLDLPWNDYTNDNFDLKHAQKILDKDHYGLEKVKARILEYLAVLKLKRDMKSPIMCLYGPPGVGKLH

SEQ ID NO: 2643 - DNA, 744 bp, Unknown
  Obtained from environmental sample
  misc_feature (1)..(744): n is a, c, g, or t
atgcactacaatggactgcatataatttttaatggcgaggtgtacaattatgcggagataagggaagatctggagaaaaagggccaccatttttctggccattccgatactgaagtcattctgcatgcatggaaagaatggggagtagatgctgtaaaacaatggaagggcatgtttgccattgtgatttatgatgaagaaaaaaagcaacttattgccataagagacagggcgggagtaaaacctttttattattatttcaatgaaggcttgtttttgtttggttccgaattaaaagcgcttgttgcgcatcctcaatttcaaaaacaaataaacccggaagccgtggcttcatacctgcagtatgggtacgtttcttttcctcattgcatttatcaaaacacttacaagctttctgcaggtcatgtattaaaattatctattgacacgcaggagatcaccacaaccaggtattggaatgtgtatgattattataatcgtcccaaatcagaaataagttttgtggaagctttgactgaaacagaaaagattttgcaaaaggcatttaattaccgcatggtatcagatgtacctgtcggagtttttctcaacgctggttttgattcttcctgcgtaactgcattgttacaaaaagacagtacagaaaaaattaaaaccttcaccattggcacaacagataagagcctggataagcgccctatcaaaacagtacacaacatttag

SEQ ID NO: 2644 - protein, 247 aa, Unknown
  Obtained from environmental sample
  misc_feature (1)..(247): Xaa is any amino acid
MHYNGLHIIFNGEVYNYAEIREDLEKKGHHFSGHSDTEVILHAWKEWGVDAVKQWKGMFAIVIYDEEKKQLIAIRDRAGVKPFYYYFNEGLFLFGSELKALVAHPQFQKQINPEAVASYLQYGYVSFPHCIYQNTYKLSAGHVLKLSIDTQEITTTRYWNVYDYYNRPKSEISFVEALTETEKILQKAFNYRMVSDVPVGVFLNAGFDSSCVTALLQKDSTEKIKTFTIGTTDKSLDKRPIKTVHNI

SEQ ID NO: 2645 - DNA, 342 bp, Unknown
  Obtained from environmental sample
  misc_feature (1)..(342): n is a, c, g, or t
ttgagatgcaaacaacaaagggattttatctatgtaaaggatgtaaccgaagtttgtttatttctgatgactcaccggaaaaattcgggtatttataatctgggaacaggccatgcccgtacatttctggatctgatacatgccgtcttcaatgcccaaaagctggacccggaaatcgaattcatcgatattccaccggatattcgtgataagtaccagtatttcactgaagcaaaaatggataagctcaggaaaacaggatatcaaaaaccattttattctattgaagccggtataaacgattatgtgacttcttatttaaagcctggtaagtactattaa

SEQ ID NO: 2646 - protein, 113 aa, Unknown
  Obtained from environmental sample
  misc_feature (1)..(113): Xaa is any amino acid
MRCKQQRDFIYVKDVTEVCLFLMTHRKNSGIYNLGTGHARTFLDLIHAVFNAQKLDPEIEFIDIPPDIRDKYQYFTEAKMDKLRKTGYQKPFYSIEAGINDYVTSYLKPGKYY

SEQ ID NO: 2647 - DNA, 609 bp, Unknown
  Obtained from environmental sample
  misc_feature (1)..(609): n is a, c, g, or t
atggacaatcagcaaattctgttaatcaatctttccaaaggtaaaatcggcgatctcaatactcagcttttgggtctagttttggttgctcgtttacaaatggccgctatgagccgcgttgatctaccagaagaaaaaagaaaagatttctatttatatgtagatgagttccaaaacttctctactgatagcttctgttcaatcctatctgaggcaagaaaatatcacttagcccttatcatggccaatcagtatattaaacagctagaaaagaaaagcgacacatctatacgcgacgcagtattcggtaacgtcggtaccatgatgtcatttaaagtaggcgccgatgatggtgaatatttagccaaagaatacgctccaattcttacagaacaagacattatctccatcgctaatttcaaagcttatatcaagttaaatatcaataacactacttcacgaccattctctttggaaactgtttacgatatgagtggctcaaataaaaaagtaggcgaaatagtaacccaatattcacgtatcaaatacggccgcaagagggaatttgtcgatcaagaaattcgcgccagaattggtatagaaacataa

SEQ ID NO: 2648 - protein, 202 aa, Unknown
  Obtained from environmental sample
  misc_feature (1)..(202): Xaa is any amino acid
MDNQQILLINLSKGKIGDLNTQLLGLVLVARLQMAAMSRVDLPEEKRKDFYLYVDEFQNFSTDSFCSILSEARKYHLALIMANQYIKQLEKKSDTSIRDAVFGNVGTMMSFKVGADDGEYLAKEYAPILTEQDIISIANFKAYIKLNINNTTSRPFSLETVYDMSGSNKKVGEIVTQYSRIKYGRKREFVDQEIRARIGIET

SEQ ID NO: 2649 - DNA, 471 bp, Unknown
  Obtained from environmental sample
  misc_feature (1)..(471): n is a, c, g, or t
ttgatgggcgatatgagatcgtacaattttgtggtcgacatcaccccggatatcgaagatgttcaatatcgaatcagggcgattgactttgaccaacagtcgtacgaaggacggaaaaacttatacctcccacagttctttaaagaaaacataccatttgttgaaacggtgatgaagtctttgaataaagattctatcgaacaatatcaaaccgaagaaagaacgctaatggcatttcgtgtggcatccacccgtcaccggttgatgcaactactgaatattatgtcgaaagattcgatttcgacgccagaaaaaatcacgcaattaaaaaacgaactgggtgattacttcaaaaataattccttctataagtgcacttctatgggccaggtggtaaaacggcagcttaaacaaacattgcaaaaaaacttaatgctgatccagcaaaacctcgggaagtttgaggattga

SEQ ID NO: 2650 - protein, 156 aa, Unknown
  Obtained from environmental sample
  misc_feature (1)..(156): Xaa is any amino acid
MMGDMRSYNFVVDITPDIEDVQYRIRAIDFDQQSYEGRKNLYLPQFFKENIPFVETVMKSLNKDSIEQYQTEERTLMAFRVASTRHRLMQLLNIMSKDSISTPEKITQLKNELGDYFKNNSFYKCTSMGQVVKRQLKQTLQKNLMLIQQNLGKFED

SEQ ID NO: 2651 - DNA, 735 bp, Unknown
  Obtained from environmental sample
  misc_feature (1)..(735): n is a, c, g, or t
gtgatcgctccaaaggatacttccaacgtgatggcgcatcgctctgcagaagattcaatcaggcttatcaatgagacggtcactacgtttaaatctcattacattgatttcaaaactttcgcagccaagatcaaggttgaggtaagcgacagcaaagggaagcagcctgatattacggctgtcgtccgcatcatcaaggacagcgcgatctggatgtcgctgtctgccacgttattcaacattgaagtgtaccgggtgctgatcacgaaagacagtgtgatcctgctgaacaaacaagccaaagaggtgcagtaccgttcgttggattatttgcaggaagtaaccgagataccatttgactataaaacattgcaggaccttcttgtgggaaaccctgtattttattccgacagtatcacatcttatacccaggacgaaaggttcattcttatgtctacgatcggtaaagattttaaaaaccttgtaacactttctcttgccgataaattgttacgtcacagtaaaatggatgatgtagacagggttaggagccgaacggctgacattacttatgcggattatgaaaataagaatggtgtatttttttcaacgaacaggctgatcagcgcttcggaaaacaataagataaacatcagccttaattttaagcagtacgagtttaacaaagaattatcagtgtccttttctatccctaaaaattataaacgcaaataa

SEQ ID NO: 2652 - protein, 244 aa, Unknown
  Obtained from environmental sample
  misc_feature (1)..(244): Xaa is any amino acid
MIAPKDTSNVMAHRSAEDSIRLINETVTTFKSHYIDFKTFAAKIKVEVSDSKGKQPDITAVVRIIKDSAIWMSLSATLFNIEVYRVLITKDSVILLNKQAKEVQYRSLDYLQEVTEIPFDYKTLQDLLVGNPVFYSDSITSYTQDERFILMSTIGKDFKNLVTLSLADKLLRHSKMDDVDRVRSRTADITYADYENKNGVFFSTNRLISASENNKINISLNFKQYEFNKELSVSFSIPKNYKRK

SEQ ID NO: 2653 - DNA, 324 bp, Unknown
  Obtained from environmental sample
  misc_feature (1)..(324): n is a, c, g, or t
atgaaagccgctaccatacacgaaattaaaaaagagcttgaaaagaaagaaggaagggagctggtttcctattgcctgagacttgcaaaatttaaaaaagagaataaagaattactcgactttttactttttcagtctggggacgtcgaggaatatgttgaaaatttgaaggcagaaacggaagagttatttactgctatcaactactcaaatattttttttattaagaaaagtatccgaaaaattctgaggatgctaaataagcacaatcgtttattctttcgcggcagtagcagcagatcaatcttcgtgttgcnatcttga

SEQ ID NO: 2654 - protein, 107 aa, Unknown
  Obtained from environmental sample
  misc_feature (1)..(107): Xaa is any amino acid
MKAATIHEIKKELEKKEGRELVSYCLRLAKFKKENKELLDFLLFQSGDVEEYVENLKAETEELFTAINYSNIFFIKKSIRKILRMLNKHNRLFFRGSSSRSIFVLXS

SEQ ID NO: 2655 - DNA, 330 bp, Unknown
  Obtained from environmental sample
  misc_feature (1)..(330): n is a, c, g, or t
gtgaagcaatttgacaaagacggtaaattggaatattcaaagatcgtttctgtaagaatagatgcggggaaaatagctgcttctgtgctgggcaatccatttcaaaacaggctttctgtcaattttattagccccattgagcaggtggttacagtcaggctgatcgacattaccggcaagcaggtaggcttgcaaaaatggaccattgctaacggcagcagcagcaaagattttgataatgtagccgccttgcaaaagggaatttatattatttcagtcacaaatgctttgggagagcgtattctaaacagcaaagtgattaaacaataa

SEQ ID NO: 2656 - protein, 109 aa, Unknown
  Obtained from environmental sample
  misc_feature (1)..(109): Xaa is any amino acid
MKQFDKDGKLEYSKIVSVRIDAGKIAASVLGNPFQNRLSVNFISPIEQVVTVRLIDITGKQVGLQKWTIANGSSSKDFDNVAALQKGIYIISVTNALGERILNSKVIKQ

SEQ ID NO: 2657 - DNA, 390 bp, Unknown
  Obtained from environmental sample
  misc_feature (1)..(390): n is a, c, g, or t
atgataaattattacgaactggtaaaaaataaccccgagtattttaaacagttctcgtgtaaagacctgttgtttttgaattatgactgcccggttaaattaaaaaaggttgccaagtggtccgagcatcattacatctactatgtgttgagcggcaaaaaaaccctgcatactacaacggaatcgctcacacttaccaacggctctattgcatttattaaaaaaggcgcttgtattattgaacagttttatgaagagcccttttgcattattgtttttattatccccgactctttaatcgtttcttttttgaacgattacctgcctggccggaaactaccacgccttcacataaaatggttattcctctccatgatgatgccggattng

SEQ ID NO: 2658 - protein, 130 aa, Unknown
  Obtained from environmental sample
  misc_feature (1)..(130): Xaa is any amino acid
MINYYELVKNNPEYFKQFSCKDLLFLNYDCPVKLKKVAKWSEHHYIYYVLSGKKTLHTTTESLTLTNGSIAFIKKGACIIEQFYEEPFCIIVFIIPDSLIVSFLNDYLPGRKLPRLHIKWLFLSMMMPDX

SEQ ID NO: 2659 - DNA, 357 bp, Unknown
  Obtained from environmental sample
  misc_feature (1)..(357): n is a, c, g, or t
ttgagatcagagtgtgagtggagctcgaaaactatggcaaagattctcgtcgtcgatgatcaggaaatgatgcgcgactcgctggtggggatcctcatccgcgagggacacgaggtcgtcggcgtcggggacccgaccgtggggatccagcggctgaccgggacgaagttcgacctggtcatcaccgatctcaagatgccgaagatgaccggcatcgagctgttggccgaggtgaagaagctccgcccggacacgccggtgatcctgatgaccgcgttcgcgaccgtgcagacgggcgtcgaggcgatgaagctcggggcgtacgactacatccagaaaccgttcgacggggacnga

SEQ ID NO: 2660 - protein, 119 aa, Unknown
  Obtained from environmental sample
  DOMAIN (13)...(118): Response regulator receiver domain
  misc_feature (1)..(119): Xaa is any amino acid
MRSECEWSSKTMAKILVVDDQEMMRDSLVGILIREGHEVVGVGDPTVGIQRLTGTKFDLVITDLKMPKMTGIELLAEVKKLRPDTPVILMTAFATVQTGVEAMKLGAYDYIQKPFDGDX

SEQ ID NO: 2661 - DNA, 666 bp, Unknown
  Obtained from environmental sample
  misc_feature (1)..(666): n is a, c, g, or t
ttgattctaagaaaattggtagatattggaagtgacccagatacagtaaaggaaatagttattgttgatgatggctcaactgacaactcctcaggcgtgatttccgagtttttgaaggctaacaaagatgctggtataatcttaatcaggcatgaaaagaactatggcaaaggggcaagtattaagacggcgctacagcattctactggaaatatagttgtcatacaggatgctgaccttgaatatgaccctgccgagtttaccaagctattgaagcctattaaggatggccatgcagatgttgtatatggctcacgcttccgtggcagtgaagctcacagaatcctatttttctttcactcggctggaaataaattcctcacatttctatccaacgtttttaccgggctcaaccttacggatatggaaactggttacaaaatgtttcgccgtgaaatccttgaacaaattacgattcgggaaaaacgattcggcgtcgaaccagaattgaccgccaaaatcagcaaaatcaaaaatattcgtatctacgaagttggaatttcatattatggtagaagaaacgcagaaggaaaaaagatacaatggaaagatggattaagagcactgtactgtattttaaagtacagcattttttcaaaaaaataa

SEQ ID NO: 2662 - protein, 221 aa, Unknown
  Obtained from environmental sample
  DOMAIN (1)...(158): Glycosyl transferase
  misc_feature (1)..(221): Xaa is any amino acid
MILRKLVDIGSDPDTVKEIVIVDDGSTDNSSGVISEFLKANKDAGIILIRHEKNYGKGASIKTALQHSTGNIVVIQDADLEYDPAEFTKLLKPIKDGHADVVYGSRFRGSEAHRILFFFHSAGNKFLTFLSNVFTGLNLTDMETGYKMFRREILEQITIREKRFGVEPELTAKISKIKNIRIYEVGISYYGRRNAEGKKIQWKDGLRALYCILKYSIFSKK

SEQ ID NO: 2663 - DNA, 300 bp, Unknown
  Obtained from environmental sample
  misc_feature (1)..(300): n is a, c, g, or t
atgaagtcaatgtccataatagttctcatgcagaacatatttaattcctcatttcatcatttcaacattgtcattcaggattacatgaaaaaggcaaggctggcaaaagccaaacatggaataaacaagatattcatcgcttctgatgatcaatccatcatcaatcaaacaagagagtattcccacgaatttgatttcctcttgttgaaaggtgatacttacttctcttttgtatttcattttcttattgtttccttgtcgaagaaagtaatcaataaagttgttattgtattgacttga

SEQ ID NO: 2664 - protein, 99 aa, Unknown
  Obtained from environmental sample
  misc_feature (1)..(99): Xaa is any amino acid
MKSMSIIVLMQNIFNSSFHHFNIVIQDYMKKARLAKAKHGINKIFIASDDQSIINQTREYSHEFDFLLLKGDTYFSFVFHFLIVSLSKKVINKVVIVLT

SEQ ID NO: 2665 - DNA, 351 bp, Unknown
  Obtained from environmental sample
  misc_feature (1)..(351): n is a, c, g, or t
atgatactttacaagggtaaattcaataccatgaaaggtaactctgcttctctcaaggcaactatgctttctttcattcttcttttcggccttgaatattttctaatatcaattacaaacgataatgctccctgtttctggcataatactgttataggcaatattgtggcatggtcaataaggatcatttgctttactattttcacctctgttttcctgcagttttttctgccttcgtataaaacattaaaagaaaggatgtttgaaagagatgaagaaaatgaaagagaaagaaatttgaaagaacaggaaacattgcttgataaatatattctgaaacaagccaggtag

SEQ ID NO: 2666 - protein, 116 aa, Unknown
  Obtained from environmental sample
  misc_feature (1)..(116): Xaa is any amino acid
MILYKGKFNTMKGNSASLKATMLSFILLFGLEYFLISITNDNAPCFWHNTVIGNIVAWSIRIICFTIFTSVFLQFFLPSYKTLKERMFERDEENERERNLKEQETLLDKYILKQAR

SEQ ID NO: 2667 - DNA, 357 bp, Unknown
  Obtained from environmental sample
  misc_feature (1)..(357): n is a, c, g, or t
atgaacagctgtcaaacgaggtttaaaaagctttttaaaatattgggagaagataataagattgatgacaactgggaacattttgcgcatcattttgataaggtgcacactgattttctcgtcctcctaaaaaaccgctaccctaatttaacggcaagtgaattgaagctttgtgcttatttgcgcatgaacctttccagcaaagaaatagcccagcttatgaatatttccattcgtggagttgaaatcggaaggtatcggctgcgaaagaaactgggtatttctaaagacaccaacctgtttgagtttttattgaatggacaatcatcacaaacaatatctgcagctacaaattaa

SEQ ID NO: 2668 - protein, 118 aa, Unknown
  Obtained from environmental sample
  DOMAIN (47)...(104): Bacterial regulatory proteins, luxR family
  misc_feature (1)..(118): Xaa is any amino acid
MNSCQTRFKKLFKILGEDNKIDDNWEHFAHHFDKVHTDFLVLLKNRYPNLTASELKLCAYLRMNLSSKEIAQLMNISIRGVEIGRYRLRKKLGISKDTNLFEFLLNGQSSQTISAATN

SEQ ID NO: 2669 - DNA, 315 bp, Unknown
  Obtained from environmental sample
  misc_feature (1)..(315): n is a, c, g, or t
ttgggagaagataataagattgatgacaactgggaacattttgcgcatcattttgataaggtgcacactgattttctcgtcctcctaaaaaaccgctaccctaatttaacggcaagtgaattgaagctttgtgcttatttgcgcatgaacctttccagcaaagaaatagcccagcttatgaatatttccattcgtggagttgaaatcggaaggtatcggctgcgaaagaaactgggtatttctaaagacaccaacctgtttgagtttttattgaatggacaatcatcacaaacaatatctgcagctacaaattaa

SEQ ID NO: 2670 - protein, 104 aa, Unknown
  Obtained from environmental sample
  DOMAIN (33)...(90): Bacterial regulatory proteins, luxR family
  misc_feature (1)..(104): Xaa is any amino acid
MGEDNKIDDNWEHFAHHFDKVHTDFLVLLKNRYPNLTASELKLCAYLRMNLSSKEIAQLMNISIRGVEIGRYRLRKKLGISKDTNLFEFLLNGQSSQTISAATN

SEQ ID NO: 2671 - DNA, 675 bp, Unknown
  Obtained from environmental sample
  misc_feature (1)..(675): n is a, c, g, or t
atggacgaaaaaatttttgtagttattcccacaattcgtaatttggattttctttcttcgtgggaaaaagagtttaaagatctttatggcattataatcgaagatcatcaggaaaaaaatattcaagtaccttcaaatgtatttaaaaaaacttaccattacacttgggcggatattaacaataacttaaaggataaaagctggataataccacgaaaatcttctgcaattagatcgtatggatttctcaaagcatatgaaatgggtgctaccagaataataactatcgatgatgattgtttgccttctgaaaaggatttcgtttctaaacacattgaaaacctcaatgctaaggttccttctaggtggtttccaacattacctgtatccggtctttggggtactagaggctttccatatggagaggaacgtgaacaaattaaaattgaagtaagccacggaatgtggaaaaggcatttagatttagatgcacctacacacttaatgaaattaaattacgagtttaaccaagacttattatttaattattttatccctaaaaattattatttcccactttgtattatgaatgtggcatttaatcgatcggtaacaccacttttttacatgcttctcatggggtaccactcgaaaacttcacctttttggttttga

SEQ ID NO: 2672 - protein, 224 aa, Unknown
  Obtained from environmental sample
  DOMAIN (1)...(224): Reversibly glycosylated polypeptide
  misc_feature (1)..(224): Xaa is any amino acid
MDEKIFVVIPTIRNLDFLSSWEKEFKDLYGIIIEDHQEKNIQVPSNVFKKTYHYTWADINNNLKDKSWIIPRKSSAIRSYGFLKAYEMGATRIITIDDDCLPSEKDFVSKHIENLNAKVPSRWFPTLPVSGLWGTRGFPYGEEREQIKIEVSHGMWKRHLDLDAPTHLMKLNYEFNQDLLFNYFIPKNYYFPLCIMNVAFNRSVTPLFYMLLMGYHSKTSPFWF

SEQ ID NO: 2673 - DNA, 507 bp, Unknown
  Obtained from environmental sample
  misc_feature (1)..(507): n is a, c, g, or t
atgattaaaaataaaaaaataatcgcaatcaaactttccagagtaacaaaacaatattttatccatcatgaaaagccaacactcatggaaaaattgtttactcgcaccaatgaaaaatttacggctttaaagaatataaacctttcaatttacgaaggagaacgcgtcggtttttatggaccaaatggatgtggtaaatctactttattaaaaattattacaggaattactactcccactctaggtaaagtagaaactaaaggaaaaattgtttcgctcatagatcttgaagctggtttccatccggatcttactggtatacaaaacatttatatgaatggcatgcttttaggaatgagcaaagatgaaataactgaacaattaaaagatattgtaaattttgcggatattcatcagtttatagatgttccactttttacatactcacagggaatgaaaattagactaggattttctgttgctttgcatgttaaaccaaaaatctaa

SEQ ID NO: 2674 - protein, 168 aa, Unknown
  Obtained from environmental sample
  DOMAIN (53)...(168): ABC transporter
  misc_feature (1)..(168): Xaa is any amino acid
MIKNKKIIAIKLSRVTKQYFIHHEKPTLMEKLFTRTNEKFTALKNINLSIYEGERVGFYGPNGCGKSTLLKIITGITTPTLGKVETKGKIVSLIDLEAGFHPDLTGIQNIYMNGMLLGMSKDEITEQLKDIVNFADIHQFIDVPLFTYSQGMKIRLGFSVALHVKPKI

SEQ ID NO: 2675 - DNA, 354 bp, Unknown
  Obtained from environmental sample
  misc_feature (1)..(354): n is a, c, g, or t
atgaagaagacgatgtcgcttttgcttttttttgtttcagcgatagctttttcacaatcaaaagatgaaaaagagatcaggcggttactaaccatacaaactgaaagctggaaccgcggcgatatagaaggttttatgcaaagctactggaaaagcgactcgttgatgtttatcggcaaaagcggggtccatttcggatggcaggaaacattgaacaactataaaaaaggctatcctgatacagttgctatgggaaagctttctttcaatattcttatcgtgaaaaagctttctgcggaatattattatgtgattggaaaatggatgctgaaaagaaccaatcggccgatttaa

SEQ ID NO: 2676 - protein, 117 aa, Unknown
  Obtained from environmental sample
  SIGNAL (1)...(18)
  misc_feature (1)..(117): Xaa is any amino acid
MKKTMSLLLFFVSAIAFSQSKDEKEIRRLLTIQTESWNRGDIEGFMQSYWKSDSLMFIGKSGVHFGWQETLNNYKKGYPDTVAMGKLSFNILIVKKLSAEYYYVIGKWMLKRTNRPI

SEQ ID NO: 2677 - DNA, 567 bp, Unknown
  Obtained from environmental sample
  misc_feature (1)..(567): n is a, c, g, or t
ttgtttcgccttacattccctatgactgctgcaaaagatctcccttngaagactcgtatcgcgatcggcattatgaacttccttttaggagggtcgactacctcacttttattcaccaaagtccgtgatgagttgggactggcctattacatcaattcatcggtaagctatgcgtcaagctttagctctttttctattgattgttatgtagatgcatcaaaactcaatcaggctttcaaagagatcatcaagatactggtagagtgcaaagaaaaaacatttgctgaaaaagattttaatcgtgcacgatcctatatgaatgctcagacactaatttcttttgctgatccaagggatatctctagtgactttacgagtcggttattgtttggcaaagatatgcttttgcccaaagaggtggtggagctagcaaataccataaaactcgaagaaatgaacggtcacataaacaagatcctggattttgatacctgctatctgtcacttatgggagatgaaaaactgattcaagaatcccaaatagaacaagaatttaagaatctctga

SEQ ID NO: 2678 - protein, 188 aa, Unknown
  Obtained from environmental sample
  DOMAIN (5)...(106): Peptidase M16 inactive domain
  misc_feature (1)..(188): Xaa is any amino acid
MFRLTFPMTAAKDLPXKTRIAIGIMNFLLGGSTTSLLFTKVRDELGLAYYINSSVSYASSFSSFSIDCYVDASKLNQAFKEIIKILVECKEKTFAEKDFNRARSYMNAQTLISFADPRDISSDFTSRLLFGKDMLLPKEVVELANTIKLEEMNGHINKILDFDTCYLSLMGDEKLIQESQIEQEFKNL

SEQ ID NO: 2679 - DNA, 696 bp, Unknown
  Obtained from environmental sample
  misc_feature (1)..(696): n is a, c, g, or t
gtggaaagtaccaacaactatgccatgggattaatacatgcaggtatggcacaacatggtacagccgtgtttgcgcatgagcaaactatgggcaaaagacagcgcaataaggaatggttctccgcccctggcaaaaacatcacttttagtctcatcttacatccgttcggattaaaaacaaatcaactttttttattgagcatggctgtagctaatggtgttcacaggttttttagtttgtacgcgggaaataaaacaaaaactaaatggccaaatgatatatattggtgtgacagaaaggcaggggggattttaattgaaaatgtgatccggggaaatacctggaagcatgcaatcgttggtatcggactcaatattaaccaaaccgattttggcgagtttaaccgcgccgtatctctcaaagaaataaatggtaaaaactatgatacaattagtcttgctaaagaattactaacgtttcttgatttttcgtttaaagagatgactgcggatactgattcagtaataaaaaattaccacgaacatctatataaatggaacaaaacagttcgattaaaaaaagacgacacaattattgaaggctatttgaggggagtaactataaatgggatgctaatattagaaaaagcagcaaaggaaatgctttttaaagttggtgaagttgaatggatctaa

SEQ ID NO: 2680 - protein, 231 aa, Unknown
  Obtained from environmental sample
  DOMAIN (1)...(132): Biotin/lipoate A/B protein ligase family
  misc_feature (1)..(231): Xaa is any amino acid
MESTNNYAMGLIHAGMAQHGTAVFAHEQTMGKRQRNKEWFSAPGKNITFSLILHPFGLKTNQLFLLSMAVANGVHRFFSLYAGNKTKTKWPNDIYWCDRKAGGILIENVIRGNTWKHAIVGIGLNINQTDFGEFNRAVSLKEINGKNYDTISLAKELLTFLDFSFKEMTADTDSVIKNYHEHLYKWNKTVRLKKDDTIIEGYLRGVTINGMLILEKAAKEMLFKVGEVEWI

SEQ ID NO: 2681 - DNA, 828 bp, Unknown
  Obtained from environmental sample
  misc_feature (1)..(828): n is a, c, g, or t
atggaacagattctgctgcagtacagatttatgatttacgaagcggaaaagcaacacccaagtatagtgagaggattgactggtgttaccaacgacattgattttttaccagacaattctggatttatggttagtaaatcagataagacggtttcattcgtaaatcacttgacaggtaaagctaccagcttggttacacttccttatgaattaaaatctatatctgttagcccagatggtaaatggttggcaggtggtgcttggtcaggtgaattggttctgattaatattcagaccaagaagtccgaaataatttatactgattcagctgcgcaaatccttacagttaaatttagtcctgacggaaagaaattagcttttggaacctttgaaataaatgataagcgaggattagtgaaaatgtacgatatgcagaaacgcgctaaagacccacggcaattcactggtcacaaagcaggtgtatatgatattgaatttagcgcagatggaaaactattggccagtgcaggggctgataagcgactgcaaatgtgggtgctggattttccggaagaccttcctattgtaatggataataataatggttttatatgggacatctcttttgcaaaaggttcagactacttaattgcagcttgtcatgaatcagaaataagagtgtggccgacaaatccggatattttggcaaatcaggtatgtccaaaacttaatcggaatatgactcaggatgaatgggctaagtatgttggtagtgatattaaatatgagaatacgtgtattagtgttttgatcaaggactataagtag

SEQ ID NO: 2682 - protein, 275 aa, Unknown
  Obtained from environmental sample
  DOMAIN (149)...(186): WD domain, G-beta repeat
  misc_feature (1)..(275): Xaa is any amino acid
MEQILLQYRFMIYEAEKQHPSIVRGLTGVTNDIDFLPDNSGFMVSKSDKTVSFVNHLTGKATSLVTLPYELKSISVSPDGKWLAGGAWSGELVLINIQTKKSEIIYTDSAAQILTVKFSPDGKKLAFGTFEINDKRGLVKMYDMQKRAKDPRQFTGHKAGVYDIEFSADGKLLASAGADKRLQMWVLDFPEDLPIVMDNNNGFIWDISFAKGSDYLIAACHESEIRVWPTNPDILANQVCPKLNRNMTQDEWAKYVGSDIKYENTCISVLIKDYK

SEQ ID NO: 2683 - DNA, 606 bp, Unknown
  Obtained from environmental sample
  misc_feature (1)..(606): n is a, c, g, or t
atgaaaaaaattattctgtcctttttgtttcttttgtattgcacgtttgtgcaaaatctctatgcgtcggattcaaccagggtaaaacagaaatcaggcaatcttattcttccgaaaggctttcggtccattattgttgctgaaaacctgggccgtgcaaggcaccttgtggtaacaaacaatggtgacctgtatgtaagactggccaggctaaataaaaaagggcagggtaccgttattcttcgcgataaaaacaaagatggtgtaatagatgacagcacgggctttggcaattatggcggtacaggtatcgccatcaaaaatggttatttatatgcagcttctgataatgacgtgtaccgttataagttgaatgataagatggagatcatagatggcaaaaatcctgaaaagatcattacaggactggttgccggcagacaacacaatactaaatcgcttgcgctggacaatgagggcaatatatacgtaaacgttggtgccccttcccatcctgtcagatacagacagaggcgttggctcaccggtatagatccctgtccttttttagaacatctgccggtatatggcagtttaatcggataa

SEQ ID NO: 2684 - protein, 201 aa, Unknown
  Obtained from environmental sample
  SIGNAL (1)...(19)
  misc_feature (1)..(201): Xaa is any amino acid
MKKIILSFLFLLYCTFVQNLYASDSTRVKQKSGNLILPKGFRSIIVAENLGRARHLVVTNNGDLYVRLARLNKKGQGTVILRDKNKDGVIDDSTGFGNYGGTGIAIKNGYLYAASDNDVYRYKLNDKMEIIDGKNPEKIITGLVAGRQHNTKSLALDNEGNIYVNVGAPSHPVRYRQRRWLTGIDPCPFLEHLPVYGSLIG

SEQ ID NO: 2685 - DNA, 402 bp, Unknown
  Obtained from environmental sample
  misc_feature (1)..(402): n is a, c, g, or t
atgataaataccaatgagctgaggttgggaaattacattcttcaaaaggtcagcaaccgtattgttactgtaaagtgcactgctcaacattttgaattattgaacacaggaaatggaaaagatatgtacccggtcattttaaaagcagagctgttagagaaggccggcttttcagaaaataaagattaccctcttctgccggaggcaagagaatttattttggtgctgccggtgattggaaataataaaaatgaaatacgggcttacattaaaaacaataaagaatgttttggtagagccgttgtaaacggattgccggtgagcaataatttttaccatcttcaccagttgcaaaacctgcattttgctttgacaaatgaagaattggaagtgaaaatttag

SEQ ID NO: 2686 - protein, 133 aa, Unknown
  Obtained from environmental sample
  misc_feature (1)..(133): Xaa is any amino acid
MINTNELRLGNYILQKVSNRIVTVKCTAQHFELLNTGNGKDMYPVILKAELLEKAGFSENKDYPLLPEAREFILVLPVIGNNKNEIRAYIKNNKECFGRAVVNGLPVSNNFYHLHQLQNLHFALTNEELEVKI

SEQ ID NO: 2687 - DNA, 1134 bp, Unknown
  Obtained from environmental sample
  misc_feature (1)..(1134): n is a, c, g, or t
gtgctcaagcaggtcgcggtctgcaagaccgagcctggcgacgagaacaaccaggacatcagctcgctggtcggcaaggtcgacatccgcaagctcgagacctatgcgcaggacgacccggacgcctacagctactcgggcggcctgtgcctggcgaaccagggcctgctcgagttcgtcgagatgttcaaggccccgatcaaggtgctgcacccgctgctgaccgcgacgcaggaaggcaacttcaagggcaccgagggcttcggtgccattcccttcgacggcatcatcctggcgcactcgaacgagagcgagtggaagaccttccgcaacaacaagaacaacgaggccttcctcgaccgcgtctacatcgtcaaggtgccgtactgcctgcgcgtcagcgaggaagtgaagatctacgagaagctcatcaagggatcgtcgctcgccgaggcgaagtgcgcgcccggcacgctgaagatgatgagccagttcgccatcctcacgcggctgaaggagccggagaactcgtcgctgttctcgaagatgcagatctacgacggcgagaacctgaaggacaccgacccgcgcgccaagagctaccaggagtaccgcgactacgcgggcgtggacgaaggcatgagcggcatctccacccgcttcgcctacaagatcctgtcgaaggtcttcaacttcgacagccaggaagtcgccgccaacccggtgcacctgatgtacgtgctggagcagcagatcgagcgcgagcagttccctcaggagctcgagcagaagtacgtcgccttcatcaaggaacagctggcgccgcgctatgccgagttcatcggcaaggaaatccagactgcctaccttgaaaagtactcggagtacgggcagaacatcttcgaacgctacgtcacctacgccgactactggatccgggacctgattaccgcgacccgaccccgcgaggtgtcgatcgccccccctgaacgccaactcaaaaaaacaaaaaccggccggcatccggaaaccgaaggacttcccaaagaaatcgcaaatttgggcggcgggccccccaaaaacccgggaagaacccggggggaccacctcaaaaaccttccccaggggatctaa

SEQ ID NO: 2688 - protein, 377 aa, Unknown
  Obtained from environmental sample
  DOMAIN (1)...(374): PrkA serine protein kinase
  misc_feature (1)..(377): Xaa is any amino acid
MLKQVAVCKTEPGDENNQDISSLVGKVDIRKLETYAQDDPDAYSYSGGLCLANQGLLEFVEMFKAPIKVLHPLLTATQEGNFKGTEGFGAIPFDGIILAHSNESEWKTFRNNKNNEAFLDRVYIVKVPYCLRVSEEVKIYEKLIKGSSLAEAKCAPGTLKMMSQFAILTRLKEPENSSLFSKMQIYDGENLKDTDPRAKSYQEYRDYAGVDEGMSGISTRFAYKILSKVFNFDSQEVAANPVHLMYVLEQQIEREQFPQELEQKYVAFIKEQLAPRYAEFIGKEIQTAYLEKYSEYGQNIFERYVTYADYWIRDLITATRPREVSIAPPERQLKKTKTGRHPETEGLPKEIANLGGGPPKNPGRTRGDHLKNLPQGI

SEQ ID NO: 2689 - DNA, 753 bp, Unknown
  Obtained from environmental sample
  misc_feature (1)..(753): n is a, c, g, or t
atgctcttaaaaaatgtggttgtacacattagcgtcagcataacaaacaaaaaagtcatccaaagtatgcgaacttcaactaacaaactggaaaaaatggcaggaataaaagtgatcattaccggcgcaaccggtatggttggtgaaggcgttttatttgaatgtttacaaaaccaaaaggttgaagaagtgctgatcataaatcgcaaacactacgaatgcaaccatcctaaattgaaagaacttattgttcccgatttcttacagttagaatcatttgctgaaaatctgacagggtacgatgcttgttttttctgtgccggtataagttcggttggtatgaatgaagacaaatactaccacattacctaccacaccactttatcatttgccaagatattgctacgcaacaatcccgacatggtatttacttatgtttcaggaagtggtacggatagctcggaaaaaggcaggctgatgtgggcacgggtaaaaggtaaaacggaaaatgaattaatgaaacttcctttcaaagcggaatacaattttcggccgggtgtgatgctgccattcgaaggacagaaaaattggaaaggcggctataaattcattgcgaaggccattaagctgtttgcaccaaaggctgtgttgccggtgcatctggtaggaaaggcaatgatcaatgcagcaataacaggttatccgaagccaatacttgaaattgctgacatcaggaaattagccaaccaatag

SEQ ID NO: 2690 - protein, 250 aa, Unknown
  Obtained from environmental sample
  misc_feature (1)..(250): Xaa is any amino acid
MLLKNVVVHISVSITNKKVIQSMRTSTNKLEKMAGIKVIITGATGMVGEGVLFECLQNQKVEEVLIINRKHYECNHPKLKELIVPDFLQLESFAENLTGYDACFFCAGISSVGMNEDKYYHITYHTTLSFAKILLRNNPDMVFTYVSGSGTDSSEKGRLMWARVKGKTENELMKLPFKAEYNFRPGVMLPFEGQKNWKGGYKFIAKAIKLFAPKAVLPVHLVGKAMINAAITGYPKPILEIADIRKLANQ

SEQ ID NO: 2691 - DNA, 597 bp, Unknown
  Obtained from environmental sample
  misc_feature (1)..(597): n is a, c, g, or t
gtgagaaaaatggatgatgcagttatttcttctcatgtgctcaataaaatacttaacgattggaatgacactgacagcaactggccaaaagataaaactatagcccagctttttttaaagcaagttaaaacttcacctaacagagttgcaatcatttttggaaaacagcggcttacttatcaacaacttaacgaaaaaagtaaccgtttggccagatatattcgtaaacaatatcaactattgtataaagcttccttacaaccggatacgctcattgccatttgtttagatcgtggcattgaaatggttattgcaatgcttgcagtattaaaagccagtgcagcatatgtgccgatagatcctgcatatcccgatgaaagaatatggtttatttttaatgatagtaaaagccggtattttggtcacacaaagctcaatgcaggcaaaatttgcagccaatcaatgccaattcacaaagctcatttttttgatagcccctataataaaaatgaaccctccccaaatttaaaatccaaaaaaagcccaagaaatttaacctatggtcagtacccttcttgggagcccggggaaacctaa

SEQ ID NO: 2692 - protein, 198 aa, Unknown
  Obtained from environmental sample
  misc_feature (1)..(198): Xaa is any amino acid
MRKMDDAVISSHVLNKILNDWNDTDSNWPKDKTIAQLFLKQVKTSPNRVAIIFGKQRLTYQQLNEKSNRLARYIRKQYQLLYKASLQPDTLIAICLDRGIEMVIAMLAVLKASAAYVPIDPAYPDERIWFIFNDSKSRYFGHTKLNAGKICSQSMPIHKAHFFDSPYNKNEPSPNLKSKKSPRNLTYGQYPSWEPGET

SEQ ID NO: 2693 - DNA, 687 bp, Unknown
  Obtained from environmental sample
  misc_feature (1)..(687): n is a, c, g, or t
gtgggtaagatgtttgacagcattgccggcaagtacgattttatgaactggtttttaagtgccggtattgataaaagctggcgcacaagggccattgaagaattaatcagtgacaatccacagcatattttagatgtggccacaggaacgggtgacatggctatacgggcagctaaaattttggatccgcaaaaaattacggggatagatatttcggaaaaaatgctggaaataggaagaaagaaagttgatacagaagggttaacaaacataattgagttacagagtggagatagcgagacaataaaatttcccagtaatacgtttgatggcgtgatggtggcgtttggtgtgcggaatttcgaaaacctgcaactggggttgacagaaattttaagagtaatgaagccaggagctaaactggtggtacttgaatttagtaagccaaaagcaggattaataaaaccattatacaattggtatatgggaaaattagcgcctgcaattgcaaaactttttaatcaaaataaaaaagcctatcaatacctgaatgaatcatccatcgcctttcctgaccggcagcaatttattgatattttaaaaggcgttggctattccgataccttctttaaacccctaagcttaggaatatgttgtatttattgcggacgcaaacctcaaggctga

SEQ ID NO: 2694 - protein, 228 aa, Unknown
  Obtained from environmental sample
  DOMAIN (1)...(225): ubiE/COQ5 methyltransferase family
  misc_feature (1)..(228): Xaa is any amino acid
MGKMFDSIAGKYDFMNWFLSAGIDKSWRTRAIEELISDNPQHILDVATGTGDMAIRAAKILDPQKITGIDISEKMLEIGRKKVDTEGLTNIIELQSGDSETIKFPSNTFDGVMVAFGVRNFENLQLGLTEILRVMKPGAKLVVLEFSKPKAGLIKPLYNWYMGKLAPAIAKLFNQNKKAYQYLNESSIAFPDRQQFIDILKGVGYSDTFFKPLSLGICCIYCGRKPQG

SEQ ID NO: 2695 - DNA, 909 bp, Unknown
  Obtained from environmental sample
  misc_feature (1)..(909): n is a, c, g, or t
atgatttgcaaatcattcctgttgatatccaagtacaccgagtatctttcctttaagcgaaagtttggcgatgatgggaatttgcttgttataggaatacaaacaaataaactttttgagcttggcactttcaagtcttatgcgacattaaatgaagagttgaaaaaagttccccatgttgaagacgtaataagcatttcttctgctgtaaaccttattaaggatactggaacagaaaagttaaatgcggtacctgtttttaataagcagttgtatacccaacatgaattagatagcggtaaatcggtcttattttcactccctttttataaaacactcttatacaacacggataccactgcttttcttaccggggtacgtatcaacaaacaagttcttaattcgtctggcaggactgatgtggtaaataatataattaaactaacaaacgccttcacaacgagcacaaaaatagaaacacatcttagcggtttgcctttaatcagaacgcttgtggcacaaaagatttcaaaagaaatgaattggtttgtgtttggctctcttgggctctcggcgttaattttgtttttattttttcgttcaatcagcactactcttatttcgttgtctgttgtagtcatcggtgtgttgtggagtttcggtattctgtatctatttggatataagataaccttactaaatgctctgatccccccgttagtagtggtaattggtattcctaattgcatttactttttaaataaatatcatgctacataccgtgcaaataaaaataaatcccaggccctgattgacatggtaagcaaaatggggattgtaactttattttgcaatgttagtgcggcaataggttttgcggtattgcttttactaagagcgctgtattaa

SEQ ID NO: 2696 - protein, 302 aa, Unknown
  Obtained from environmental sample
  misc_feature (1)..(302): Xaa is any amino acid
MICKSFLLISKYTEYLSFKRKFGDDGNLLVIGIQTNKLFELGTFKSYATLNEELKKVPHVEDVISISSAVNLIKDTGTEKLNAVPVFNKQLYTQHELDSGKSVLFSLPFYKTLLYNTDTTAFLTGVRINKQVLNSSGRTDVVNNIIKLTNAFTTSTKIETHLSGLPLIRTLVAQKISKEMNWFVFGSLGLSALILFLFFRSISTTLISLSVVVIGVLWSFGILYLFGYKITLLNALIPPLVVVIGIPNCIYFLNKYHATYRANKNKSQALIDMVSKMGIVTLFCNVSAAIGFAVLLLLRALY

SEQ ID NO: 2697 - DNA, 321 bp, Unknown
  Obtained from environmental sample
  misc_feature (1)..(321): n is a, c, g, or t
atgggtaattgttcctcaataaaaattactatgaattctactctcgcccttctttcttttgcattttctttttttgcattcactctacattctcaaccggaagaaatctatgaatcattagaatccgctttgatcaatcctgaanatgtttatcagctggatttggaagaaatgggacttgaaagtattcctgccgaaattgggaaattaaaagaacctcagagtgctggaactcgaaggaaaatcattaaaagaaattaccgaaagaaatctggcagcttacgaaatctgtgcgcctggatcttgatcaaaattatttaa

SEQ ID NO: 2698 - protein, 106 aa, Unknown
  Obtained from environmental sample
  misc_feature (1)..(106): Xaa is any amino acid
MGNCSSIKITMNSTLALLSFAFSFFAFTLHSQPEEIYESLESALINPEXVYQLDLEEMGLESIPAEIGKLKEPQSAGTRRKIIKRNYRKKSGSLRNLCAWILIKII

SEQ ID NO: 2699 - DNA, 324 bp, Unknown
  Obtained from environmental sample
  misc_feature (1)..(324): n is a, c, g, or t
ttgctatattgttgggtaaatgcttgtgaaactagtaagataatgttacctcgctcccttttagatactgcgaccctctttaaaatattaaataatcaaaatgtaattttaaagaagctcgctctatgtattaacgcacataatcttcctattgatatttgctataatatatatacttaccttgtatctgaagactgtacaatattaccttgtgaagtttttaaacccattatgagacatttggaaactgaattcctaaaagaaggcgactcctggcagaaaaatctcaatgcaaacattatcgacaagcagttaattcgttaa

SEQ ID NO: 2700 - protein, 107 aa, Unknown
  Obtained from environmental sample
  misc_feature (1)..(107): Xaa is any amino acid
MLYCWVNACETSKIMLPRSLLDTATLFKILNNQNVILKKLALCINAHNLPIDICYNIYTYLVSEDCTILPCEVFKPIMRHLETEFLKEGDSWQKNLNANIIDKQLIR

SEQ ID NO: 2701 - DNA, 744 bp, Unknown
  Obtained from environmental sample
  misc_feature (1)..(744): n is a, c, g, or t
ttgcaggagcataaatattttactgattatggccagcagaatttagaacccgggaaacaggcaaacctgctagccctcaccaaaaagaaaaatgataaggaagatattgaagaaggcccaaccgcgtttccttacatatcggatatcaataaaaaagatgagaaaaatcttcagaaaagtgcagagcgtggtattcaaaccatgtttcgcttaacatcgagcaatcatttgcggctaagttctatgtcggataacaaggctcacatcatgatctcagtaaactctatcattatttctattatcatttctgttttgttcggaaaacttgccaccaaccgcgaatacattattccggcatgcgtattacttgctgtttgtttgggatcgatgacatattcaattttagcgacaagaccttcggtcagcggcggacggttcactgaagaagatatccgcaacaaaaaaacaaacctgttgttctttggtaatttttacaagatggagttagaagactaccagcgagccatgaatcaaatgatgaaagatggagaatacctgtacaacagcatgatcaaggatgtttattttttaggaactgtgctcgcaaaaaaatacaagtacctcaaggtttcgtacaccatttttatgtggaggttgattgtagccgtgattgcatttgtaataactgcgtttatcgttgcagcgaatacgacaacgacgacngtgccaacgatcgattactag

SEQ ID NO: 2702 - protein, 247 aa, Unknown
  Obtained from environmental sample
  misc_feature (1)..(247): Xaa is any amino acid
MQEHKYFTDYGQQNLEPGKQANLLALTKKKNDKEDIEEGPTAFPYISDINKKDEKNLQKSAERGIQTMFRLTSSNHLRLSSMSDNKAHIMISVNSIIISIIISVLFGKLATNREYIIPACVLLAVCLGSMTYSILATRPSVSGGRFTEEDIRNKKTNLLFFGNFYKMELEDYQRAMNQMMKDGEYLYNSMIKDVYFLGTVLAKKYKYLKVSYTIFMWRLIVAVIAFVITAFIVAANTTTTTVPTIDY

SEQ ID NO: 2703 - DNA, 708 bp, Unknown
  Obtained from environmental sample
  misc_feature (1)..(708): n is a, c, g, or t
ttgattgaaaattatctaagggaccagtccaattattataacctcgttccctcttcattgggtctggaggatcctacattgaacacaatgatctctgcctttaatgtggccgtgatggaacgcaagatgttgctggataaaaatgtgcctgcaaccaatgttaaagtaaaagaagctgaagagcagatagaaaagctaagactcaacatattggaaagtctccggaatgtaaaatcagtattaggctcttctctttctgaactgcaaagaaaaaatgccgatgtgctttcccagatcacggcactgccgctgaaagagcaggaacttctcgacatcaaaagggagcaggaaaccaaactggctgtatataacatactgctagaaaagaaagaacagcttgccatcacaaaggcaggaaccatatccaataccaaagtactggatccggcagttgaaaaccggacgccggtttcacccaataaaaagaatgtgcaactcattgccatctttatcggtttattactgcctgctttatttgtgtttgcattggaaatgctgaatgataaggtgactactcgccatgatattgagaagatcaccgatgctactatactgggtgaagtaggacactcctatgcggccgatccgcttgtagtaacctccataatcgaatggtgtaacagaacagttccgtattattcgttctaa

SEQ ID NO: 2704 - protein, 235 aa, Unknown
  Obtained from environmental sample
  misc_feature (1)..(235): Xaa is any amino acid
MIENYLRDQSNYYNLVPSSLGLEDPTLNTMISAFNVAVMERKMLLDKNVPATNVKVKEAEEQIEKLRLNILESLRNVKSVLGSSLSELQRKNADVLSQITALPLKEQELLDIKREQETKLAVYNILLEKKEQLAITKAGTISNTKVLDPAVENRTPVSPNKKNVQLIAIFIGLLLPALFVFALEMLNDKVTTRHDIEKITDATILGEVGHSYAADPLVVTSIIEWCNRTVPYYSF

SEQ ID NO: 2705 - DNA, 417 bp, Unknown
  Obtained from environmental sample
  misc_feature (1)..(417): n is a, c, g, or t
gtgccgcttgctatattttttcctgaagtaaattttcatttagtggacagcattggcaaaaaattaaaaattgttgatgtagtgtcagaggctatcggtttaaataacataaccacacagcatattcgtgcagaagaaataaagaacaggaaatttgatttcgcggtaagtcgcgccgtggcatcgttaaaagatctttggcgatggagcaaacccttgttgaaaggatcaaactacaagacacagggtataagtgaagaacaaatattgcttaaatcaggattgatttgcctcaaaggtggtgacttaagacaagagataattgaaagcggaaccaaaccaaaaagcatagagatcacagatttgtttgatgaagaattttttaaagagaaatatttattgtacgtgtctacttaa

SEQ ID NO: 2706 - protein, 138 aa, Unknown
  Obtained from environmental sample
  misc_feature (1)..(138): Xaa is any amino acid
MPLAIFFPEVNFHLVDSIGKKLKIVDVVSEAIGLNNITTQHIRAEEIKNRKFDFAVSRAVASLKDLWRWSKPLLKGSNYKTQGISEEQILLKSGLICLKGGDLRQEIIESGTKPKSIEITDLFDEEFFKEKYLLYVST

SEQ ID NO: 2707 - DNA, 348 bp, Unknown
  Obtained from environmental sample
  misc_feature (1)..(348): n is a, c, g, or t
atgttcgattttgaaaaactggaagtttatcataaagccaagcattttcattcacaggtctatcattatattcaaaccctgaataatttagattcagcatctaaaaaccaactcaggcgtgcttccctaagtataatgcttaacattgctgaaggatcaagcagattcagcaaagcagaccggagaaatttttttgttattgcaagaggttcagtatttgaatgcgttgccatattcgacttcatgaaggaagaaagaattatagacaacaattttcacatggaactttatcagaaatcagaagagctttcaaaaatgatttatggaatgataaaaaatttggtgtaa

SEQ ID NO: 2708 - protein, 115 aa, Unknown
  Obtained from environmental sample
  DOMAIN (3)...(110): S23 ribosomal protein
  misc_feature (1)..(115): Xaa is any amino acid
MFDFEKLEVYHKAKHFHSQVYHYIQTLNNLDSASKNQLRRASLSIMLNIAEGSSRFSKADRRNFFVIARGSVFECVAIFDFMKEERIIDNNFHMELYQKSEELSKMIYGMIKNLV

SEQ ID NO: 2709 - DNA, 531 bp, Unknown
  Obtained from environmental sample
  misc_feature (1)..(531): n is a, c, g, or t
atgactttacttcaatctattgacaaactcattgagaatatatcagtgacagataggcaagaggagaatattaaaaactcgctctccaatatccagactcatctaaagaacaaggataatgaccttcatgttaaggatacatttgaaactggttcttatgacagagatacaataatccggccattgaatgacatagacttgttcgctgtacttaaacaagacaaatgggaagatgagaacggaaatttacccaagccccaaagcgtacttaccaagataaaaaactacttaaataatttgtccgactataagggaaaggtaactcaagaccgaccctgcgtaactatagaactgagcgataaaaatttcgatgtattgccaagctttgagcaaagttggggagggtatcttattccaagccatgatttgcagtcatggacttattctaatccaaagcagttaacaactgacctggacgagattcacagggaaacgaaattattaggtaaaaaccgaccatccaggcagtaa

SEQ ID NO: 2710 - protein, 176 aa, Unknown
  Obtained from environmental sample
  misc_feature (1)..(176): Xaa is any amino acid
MTLLQSIDKLIENISVTDRQEENIKNSLSNIQTHLKNKDNDLHVKDTFETGSYDRDTIIRPLNDIDLFAVLKQDKWEDENGNLPKPQSVLTKIKNYLNNLSDYKGKVTQDRPCVTIELSDKNFDVLPSFEQSWGGYLIPSHDLQSWTYSNPKQLTTDLDEIHRETKLLGKNRPSRQ

SEQ ID NO: 2711 - DNA, 357 bp, Unknown
  Obtained from environmental sample
  misc_feature (1)..(357): n is a, c, g, or t
ttgcatatctctttgcattttctttatgatttttatattagttttattcgcggattcttctataaggattatgaaaagatatcaataaacgtcaataatattatttaccatttatctttttcaaaaaaaggaaatattaatgacgagttggtggataaaatactggctactatattaaatgatattcataatatgattgaacaacaaataaaacaacaacaaattgaatctaaattgattactgctgaaaatatggcatcagaaattattatttctatatatgaggagataatttcaaaatgtaaattacatgttaaacaagcgagcataacatatgattttgacaaattgttgtga

SEQ ID NO: 2712 - protein, 118 aa, Unknown
  Obtained from environmental sample
  misc_feature (1)..(118): Xaa is any amino acid
MHISLHFLYDFYISFIRGFFYKDYEKISINVNNIIYHLSFSKKGNINDELVDKILATILNDIHNMIEQQIKQQQIESKLITAENMASEIIISIYEEIISKCKLHVKQASITYDFDKLL

SEQ ID NO: 2713 - DNA, 777 bp, Unknown
  Obtained from environmental sample
  misc_feature (1)..(777): n is a, c, g, or t
gtgaaaccctcaatcacatattcgactgcattatgttcttgtttgttgctgtcatttctttgccacggccagaacaatcaaaaagcgccgcttttcttttccagctcaatcattaatacttcagagaatagcaaacctttttacccggctttaaaaagaaagaagtacatcatacgtaaacaacaggcgttgattgaccgtttcagatgcttcggaaatcctggagagccttctgcattttcaataaccatttgtgctgatgttcctgacaatgagcatccagataaagtattattagatggcaagccgggacatgtatttctcatcttttctaaatccacaggtaaggacacattcaataccgtattcggcttctatcctaaacatgccgcctttttattgtgcagatacatcagaagtgaaatcagggataacagttacagggcgtatgatgcttgtttaaagcgatcggtaaatgcaaatgaatttacggccactcttaataatgctgtactctttgcacacaaaagataccatttaaaaaaatataattgctacgactatgccctggacatttttaactctctccccggtgaaaaaatcgatgtcattcacataagatttcctttccttatgggaaaaggcggaactccttgcagcctttatagtgaactaaagaaaatgaaaactgaaagcgcagccaaaaattttgagatttcgtttggctcctttttatcgcctatgagttatcggcaaaatcaacccatggaacgttaa

SEQ ID NO: 2714 - protein, 258 aa, Unknown
  Obtained from environmental sample
  misc_feature (1)..(258): Xaa is any amino acid
MKPSITYSTALCSCLLLSFLCHGQNNQKAPLFFSSSIINTSENSKPFYPALKRKKYIIRKQQALIDRFRCFGNPGEPSAFSITICADVPDNEHPDKVLLDGKPGHVFLIFSKSTGKDTFNTVFGFYPKHAAFLLCRYIRSEIRDNSYRAYDACLKRSVNANEFTATLNNAVLFAHKRYHLKKYNCYDYALDIFNSLPGEKIDVIHIRFPFLMGKGGTPCSLYSELKKMKTESAAKNFEISFGSFLSPMSYRQNQPMER

SEQ ID NO: 2715 - DNA, 810 bp, Unknown
  Obtained from environmental sample
  misc_feature (1)..(810): n is a, c, g, or t
gtgaaaagaaaaggaatccactacaaaatgggagaaaaatatacattctccattccagataaaaaaggaggcgcatttaaatttaaacacagattgattgatagaaaaacatcaaatttgcaaattttaaagttcagacacaaaatgttgactcatttggttgaaaagaaaaaaatgatattgcaaaatcaaaacgaaacaaaagaaaccaacgaaaaaacatactctttaggaagtgatgatatgaacattgaaaagaataatattgaaatgcaaaataaaacaaacaaaaataatgaaaagaacattgaaataatcaggcagagagaagaaaaaatgaaggaaaatgaattatatgtgaatgaacacactttagaagaacttttatatgaacaagaagttttttgtaaacgagtagaattcgaaagagagaaaaataattcaaaaaatttaaagaaattaacattagcaccagaagaaaaaataacaaaaaatgacaaaaacaaattcttttattcatatcatattggaaacatgtcaatagattggagatttaaatcaccaaaaacaaaaagttttgttttgcagaaacatttgaaatttttgaaaaatcaagtttctcaactgcaatataaaccagaaaatgaagaattgttaaaaccttatagaagtaatattgaattggtgggaaaatatttttgtcaaatgtggaattcagaaagagcacctactaaaaaaactaaaatgattaaatttttgttgataatagctttttttaaagacgatttgaaaaaaccaaaagaanattaa

SEQ ID NO: 2716 - protein, 269 aa, Unknown
  Obtained from environmental sample
  misc_feature (1)..(269): Xaa is any amino acid
MKRKGIHYKMGEKYTFSIPDKKGGAFKFKHRLIDRKTSNLQILKFRHKMLTHLVEKKKMILQNQNETKETNEKTYSLGSDDMNIEKNNIEMQNKTNKNNEKNIEIIRQREEKMKENELYVNEHTLEELLYEQEVFCKRVEFEREKNNSKNLKKLTLAPEEKITKNDKNKFFYSYHIGNMSIDWRFKSPKTKSFVLQKHLKFLKNQVSQLQYKPENEELLKPYRSNIELVGKYFCQMWNSERAPTKKTKMIKFLLIIAFFKDDLKKPKEX

SEQ ID NO: 2717 - DNA, 564 bp, Unknown
  Obtained from environmental sample
  misc_feature (1)..(564): n is a, c, g, or t
atggtgaagcaaggatggagctattctgattacactaaattatccaataattcaaccaataaagaaactctcaaagaaataagagtagagggaataaaaatatctccatcagaaagcaattcgcttgaggagaaaaagaataatcaaattcagatacgagagggcgttaaaatagataacccagacctgaatgaagtaactgtggtgggttatgggaaaaaggatgaggactcaaataagatatttgaaaaaatggaaaaagaacctgaatttccgggaggtactgctgcatggcaaagatatctacagagaaaccttaaaccgaccattccggctgataatggtgcaccatcaggttcttacaccgtaacagttcaatttatcgttgacaggcagggtaacatatcagatgttaagcctctcaccaggcatggatatggtatggaagaagaagtaattcgcttaattagaagaggacctaaatgggttccaggcgttcaaaatggtcataacgttactgcctataaaaaacagaatgtaacatttgcagtttcaatcgaatag

SEQ ID NO: 2718 - protein, 187 aa, Unknown
  Obtained from environmental sample
  misc_feature (1)..(187): Xaa is any amino acid
MVKQGWSYSDYTKLSNNSTNKETLKEIRVEGIKISPSESNSLEEKKNNQIQIREGVKIDNPDLNEVTVVGYGKKDEDSNKIFEKMEKEPEFPGGTAAWQRYLQRNLKPTIPADNGAPSGSYTVTVQFIVDRQGNISDVKPLTRHGYGMEEEVIRLIRRGPKWVPGVQNGHNVTAYKKQNVTFAVSIE

SEQ ID NO: 2719 - DNA, 546 bp, Unknown
  Obtained from environmental sample
  misc_feature (1)..(546): n is a, c, g, or t
atggaacaactaaacctgggcatcggcacccgcttgcaacatacgcaatacggacccggtgtaattgctggcattcgttatgccacttatcttatttcctttattcatcatggcgtgaaagagattgataaaaatgatacaaagctggaagagatcatcccggaaaacgtaacagaagaaatagaaacgcattcagaggttgaaagatcattgctgaaaattttgcgcctttggagcgatgtgaatgaaattgttcctttaggagaccggtggaaaggtggcaccatgcttttacagccagccgacaaatcgctaaaaccaaaagaaattcctgttgacgacttttttcataaaatagtgatgctgcgcgacaggttaagagtgttggaacaaaatatcaatagcaataaaaaacttagtgatgaagaaaaagtgaacatccagcaatatattacccgctgctatggatcgcttaccacattcaatgttttattcaaaaacaaagagcattggtttgtgggtgataaggggagtaaggaggagtaa

SEQ ID NO: 2720 - protein, 181 aa, Unknown
  Obtained from environmental sample
  misc_feature (1)..(181): Xaa is any amino acid
MEQLNLGIGTRLQHTQYGPGVIAGIRYATYLISFIHHGVKEIDKNDTKLEEIIPENVTEEIETHSEVERSLLKILRLWSDVNEIVPLGDRWKGGTMLLQPADKSLKPKEIPVDDFFHKIVMLRDRLRVLEQNINSNKKLSDEEKVNIQQYITRCYGSLTTFNVLFKNKEHWFVGDKGSKEE

SEQ ID NO: 2721 - DNA, 465 bp, Unknown
  Obtained from environmental sample
  misc_feature (1)..(465): n is a, c, g, or t
ttgacccaaccaatccagggcaattatcttcgcctgatgaaaaagatggccttgtttgcttcaggtaccggtaccaatgcacaaaagatcattgaccatttttctaaatctggtaaaaatgccacggtaggtttgatcgtttgcaataaacccggagctgccgtacttcagattgctgaaaaagaaaaaattccctccttaattattgaaaaagaaaaattttttcgcggtgatgcttatgtgcccgaactaaaatcgtacgaaatagacctgattgtattggctgggtttctctggaaaattcctctaccactaatagaagcatatcctcggcgcattattaatatccacccggctctattaccaaaatatggggggaaaaggcatgtatggaaaacttgttcaccaggcagttttggatgcaggcgacaaagaaagtggcattaccatacattatgtagatga

SEQ ID NO: 2722 - protein, 154 aa, Unknown
  Obtained from environmental sample
  DOMAIN (14)...(152): Formyl transferase
  misc_feature (1)..(154): Xaa is any amino acid
MTQPIQGNYLRLMKKMALFASGTGTNAQKIIDHFSKSGKNATVGLIVCNKPGAAVLQIAEKEKIPSLIIEKEKFFRGDAYVPELKSYEIDLIVLAGFLWKIPLPLIEAYPRRIINIHPALLPKYGGKRHVWKTCSPGSFGCRRQRKWHYHTLCR

SEQ ID NO: 2723 - DNA, 348 bp, Unknown
  Obtained from environmental sample
  misc_feature (1)..(348): n is a, c, g, or t
atgaggaaaaattcatttgcttatgatgatggacagatcatgcctttagctatcccaaaaggttttaaaaaagtggaattacaaacagatagtgccggtaataaaataaaattgttttcatatgctgatggaagcattatctatttttattatggagatactattaaaaattaccagcccatcgacacctcgatgaacattgcaaaatattatcctggaaatgtattgttcttcaaagggcaggatagcagcaatagattattctggagagaaagccggtataaaattttcgatttgggtatagaaatatttcttttgaaagggaagctttatttgattcttctgtga

SEQ ID NO: 2724 - protein, 115 aa, Unknown
  Obtained from environmental sample
  misc_feature (1)..(115): Xaa is any amino acid
MRKNSFAYDDGQIMPLAIPKGFKKVELQTDSAGNKIKLFSYADGSIIYFYYGDTIKNYQPIDTSMNIAKYYPGNVLFFKGQDSSNRLFWRESRYKIFDLGIEIFLLKGKLYLILL

SEQ ID NO: 2725 - DNA, 333 bp, Unknown
  Obtained from environmental sample
  misc_feature (1)..(333): n is a, c, g, or t
ttgtttacacattattcagttccttccccagttttagtattgcgaaattcatttttaattattgaaaaaaaatggcaggagttcatacaaaaattatccctgggcattaaagaaatttttcttcctgatcttcaattattgaatttagtgattgagcgtgaaggcaggaagccgcagttaaatggtgagctaaccaaagtacagcaagtatatgcccaactacatgaactggctactggtatcgacaccactttatcacaacatgttgccgcatcaaaagcaaagaccattaagcagttgcaaaatcttgagaacccaaatgatgccggctga

SEQ ID NO: 2726 - protein, 110 aa, Unknown
  Obtained from environmental sample
  misc_feature (1)..(110): Xaa is any amino acid
MFTHYSVPSPVLVLRNSFLIIEKKWQEFIQKLSLGIKEIFLPDLQLLNLVIEREGRKPQLNGELTKVQQVYAQLHELATGIDTTLSQHVAASKAKTIKQLQNLENPNDAG

SEQ ID NO: 2727 - DNA, 660 bp, Unknown
  Obtained from environmental sample
  misc_feature (1)..(660): n is a, c, g, or t
atggaacgcgaaagtgtagaaatacctgttgagattgaacctaaagtcgaatgccagtggcgctggcttaacaccagcgcgcttgcgtgcaatcttgatgaaaaaaacaaactaaagtcggcaaccgcctataatattaagattgcgcctggtattaaagcagaagacggagctactattgaaaataatttcaatcaccagtttattacagaacgtcccgatatacgttatgcttggtttaaaaaatcactctctccaggcactcccattattcttgttatcttcaatcagcctgttactaaaaaatcggttgagtccagcttatctgttatttttacagaaggaggaactaacaaacaatacaagttaaaagctgaaccagacccagatgatagggagactccttcttatttgctaatacataataccaaagtgactggagtttctgagcaaaatagtcaacaaaaaagtgataaagatttacataaaagcacagatgaagaagcaagacgcatgtggttagttatttctagggaggaacttccccttgatactgcgatggccattagaatgaagtcagggctcatatctgtacttggggatgacaaaggtataggtgatcgtgaagttatacattctcaacacatttccagagtttaa

SEQ ID NO: 2728 - protein, 219 aa, Unknown
  Obtained from environmental sample
  misc_feature (1)..(219): Xaa is any amino acid
MERESVEIPVEIEPKVECQWRWLNTSALACNLDEKNKLKSATAYNIKIAPGIKAEDGATIENNFNHQFITERPDIRYAWFKKSLSPGTPIILVIFNQPVTKKSVESSLSVIFTEGGTNKQYKLKAEPDPDDRETPSYLLIHNTKVTGVSEQNSQQKSDKDLHKSTDEEARRMWLVISREELPLDTAMAIRMKSGLISVLGDDKGIGDREVIHSQHISRV

SEQ ID NO: 2729 - DNA, 816 bp, Unknown
  Obtained from environmental sample
  misc_feature (1)..(816): n is a, c, g, or t
ttgaaaactaccaaagaagagttaacctttgcattggacgcactgtatgattgtgagagagagaagaaaaatagcgggttgagtcaaaaagatattgatgatttccttgaggctgttaaacaacttattgaaataaggcaggttttattcccgtcaggaattctttctcaagatgaacgaaaaaaaatatcaatcgtgatggctgttatcgatgatagacaaattgagataattaaaaaaggaaaagaattaaaagactttatagctaataaacgagatagtgaagagaaattatttaaggaccaacagttgtggggattagatcatacgcgccagtgcgtccaaaaacttggttttaattttaatttagtagtaataaatgaaaatcaagatcgtgataattgggatgcgtttggctcgacaaaggaagaggggctaccagaagatactggtgaaggtgtagatcaagaagacaccccttcttctgaagatgctgtagacgttacagagacagtaccgaagcagagtactcagaaatcttcaactttaagcaaaaaaatagagcaagaagaaaaagtttttaaatatcaatacacctcaactgatattaatcggttactatctcaatctctggcagatgaaagcaagcgtcctgctaaggcagtttataataaattttctttaagtggtgctgtaagtgatgataatgcagatacagttgatctcattcattgcttgaatagtagtaaatatgtattggctcctattattccacatctggaagaaaatgaagagaaaaaatcctgtgaaatttga

SEQ ID NO: 2730 - protein, 271 aa, Unknown
  Obtained from environmental sample
  misc_feature (1)..(271): Xaa is any amino acid
MKTTKEELTFALDALYDCEREKKNSGLSQKDIDDFLEAVKQLIEIRQVLFPSGILSQDERKKISIVMAVIDDRQIEIIKKGKELKDFIANKRDSEEKLFKDQQLWGLDHTRQCVQKLGFNFNLVVINENQDRDNWDAFGSTKEEGLPEDTGEGVDQEDTPSSEDAVDVTETVPKQSTQKSSTLSKKIEQEEKVFKYQYTSTDINRLLSQSLADESKRPAKAVYNKFSLSGAVSDDNADTVDLIHCLNSSKYVLAPIIPHLEENEEKKSCEI

SEQ ID NO: 2731 - DNA, 579 bp, Unknown
  Obtained from environmental sample
  misc_feature (1)..(579): n is a, c, g, or t
gtgtcggagggtaagatgtattatttctttnctcatatatctcaaacagcagtaattgtaattggaatgttatttgtactttcgatttttatccgaagtttctngtgcagattcctttgtccgtacgtggcattgctcggaatagtttcattactaagtccaaataaaattcaaagaaatgcaaagagttgtattgattgcggactttgtaataaagcgtgtccatcttttataaaagttgatagtgttaagacagttatttcagatgaatgttcaacttgtttaaactgcgttgatgtgtgtcccgttaaagatactctggaactaaaatcgatccttccgggagaaaagaaaataaataaaaaatttgttgcgattggtgtagtttccatatttatgatagtaacagggtttgcaatgctaacaggcaactggcaaaataagataacaaaagaggaatatcttttacactataaatacatgaacagttatgggcaccctacaggcgtaaaggaattcaaaaaattaaataaggacgttgaattgcagaatcaacagaaaaacttagatagcaaatag

SEQ ID NO: 2732 - protein, 192 aa, Unknown
  Obtained from environmental sample
  DOMAIN (57)...(80): 4Fe-4S binding domain
  misc_feature (1)..(192): Xaa is any amino acid
MSEGKMYYFFXHISQTAVIVIGMLFVLSIFIRSFXCRFLCPYVALLGIVSLLSPNKIQRNAKSCIDCGLCNKACPSFIKVDSVKTVISDECSTCLNCVDVCPVKDTLELKSILPGEKKINKKFVAIGVVSIFMIVTGFAMLTGNWQNKITKEEYLLHYKYMNSYGHPTGVKEFKKLNKDVELQNQQKNLDSK

SEQ ID NO: 2733 - DNA, 777 bp, Unknown
  Obtained from environmental sample
  misc_feature (1)..(777): n is a, c, g, or t
ttgcagttggttttgtccaatcggatttattctgaactgattggtgattttggagaaaagatctttaagcgaagattaaaacttccaaagtggctggattatccgttaagaagtttaaaatatattttgcttgcgtttctggtttactcagtaatttttttaatgtcaactttagcacttaaagcatttcttgatagtccgtacaatcttgtatcggatgttaagatgtattatttctttgctcatatatctcaaacagcattaattgtaattggagttttatttgtactttcaatttttatccgaagtttctggtgcagattcctttgtccgtacggtgcattgctcggaatattttcattactaagtccaaataaaattcaaagaaatgcaaagagttgtattgattgcggactttgtaataaagcgtgtccatcttttataaaagttgatagtgttaagacagttatttcagatgaatgttcaacttgtttaaactgcgttgatgtttgtcccgttaaagatactctggaactaaaatcgatccttccgggaaaaaagaaaataaataaaaaatttgttgcgattggtgtagtttccatatttatgatagtaacagggtttgcaatgctaacaggcaactggcaaaataagataacaaaagaggaatatcttttacactataaatacatgaacagttatgggcaccctacaggcgtaaaggaattcaaaaaattaataaggacgttgaattgcagaatcaacagaaaaacttag

SEQ ID NO: 2734 - protein, 258 aa, Unknown
  Obtained from environmental sample
  DOMAIN (127)...(150): 4Fe-4S binding domain
  misc_feature (1)..(258): Xaa is any amino acid
MQLVLSNRIYSELIGDFGEKIFKRRLKLPKWLDYPLRSLKYILLAFLVYSVIFLMSTLALKAFLDSPYNLVSDVKMYYFFAHISQTALIVIGVLFVLSIFIRSFWCRFLCPYGALLGIFSLLSPNKIQRNAKSCIDCGLCNKACPSFIKVDSVKTVISDECSTCLNCVDVCPVKDTLELKSILPGKKKINKKFVAIGVVSIFMIVTGFAMLTGNWQNKITKEEYLLHYKYMNSYGHPTGVKEFKKLIRTLNCRINRKT

SEQ ID NO: 2735 - DNA, 807 bp, Unknown
  Obtained from environmental sample
  misc_feature (1)..(807): n is a, c, g, or t
ttgggcatatatcagcatggccactctttatcaggccacaaagcaaagcgattcatctatcttctatgcgaagaagggatttccctctctcagaaaataaaactccaggagggcattcttggcactagccggatactttcgcgggaatatgaatccatcgacgttggtgaagcactgtattatcgtaaaatatttgacgagacaaatgatgaaatgtacggtcaaaataaggtattagcattgcaaaaaacattaacggaagagcaggaacggcaaagactgcttgatgaaaagagcacagcctacaagaacagcatcaagctctacgcatnttcagccgggcttctgttcctgttgttagtcgctattttcctgcttcgaaataacaggcaaaaacaaaaggccaataagctgttggagacagcgcttactaatttaaaatctactcaatctcaacttatccaatccgaaaagatggcttcacttggagaactcactgcaggtattgcacacgagattcaaaaccctttaaactttgtcaataacttttctgaagtaagcaatgagttgattgatgaaatgagatcagaactggtaaccggcaatctgcgactggcaactgaaattgcgaatgatgtgaaacaaaacctggaaaaaataatcctcatggggcaaagagcagatgccatagtaaaaggcctgttggcaccattcccaaaggtgcgacgggttaaaaagaaccaccgatatcaatgcctgggtgatgaatattacgtctccacaataacgggttctgccacagattag

SEQ ID NO: 2736 - protein, 268 aa, Unknown
  Obtained from environmental sample
  DOMAIN (161)...(229): His Kinase A (phosphoacceptor) domain
  misc_feature (1)..(268): Xaa is any amino acid
MGIYQHGHSLSGHKAKRFIYLLCEEGISLSQKIKLQEGILGTSRILSREYESIDVGEALYYRKIFDETNDEMYGQNKVLALQKTLTEEQERQRLLDEKSTAYKNSIKLYAXSAGLLFLLLVAIFLLRNNRQKQKANKLLETALTNLKSTQSQLIQSEKMASLGELTAGIAHEIQNPLNFVNNFSEVSNELIDEMRSELVTGNLRLATEIANDVKQNLEKIILMGQRADAIVKGLLAPFPKVRRVKKNHRYQCLGDEYYVSTITGSATD

SEQ ID NO: 2737 - DNA, 612 bp, Unknown
  Obtained from environmental sample
  misc_feature (1)..(612): n is a, c, g, or t
ttgattttgaaaatatataatactctttccacaaaagttgatgaattacaagttaataataatattaaaatttatttatgtggagtgacagtttacgacgaatctcacattggacacgcaagaactattattatatttgatgtcttacatagatatcttttatcgagacaccataaagtaacattcattcaaaattttaccgatattgatgacaaaataataaaaaaagctaactctcttaataaagactacaaagaaatatctcaaaaatatatcaaacaatatttggaggatgcatctaaattaaacgttttaaaaggagttcattatccaaaggctactgaccatatctcaaatatgatagaattaataaaatatttgcttgaaaaaaattatgcatatattaccttaaatggaatttattttgaagtaaaaaaattttctcagtatggaaaattatctaagaaaacttctgaaagtattaattctggggtaagagtagagattgatcctacaaaaaaagatccgcttgattttgccttgtggaattttcatctgtctcgcctatatgggaaagtccttggggagcaggtcgtccaggatggcacatag

SEQ ID NO: 2738 - protein, 203 aa, Unknown
  Obtained from environmental sample
  DOMAIN (12)...(200): tRNA synthetases class I (C) catalytic domain
  misc_feature (1)..(203): Xaa is any amino acid
MILKIYNTLSTKVDELQVNNNIKIYLCGVTVYDESHIGHARTIIIFDVLHRYLLSRHHKVTFIQNFTDIDDKIIKKANSLNKDYKEISQKYIKQYLEDASKLNVLKGVHYPKATDHISNMIELIKYLLEKNYAYITLNGIYFEVKKFSQYGKLSKKTSESINSGVRVEIDPTKKDPLDFALWNFHLSRLYGKVLGEQVVQDGT

SEQ ID NO: 2739 - DNA, 699 bp, Unknown
  Obtained from environmental sample
  misc_feature (1)..(699): n is a, c, g, or t
ttgatatttgaaattattcataaaaatgaaaagaaagaaggagattatttgaattttattatttctatgcaatgtattggatctttgaaatacaaatttatatcttcatttcattttattattgaagaaatatttcagaataattatccattactttggaataatgttaaaattcaaatttatttcaatagattattgaattcacaaatcgaagaatttcatttagattacaatgaatgtttgaagaatttttattcaaatgaagaagagattggaattgggaatagatttacaataccattacaaaaactaattcctgaaaaatttgaagaaaaattgaataaaacagataatattgatattccacaaatggattcttctcaatttacaattctaagaaatcttggatctggtgcttattcagatgtttttctttgtgttaatttaattaatgatggaagatatgtaatcaagaaattcaaaattcatagtgaaaaaagtgaagatattccaaaaatcaaaaaatcatttgaaagagaattggatattatgaagaatttgaaacacgaaaatataactaaattagttggatatgaacaatctgaagaaaattggagtttaattatcaatttatctgattattctttgagtgcattacaaaaagaatggttgacttatttaccttcttcttttgaatga

SEQ ID NO: 2740 - protein, 232 aa, Unknown
  Obtained from environmental sample
  misc_feature (1)..(232): Xaa is any amino acid
MIFEIIHKNEKKEGDYLNFIISMQCIGSLKYKFISSFHFIIEEIFQNNYPLLWNNVKIQIYFNRLLNSQIEEFHLDYNECLKNFYSNEEEIGIGNRFTIPLQKLIPEKFEEKLNKTDNIDIPQMDSSQFTILRNLGSGAYSDVFLCVNLINDGRYVIKKFKIHSEKSEDIPKIKKSFERELDIMKNLKHENITKLVGYEQSEENWSLIINLSDYSLSALQKEWLTYLPSSFE

SEQ ID NO: 2741 - DNA, 753 bp, Unknown
  Obtained from environmental sample
  misc_feature (1)..(753): n is a, c, g, or t
ttgtcctctattgaaggattaagatcgattagtatgactacaaatggaatactcgtaaaagataaaataaagattctcaaagaatctgggctagaaagtttaaacattagtttggatacattcaaacctgatagatttaaagctatgagtggaattgatggcttttatagagtaaagaatgcaataaataccgcaatagatgaaaatttgccagtaaaaattaatactgtaattattaagggatggaatgatgatgaaataccacattttgtaagattttctagggacactggatgtgttgttaaatttattgaatttatgccattggatggaacaggcatgtggtctgacgaattggtagtaagtaagaaaaaaatgatagagataataaacaatgactttgatcaactatctccactttataacgataagtctgaccccgctagattatacacatttgaggatggaaaaggagtcataggatttattccctccatcacagaacccttttgtcaaaactgtgatagagttcgtatgactgcagatggtaaactttacagttgtttatttgacaagtcaagcaatgatctaaagagtttacttgatggaggaaaatcagatatagatataatcaagtgtatcaacaagtcagtacaggaaaaacccgaaggaattattaaaattattaaaacacattcattaagaccaactttgaatgttatgcacacgattgggtggataacacctagttga

SEQ ID NO: 2742 - protein, 250 aa, Unknown
  Obtained from environmental sample
  DOMAIN (99)...(227): Molybdenum Cofactor Synthesis C
  misc_feature (1)..(250): Xaa is any amino acid
MSSIEGLRSISMTTNGILVKDKIKILKESGLESLNISLDTFKPDRFKAMSGIDGFYRVKNAINTAIDENLPVKINTVIIKGWNDDEIPHFVRFSRDTGCVVKFIEFMPLDGTGMWSDELVVSKKKMIEIINNDFDQLSPLYNDKSDPARLYTFEDGKGVIGFIPSITEPFCQNCDRVRMTADGKLYSCLFDKSSNDLKSLLDGGKSDIDIIKCINKSVQEKPEGIIKIIKTHSLRPTLNVMHTIGWITPS

SEQ ID NO: 2743 - DNA, 435 bp, Unknown
  Obtained from environmental sample
  misc_feature (1)..(435): n is a, c, g, or t
ttgaatggaggttctgagatctctcatgtctataagattccggcaaaaggatatcaaatcatttaccagatcaaaagcaacggtttcggggaccaactttcgggagagtatttgtcattccagtggaaaaatatcctgaagcctattgaaaaggaccttgcagatacgcgcgtctactctacaataacctactattctgatgccgacggctttgacgaattgagcgagcgttcaacagataccgagactgagatatttggaggaccgctgaaatggataacgatcaaagaaaaattctttctatcctcgatcatagccaagaatagtttttcaggcggagaggttgaaacagctgtaaacgaaagtgatacgtcggtagtgaaacgcgcccaatgcaaggttgtttattcccctcaacgacgtcaaacagaataa

SEQ ID NO: 2744 - protein, 144 aa, Unknown
  Obtained from environmental sample
  misc_feature (1)..(144): Xaa is any amino acid
MNGGSEISHVYKIPAKGYQIIYQIKSNGFGDQLSGEYLSFQWKNILKPIEKDLADTRVYSTITYYSDADGFDELSERSTDTETEIFGGPLKWITIKEKFFLSSIIAKNSFSGGEVETAVNESDTSVVKRAQCKVVYSPQRRQTE

SEQ ID NO: 2745 - DNA, 303 bp, Unknown
  Obtained from environmental sample
  misc_feature (1)..(303): n is a, c, g, or t
gtgtcgtcgcacaaaaatttacgaagaacgtttatctcggttggcctcctgttttctggatcaaccaagtttgtcattcttccggtttttcatttcctgaccaagatcatttccaattatgggttgattattatcantcctgttattctnctaaagctgctgctgtttcccctctcctacaagtcgttcctgagcactggcaccatgaacgtactcaagccgcagttngatgaaataaaggaaagagttggccacgatatgaagaaagttaagcaggagcaactgaacctgtntcaccggtag

SEQ ID NO: 2746 - protein, 100 aa, Unknown
  Obtained from environmental sample
  misc_feature (1)..(100): Xaa is any amino acid
MSSHKNLRRTFISVGLLFSGSTKFVILPVFHFLTKIISNYGLIIIXPVILLKLLLFPLSYKSFLSTGTMNVLKPQXDEIKERVGHDMKKVKQEQLNLXHR

SEQ ID NO: 2747 - DNA, 663 bp, Unknown
  Obtained from environmental sample
  misc_feature (1)..(663): n is a, c, g, or t
atggaaactcagcctcgtgaacaactacccctaattgatgtggcaaagcggcatgttgcccaacaaaaagtgaaaactaatagggcagatgaagttttatggaaaataaggaaatctcaaccttataatcatactacagaaaagcaaaaactgttcttccaggatctgccaaaaaaagcaaaacgtcttattctagaatttgcaaatacagaagacttgcttgaagctttggttgatacaaataaagtagaagataaaatcttcactcgattaaagacgctgattgcaaattataatactgcgagattccaggatcaatacaggggtcccactttcaactacaaatctgataatcctttatttgataatacagcattttttaatagagaaacaaatgacttttataatcagcttagaaatgagcacaataagataaattggtactactttaatggaacaggtatatcgaaatatatcaatcttcgtctacgtttattaaacagaacagcagactgtaccaatgctttaatttgggctgaacaaataaagaaagatctttatgatcatgtaataaaagcacctattgaattacaagatactaatgacttgcaaattctcatcactccagaacaacacacacatgatatctttattgtcatgtaa

SEQ ID NO: 2748 - protein, 220 aa, Unknown
  Obtained from environmental sample
  misc_feature (1)..(220): Xaa is any amino acid
METQPREQLPLIDVAKRHVAQQKVKTNRADEVLWKIRKSQPYNHTTEKQKLFFQDLPKKAKRLILEFANTEDLLEALVDTNKVEDKIFTRLKTLIANYNTARFQDQYRGPTFNYKSDNPLFDNTAFFNRETNDFYNQLRNEHNKINWYYFNGTGISKYINLRLRLLNRTADCTNALIWAEQIKKDLYDHVIKAPIELQDTNDLQILITPEQHTHDIFIVM

SEQ ID NO: 2749 - DNA, 669 bp, Unknown
  Obtained from environmental sample
  misc_feature (1)..(669): n is a, c, g, or t
gtgttcaaatcgaagaatagtttcctatctgtatttcagagtcttgattttatcacgttgcagggcataaccggtgcttccgtgttcagaaagtttcatacgatgtgtaatggtgctaaccttgcctattcaaaaaaagctttccgggaagtaaatggatttgaaggtattgatcatataccaagtggtgatgacatgatgctgatgtataagatttatcagcgtcatcccgataacgttttctatctgaaaaacccgggagcgatcgttacaacagagccggccaaaagctggaaagagtttttgaatcaacgtattcgctggtcaagcaaagcagtacactatgatgataaaaggatttatcgtgtgttgttgctggtttacgcattgaatgtttcttttcttgttgttgccattgcttcgttctggaagctgaattttttcctgttcttcctgttatcgcttacagcaaaggtgttgatagagtttccgtttgtaaacaacatcgcaatgttttttggtcagcagcgcctgatgaagtactttccgctaatgcagcctttccatattttgtataccattgttgccggctggctcggcaaatttggatcgtatgaatggaagggaagaaaaatagtgaacaatggcaaaaggatccaggcaacgtag

SEQ ID NO: 2750 - protein, 222 aa, Unknown
  Obtained from environmental sample
  misc_feature (1)..(222): Xaa is any amino acid
MFKSKNSFLSVFQSLDFITLQGITGASVFRKFHTMCNGANLAYSKKAFREVNGFEGIDHIPSGDDMMLMYKIYQRHPDNVFYLKNPGAIVTTEPAKSWKEFLNQRIRWSSKAVHYDDKRIYRVLLLVYALNVSFLVVAIASFWKLNFFLFFLLSLTAKVLIEFPFVNNIAMFFGQQRLMKYFPLMQPFHILYTIVAGWLGKFGSYEWKGRKIVNNGKRIQAT

SEQ ID NO: 2751 - DNA, 450 bp, Unknown
  Obtained from environmental sample
  misc_feature (1)..(450): n is a, c, g, or t
atgctaactattatcagaaccaactccgaaaacaaggattttatccatcttgttaaatatcttgatgctgaattagcagtactggacggtgacgaacatgaattttacgcgcagcttaataaaacacataacttaaaacaggtggttgtcgcttatgaaaatggcaaaccaatcgcttgtggtgcattaagagaacattcaccaaccatcatggaggttaaacgaatgtacacgttgcgggagaacaggggcaaaggaattgcaactaaaatcttaactgaattagaaaaatgggcagccgaattatcctatcagaaatgtattttggaaacgggcaagcgacagccggatgcgatctggttatatcaaaagaatggatacaaggtcattcccaattacggcaaatatcttgtcatggagaacagcgtatgttttgaaaaagaaatttga

SEQ ID NO: 2752 - protein, 149 aa, Unknown; identical to SEQ ID NO: 1214
  Obtained from environmental sample
  DOMAIN (49)...(128): Acetyltransferase (GNAT) family
  misc_feature (1)..(149): Xaa is any amino acid

SEQ ID NO: 2753 - DNA, 648 bp, Unknown
  Obtained from environmental sample
  misc_feature (1)..(648): n is a, c, g, or t
ttgcaggatataacaaaaatccgggaaaaacaaaaactcaaagatgactggttcagtatgctttcccatgagctcaaatctccaataacaagcataaaagcttacaatcagctgcttttaagccagatttcggaaaatgaccagaaaagaaagctccttataaatatggatgaccagatagacaggttaaacaggttaattcaggacttttttgagctctccaggctgcaatcgggtaatttaaaatttgataaagagtttattgatattgacctgttcctcaaaaagctaatccataccatgaaaataacctacacccacagaaaatttgtattaaaaggcaatacaaacggttttatttttgcagataaagacagtattgaacaggtgttaataaatttcataacaaatgccataaaatattcagaggataataaaaaaattgaaattattgtttatgacgatgataaatcagtgacttttggagtcagagatttcgggaaaggcatacctgcaaaattccggaaaaaaatatttaaccccttttaccggattaatcattcatcaaaaggcaaaagcggaatgggtatcggcttatttattgccggtaccatcattaaagctcacgaaggaaaaatctggggttga

SEQ ID NO: 2754 - protein, 215 aa, Unknown
  Obtained from environmental sample
  DOMAIN (13)...(79): His Kinase A (phosphoacceptor) domain
  misc_feature (1)..(215): Xaa is any amino acid
MQDITKIREKQKLKDDWFSMLSHELKSPITSIKAYNQLLLSQISENDQKRKLLINMDDQIDRLNRLIQDFFELSRLQSGNLKFDKEFIDIDLFLKKLIHTMKITYTHRKFVLKGNTNGFIFADKDSIEQVLINFITNAIKYSEDNKKIEIIVYDDDKSVTFGVRDFGKGIPAKFRKKIFNPFYRINHSSKGKSGMGIGLFIAGTIIKAHEGKIWG

SEQ ID NO: 2755 - DNA, 321 bp, Unknown
  Obtained from environmental sample
  misc_feature (1)..(321): n is a, c, g, or t
ttggagtcagagatttcgggaaaggcatacctgcaaaattccggaaaaaaatatttaaccccttttaccggattaatcattcatcaaaaggcaaaagcggaatgggtatcggcttatttattgccggtaccatcattaaagctcacgaaggaaaaatctggggttgactcggtagatggaaaaggcagtacatttaatttcagtctccccatcagcaaaagctataaaggtgcacaattatccgaaaatcagatcagtttttattcgttatacatgactggctatattgttaaccgattaatgatctgcatcaataattaa

SEQ ID NO: 2756 - protein, 106 aa, Unknown
  Obtained from environmental sample
  misc_feature (1)..(106): Xaa is any amino acid
MESEISGKAYLQNSGKKYLTPFTGLIIHQKAKAEWVSAYLLPVPSLKLTKEKSGVDSVDGKGSTFNFSLPISKSYKGAQLSENQISFYSLYMTGYIVNRLMICINN

SEQ ID NO: 2757 - DNA, 675 bp, Unknown
  Obtained from environmental sample
  misc_feature (1)..(675): n is a, c, g, or t
atgagacttacaagtttagagattaaaggattcaagagttttggcgaaaaagtagccatccattttgataagggagtaacatccattgtcggcccaaatggcagcggcaaatcgaatgtggtagacgcaatcaggtgggttctgggcgagcaaaaaacacgtatgctgcgttcggaaaaaatggaaaatataattttcaacggaaacaagaatcgtaagccggctaacctggctgaggtctctctttcttttgagaacacaaagaatattcttccgacagaatacagcaatgttaccataacacgcaggctttacaggtccggtgaaagtgaatacctgctgaataatgttccatgcaggctgaaagacattgtcgatcttttcctggatacaggtattggtcctgatagttatgctatcatcgaattgaagatggtagatgaaattctgaacgataaaaataatgcgatcaaacttcttctcgaggacgcagcaggaatttcaaaatatcaaattcgtaagaagcagacacttcaaaagctggaggaccctgcgaaagatctgaaccgggttgatgatctgctgttccagaatccaacgaatatgaaacaggtcgaatctcagcgcaagaagactgagagatattcaaactgtaagaaccatataaggagttag

SEQ ID NO: 2758 - protein, 224 aa, Unknown
  Obtained from environmental sample
  DOMAIN (1)...(167): RecF/RecN/SMC N terminal domain
  misc_feature (1)..(224): Xaa is any amino acid
MRLTSLEIKGFKSFGEKVAIHFDKGVTSIVGPNGSGKSNVVDAIRWVLGEQKTRMLRSEKMENIIFNGNKNRKPANLAEVSLSFENTKNILPTEYSNVTITRRLYRSGESEYLLNNVPCRLKDIVDLFLDTGIGPDSYAIIELKMVDEILNDKNNAIKLLLEDAAGISKYQIRKKQTLQKLEDPAKDLNRVDDLLFQNPTNMKQVESQRKKTERYSNCKNHIRS

SEQ ID NO: 2759 - DNA, 525 bp, Unknown
  Obtained from environmental sample
  misc_feature (1)..(525): n is a, c, g, or t
atgaaaaaattcctttttacattatctgtaattattttaagttatctactaagttttatattgtttctaacagtaatggttcctggatataataatacagattttaaaaatataaatgctgatgcaatagtggttttaacaggggctaatggaagaattcaaaaaggaattgagttactttcagaaaataaagcaaaaaagcttttgattacgggcgttggacaaaaaactaatcttaaagatatagaatatattaatgaagaatttcctattaattatgtacaaaatttgaaatatcgaatcactttaggttatgaggctagtaatactaagggtaatgctaaggaagctaccgattggcttcaaaataataattttaacaaaattattcttgtgacatctgactatcatatgccacgcagtattctggaatttaccatgatttcacctgatgtagatataattgcttgtgctgttgatacaaattatttatccttcaaagataattggaaaatgctgtattaa

SEQ ID NO: 2760 - protein, 174 aa, Unknown
  Obtained from environmental sample
  DOMAIN (39)...(168): DUF218 domain
  misc_feature (1)..(174): Xaa is any amino acid
MKKFLFTLSVIILSYLLSFILFLTVMVPGYNNTDFKNINADAIVVLTGANGRIQKGIELLSENKAKKLLITGVGQKTNLKDIEYINEEFPINYVQNLKYRITLGYEASNTKGNAKEATDWLQNNNFNKIILVTSDYHMPRSILEFTMISPDVDIIACAVDTNYLSFKDNWKMLY

SEQ ID NO: 2761 - DNA, 417 bp, Unknown
  Obtained from environmental sample
  misc_feature (1)..(417): n is a, c, g, or t
atgaaaaaaattcacatcgtttttttgatactgatcgttgcagctcttgccgggatgtcattctttataaaagacctgaccacttacgaaacatttaattcggcacagcaaaaaaccaacaagtttgtagtggtaaaagtaaagctggataaaacaacacctattgaatatgaccaggtgaaaaacccaaaccttaccacattttatgctgttgaccataatggcaataaaagtaaagtgatatacaaaaacgccaaaccaaccgatatagaaaaaagcgaaggcattgacctcaatggttatatgcgtgatggctatttcgagtgtacaaaattgcaaatgaaatgcccatctaaatacaaggataatatgcagcaggcagaaaagaatttatctgccaccaccaacgaaaaataa

SEQ ID NO: 2762 - protein, 138 aa, Unknown
  Obtained from environmental sample
  SIGNAL (1)...(17)
  misc_feature (1)..(138): Xaa is any amino acid
MKKIHIVFLILIVAALAGMSFFIKDLTTYETFNSAQQKTNKFVVVKVKLDKTTPIEYDQVKNPNLTTFYAVDHNGNKSKVIYKNAKPTDIEKSEGIDLNGYMRDGYFECTKLQMKCPSKYKDNMQQAEKNLSATTNEK

SEQ ID NO: 2763 - DNA, 789 bp, Unknown
  Obtained from environmental sample
  misc_feature (1)..(789): n is a, c, g, or t
atgcatttcagtaaaacacttgatggatatattaccagctggaacccggctgctgagcggatgtatggttattcagccaaagagatgattggtaaacatattagtatcattgttcctttagaattacggaaagatcttaagggtattttctctaagttaagaaagggtattcctattgagaattatgagacgattcgagttcgtaaagatgggatgcatttaaatgtatccatatcaatttcaccgatcaaaaataaagaaggtaaaatccttggtgcatcagtgattgcacgagatataagtgagcggaaacaagcatctgtcgatgaacaatttatggctcaggcgagtataatacttgcttcatcgcttgattacaataaaacattggaatctattgcaaaactagctgtgcctaatttagctgattggtgtggtattgatctccttaatgaaaatggagagattaatcaggtggttgttgcgcatgtagatccaaagaaagttgagtgggcaagggaactacgtaaaaaaaccccggttgatcttaatcaggacacaggaattgcaaaagttttaaaaacagggaagtcagaattttacccatatattagtgatgaggtcataaagatgactaattctgatccaaaacagctaaagcttattaaaagattaggattacgttctgcaattattgtacctcttattataagaaataagccgattggcacgatcacttttatttcgaccaatgaagcgaatctctataatgaaagaaggctgcattag

SEQ ID NO: 2764 - protein, 262 aa, Unknown
  Obtained from environmental sample
  DOMAIN (61)...(103): PAC motif
  misc_feature (1)..(262): Xaa is any amino acid
MHFSKTLDGYITSWNPAAERMYGYSAKEMIGKHISIIVPLELRKDLKGIFSKLRKGIPIENYETIRVRKDGMHLNVSISISPIKNKEGKILGASVIARDISERKQASVDEQFMAQASIILASSLDYNKTLESIAKLAVPNLADWCGIDLLNENGEINQVVVAHVDPKKVEWARELRKKTPVDLNQDTGIAKVLKTGKSEFYPYISDEVIKMTNSDPKQLKLIKRLGLRSAIIVPLIIRNKPIGTITFISTNEANLYNERRLH

SEQ ID NO: 2765 - DNA, 342 bp, Unknown
  Obtained from environmental sample
  misc_feature (1)..(342): n is a, c, g, or t
gtggatcaagaatgcacgcanccgatgtctgatgtgacacgacttaaaaattcttttctctatcgttgttgtgaaaaaggaatcattgctcaggacgaattaaggcttggaataaatgcagatcataaaacttttcaggttattgataagaataacaaaaaacacaaacatctttttgtgatgggcacaaacctgagagggatactttgggaatcaacggcagttaatgaattgagatctcaggccgaagggctgactgattatattacctcgatcatcagaaaacccgatttaccaataggtatttcaaaaaataaatctcataatcatagcagtaattaa

SEQ ID NO: 2766 - protein, 113 aa, Unknown
  Obtained from environmental sample
  misc_feature (1)..(113): Xaa is any amino acid
MDQECTXPMSDVTRLKNSFLYRCCEKGIIAQDELRLGINADHKTFQVIDKNNKKHKHLFVMGTNLRGILWESTAVNELRSQAEGLTDYITSIIRKPDLPIGISKNKSHNHSSN

SEQ ID NO: 2767 - DNA, 321 bp, Unknown
  Obtained from environmental sample
  misc_feature (1)..(321): n is a, c, g, or t
atgaaatatatctgcaagttcctggccttctatgaaagtaaaaaaagggtgtggatcaatgacggaatgagtatcccggaatggtttgttttgctggctctttatcacgggaatgaaatggccggctcccctcttcataaggaagtatttaaaaaagctccagtatgtagcccaggaagaataaaattagcatttggttcattgcaaaggctggggtatatcgataaaattggaagattccgttacgcgaaatttaggatcactccacttggaaccgatgaggtaaacaggattttaatgaaatatgccttaaattgttga

SEQ ID NO: 2768 - protein, 106 aa, Unknown
  Obtained from environmental sample
  misc_feature (1)..(106): Xaa is any amino acid
MKYICKFLAFYESKKRVWINDGMSIPEWFVLLALYHGNEMAGSPLHKEVFKKAPVCSPGRIKLAFGSLQRLGYIDKIGRFRYAKFRITPLGTDEVNRILMKYALNC

SEQ ID NO: 2769 - DNA, 1017 bp, Unknown
  Obtained from environmental sample
  misc_feature (1)..(1017): n is a, c, g, or t
atgaaatccttaacgataaaattcctgcttctttttctgctcattgaatcgtattccttcgcacaggatcgcaccactggaagaacatttacctcaagatctgaagtaatgggtgtcaaaggaatgatcgcttctagtcatcctctcgtgagtcaggttgggcttacaattcttcaaaaaggaggaaatgctattgatgcggctatcgcagctaatgctcttcaaggtttcgttgatcccagtatgaatggcatcggaggtgatttgtttgctataatatggcatgccaaaaccaacaaactttacggactaaacgccagtggacgatcgccggaattattaacgcttgaatattttcaggataaggacttgaccaggattccaaggtatggagccctatcagtatcagtacctggctgcgtcgatggttggtttgagatgaataaaaaatttggaaaaatgaagatggaggaactactggcccctgccataaattatgcacgggatggatttcccctagctgaagaagctgcaaatacattagcccgccttaagcccgaatcacttccttcctcaaattttaaaaaactttacttccctaagaaccgtgttataggcaaaggagaaatatttaagaatccggatttggcaaactctctttctttaatcagcaaaaaaggaagggagggtttttataacggagaggtggccaaaagcatcgaagctcatataaaaaaaaaggtggatttctttctgtcagtgatctggcaaatcacaaatccgaatgggtggaaccggtctcaacgaattacagaagttatgatgttttggaactacccccccacggacaaggtattttcgggctgcaaaattcttaaggtcctggaaggttttaattttaaaaaaatttggcttatgaaacccctaaacacattcactcactttgaaaaaggccaaaaccccttgggttttgaaaaaaattggggtttgtacctatgggggaaccctggcctttaa

SEQ ID NO: 2770 - protein, 338 aa, Unknown
  Obtained from environmental sample
  DOMAIN (55)...(337): Gamma-glutamyltranspeptidase
  misc_feature (1)..(338): Xaa is any amino acid
MKSLTIKFLLLFLLIESYSFAQDRTTGRTFTSRSEVMGVKGMIASSHPLVSQVGLTILQKGGNAIDAAIAANALQGFVDPSMNGIGGDLFAIIWHAKTNKLYGLNASGRSPELLTLEYFQDKDLTRIPRYGALSVSVPGCVDGWFEMNKKFGKMKMEELLAPAINYARDGFPLAEEAANTLARLKPESLPSSNFKKLYFPKNRVIGKGEIFKNPDLANSLSLISKKGREGFYNGEVAKSIEAHIKKKVDFFLSVIWQITNPNGWNRSQRITEVMMFWNYPPTDKVFSGCKILKVLEGFNFKKIWLMKPLNTFTHFEKGQNPLGFEKNWGLYLWGNPGL

SEQ ID NO: 2771 - DNA, 666 bp, Unknown
  Obtained from environmental sample
  misc_feature (1)..(666): n is a, c, g, or t
ttgatttataaaatgcttgccatgaacaaaaaattctttacactggccattcttttttttatagtaagcaacagtactattaaggcccaatcaaaattagatagtgtgttgcctatccgtggattttctattggtagcccctcgccggaagatcttgattcctttgttattttcatcaataaggaacttgcgccgcgtaaaatcaatacacttctattgagagttgattataattatcaatacaaatcacatccagagttggtcaatagttctgccttgtcaacagcccaggtaaaggaaattgtaaaagcctgcaaacaaaaaaacatacgcattattccgcaaattaatttgctggggcaccagtcgtgggcagagaagttagggaagcttttagaagtatatccgcagtttgatgaaacgcctcatataaaaatgccggaaaaatatgtgtggcctaacgctgataatctttattgcaaaagttattgtccgttacatcccgatgtacacaaagtagtatttgaccttgtagatgaagtgtgtgatgtatttgagacagatgcatttcatgcaggtatggacgaagtgttttatttaggcgatgataaatgcccacgctgtggcggaagggataaggcagaaactttttgcgggagaaagtaa

SEQ ID NO: 2772 - protein, 221 aa, Unknown
  Obtained from environmental sample
  misc_feature (1)..(221): Xaa is any amino acid
MIYKMLAMNKKFFTLAILFFIVSNSTIKAQSKLDSVLPIRGFSIGSPSPEDLDSFVIFINKELAPRKINTLLLRVDYNYQYKSHPELVNSSALSTAQVKEIVKACKQKNIRIIPQINLLGHQSWAEKLGKLLEVYPQFDETPHIKMPEKYVWPNADNLYCKSYCPLHPDVHKVVFDLVDEVCDVFETDAFHAGMDEVFYLGDDKCPRCGGRDKAETFCGRK

SEQ ID NO: 2773 - DNA, 450 bp, Unknown; identical to SEQ ID NO: 985
  Obtained from environmental sample
  misc_feature (1)..(450): n is a, c, g, or t

SEQ ID NO: 2774 - protein, 149 aa, Unknown; identical to SEQ ID NO: 986
  Obtained from environmental sample
  misc_feature (1)..(149): Xaa is any amino acid

SEQ ID NO: 2775 - DNA, 408 bp, Unknown
  Obtained from environmental sample
  misc_feature (1)..(408): n is a, c, g, or t
atgattaatctcaatcttccctcatacaactataaaataaaaaaagaggatgataaaatctggatcttcgacgtgcttcgcaaaaagtacgttgtgttgacaccggaagaatgggtgcgtcaacactttgtcaattacatgatggaggaactttcgtatccgaaggcgctgatcaaactggagggtggcctcacgtataatcagcttgcgaaaagatctgacattgtcgtatttgatcgggaaggaaaaccgtggatgatcatcgaatgcaaagcggcagattgtgctctttctccggctacgcttaggcaggcttcggtttacaatgctacgctgaaggcaaagtacctggttgtaacaaacggacgtgtctcatttctatttcgaaacagactgggatgccggtaa

SEQ ID NO: 2776 - protein, 135 aa, Unknown
  Obtained from environmental sample
  misc_feature (1)..(135): Xaa is any amino acid
MINLNLPSYNYKIKKEDDKIWIFDVLRKKYVVLTPEEWVRQHFVNYMMEELSYPKALIKLEGGLTYNQLAKRSDIVVFDREGKPWMIIECKAADCALSPATLRQASVYNATLKAKYLVVTNGRVSFLFRNRLGCR

SEQ ID NO: 2777 - DNA, 609 bp, Unknown
  Obtained from environmental sample
  misc_feature (1)..(609): n is a, c, g, or t
atgtcagataaattaaaaaggaatttaattaaagtaagtgatgagatattcaattttttaatgaagtatagggatactcatcctgattttacgtttgctttaagaaagcgagatagttcagcttcagaagaaaagcgattggaaaatggccaatggtttcagggctctgactatatttttgttccactatttaaaagaggtgacaaggatagaaaaataaaaaccataggatttgtaattaatttcgatgatgatgggaatataaatcgcaatgctatcgcaatctcattcaaaggcggtgtatttacggatccagaaataaattttcatagagaactggcaaaggcagcaagtgttgagttaaatgaaagcaattttggccacaaagattttatcagttcagaaaactatataaaaaacctgcaggcgtttcttgataatctaaggccagttgccctgaatttactttctaaatataaaattgctgatgattatatagttcctattgatgaatttgaaaaacgagttcaggttgttaatgaaatcagaagtggcaagaaaatagacaaaaaaacccaatctgagatgcctacaataatcccttattaa

SEQ ID NO: 2778 - protein, 202 aa, Unknown
  Obtained from environmental sample
  misc_feature (1)..(202): Xaa is any amino acid
MSDKLKRNLIKVSDEIFNFLMKYRDTHPDFTFALRKRDSSASEEKRLENGQWFQGSDYIFVPLFKRGDKDRKIKTIGFVINFDDDGNINRNAIAISFKGGVFTDPEINFHRELAKAASVELNESNFGHKDFISSENYIKNLQAFLDNLRPVALNLLSKYKIADDYIVPIDEFEKRVQVVNEIRSGKKIDKKTQSEMPTIIPY

SEQ ID NO: 2779 - DNA, 663 bp, Unknown
  Obtained from environmental sample
  misc_feature (1)..(663): n is a, c, g, or t
atgtcagataaattaaaaaggaatttaattaaagtaagtgatgagatattcaattttttaatgaagtatagggatactcatcctgattttacgtttgctttaagaaagcgagatagttcagcttcagaagaaaagcgattggaaaatggccaatggtttcagggctctgactatatttttgttccactatttaaaagaggtgacaaggatagaaaaataaaaaccataggatttgtaattaatttcgatgatgatgggaatataaatcgcaatgctatcgcaatctcattcaaaggcggtgtatttacggatccagaaataaattttcatagagaactggcaaaggcagcaagtgttgagttaaatgaaagcaattttggccacaaagattttatcagttcagaaaactatataaaaaacctgcaggcgtttcttgataatctaaggccagttgccctgaatttactttctaaatataaaattgctgatgattatatagttcctattgatgaatttgaaaaacgagttcaggttgttaatgaaatcagaagtggcaagaaaatagacaaaaaaaccaaatctgagatgcctaacaataatccttatttaaacccagatattatttggtcctcgcgggtactggtaaaacttttaatacaataa

SEQ ID NO: 2780 - protein, 220 aa, Unknown
  Obtained from environmental sample
  misc_feature (1)..(220): Xaa is any amino acid
MSDKLKRNLIKVSDEIFNFLMKYRDTHPDFTFALRKRDSSASEEKRLENGQWFQGSDYIFVPLFKRGDKDRKIKTIGFVINFDDDGNINRNAIAISFKGGVFTDPEINFHRELAKAASVELNESNFGHKDFISSENYIKNLQAFLDNLRPVALNLLSKYKIADDYIVPIDEFEKRVQVVNEIRSGKKIDKKTKSEMPNNNPYLNPDIIWSSRVLVKLLIQ

SEQ ID NO: 2781 - DNA, 384 bp, Unknown
  Obtained from environmental sample
  misc_feature (1)..(384): n is a, c, g, or t
atgccaaaagcaaacataaggcagcccgctatcctctggttcaatgaaaaatatccagaagtaacagaacacataatcacttcaaaattttattcatcatcagaatcatggagcaaatcccgtgtctggttttttcaaattcctcaaaatctcatagaaccctctaaaatcaaatacattcacttactatgtcaaaaccatttgagtggagaaccatttatctacttaaaggttcccaccttgtttctattgaaaaatgaaagaagctttgaaatagacaggaaaactaaaatgatgcgaatttatttatccgctgaagccgcggacatgttcctggagatccgaaaaggtagtaagctcgatttcaaaatttatattcagtaa

SEQ ID NO: 2782 - protein, 127 aa, Unknown
  Obtained from environmental sample
  misc_feature (1)..(127): Xaa is any amino acid
MPKANIRQPAILWFNEKYPEVTEHIITSKFYSSSESWSKSRVWFFQIPQNLIEPSKIKYIHLLCQNHLSGEPFIYLKVPTLFLLKNERSFEIDRKTKMMRIYLSAEAADMFLEIRKGSKLDFKIYIQ

SEQ ID NO: 2783 - DNA, 675 bp, Unknown
  Obtained from environmental sample
  misc_feature (1)..(675): n is a, c, g, or t
atgagtaaaagcgtaagggaaaaagggggcaatgacccatttatgttaggagtagatactcctgcaaaaaaaaatggaacgccaaaaattgaaaagactacagaacagcagtccgatcccttcatgcttggccttgaagtaaaaaaaaaagaaactacttcgcaagagcctgttattacttcagagcaagatgttacagtttcgcaagatggtacagaagatattcccccctcatcatcaccattaaaatcggagccgaaagagacgaataaaaaaagatatgccagaatagaagaagccgatgccaaagcattggctgatgattataaggacaaactatctgagattgatgtacaaaattcactctctccattcaatatagttggtaatgccagaaaaagaaatgatttcctgcaatccagagaagggaagataggaaagattatttcagatattaacgatggtaaattcaacaaggaagatattaattaccttgtcagagttgcccccgcagcaggtaaagaaattatttctactgtacttccagactctccccctcaaaacgttatatcaactgacaatatcaacaggtttatagatcaaggtaaaaaatttgtcgatcagcagctaacgcaggcaaaggttaactacttcaaaaaggtaaaaaatcagtaa

SEQ ID NO: 2784 - protein, 224 aa, Unknown
  Obtained from environmental sample
  misc_feature (1)..(224): Xaa is any amino acid
MSKSVREKGGNDPFMLGVDTPAKKNGTPKIEKTTEQQSDPFMLGLEVKKKETTSQEPVITSEQDVTVSQDGTEDIPPSSSPLKSEPKETNKKRYARIEEADAKALADDYKDKLSEIDVQNSLSPFNIVGNARKRNDFLQSREGKIGKIISDINDGKFNKEDINYLVRVAPAAGKEIISTVLPDSPPQNVISTDNINRFIDQGKKFVDQQLTQAKVNYFKKVKNQ

SEQ ID NO: 2785 - DNA, 333 bp, Unknown
  Obtained from environmental sample
  misc_feature (1)..(333): n is a, c, g, or t
ttgcgccggttatttatgattaaattttctgccacactattaaaatttgcagagcaaggtgaaaaaacagggtggacatatattgaagtacctgctgaaatagcccaaaaactcaagtctaacaataaaaagtcttttagagtaaaaggctatttggatgactattattttgaaggaaaggcacttcttcctatgggcgaagggaatttcattatggcattaaagacagaaataagaaaagcagttggtaagcgaaagggcgcaactgtcggtgtgatctgtgataataatgatttagtctctcaacatggaactattactcttttgcggtaa

SEQ ID NO: 2786 - protein, 110 aa, Unknown
  Obtained from environmental sample
  misc_feature (1)..(110): Xaa is any amino acid
MRRLFMIKFSATLLKFAEQGEKTGWTYIEVPAEIAQKLKSNNKKSFRVKGYLDDYYFEGKALLPMGEGNFIMALKTEIRKAVGKRKGATVGVICDNNDLVSQHGTITLLR

SEQ ID NO: 2787 - DNA, 351 bp, Unknown
  Obtained from environmental sample
  misc_feature (1)..(351): n is a, c, g, or t
atgaataaaactaaactttctgtaaatatcaataagcttgcgacgctgcgtaattcaagaggtggtaataatcccgatattattaaatccgcaaaagacattgaacgctttggagcggatggaattaccgtacatcccagacctgatgaaagacacattcgttatgcggatgtttatgagctgaaaaaagtagtcaccactgaatttaatattgaaggcaaatccaaagaaaaaaaatttgtagacctcgtgttagccaaacaagccactcaggtaacgctggtgcctgatgcaaaagggcaactaactttcaatcatggatggaataccattaaaaccaaaattatttga

SEQ ID NO: 2788 - protein, 116 aa, Unknown
  Obtained from environmental sample
  DOMAIN (4)...(115): Pyridoxal phosphate biosynthesis protein PdxJ
  misc_feature (1)..(116): Xaa is any amino acid
MNKTKLSVNINKLATLRNSRGGNNPDIIKSAKDIERFGADGITVHPRPDERHIRYADVYELKKVVTTEFNIEGKSKEKKFVDLVLAKQATQVTLVPDAKGQLTFNHGWNTIKTKII

SEQ ID NO: 2789 - DNA, 486 bp, Unknown
  Obtained from environmental sample
  misc_feature (1)..(486): n is a, c, g, or t
atgggttatcttaaccccgttatgcaatatggctttgagaaattttgcagagaggcaaaaaatgtaggcgtagatggaatcattcttcccgatctgcctatatatgaatttgaaacagagtacaaaaaaatcctccgggaaaatgaactggattttattttccttatcactcctgaaacatctgaagaaaggataaaaaaaatcgatgaattgacaaccgggtttatttatgcagtgtcatcgtcttctacaaccggaaaagatacaaatctaagtctccggcaaaattattttcaaaagcttcaacaactaaaattaagaaacccggtgctggttggctttggtataaaagacaaacagacatttaattttgcctgtgaattcgccaatggcgcaattatcgggagtgcatttattaaagccctgcaaaacagtactgatataaacgctgcaacggaaacgtttcttaacaaaattttaaaatag

SEQ ID NO: 2790 - protein, 161 aa, Unknown
  Obtained from environmental sample
  DOMAIN (1)...(161): Tryptophan synthase alpha chain
  misc_feature (1)..(161): Xaa is any amino acid
MGYLNPVMQYGFEKFCREAKNVGVDGIILPDLPIYEFETEYKKILRENELDFIFLITPETSEERIKKIDELTTGFIYAVSSSSTTGKDTNLSLRQNYFQKLQQLKLRNPVLVGFGIKDKQTFNFACEFANGAIIGSAFIKALQNSTDINAATETFLNKILK

SEQ ID NO: 2791 - DNA, 357 bp, Unknown
  Obtained from environmental sample
  misc_feature (1)..(357): n is a, c, g, or t
atgctggttgaaaagtttgatcccgaaagaatcatcagtgcaatttatttggataatgacaagcttcagtacaatgtgaaacgtttcaaaattgagaccacaacacttcgcactaaattccttttcatcaaagaggggaaaggaaatatcttggaggcagtgtcaaccgaagaagagccaattcttattgtgaattcaggtaaaggctcgcaagtaagaaaggcgaaatttaagattgccaggatggttgatgtaatgggttggaaagctgtgggagcaaagctgatcgattttaataagagcattatgatggagtgggaagtgaaagagcaagcaaaacagcctgagttgttttga

SEQ ID NO: 2792 - protein, 118 aa, Unknown
  Obtained from environmental sample
  misc_feature (1)..(118): Xaa is any amino acid
MLVEKFDPERIISAIYLDNDKLQYNVKRFKIETTTLRTKFLFIKEGKGNILEAVSTEEEPILIVNSGKGSQVRKAKFKIARMVDVMGWKAVGAKLIDFNKSIMMEWEVKEQAKQPELF

SEQ ID NO: 2793 - DNA, 309 bp, Unknown
  Obtained from environmental sample
  misc_feature (1)..(309): n is a, c, g, or t
gtgctcatgcaacaattctgggtcaagatacgggagaattttgctaagcataaattcaaaggcttggatattgggtggatggcggaagttccctacaaacagaatgcctcggcgctggtgaaatggaatctgcgaaactggaagctcttccataagtgggaggtaatgcgccttttggacattgagaaaatcgtttacaagcgccttttccttttcagataccgcaagaacagcatctgcctcatgataaatgttgagttctctgcgatattcctgagcatcagtatcgctcaatccgccttcatttag

SEQ ID NO: 2794 - protein, 102 aa, Unknown
  Obtained from environmental sample
  misc_feature (1)..(102): Xaa is any amino acid
MLMQQFWVKIRENFAKHKFKGLDIGWMAEVPYKQNASALVKWNLRNWKLFHKWEVMRLLDIEKIVYKRLFLFRYRKNSICLMINVEFSAIFLSISIAQSAFI

SEQ ID NO: 2795 - DNA, 1122 bp, Unknown
  Obtained from environmental sample
  misc_feature (1)..(1122): n is a, c, g, or t
gtgacagcagaatatcccggcactaacggagagctaatgaccaaagcagtattgattcccctcgaaagagccatcaatggaattccgggaatgaaatacatggcttccgatgcaggtaacgatggagaagccagtatacaggttgtatttaacttgggaacagatcccaaccttgctgcagtaaacgttcaaaaccgtgtggcatcagtggttaataaattgccgccactcgtagtgcgtgaaggtgtaaaaattacccgtgaggaatcgaacatgcttatgtacatcaacttgtacagcaacgatccaaacatggatcaaaaattccttttcaattttgcggacattaatattttatccgaattaaaaagagtaaatggagttggtgttgcagacattttgggtaatcgtgaatatgccatgcgcatatggttgaagcctgacaggatgctggcgtataaaatttcagcagaagaaataatgaaagcacttgacgaacaaagtcttgaagcatcgccaggtaaaactggtgaaagctctggaaaacgttcgcaggcttttgagtatgttttaaaatattccggtcgctttagcaacaaggaggaatatgaaaacatcattttaaaatcaagcgccaatggagaaatattaaggctgaaaaacgtagccgatatagaatttggcagctctatgtatgatatctattcaacgctgaatggaaaaccttctgccgccattgttctaaaacaatcttatggcagtaatgccacacaggttattgaagatgtgaaggccaagttgaaagagattaaggctaatatatttccaaaaggattagattatgagatcagttatgatgtatcgaagtttctcgatgcatcaattggaaaagtgattcaccacgttggtaaaaccctttctacttgtaggactagtagtattttctttttctcggtgatgggcggtctactcttattcctgccaaaaaccgggcctgttctcgtgaaccggaaaattttggttcctgcaaattttttggaaaaaatccaaaccccctccccattaatttcccttggaaccgggccaaccggaattgtttgcccaataaccccattttttgaa

SEQ ID NO: 2796 - protein, 374 aa, Unknown
  Obtained from environmental sample
  misc_feature (1)..(374): Xaa is any amino acid
MTAEYPGTNGELMTKAVLIPLERAINGIPGMKYMASDAGNDGEASIQVVFNLGTDPNLAAVNVQNRVASVVNKLPPLVVREGVKITREESNMLMYINLYSNDPNMDQKFLFNFADINILSELKRVNGVGVADILGNREYAMRIWLKPDRMLAYKISAEEIMKALDEQSLEASPGKTGESSGKRSQAFEYVLKYSGRFSNKEEYENIILKSSANGEILRLKNVADIEFGSSMYDIYSTLNGKPSAAIVLKQSYGSNATQVIEDVKAKLKEIKANIFPKGLDYEISYDVSKFLDASIGKVIHHVGKTLSTCRTSSIFFFSVMGGLLLFLPKTGPVLVNRKILVPANFLEKIQTPSPLISLGTGPTGIVCPITPFFE

SEQ ID NO: 2797 - DNA, 324 bp, Unknown
  Obtained from environmental sample
  misc_feature (1)..(324): n is a, c, g, or t
atgttcttaaaaaaagacaacctccaacttggtctcatccttggtcttgtaggaccactactgggactggccattatctattttgcaagattctcctcctatacatttggggaattcctggaagagtttttcagcaataacaggctgatcacttcgatcggtacacttgctcttcttgccaatgctgtactctttgccatctatgtcaatgccaataagtacaaaacttttaaaggaatcttttttgtcaccccttatttatggtatcgcaatcctggtactaaaaaacacaaactaaaaaagtctgtggtttatccgttatag

SEQ ID NO: 2798 - protein, 107 aa, Unknown
  Obtained from environmental sample
  misc_feature (1)..(107): Xaa is any amino acid
MFLKKDNLQLGLILGLVGPLLGLAIIYFARFSSYTFGEFLEEFFSNNRLITSIGTLALLANAVLFAIYVNANKYKTFKGIFFVTPYLWYRNPGTKKHKLKKSVVYPL

SEQ ID NO: 2799 - DNA, 570 bp, Unknown
  Obtained from environmental sample
  misc_feature (1)..(570): n is a, c, g, or t
gtggttatgaaaaaaggtgacagagcagcgcgattatttgccttaggacttaattcggatttaattgataaaattttttcagctaattattctataacgaaacttaaaacggcaagaaaaagagatttagaagaattttttactacagaagaaattgacctaatcgcaaattcgttacaacgaaatcccattccagaagaaacattgctacgactaattcaagattgcgactcgaagtgttgcatgtgttgggattataagaaagaatctcctgtcataattcaccatattattgaacattcaaaaactcatgacgatagctatgaaaatctagttgttctatgtctcgaccatcatgcaaaggcccatagtcgttgggaaatctcaagatccccttactctcctgatgtgatcaaacaaaaaaagctggattggataaaagcaatagccgaattcaaagcaggtcgtagaccgccaccaagtagtgaaccacttcaagccgctaccattataaacaatctccccccaggtccaaaactattcgttggtcgtaaagagtatatgagataa

SEQ ID NO: 2800 - protein, 189 aa, Unknown
  Obtained from environmental sample
  DOMAIN (78)...(126): HNH endonuclease
  misc_feature (1)..(189): Xaa is any amino acid
MVMKKGDRAARLFALGLNSDLIDKIFSANYSITKLKTARKRDLEEFFTTEEIDLIANSLQRNPIPEETLLRLIQDCDSKCCMCWDYKKESPVIIHHIIEHSKTHDDSYENLVVLCLDHHAKAHSRWEISRSPYSPDVIKQKKLDWIKAIAEFKAGRRPPPSSEPLQAATIINNLPPGPKLFVGRKEYMR

SEQ ID NO: 2801 - DNA, 396 bp, Unknown; identical to SEQ ID NO: 2437
  Obtained from environmental sample
  misc_feature (1)..(396): n is a, c, g, or t

SEQ ID NO: 2802 - protein, 131 aa, Unknown; identical to SEQ ID NO: 2438
  Obtained from environmental sample
  misc_feature (1)..(131): Xaa is any amino acid

SEQ ID NO: 2803 - DNA, 621 bp, Unknown
  Obtained from environmental sample
  misc_feature (1)..(621): n is a, c, g, or t
atggagctagacggtatcaagttggataaggaatcttggctggcagtggaagctactgctaaagagaaacgagaagaattgttcatcaagttcaaagacgaactagtagaattcctagtaaagcagaaagtacctaatgctttggagttgtgtaagaaagcctgtattcctgtaaagacaaagaaactatccaagttccttgaagagattacagacttatctaatcttaggggctggcttacggagaacttcaatgtcaaatctcctaagcaaatgcacacaacattcaatttgatgggcataaaggtaaaagatactaatagaaagacactagaagagtatgtaaagaaatcaaaaaaagagattccaatcatcagtttgttgttggaaatcagagggtacgataagcaaatagatacttatggaagcaacgttctggatttcataaagcccttaaccggaaaaatacacacagaatatagtactgttggaactgctacagttcgcttctcttcaaaaaatcctaacatgcagaatgttccaagagacggaggctacagagaaagttttatagcggacgaagattactacatagttcccattgactactcccaacagtga

SEQ ID NO: 2804 - protein, 206 aa, Unknown
  Obtained from environmental sample
  misc_feature (1)..(206): Xaa is any amino acid
MELDGIKLDKESWLAVEATAKEKREELFIKFKDELVEFLVKQKVPNALELCKKACIPVKTKKLSKFLEEITDLSNLRGWLTENFNVKSPKQMHTTFNLMGIKVKDTNRKTLEEYVKKSKKEIPIISLLLEIRGYDKQIDTYGSNVLDFIKPLTGKIHTEYSTVGTATVRFSSKNPNMQNVPRDGGYRESFIADEDYYIVPIDYSQQ

SEQ ID NO: 2805 - DNA, 852 bp, Unknown
  Obtained from environmental sample
  misc_feature (1)..(852): n is a, c, g, or t
ttgaaagcaaatacaccttctttaagctatgacttcattacggatatccacctctcatcagctaatgaactttggatttcgacagaagatggcttgaacaggcttgttgttaccgacaagccgggagcggaacgctatacttttgaaaattatagctatgaagaagatgcatccaacaaagcccttcataattacatctaccagattgaagaattggtagtaaagggaaagccttcgatctggctcagcaccaagaagggcctcaaaggattgttgaataataaacttcagaatttccttgtccccgataaatcgctcagtcattcgttcttccgcagcctgcttgcggtagatggcgagaactcatacctcattgcaggatcggagatgggactatccttgttcgatccggaaacacaacgctttgaaacggtcgcctacgatgactatcgcgaaatgaatattagccaccgaacgattaccgcattgtacattgatgaaggcggtgtgttgtgggtcggcacaaaaaaaggattgaacaaatttgacacctattcaaaggactttgaagcattccggacgacacagttcgataaatcaaagaacatcatcacaggggtacaaaattcttctctcggaggttattggatatcaaccattggtggtggacttttcaaattcgatggaaaagattctttcacacactataaaatcatcagccgggaagagaatgacttcaccgaatttattcaaaccctgtactccgataacaaaggaatatctgggtggtacggcaggtgcagtgtctatcatttcaatgaaaaggatataacgaagccggaacattcttga

SEQ ID NO: 2806 - protein, 283 aa, Unknown
  Obtained from environmental sample
  misc_feature (1)..(283): Xaa is any amino acid
MKANTPSLSYDFITDIHLSSANELWISTEDGLNRLVVTDKPGAERYTFENYSYEEDASNKALHNYIYQIEELVVKGKPSIWLSTKKGLKGLLNNKLQNFLVPDKSLSHSFFRSLLAVDGENSYLIAGSEMGLSLFDPETQRFETVAYDDYREMNISHRTITALYIDEGGVLWVGTKKGLNKFDTYSKDFEAFRTTQFDKSKNIITGVQNSSLGGYWISTIGGGLFKFDGKDSFTHYKIISREENDFTEFIQTLYSDNKGISGWYGRCSVYHFNEKDITKPEHS

SEQ ID NO: 2807 - DNA, 546 bp, Unknown
  Obtained from environmental sample
  misc_feature (1)..(546): n is a, c, g, or t
atgcgcattccttttaaacccggtgaatatctggcattagttgaaactgaatttggctaccatataatcaagctgaatgataaaaccggtgatttcatcacctgccagcatatactggttaaattccccaggcttgaagccgccgatttcacggagataaatttccttaaggatctaaaggataaaataaactcaggccagataagttttaataaagccgcagttgagtattcacaggacccgaaatctgccgcagatagcggtcacatagggaaactaagtgttacaaatctggaccagcttgaaattgcggcattaacgccgctttcgatcggtgaactttctgacccggttaaagttggtgatgaaagatattacggctattatatgtaccgcgttaatgataaattccccgagcacaaagctacacttgaaagcgattatgtacttatcgagcagtatgctcagagattcaaagagcagaagctgcttggcgaatggcttgaagagctgaaaaaaactatttacctcgaaataaaactctga

SEQ ID NO: 2808 - protein, 181 aa, Unknown
  Obtained from environmental sample
  DOMAIN (37)...(135): PPIC-type PPIASE domain
  misc_feature (1)..(181): Xaa is any amino acid
MRIPFKPGEYLALVETEFGYHIIKLNDKTGDFITCQHILVKFPRLEAADFTEINFLKDLKDKINSGQISFNKAAVEYSQDPKSAADSGHIGKLSVTNLDQLEIAALTPLSIGELSDPVKVGDERYYGYYMYRVNDKFPEHKATLESDYVLIEQYAQRFKEQKLLGEWLEELKKTIYLEIKL

SEQ ID NO: 2809 - DNA, 309 bp, Unknown
  Obtained from environmental sample
  misc_feature (1)..(309): n is a, c, g, or t
atgataaagacaatttaccaggaatgtattgatatcgtaaaaaaccttgtaggtaacgaatacctgtatttcgactcggctgtagaaataaaagtatctccacatagttttccatttgctgcgtgggcagtttctgttagtccaaaaaacgaactttttgtaatggacaacaacgagcaatggcacctggtagaacttacagatgatcatgcctctttagtaattggcagtttataccaacgtctaaaacttatgcgcatacaatatgcgaaagctaactcatatgttctgaagaagcaaatatcttga

SEQ ID NO: 2810 - protein, 102 aa, Unknown
  Obtained from environmental sample
  misc_feature (1)..(102): Xaa is any amino acid
MIKTIYQECIDIVKNLVGNEYLYFDSAVEIKVSPHSFPFAAWAVSVSPKNELFVMDNNEQWHLVELTDDHASLVIGSLYQRLKLMRIQYAKANSYVLKKQIS

SEQ ID NO: 2811 - DNA, 765 bp, Unknown
  Obtained from environmental sample
  misc_feature (1)..(765): n is a, c, g, or t
atgcaactaagaaaagcaacaagaaaaaaagctaaaataagattaggcctgtcagcagttagtggcggtggaaaaactttttccgcattactaattgcgaaaggaatttgtaatgattggaataaaattgccatcatagattctgaaaataacagtgcagatctatatgcccaccttggcaattataatgtgatgccaatagcggcacctttttcacccgaaaaatatgtagaagcaattaagatttgtgaaaaagcaggcatggaagtaatcatcattgacagtatcactcatgaatgggatggcaaaggaggttgtttggagatagtcgaatctttaggcggtaaataccaggattggggaaaggttactccgcgtcaccagtcttttattgatgccatcattcaaagcccctgccatgttattaccacagtccgacgcaagcaagattatgaagtaataaaagatggcaatggaaaaataaaagttgaaaaaagcgggttaagagagatcacacgtgaaggatttgaatatgagctcaccattaatcttgagttggatacgaagcataatgctacagcaagcaaggaccgcacaggcttgtttatgggcaagtctgcgtttattccgtctgagaaaaccggtgaattaatacaacaatggtgcgaccagggagaagatgcttttgatataaagccaggaagcgaatggtaccatcgtgtggaggaatgccaatacccaaaaagaattagtagaactctataa

SEQ ID NO: 2812 - protein, 254 aa, Unknown
  Obtained from environmental sample
  misc_feature (1)..(254): Xaa is any amino acid
MQLRKATRKKAKIRLGLSAVSGGGKTFSALLIAKGICNDWNKIAIIDSENNSADLYAHLGNYNVMPIAAPFSPEKYVEAIKICEKAGMEVIIIDSITHEWDGKGGCLEIVESLGGKYQDWGKVTPRHQSFIDAIIQSPCHVITTVRRKQDYEVIKDGNGKIKVEKSGLREITREGFEYELTINLELDTKHNATASKDRTGLFMGKSAFIPSEKTGELIQQWCDQGEDAFDIKPGSEWYHRVEECQYPKRISRTL

SEQ ID NO: 2813 - DNA, 771 bp, Unknown
  Obtained from environmental sample
  misc_feature (1)..(771): n is a, c, g, or t
ttgcctgatgacccatatcttcttgaacaaaatatcttgcccattgcttgcattggtgtagattatcgtttcattaaagtaaatcgtgctttttgtgagctaacaggatttactgaacaagaattaaaacatcttaagttgacggatatagtccacgctgcggataagcatagggagaaatatattttatcaaatttatttggtgggcgaattcctgtaaaccgatcggacaagagattaattaaaaaaaatcagcaggttatttgggtgaattgttcttctaccattcaacgcgatagtaggggttatccgcagtttatattctccgcaatggaaaatatcaatcgccgcaagcgatatgagcaaacacttattaaagataaaactactctttcttctgttgttgatcattctgatacgtttatttttagcgttgacaccaatcatacacttatcttcctgaatgaaaaagtaaaagatttctttttcggattaactgatattgtgattgaagccggttttaacctgcaacaaattatcccgccagtctatctttcacaataccaggaaacttttaagcgtggaataaatggagaagctttcagtgtggatattaagcttgaagcaactgggtcatcctttatagaaatttctgtacagccggttgttgatgatttaagcagggtggttagtcttacttttactgcaaaggacattagcgagaggaagaaaaaggagcaagaacttttaaaacaaaaggaagatgcagat

SEQ ID NO: 2814 - protein, 257 aa, Unknown
  Obtained from environmental sample
  misc_feature (1)..(257): Xaa is any amino acid
MPDDPYLLEQNILPIACIGVDYRFIKVNRAFCELTGFTEQELKHLKLTDIVHAADKHREKYILSNLFGGRIPVNRSDKRLIKKNQQVIWVNCSSTIQRDSRGYPQFIFSAMENINRRKRYEQTLIKDKTTLSSVVDHSDTFIFSVDTNHTLIFLNEKVKDFFFGLTDIVIEAGFNLQQIIPPVYLSQYQETFKRGINGEAFSVDIKLEATGSSFIEISVQPVVDDLSRVVSLTFTAKDISERKKKEQELLKQKEDAD

SEQ ID NO: 2815 - DNA, 729 bp, Unknown
  Obtained from environmental sample
  misc_feature (1)..(729): n is a, c, g, or t
ttggttcaatctactttaatggaattggataaatttatacttttattatctcatgaaagtttagatagttttaagcatttattatcaaatcagaaaatacttataaactttcctatagatcgttataaaattgaatatttaaaagaagatcataaaaataaaattaaaattaaaaatttgataataccaatgttgccttataaaaaaaaattactagaacataataatagaataattatacaggaaaaccaaaaattacaaaactcaaaacttaagatggttgtgattactgtaccaaacaataaccctgttttacaacagtatgaaataaaagattatacttcaaattttatatatacctggaaggttgatggcaacacaacaatatcatcagtttattatcataatagaaagaataaacaagaacaagttaaatatttaactagggataaaataacaaataatttattaccatatccacctaacggtgaggtttatataagtctattaattgatgatcaagaagtaataacacctaaaccgataattttgagagataatccatatgtatctaaccttgattttacccctagtcttgaccccggcaaccccaatccagacgaacatatgagtaattttttaattgattggtcaagaatcactaattctaatggaactttttattggattaataaaatatcaattatagaatttgatgatgacatgtaa

SEQ ID NO: 2816 - protein, 242 aa, Unknown
  Obtained from environmental sample
  misc_feature (1)..(242): Xaa is any amino acid
MVQSTLMELDKFILLLSHESLDSFKHLLSNQKILINFPIDRYKIEYLKEDHKNKIKIKNLIIPMLPYKKKLLEHNNRIIIQENQKLQNSKLKMVVITVPNNNPVLQQYEIKDYTSNFIYTWKVDGNTTISSVYYHNRKNKQEQVKYLTRDKITNNLLPYPPNGEVYISLLIDDQEVITPKPIILRDNPYVSNLDFTPSLDPGNPNPDEHMSNFLIDWSRITNSNGTFYWINKISIIEFDDDM

SEQ ID NO: 2817 - DNA, 354 bp, Unknown
  Obtained from environmental sample
  misc_feature (1)..(354): n is a, c, g, or t
gtgtcgcaggacattggaagagtgctactcaacttatacaataaggcattttatgctttaaatgaaaagaagaaaactgctcatgaaaaatatcagccaacaatttcagttcaaacaaagaaattaaatgacagggttgagataaaagttgcggataatggtaacggcattccgcaaaaagtaattgataaaatctttcagccattctttacaacaaaaccaaccggacaaggaactggcttgggtttaagcttgagttatgatattataaaggctcatggaggggaaataagagtagagactaaggagggtcaagggacggaatttataattgagctgcctgttatttcctga

SEQ ID NO: 2818 - protein, 117 aa, Unknown
  Obtained from environmental sample
  DOMAIN (11)...(116): Histidine kinase-, DNA gyrase B-, and HSP90-like ATPase
  misc_feature (1)..(117): Xaa is any amino acid
MSQDIGRVLLNLYNKAFYALNEKKKTAHEKYQPTISVQTKKLNDRVEIKVADNGNGIPQKVIDKIFQPFFTTKPTGQGTGLGLSLSYDIIKAHGGEIRVETKEGQGTEFIIELPVIS

SEQ ID NO: 2819 - DNA, 522 bp, Unknown
  Obtained from environmental sample
  misc_feature (1)..(522): n is a, c, g, or t
atgctgcagcattcaagaaccagcagtggacagaaagaaccaacagatatcgatgcgttagcagatgaatatttgcgactctcctatcatggtatgcgagcaaaggacaaatctttcaatgcagaaataaaaactgactttgatggaaatattggaaaaataaatgtcgtgtcgcaggacattggaagagtgctactcaacttatacaataatgcattttatgctttaaatgaaaagaagaaaactgctcatgaaaaatatcagccaacaatttcagttcaaacaaagaaattaaatgacagggttgagataaaagttgcggataatggtaacggcattccgcaaaaagtaattgataaaatctttcagccattctttacaacaaaaccaaccggacaaggaactggcttgggtttaagcttgagttatgatattataaaggctcatggaggggaaataagagtagagactaaggagggtcaagggacggaatttataattgagctgcctgttatttcctga

SEQ ID NO: 2820 - protein, 173 aa, Unknown
  Obtained from environmental sample
  DOMAIN (56)...(172): Histidine kinase-, DNA gyrase B-, and HSP90-like ATPase
  misc_feature (1)..(173): Xaa is any amino acid
MLQHSRTSSGQKEPTDIDALADEYLRLSYHGMRAKDKSFNAEIKTDFDGNIGKINVVSQDIGRVLLNLYNNAFYALNEKKKTAHEKYQPTISVQTKKLNDRVEIKVADNGNGIPQKVIDKIFQPFFTTKPTGQGTGLGLSLSYDIIKAHGGEIRVETKEGQGTEFIIELPVIS

SEQ ID NO: 2821 - DNA, 720 bp, Unknown
  Obtained from environmental sample
  misc_feature (1)..(720): n is a, c, g, or t
gtgggcgataatttttcagaacaggatgagatccttctgaaattagacattcataaaaacatcccggaattattattggatactacagaccgtaaccgtacttcgccttttgcctttaccggtaataaatttgaattccgcgccgtaggctctaccgctaactgtggtattcctatgactacccttaacgctattatggcaaatactttaacccagtttaaaaaagaagtggatgccctgatagataaaggagagaagaaggaaattgccatcatgcatgttatccgtgaatacataaccagttccgaaaaagtattgtttgaaggagatggatatagtgatgaatggcatcatgaagcggaaaggcggggtttgcccaatgtaagaacaacgccattggcattagatgcgatggttacagacaaggctaaaaaattgtttgaagacctgggtatatatcatcattccgagattgaagcgcggcatgaaattgaactggaaaaatacattaaaaaagtgcagatcgaaagccgtatcatgggagagctctgcaccagtcatatcttaccctgttcggtaaaatatcagaacatccttatcaataatatccgcgggcttaaagacctgggtttgccggaatcatcctatgccaaccagttgcagatactcgagaaatatctgaacatattggccaggtggcagacggagttgaaaaaatga

SEQ ID NO: 2822 - protein, 239 aa, Unknown
  Obtained from environmental sample
  misc_feature (1)..(239): Xaa is any amino acid
MGDNFSEQDEILLKLDIHKNIPELLLDTTDRNRTSPFAFTGNKFEFRAVGSTANCGIPMTTLNAIMANTLTQFKKEVDALIDKGEKKEIAIMHVIREYITSSEKVLFEGDGYSDEWHHEAERRGLPNVRTTPLALDAMVTDKAKKLFEDLGIYHHSEIEARHEIELEKYIKKVQIESRIMGELCTSHILPCSVKYQNILINNIRGLKDLGLPESSYANQLQILEKYLNILARWQTELKK

SEQ ID NO: 2823 - DNA, 882 bp, Unknown
  Obtained from environmental sample
  misc_feature (1)..(882): n is a, c, g, or t
atgatttcattcatcgcagtaccgggaaagaagaaatttattttattcaggaatgtaaaaaatgaactgttgaacggaacggcagtgttccgcattaaaaatttgattcctgaaatatggaatgctgaaaccggtgaaataatccctgtgcctgcttatacgataacagcaaaaggcattcaactacctttaagcctcaacgcttatggctcctgttttgtcgtctttagtgcaggaaataaaaagcccccgatgactgatattacaatcaatgataaaaaaatcggtgatacaaacagtgaatatcccgggttcatgtattcatcaaaaggcattaccacgatgatgaatgaaaaatggaactggaccgtaaacaataaaactttttcaaaacaggtttcactaccttctcccattgcattaaccgggccatgggaactacggtttgaacaggaaatgaataatgttcccaccgatacaatgctgacacttgttcccctgaaccaatcttccaaagaaaaaataaaatacttttcgggcactgttgcttatcaccatgtgttcaacatgcagaagaatcaactgcaaaaagaccagcttgtttttttggacctggggaatgtaaaagagatcgcagaggtatttatgaatggcaaaagaataggattaagctggcatgcaccttttcacctggatattacgaatgcaatacttgaaggagaaaactacctggtgatcgaagtagtaaacactatcaataatttgctggtaggagatgcaaaacgaccggagcaataccgccgtacaaaaacgaacatcacaaaaatttccaacgcatggcgacaacctttggcgaaactccttaatgggatcccgggttga

SEQ ID NO: 2824 - protein, 293 aa, Unknown
  Obtained from environmental sample
  DOMAIN (110)...(259): Glycosyl hydrolases family 2, sugar binding domain
  misc_feature (1)..(293): Xaa is any amino acid
MISFIAVPGKKKFILFRNVKNELLNGTAVFRIKNLIPEIWNAETGEIIPVPAYTITAKGIQLPLSLNAYGSCFVVFSAGNKKPPMTDITINDKKIGDTNSEYPGFMYSSKGITTMMNEKWNWTVNNKTFSKQVSLPSPIALTGPWELRFEQEMNNVPTDTMLTLVPLNQSSKEKIKYFSGTVAYHHVFNMQKNQLQKDQLVFLDLGNVKEIAEVFMNGKRIGLSWHAPFHLDITNAILEGENYLVIEVVNTINNLLVGDAKRPEQYRRTKTNITKISNAWRQPLAKLLNGIPG

SEQ ID NO: 2825 - DNA, 630 bp, Unknown
  Obtained from environmental sample
  misc_feature (1)..(630): n is a, c, g, or t
ttgtactcgctgaaggacttaccggctaatgtcccattaaacctgaattacatgtacgatgctgaaatatggaaagcctgggtgcaacaagaaatgaacaactaccaagaagatgccgacggaaagaaaatctatctaaaaaaaggttacttgcatttagatcaccggatctggtttcctaacgagcatcctaaacttgaagagttaattaaagacgggttaatggtaatgaagccacaacgacatgtgaaggaattttacacgttctctccattcttaaaaattctggctaaaacaccgcgctaccgataccaatctgaagaaggatattatgatctggaaacaaagattcgcccgctttgctatgcagcacacaaggatagcctgatcatggggtattattcctttgcgcttaccaaaaagtacgaggagtatatcagaaagcatacgtttgatgagacggtattggcttaccggacggacttgggaaaatgcaatattcaattcgcaaaggaggcatttgatgaggtcaggtcaaggaaaaaatgttcagctattgcgcttgatatcaaaggctattttgaccacatagatcatacaatcttgctggaaaaatggcaaaagtattag

SEQ ID NO: 2826 - protein, 209 aa, Unknown
  Obtained from environmental sample
  misc_feature (1)..(209): Xaa is any amino acid
MYSLKDLPANVPLNLNYMYDAEIWKAWVQQEMNNYQEDADGKKIYLKKGYLHLDHRIWFPNEHPKLEELIKDGLMVMKPQRHVKEFYTFSPFLKILAKTPRYRYQSEEGYYDLETKIRPLCYAAHKDSLIMGYYSFALTKKYEEYIRKHTFDETVLAYRTDLGKCNIQFAKEAFDEVRSRKKCSAIALDIKGYFDHIDHTILLEKWQKY

SEQ ID NO: 2827 - DNA, 300 bp, Unknown
  Obtained from environmental sample
  misc_feature (1)..(300): n is a, c, g, or t
atgagtgactttagggttatagaaataattgacggcaatacaattaaggtgtcccctttttggcaaatgggtttaagaaacaatgatgttattaagggcgacaaaatatatatccgagggctagaggggttggaaaataatcaaattgtcaaaaagcgattagaaaagatattaatcaatactaatgaggctataacctttgatgcccccgaattaattgattccgataactatgcaaaatgcattagtatcctgttctgtttatgtagggcgaacaaatattgcatactacttccctga

SEQ ID NO: 2828 - protein, 99 aa, Unknown
  Obtained from environmental sample
  misc_feature (1)..(99): Xaa is any amino acid
MSDFRVIEIIDGNTIKVSPFWQMGLRNNDVIKGDKIYIRGLEGLENNQIVKKRLEKILINTNEAITFDAPELIDSDNYAKCISILFCLCRANKYCILLP

SEQ ID NO: 2829 - DNA, 471 bp, Unknown
  Obtained from environmental sample
  misc_feature (1)..(471): n is a, c, g, or t
gtgatctatggaaattccaatgttatcaatagagatggtatggccgttaaattgatcccgccggttaaattgaatttaaacttttggtaccgaaaaaccttaaatcaccaggcggtattttttaaacgagagctttttggatcatacggtttgtataattcctcatacaggtatagtgcagatctggatttcttattaaacgtttttaagaatgaaccggaaacctttgagtatttcaataagatcatttgcaattatcatgagataggattaagtgccaaaccggaaaactatgacaagatcattgaagaaaaagagcaaatattaaaaagccgtttaacttcagatgaatataaaagtgcaagaaagcaatatttgaagggactaccgtttaaaacacggttattgatctatatctctcaaagaccgtttcttaagaaaattgtaggtaaattatatgaaaaaaaatga

SEQ ID NO: 2830 - protein, 156 aa, Unknown
  Obtained from environmental sample
  misc_feature (1)..(156): Xaa is any amino acid
MIYGNSNVINRDGMAVKLIPPVKLNLNFWYRKTLNHQAVFFKRELFGSYGLYNSSYRYSADLDFLLNVFKNEPETFEYFNKIICNYHEIGLSAKPENYDKIIEEKEQILKSRLTSDEYKSARKQYLKGLPFKTRLLIYISQRPFLKKIVGKLYEKK

SEQ ID NO: 2831 - DNA, 387 bp, Unknown
  Obtained from environmental sample
  misc_feature (1)..(387): n is a, c, g, or t
atgaaaaaaaatgacatattagtttcagtgatcgtgccagcgtacaattatgcgcaatatttacccgaatgccttgacagcgttaaagcgcagggctttcaaaattgggaatgcattatcattgataaccggttctaccgattataccaaaagagcttgtgcaacaatatgtgtcagcagattcacgttttaagtatctgtcccccgagaataagggggtctcaaaagcccgtaacttggagttgccaattcaaacgggttatcatattgcctttgcatgctgctgataagatccatccaattaatgccaaaggagtggaacagctcaaaaagataagatctactcttggttattccaaagcggaccttttgggaattcgatggtaa

SEQ ID NO: 2832 - protein, 128 aa, Unknown
  Obtained from environmental sample
  misc_feature (1)..(128): Xaa is any amino acid
MKKNDILVSVIVPAYNYAQYLPECLDSVKAQGFQNWECIIIDNRFYRLYQKSLCNNMCQQIHVLSICPPRIRGSQKPVTWSCQFKRVIILPLHAADKIHPINAKGVEQLKKIRSTLGYSKADLLGIRW

SEQ ID NO: 2833 - DNA, 549 bp, Unknown
  Obtained from environmental sample
  misc_feature (1)..(549): n is a, c, g, or t
atgagcaaaaagaagataaatattgcactggttggaaatcctaacagcggtaaaagctccttattcaattccctaacgggtttgaatcaaaaggttggaaacttcccaggtgtaactgtagataaaagttcgggtattataaccctgcccgatgaaacaaaagccaacattatagatttacccggtacttacagtttatatcccaaacgactggatgaatgggttagttacagggttttgttaaaccaggaccatgatatcaaggctgatctatttatagtagttgtagatgcaaataacctaaagcgaaatttacttttttgtacccagatcattgatttgaaaaagccggtggttgttgcccttactatgacagacctggcaaagcaaaagggtattaaaatcgatctgaatgagcttgaaagagaactcggtgttcccatcgtagctgtaaatccgagaaaaggaaaaggtatttcccagttaagaaaagctattgagctcactatctccaaccaatacaaaattctgacacagcgatgttattga

SEQ ID NO: 2834 - protein, 182 aa, Unknown
  Obtained from environmental sample
  DOMAIN (10)...(179): Ferrous iron transport protein B
  misc_feature (1)..(182): Xaa is any amino acid
MSKKKINIALVGNPNSGKSSLFNSLTGLNQKVGNFPGVTVDKSSGIITLPDETKANIIDLPGTYSLYPKRLDEWVSYRVLLNQDHDIKADLFIVVVDANNLKRNLLFCTQIIDLKKPVVVALTMTDLAKQKGIKIDLNELERELGVPIVAVNPRKGKGISQLRKAIELTISNQYKILTQRCY

SEQ ID NO: 2835 - DNA, 435 bp, Unknown
  Obtained from environmental sample
  misc_feature (1)..(435): n is a, c, g, or t
atgaagttaattctggacccaaaagacctgaccgaaggtttttttgaagaaacacgcctgcttggtatcatggcacctatgaaagattatttgttttgttggcatgtcaataactttttaagcgtagacttcaggatcaataatgaaattgagattcagctaaagaaaaagaacaggcactacttctttgctgtttacgaattcacagagccacacacctcacttgttcattatctctacaacaatcaattcgatggagaatacttactgcccgaatttaaacaccttgactttttatggttattaaaaggagatagtgttatggaatcacacattcagggacttgttgaatctatcagagcaattaaaagcgtgcagttggtagttgaactgacaaatgagaaaataagaaataaagaacaccttgttttttaa

SEQ ID NO: 2836 - protein, 144 aa, Unknown
  Obtained from environmental sample
  misc_feature (1)..(144): Xaa is any amino acid
MKLILDPKDLTEGFFEETRLLGIMAPMKDYLFCWHVNNFLSVDFRINNEIEIQLKKKNRHYFFAVYEFTEPHTSLVHYLYNNQFDGEYLLPEFKHLDFLWLLKGDSVMESHIQGLVESIRAIKSVQLVVELTNEKIRNKEHLVF

SEQ ID NO: 2837 - DNA, 372 bp, Unknown
  Obtained from environmental sample
  misc_feature (1)..(372): n is a, c, g, or t
atgggtcagatgcaaatcgtaaaacacattcaccatcttgttgaagaagcaggtaaaagcaatgaaaaattggcttttacaaaaacccgtgaagcgcaaacaaccacatctgcacgattttccgtttctcttggtatcatgcccgattacacattttcagggcagggagtcagggttgatggcgtaagtgaaaataaaccggcaataaaagccggtatacaagccggggatattattactactttgggagatttcccggtctcatcagtagagtcatacatgcaagcgcttagtaaattcaaaaaaggagataaaacaacagtatctttcaacaggggcactgaaaaactttcagttaacatagaattttag

SEQ ID NO: 2838 - protein, 123 aa, Unknown
  Obtained from environmental sample
  misc_feature (1)..(123): Xaa is any amino acid
MGQMQIVKHIHHLVEEAGKSNEKLAFTKTREAQTTTSARFSVSLGIMPDYTFSGQGVRVDGVSENKPAIKAGIQAGDIITTLGDFPVSSVESYMQALSKFKKGDKTTVSFNRGTEKLSVNIEF

SEQ ID NO: 2839 - DNA, 417 bp, Unknown
  Obtained from environmental sample
  misc_feature (1)..(417): n is a, c, g, or t
atgttcaaattgattgatatagctaaagaaactcagtatcccaaactgaatgaactaactgttaagattgaagacctgaagaataaatcagcagacattctaaaattaagaagcaaatttattgcacaccgagacttaaatcactccattaagaatgatttagttgtagggccgattgagtttgacagtataaaggaaacgttttggacaatggctaaaagtgtaaatgaaatagaaatctttttgggaatggaacacacatcatttgcttgggttagagactttcatggagttactgcattgctcaaacatttaaaggacagcttaatctatagagacatcctaatctcaagcgataattggagtacaatggaaatggaatctcaaaaaagtaagttctataaattaaaagtctga

SEQ ID NO: 2840 - protein, 138 aa, Unknown
  Obtained from environmental sample
  misc_feature (1)..(138): Xaa is any amino acid
MFKLIDIAKETQYPKLNELTVKIEDLKNKSADILKLRSKFIAHRDLNHSIKNDLVVGPIEFDSIKETFWTMAKSVNEIEIFLGMEHTSFAWVRDFHGVTALLKHLKDSLIYRDILISSDNWSTMEMESQKSKFYKLKV

SEQ ID NO: 2841 - DNA, 648 bp, Unknown
  Obtained from environmental sample
  misc_feature (1)..(648): n is a, c, g, or t
atgatagcaccatgctacaagcctgcatccgtaaacggagagaactggaggcacttaaagcaaacccgatttattcaattcaaaaccattttggtaatggaaaccctaatcacagagcctaacagaaggccaaagaagaacgccaaacaggtagacacatctgtagaagtacaggttcaggatactacaatagaaacggagagctcgatagtatctgactccaaagcctttatcacggcaaatacggtagaaagcacgcttgaagagatcaagagggggcatgtcatacctgtatttgtaaaggataatgagccggtgatctcccatgcagatttcatagagagtgcaatggaagtcacccgtgatatatttcacggagagaccattttaaagccctctattcgcctgtcgcacgagatcaagggcagaataccagaagcgaaacacaagcctgctaaagagctcctagagcacgagcggaccctttattatgaacgtatggcatttctgattgaagtgcccagtgttagggacaaagtaggagagaatccggtttctttacctattggacgggtaaaggcctataacctggataacctctatacaagaaaggaacagacgaacactccaggtctttattgggtttaa

SEQ ID NO: 2842 - protein, 215 aa, Unknown
  Obtained from environmental sample
  misc_feature (1)..(215): Xaa is any amino acid
MIAPCYKPASVNGENWRHLKQTRFIQFKTILVMETLITEPNRRPKKNAKQVDTSVEVQVQDTTIETESSIVSDSKAFITANTVESTLEEIKRGHVIPVFVKDNEPVISHADFIESAMEVTRDIFHGETILKPSIRLSHEIKGRIPEAKHKPAKELLEHERTLYYERMAFLIEVPSVRDKVGENPVSLPIGRVKAYNLDNLYTRKEQTNTPGLYWV

SEQ ID NO: 2843 - DNA, 984 bp, Unknown
  Obtained from environmental sample
  misc_feature (1)..(984): n is a, c, g, or t
ttgaatgatgctggaaccggcgagatcagaagtaaagcagaggaaggcattttcctgaactggccatcaatgcgcatttacaaaaattcaaatgtgagtgaggctgaacaaaaagaaaagatggagaacagtctgctggaacttgaatctttttttgatgctgcacgatcttattcaaaaaaaaccgaagtgcctgtgcaggttaaccagcattttgaagctatgaaaggattgtttaatgggagcaggaaattatatattagaaccaacgatataaaagaaattgtttctgccatacgctttagtaataagtttaatgttaaaatggtgctcgttgatggcgctgacagctggcgtgttgcatccatgttgaaggaaaataatgttcctgtagtcatcgtgcgtacgcattcacttccatttcataatgatgatgatatcgatatccaattcaggttgccggcattattatataaagcaggtgttaaattctgtataaccgatgacggatactggctgcagaggaatattccttaccaggcagggagtgcagttgcatacgggctgccctatgaagaggctgtaaaagcaatcacactttcccccgctgaaatacttggaataaatggccataccggatcacttgaagataataaagatgcgacattcataattgcatcaggtgatatgcttgacatgaaaacaagtaaagtggaggaagcctatatcaatggaagacagatcagccttgataatattcaaagtcagctgttcaacaagtacatgaaaaaatacaaattgccgttaataaaaaagtgcttaaatagtgcagctttttattatatatatattatatataagcaagataagcttcagcagttgtttcttgaattctgctcagtgtctggatgcgttttctttaatcgggcaaccctttccttgtcagatcaatttctctcgaattcttccgtgaaggtctgttga

SEQ ID NO: 2844 - protein, 327 aa, Unknown
  Obtained from environmental sample
  misc_feature (1)..(327): Xaa is any amino acid
MNDAGTGEIRSKAEEGIFLNWPSMRIYKNSNVSEAEQKEKMENSLLELESFFDAARSYSKKTEVPVQVNQHFEAMKGLFNGSRKLYIRTNDIKEIVSAIRFSNKFNVKMVLVDGADSWRVASMLKENNVPVVIVRTHSLPFHNDDDIDIQFRLPALLYKAGVKFCITDDGYWLQRNIPYQAGSAVAYGLPYEEAVKAITLSPAEILGINGHTGSLEDNKDATFIIASGDMLDMKTSKVEEAYINGRQISLDNIQSQLFNKYMKKYKLPLIKKCLNSAAFYYIYIIYKQDKLQQLFLEFCSVSGCVFFNRATLSLSDQFLSNSSVKVC

SEQ ID NO: 2845 - DNA, 381 bp, Unknown
  Obtained from environmental sample
  misc_feature (1)..(381): n is a, c, g, or t
atgaaagcaaaacaattcacacttattgcattatcaatgataatgcttattacattttcctcttgtaaaaaagaaggtttaggcggaaaggcaaaaatagtaggaaaagtattacatcacgaaacacctattcctaatgctattgtatatatcaaatacggagttaaagaatctccgggatcagacccttctaattacgatgcaagtgttacagcagatgcaaattctaatttcgagtttaaagaacttcaaaaaggtgattactatttgtattccataggatatgacaattctatttcggctacggttaacggtggagttcctattgtgattaaaaagaaaactgaaacaaaaaacagtaacgtacaagttgttgaataa

SEQ ID NO: 2846 - protein, 126 aa, Unknown
  Obtained from environmental sample
  misc_feature (1)..(126): Xaa is any amino acid
MKAKQFTLIALSMIMLITFSSCKKEGLGGKAKIVGKVLHHETPIPNAIVYIKYGVKESPGSDPSNYDASVTADANSNFEFKELQKGDYYLYSIGYDNSISATVNGGVPIVIKKKTETKNSNVQVVE

SEQ ID NO: 2847 - DNA, 540 bp, Unknown
  Obtained from environmental sample
  misc_feature (1)..(540): n is a, c, g, or t
gtgaaacttagtgtttacatcaatcaggaccaggtgcaacatatagaattctttcatagggatcatttcgatttccgctaccatcgcaggaaggccaaaaaatccctttcccagttcattgattttttctgggaaaccgattttgattcgctctttacacaatatccggaaggtttttcagatgccctttttcccaacataggttatacctacctgatcaacctgggcacccccttcatcatgcaactgggtgatgaatcttttgaaatgaagtcggatggctttcttccccgtcataaaaacatgatttgccatcatgcaccaggcaataagatattcgggatcaaattcagggtttctccggtgatatttgaaaaaaagatcaacttttcagaataccgggaatacatttttccactggcttatctcatcgacagaaagatcatggaaaagatcaaagccgctgattccttcgacaaaagggtcatgatcgcatctgaatactttgaaaggatcgtggaaaacataccggctgcctga

SEQ ID NO: 2848 - protein, 179 aa, Unknown
  Obtained from environmental sample
  misc_feature (1)..(179): Xaa is any amino acid
MKLSVYINQDQVQHIEFFHRDHFDFRYHRRKAKKSLSQFIDFFWETDFDSLFTQYPEGFSDALFPNIGYTYLINLGTPFIMQLGDESFEMKSDGFLPRHKNMICHHAPGNKIFGIKFRVSPVIFEKKINFSEYREYIFPLAYLIDRKIMEKIKAADSFDKRVMIASEYFERIVENIPAA

SEQ ID NO: 2849 - DNA, 507 bp, Unknown
  Obtained from environmental sample
  misc_feature (1)..(507): n is a, c, g, or t
ttgcacggaaaaattcacggaaaaggaactggtttacaagagtataatccatggataggtgatgccagcaaaacccagcgttatgaatacgctttttcagctggtattttacctctcacggccagcaataatgaaccctggtcgctggtgctggtaaaccgttacgatgctgcgaaagacacagccaggcgtttattcgacaggccttatgtggaagaagagggctatgctaccaatggaaaggaaaatatcagtatccggcccttgcggattgataaagtgacaacccaaagcgggaaggacacgaagatctttggtggcaaaatgcttacaggttatgaattgagatgggatgatggggtagtgggcatcattgatatactggataataatatctggcttgccaatgatcttgatgcaggcgataaactgattctgtcctccattgcctcttcgatccttttgaaaagaatgcaggacgtggaaaaagaaaaagaagatttttaa

SEQ ID NO: 2850 - protein, 168 aa, Unknown
  Obtained from environmental sample
  misc_feature (1)..(168): Xaa is any amino acid
MHGKIHGKGTGLQEYNPWIGDASKTQRYEYAFSAGILPLTASNNEPWSLVLVNRYDAAKDTARRLFDRPYVEEEGYATNGKENISIRPLRIDKVTTQSGKDTKIFGGKMLTGYELRWDDGVVGIIDILDNNIWLANDLDAGDKLILSSIASSILLKRMQDVEKEKEDF

SEQ ID NO: 2851 - DNA, 669 bp, Unknown
  Obtained from environmental sample
  misc_feature (1)..(669): n is a, c, g, or t
ttgctatcatcgctgaaaaaataccagcgggacaaaaaactaaaagcagatggcaaaattggcgcacaaacaatacgaatgttgaatttgtccgaccaggaaaaattcaatcgtattgctattacaatggatagatataaaatgttgcccgaaaagatgcccgggaagtatatctgggtgaacattccttcattttcattaaagttgctgagtaatgatacattgatagtgagcagcaaggtcgtggtcggtaaaccacaaacaaggactcctgtacttaccagcgctgtatcagaaatgatcacctatccgcaatggaccattccggaaagcattattgaaaaagaaatcttaccgggaataaaaaaagacacagcatatcttacaaaaaagggatatagtttactgaatagtaagaacgaagaagtagatccggattctgtcgattggtcaaagtatacaaagcggataccttataaagttatccagggcagtggtgatgacaatgcgcttggcgttttgaaatttaatttttacaataaatattccgtttatctgcatgatacaaatcaacgttctttttttgggtctgattcaagggcattgagtcatggttgtgttcgggtccaggaatgggaaaaaatggcttattatatcatggagaattga

SEQ ID NO: 2852 - protein, 222 aa, Unknown
  Obtained from environmental sample
  misc_feature (1)..(222): Xaa is any amino acid
MLSSLKKYQRDKKLKADGKIGAQTIRMLNLSDQEKFNRIAITMDRYKMLPEKMPGKYIWVNIPSFSLKLLSNDTLIVSSKVVVGKPQTRTPVLTSAVSEMITYPQWTIPESIIEKEILPGIKKDTAYLTKKGYSLLNSKNEEVDPDSVDWSKYTKRIPYKVIQGSGDDNALGVLKFNFYNKYSVYLHDTNQRSFFGSDSRALSHGCVRVQEWEKMAYYIMEN

SEQ ID NO: 2853 - DNA, 486 bp, Unknown
  Obtained from environmental sample
  misc_feature (1)..(486): n is a, c, g, or t
atgaatgacaatagtcttgaaattgctacctttgctgctggctgtttctggggggttgaggatgcgttcatgaaggtaagaggagtaaaatcaacaagagttggatacactggaggtaatcttacgaatccaacatacgaggatgtttgtaccgatagaacaggacatgctgaagccatacagctaaagtacgatcctaaagaaatttcgtataaagagctactagaattattttggtcattacacaatccaactactgtaaatagacaaggtcctgacataggaactcagtatcgttcttcaatattctttcatactctagagcaagagaaaatagctaaacgagtgaaacaagagctggatggttcgaagtttcagaacaaaatagttaccgaaattgttccagcatccatattttatccagctgaagagtatcatcaaaaatattatcacaagataggaagaggtagttgttacaaaaaatga

SEQ ID NO: 2854 - protein, 161 aa, Unknown
  Obtained from environmental sample
  DOMAIN (7)...(161): Peptide methionine sulfoxide reductase
  misc_feature (1)..(161): Xaa is any amino acid
MNDNSLEIATFAAGCFWGVEDAFMKVRGVKSTRVGYTGGNLTNPTYEDVCTDRTGHAEAIQLKYDPKEISYKELLELFWSLHNPTTVNRQGPDIGTQYRSSIFFHTLEQEKIAKRVKQELDGSKFQNKIVTEIVPASIFYPAEEYHQKYYHKIGRGSCYKK

SEQ ID NO: 2855 - DNA, 636 bp, Unknown
  Obtained from environmental sample
  misc_feature (1)..(636): n is a, c, g, or t
atggctctcgacaacttggcaaaaataatgtcaataaggcctgcccctattgatgcagtaattcacgttgacaaagatgccatcctgccatttacagaaagcagtctttcatcgtcaacgtcttatattataagaataagcgcaactgatctaattaggataacctgtaatgacagatcctacagagagaattacagaatagaggactattctcagctatatgaaacagaaatggaatacaacttattatttgataatgttcgaggatttataacaaagtccaaatttaatgtgaatttatctaaaacgctaagagatgaaccaagtaaattctttatgtataacaacggcttgacccttactgctaatgacataatatccgaagacacaaatgccaaacaaaaaattaaaattactataaaagactttcaagtggtgaacggcggacaaacacttcgaactttgcatagtttcaagcaacaagacaaggataatattcacctatatttgtccaactgtgagattctccttcgtgttttcaagacatcaactggccctgtaaggaacaaaattgcagagtatacaaacagtcaaaatgcaatttcaagtattgatctgaagtcatttaagtattga

SEQ ID NO: 2856 - protein, 211 aa, Unknown
  Obtained from environmental sample
  misc_feature (1)..(211): Xaa is any amino acid
MALDNLAKIMSIRPAPIDAVIHVDKDAILPFTESSLSSSTSYIIRISATDLIRITCNDRSYRENYRIEDYSQLYETEMEYNLLFDNVRGFITKSKFNVNLSKTLRDEPSKFFMYNNGLTLTANDIISEDTNAKQKIKITIKDFQVVNGGQTLRTLHSFKQQDKDNIHLYLSNCEILLRVFKTSTGPVRNKIAEYTNSQNAISSIDLKSFKY

SEQ ID NO: 2857 - DNA, 432 bp, Unknown
  Obtained from environmental sample
  misc_feature (1)..(432): n is a, c, g, or t
atgttagttgataaatctaaaaacaccaccgatgtgccacatgattatgtggaattatccaaaccggtgcaggcacgttatatcaggctggaaaacgtacacatgcccaccggaaaatttgcattaagcggcttccgggtttttggaaacggcaatggagaaataccggattctgtaaaacaattcattgtattgcgaacggagaaggacaaacgcagtgcgtttataaaatggagtcctgttgataatgcgtttgcttataatattttttatggaacggcgcctggtaagctttatacaagcatcatggttcatggcaataatgaatattggttaaaaaccatggacagtcaaaagcctgattatttcactattgaatccattaatgaaaacggtgtttcaaaaagaaccgaagtcataaaagttgattaa

SEQ ID NO: 2858 - protein, 143 aa, Unknown
  Obtained from environmental sample
  misc_feature (1)..(143): Xaa is any amino acid
MLVDKSKNTTDVPHDYVELSKPVQARYIRLENVHMPTGKFALSGFRVFGNGNGEIPDSVKQFIVLRTEKDKRSAFIKWSPVDNAFAYNIFYGTAPGKLYTSIMVHGNNEYWLKTMDSQKPDYFTIESINENGVSKRTEVIKVD

SEQ ID NO: 2859 - DNA, 822 bp, Unknown
  Obtained from environmental sample
  misc_feature (1)..(822): n is a, c, g, or t
atgattctcaacaaagagttgaggatattcacctttggtgacatgatccagcattatcctttccgttatgaagacagaacgaaattctataggataggagaactggaagatgaacttcagtatgttcagataaaaggccagataacgaaaaaggaacttattggagccggatttaagaaacgtttggttgcacacttcgttgatgggacgggggaaatggagttggtatggtttcagggaataaactgggtcaatgaaaaaataaaaccgggtgtcgaatacgttgtgtttggccgagtaagccgtttcggaaataaatttaatatcgcgcaccctgaacttgagccggtatctgtgaaggtagaaaaagcaggatttcttcagccagtttatccgctcaccgaaaaactaaaaacaaaacatctggatagtaaagcgatcgcaggcattatccaaaagttacttcaacaatcagaaggtaaaatacgggaaacattaccatcaaatcttctagctgaggaaaaattgctgtcaaagaaagactcgatgctcaacattcacttcccgtccagttatgaattgttggccaaggcacaacgcagacttaagtttgaagagttgttttacattcagcttcgtcttttaaagatgaaactggtcaggcaggacaagttcaaaggtcgcgtttttcaaaatgtttccctacttactaccttttacaatgaacatctgccattcgcattaacggatgcgcagaaaaaggtcgtncaggaaatatatgccgacctgatatcaggtaaacaaatgaatcgatacttctga

SEQ ID NO: 2860 - protein, 273 aa, Unknown
  Obtained from environmental sample
  DOMAIN (42)...(117): OB-fold nucleic acid binding domain
  misc_feature (1)..(273): Xaa is any amino acid
MILNKELRIFTFGDMIQHYPFRYEDRTKFYRIGELEDELQYVQIKGQITKKELIGAGFKKRLVAHFVDGTGEMELVWFQGINWVNEKIKPGVEYVVFGRVSRFGNKFNIAHPELEPVSVKVEKAGFLQPVYPLTEKLKTKHLDSKAIAGIIQKLLQQSEGKIRETLPSNLLAEEKLLSKKDSMLNIHFPSSYELLAKAQRRLKFEELFYIQLRLLKMKLVRQDKFKGRVFQNVSLLTTFYNEHLPFALTDAQKKVVQEIYADLISGKQMNRYF

SEQ ID NO: 2861 - DNA, 462 bp, Unknown
  Obtained from environmental sample
  misc_feature (1)..(462): n is a, c, g, or t
atgggagggaacctgagtaaagtatatgttcttccttctggagttgaccttgacaagttcaatttacagatagatggttcaataatccgaaaaagatacggtataaaaaaggacgatacactactatttttcatgggctggatttacgaattttcaggcatgaaagaagtaactgaaagtcttgctaatttggaaagcgggtctataaagctaatgattgttggcgatggcgatctctatgatactctatgcaaaatgagtactgaagaaaatcttaagaataaattaattctcaccgggaaagtgccttttgagcagattccatcatttattgctgctgctgatatatgccttttgccagcttataagaatgaaatcatgatgaatattgtaccaattaagttatatgaatatatggctatgggaaaaccagtaatagccacaaatcttcctggaatttaa

SEQ ID NO: 2862 - protein, 153 aa, Unknown
  Obtained from environmental sample
  DOMAIN (26)...(151): Glycosyl transferases group 1
  misc_feature (1)..(153): Xaa is any amino acid
MGGNLSKVYVLPSGVDLDKFNLQIDGSIIRKRYGIKKDDTLLFFMGWIYEFSGMKEVTESLANLESGSIKLMIVGDGDLYDTLCKMSTEENLKNKLILTGKVPFEQIPSFIAAADICLLPAYKNEIMMNIVPIKLYEYMAMGKPVIATNLPGI

SEQ ID NO: 2863 - DNA, 456 bp, Unknown
  Obtained from environmental sample
  misc_feature (1)..(456): n is a, c, g, or t
ttgactattcaccccatgtatctctacctaaaagccctccatatcatctttattgtcacctggtttgcgggtatgttttatattgttcgtttgtttatttacaatacggaagcaaatgaaaaacctgaacccgcgaaatctatattgcaaaaacaatttggtgtgatgatgaaaaggctttggttgggaattacagtgccttctgctatacttactttaatccttggcccaaccgtaatgtttatgaatggatggaataaagtattatttgatccggccggcagatgccttttaatcaaattaatattcgtactggggctttacgcttatcattcaagcctggagaaaatatacaaacagcagatgaaaggcatttttaaatattcttctcaaaagctgcgtatctggaatgaagtagcaacgattttcctggtagccatagtgatgttggcnnnn

SEQ ID NO: 2864 - protein, 152 aa, Unknown
  Obtained from environmental sample
  DOMAIN (3)...(151): Uncharacterised protein family (UPF0093)
  misc_feature (1)..(152): Xaa is any amino acid
MTIHPMYLYLKALHIIFIVTWFAGMFYIVRLFIYNTEANEKPEPAKSILQKQFGVMMKRLWLGITVPSAILTLILGPTVMFMNGWNKVLFDPAGRCLLIKLIFVLGLYAYHSSLEKIYKQQMKGIFKYSSQKLRIWNEVATIFLVAIVMLAX

SEQ ID NO: 2865 - DNA, 624 bp, Unknown
  Obtained from environmental sample
  misc_feature (1)..(624): n is a, c, g, or t
ttgctcgatattctctttattaaggttcttgctgtttctgaaattctccccaaagctgataaggcgactaaaaataagatttcaaaatacctggagtcgcaattattggaacgcgcgagcgcgtattattcctcgttgacagtagcacaagctggcgcagctcttgaacgcgcaaatatgatcaaaaactgccttgagttctatgaaagtgtatacggaaagcaaatctggcccgctggcgaagaggagatgcagtttgcgagagaacgctggttagtgtgcaagtctcgtcaaattgatctacataaagatgagaagagtaaacagcgaataaggcgagagattcaaaacaggcagatagaatggaatgttgacaatattgccgtgctcgaaggatatcctgctgtagatttgaatgataagcccaggcccgtcaaactgatcaaagaaaggaaaattaaggttcctgtacaagttgtgccagaccaaaacggcgcgaaagatacaatgtctttgcccggtctgctgcatgaattccacccatcccaaccccccctaatacagcaccacatctctttccgacatccaggctgttcctgtgagcgcccgcataacaaaccataa

SEQ ID NO: 2866 - protein, 207 aa, Unknown
  Obtained from environmental sample
  misc_feature (1)..(207): Xaa is any amino acid
MLDILFIKVLAVSEILPKADKATKNKISKYLESQLLERASAYYSSLTVAQAGAALERANMIKNCLEFYESVYGKQIWPAGEEEMQFARERWLVCKSRQIDLHKDEKSKQRIRREIQNRQIEWNVDNIAVLEGYPAVDLNDKPRPVKLIKERKIKVPVQVVPDQNGAKDTMSLPGLLHEFHPSQPPLIQHHISFRHPGCSCERPHNKP

SEQ ID NO: 2867 - DNA, 879 bp, Unknown
  Obtained from environmental sample
  misc_feature (1)..(879): n is a, c, g, or t
atggtcaagatgcagaagaataaagtctccttactaatgtcaaagggcatgattaaggatccatccagaggtggttctggacttcctccattcgattcacaaggagaagaagccatgattgcacttcatggcagaccagttttattgattagaaataataaaatcgaacgaccagattctgctgaagtgcttagaaaaattcgcccgtttattaagaaaattgaacactcaataccatccgttggcagattagaatttataaattcttcaaagttgtttggaggaacagcatggatgataactgagaatattgttgttaccaataggcatgtagcagaattgatagcacagaagaaaaacaaagtctttccatttaaaaccacatttaccggtctgatgggagccgtattagatttcaaagaggagtatgcaggcccaggggttgcttcccctgaatttgaaattgaaattgaaaaagtacttttcatgactgagtcaagaaaagatgtaccggatattgcgtttttaaaaataaagaatcacaaatatttacccccaccaattccgcttagtgaaagggcattatttgatagacagcaagtaagtgtaattgggtatcctgcagaaactgatacaggcataatcagtgagactgctgctttcaaggtgtttaaggatatctataatgttaagcgatgttctccaggtgatatcatgaatccattgaaggatcaatggtatttttcacactcttgtactaccctacagggtaactctggatctgtggtaattgaccatgaaactggtgcagcagttggcttgcatttctatggtttggttcaagatgcgaactatgccgttaaggttctttacttctaa

SEQ ID NO: 2868 - protein, 292 aa, Unknown
  Obtained from environmental sample
  misc_feature (1)..(292): Xaa is any amino acid
MVKMQKNKVSLLMSKGMIKDPSRGGSGLPPFDSQGEEAMIALHGRPVLLIRNNKIERPDSAEVLRKIRPFIKKIEHSIPSVGRLEFINSSKLFGGTAWMITENIVVTNRHVAELIAQKKNKVFPFKTTFTGLMGAVLDFKEEYAGPGVASPEFEIEIEKVLFMTESRKDVPDIAFLKIKNHKYLPPPIPLSERALFDRQQVSVIGYPAETDTGIISETAAFKVFKDIYNVKRCSPGDIMNPLKDQWYFSHSCTTLQGNSGSVVIDHETGAAVGLHFYGLVQDANYAVKVLYF

SEQ ID NO: 2869 - DNA, 345 bp, Unknown
  Obtained from environmental sample
  misc_feature (1)..(345): n is a, c, g, or t
atggaagtaaagattcacttatatgccatctgctggaatgaggcaaagatattgcctcattttttaagatattataatgaaatatgtgagcggatattcatttacgataatttctctactgaccgttcattggaaattatttctggttgtagcaaggctgaaatttttaatttttacaccaacaaccaaataagggatgatgtttacctcaaaataaaaaatgaagcctggaaaaaaagccgtggtaaatgcgattttgtaattgtttgtgacgttgatgaatttatatatcatcctgatatgaataactttcttaatcacggaaagacaaatttttccctttaa

SEQ ID NO: 2870 - protein, 114 aa, Unknown
  Obtained from environmental sample
  misc_feature (1)..(114): Xaa is any amino acid
MEVKIHLYAICWNEAKILPHFLRYYNEICERIFIYDNFSTDRSLEIISGCSKAEIFNFYTNNQIRDDVYLKIKNEAWKKSRGKCDFVIVCDVDEFIYHPDMNNFLNHGKTNFSL

SEQ ID NO: 2871 - DNA, 402 bp, Unknown
  Obtained from environmental sample
  misc_feature (1)..(402): n is a, c, g, or t
atgtcccaggcacagaaacaggataaattttggtctaatttaattgaaggtgcaaagaaaagaaccaaaaaaacaatttcaagcccctatcgcatatttaatattaactggttgcaggaaaaatattacaagcacgccacgaaaggtaaagattacaagcatagttataatggtaaggaaatactgtttacagacccccaggcttttttactttctgtccgggagttatttattgaagaaatatataagttcaaaaccagtaatccaaggccggttatcctggattgtggcgcccatatcggcatgagcattttgttttttaaaaacatctatcccgaagcatcaatcatagcttttgagccagacacacataactatgaactcacaaaaaaaaaatcttga

SEQ ID NO: 2872 - protein, 133 aa, Unknown
  Obtained from environmental sample
  misc_feature (1)..(133): Xaa is any amino acid
MSQAQKQDKFWSNLIEGAKKRTKKTISSPYRIFNINWLQEKYYKHATKGKDYKHSYNGKEILFTDPQAFLLSVRELFIEEIYKFKTSNPRPVILDCGAHIGMSILFFKNIYPEASIIAFEPDTHNYELTKKKS

SEQ ID NO: 2873 - DNA, 342 bp, Unknown
  Obtained from environmental sample
  misc_feature (1)..(342): n is a, c, g, or t
ttgcgcattacgttgaacaacaatcaaaggctccttacagaattaacaccagctatacttttcactttacagatacaaaaggaactcaatcagaaacgaggttcaatgtttatgcaaaaaaacgncggatatattccggtacttaatagcctgcttacacccttgatggagcaaaaagcacttgagataattaaaattaatcaggtgcagatatacaggatcgatctgcaaaaggcttttacagttctggagaacgatattttgaacaataaaggaaggaatttgattgattttaatttatctttatatcttaaacagaccattaaaaaaattaccaggtaa

SEQ ID NO: 2874 - protein, 113 aa, Unknown
  Obtained from environmental sample
  misc_feature (1)..(113): Xaa is any amino acid
MRITLNNNQRLLTELTPAILFTLQIQKELNQKRGSMFMQKNXGYIPVLNSLLTPLMEQKALEIIKINQVQIYRIDLQKAFTVLENDILNNKGRNLIDFNLSLYLKQTIKKITR

SEQ ID NO: 2875 - DNA, 636 bp, Unknown
  Obtained from environmental sample
  misc_feature (1)..(636): n is a, c, g, or t
gtgatcattatctacactgaacatagtagtccgcgattaaaatatgcggcggaggtagtttttaatcatatccttaaagtggttattcctgtaaactttactgataatgttggttatttcctttctgtttcgggtgccaagatcaactatagccatcagcagcttgatcatggattacacattgttccatcaggatttttatttcagaataaaataaaggcggagtttcccggaattacagatggccaatacagtaaagctatttttccaacggaaggaagtaaagattttaactatgatcctttagcggctgtattttacatggtaacccgttacgaggaatatctttctcatgataccgatcaatacgatcgttttgctcctgaaaaagtattttcgtttcagcataatttttatttgaaacccatgtgtcattattgggcagaagagatcaaggataaattggttgctaaatttccggattttgaatttcctgagaaaagtttcagagcattggcaaccatcgatgttgacaatggatatgcatatagaggtaaaggaatggtaagaacgtttggagccttcgtaaaggatatcctgcgtttcaaattcaaatcagtcatagaaagggcataa

SEQ ID NO: 2876 - protein, 211 aa, Unknown
  Obtained from environmental sample
  misc_feature (1)..(211): Xaa is any amino acid
MIIIYTEHSSPRLKYAAEVVFNHILKVVIPVNFTDNVGYFLSVSGAKINYSHQQLDHGLHIVPSGFLFQNKIKAEFPGITDGQYSKAIFPTEGSKDFNYDPLAAVFYMVTRYEEYLSHDTDQYDRFAPEKVFSFQHNFYLKPMCHYWAEEIKDKLVAKFPDFEFPEKSFRALATIDVDNGYAYRGKGMVRTFGAFVKDILRFKFKSVIERA

SEQ ID NO: 2877 - DNA, 510 bp, Unknown
  Obtained from environmental sample
  misc_feature (1)..(510): n is a, c, g, or t
ttgtggngtaattgcttaaaatctgtttcatggggttctaagttagggcgtcttgctaaacgtaaaagacnnatcatgaggggttttaagttttttcacctttcaactcaaaattccaatggttttttgtgtcaaaattctttacttgcatacaatatgaaaaagtgccgcagtatttctctttttgcatctattcttgcagtgcttattacttcatgtggagggaaagtaacctctgagaagcttgtgggcaaatggaattatgtcaaggttgagagtcttcaccatttagaagaggatttatcagatgaggaggtagcagaacacgctccgtctataacgttctcaaaagatggggatctagtcattatatggggaaaagaagtgttatntaaaggaaagtttaaagttgaaggagatattatcagatatacagagtctttgccgaatggagtaaccagaccaatcccttatttggtaaaaagcttgatgacaataatcttgtgttga

SEQ ID NO: 2878 - protein, 169 aa, Unknown
  Obtained from environmental sample
  misc_feature (1)..(169): Xaa is any amino acid
MWXNCLKSVSWGSKLGRLAKRKRXIMRGFKFFHLSTQNSNGFLCQNSLLAYNMKKCRSISLFASILAVLITSCGGKVTSEKLVGKWNYVKVESLHHLEEDLSDEEVAEHAPSITFSKDGDLVIIWGKEVLXKGKFKVEGDIIRYTESLPNGVTRPIPYLVKSLMTIILC

SEQ ID NO: 2879 - DNA, 948 bp, Unknown
  Obtained from environmental sample
  misc_feature (1)..(948): n is a, c, g, or t
atgatgttgtgttttgcattggtgcgaatttcaggtcctgtagctatattttatctgcaactgtttaccgggatcaaaaaaattttgcttatttacaaatatcatcggacctgtgatcttctcaatcgcataagacaaatagggatatgggatgaggttattgaaatagacccaaatcaacccgaactatcaaacgattctattctccaggtcttcaataagattaatattttgcatactttctcatgggggtttccagaattcaatgtcctgttttcaaaatgcattgataatgacattaagattattcttacagacgaaggtattggtacctacttaccttctttacgctatgcagcttgggaaggagaacaaaaatcgaataaactttttgcaaaaggctttgacttagcaaagataacagaaatctggctgtttgagcccaatttatatgatgatcgtttaattgcaccgattaaaaagatatctattgatgacttttatactgcttgtctgaaagataaaatagttaccgaagaatataaaaaattatttaattttccttctaactttcattttgattatgacatactttattttaggcaatacttttcctttaacaatgtaatttcgaatgaagcagatgcttttatagaccattgtattgttgaaacaattaaagattacaagtcgtttgtaaaggaccatcttgcaaatcggaacgatcaatatgatgcaaatattaaacagaacaggtcattagatgtaccttgggaagcgttattgatcctgtttaagatcagcaatgagcaaaatctggttaaattaccacgaatttacatatccccgacatcctctgcgatgtttaagacaaacaatttgggtgtgtctggtacttttatttttacacataagttaataagcagactgacagataatcccnggtaa

SEQ ID NO: 2880 - protein, 315 aa, Unknown
  Obtained from environmental sample
  misc_feature (1)..(315): Xaa is any amino acid
MMLCFALVRISGPVAIFYLQLFTGIKKILLIYKYHRTCDLLNRIRQIGIWDEVIEIDPNQPELSNDSILQVFNKINILHTFSWGFPEFNVLFSKCIDNDIKIILTDEGIGTYLPSLRYAAWEGEQKSNKLFAKGFDLAKITEIWLFEPNLYDDRLIAPIKKISIDDFYTACLKDKIVTEEYKKLFNFPSNFHFDYDILYFRQYFSFNNVISNEADAFIDHCIVETIKDYKSFVKDHLANRNDQYDANIKQNRSLDVPWEALLILFKISNEQNLVKLPRIYISPTSSAMFKTNNLGVSGTFIFTHKLISRLTDNPX

SEQ ID NO: 2881 - DNA, 771 bp, Unknown
  Obtained from environmental sample
  misc_feature (1)..(771): n is a, c, g, or t
atgatcttaaacagacgcaaaatgaaactaacacttaacattccccgcttccgggttataatagccaccatcctggcaggtttcctttttttattgccaactacgttagatgcccaggatagtacggttgtcgaagaggcagaagagcccgtaaaacctaaaccggttaaaaataccttccagagcgtttggatcatcgataaccaaaccgtattggtgcctgtaaaaaagacctttgaaatggacattcatcaccggtttggcactgttgaaaatgggtatgaagattttttcggtttctttgcaccttccaatataaggatcgggtttagttatgtacctgtcaataaattgaacgttggcgtaggctttaccaaaaccactgccgccatcataccggaacaggcgccctcatctgtaaacgggccactatgggatgcgaacctgaaatattctatcataacacaaacaaaagggatctacccggtgagtgtttcctattatgtgaataaagcatataatacgaaaaaggacaaggagaaagaaatttacaggaactattccgaccgtataacctatttccatcaattgctgattgcaagaaaggttacagataaattatctgtccaggttgcacccagtatttcacatcaaaatgtagcaaatggttactttacccagctaaacgacaccacattgaaagtgaagtcagatatgaaatttgaccattttgcggttacaacttntgncaaggtatacactgactgttga

SEQ ID NO: 2882 - protein, 256 aa, Unknown
  Obtained from environmental sample
  misc_feature (1)..(256): Xaa is any amino acid
MILNRRKMKLTLNIPRFRVIIATILAGFLFLLPTTLDAQDSTVVEEAEEPVKPKPVKNTFQSVWIIDNQTVLVPVKKTFEMDIHHRFGTVENGYEDFFGFFAPSNIRIGFSYVPVNKLNVGVGFTKTTAAIIPEQAPSSVNGPLWDANLKYSIITQTKGIYPVSVSYYVNKAYNTKKDKEKEIYRNYSDRITYFHQLLIARKVTDKLSVQVAPSISHQNVANGYFTQLNDTTLKVKSDMKFDHFAVTTXXKVYTDC

SEQ ID NO: 2883 - DNA, 456 bp, Unknown
  Obtained from environmental sample
  misc_feature (1)..(456): n is a, c, g, or t
ttgtatcttcgtccggagatcaacatgaaacaactcactttcctcttcttttgtcttttgtctcttggcgtattccagcttcatgctcagaataaagttcaacagaagcttccggaaaaaacgcgcatactgttcctgctcgatggttcgggaagtatggaaggcatttgggaagggaaagaatctcggatggagatcgccaagaagatccttacaaaacttgtcgattcgctgagagcgaatcaaaatcttgagcttgcactccgggtttatggccatcgcttcaaccgcagcgcaaacaactgccaggatactcagcttgaagttcctttcggagcaaagaaccacaatacgattataaacaagctaaaagacatcactccgcgtggcaccactcctatcacgtattctcttcaacaagcatacaagattttccgacagcacctggtatcttaa

SEQ ID NO: 2884 - protein, 151 aa, Unknown
  Obtained from environmental sample
  misc_feature (1)..(151): Xaa is any amino acid
MYLRPEINMKQLTFLFFCLLSLGVFQLHAQNKVQQKLPEKTRILFLLDGSGSMEGIWEGKESRMEIAKKILTKLVDSLRANQNLELALRVYGHRFNRSANNCQDTQLEVPFGAKNHNTIINKLKDITPRGTTPITYSLQQAYKIFRQHLVS

SEQ ID NO: 2885 - DNA, 465 bp, Unknown
  Obtained from environmental sample
  misc_feature (1)..(465): n is a, c, g, or t
ttgcatacagaccctagggcagggttttctcgaaaggaaatcagaatcccaaatcctcttcagcagggcaaattagtcaatttcattgaaaaggtttttcctgaaattattaagatttatggtcaatctgaaatatccctaaccaaacccattcaaaatagttctcaggaactaccgagaagagccgttacgcattcttcctttggagaatttcgtgaaaaatgcgtcctttctgcatatcatatgcatatacagctgaaaaccgatgtttctaaattttatccatcaatctatacccatgcgataccttgggcaaccgaagggaaacaggcttataaaaagaattgggctttgagtgacactaatccccgtaagaaaaaaaacatttatggtgacgaaattgattcacacctaagaaattgtcaatctaagcaaacncaggntattccaatcttgatccactag

SEQ ID NO: 2886 - protein, 154 aa, Unknown
  Obtained from environmental sample
  misc_feature (1)..(154): Xaa is any amino acid
MHTDPRAGFSRKEIRIPNPLQQGKLVNFIEKVFPEIIKIYGQSEISLTKPIQNSSQELPRRAVTHSSFGEFREKCVLSAYHMHIQLKTDVSKFYPSIYTHAIPWATEGKQAYKKNWALSDTNPRKKKNIYGDEIDSHLRNCQSKQTQXIPILIH

SEQ ID NO: 2887 - DNA, 357 bp, Unknown
  Obtained from environmental sample
  misc_feature (1)..(357): n is a, c, g, or t
ttggagagtaagaacaaggctggaggcgttttctatacctacgtacaagttccaataaaaggcggtccaaattggatttatctagagtatggcatattttctgagattgcccctttccaaaaatccgtagatacgggcgtttattcaatgataagttgcaaaggattgaaggacaggaaaaagtattactccgaaaaatattttagcaccaaaaaattatcagacaagagtcatttaataaataaaattgaatcttgtatcggcgaatcatttcgaatttcgttaaatgatatgattaaggacagaaaattgatccgaaaattcagggacagcattttgaatgaaatcaaagcatga

SEQ ID NO: 2888 - protein, 118 aa, Unknown
  Obtained from environmental sample
  misc_feature (1)..(118): Xaa is any amino acid
MESKNKAGGVFYTYVQVPIKGGPNWIYLEYGIFSEIAPFQKSVDTGVYSMISCKGLKDRKKYYSEKYFSTKKLSDKSHLINKIESCIGESFRISLNDMIKDRKLIRKFRDSILNEIKA

SEQ ID NO: 2889 - DNA, 366 bp, Unknown
  Obtained from environmental sample
  misc_feature (1)..(366): n is a, c, g, or t
ttgagtgtttatataaattcttttaagcctaatatagaattaacttgctatattggttgggtaaatgcttgtgaaactagtaagataatgttacctcgctcccttttagatactgcgaccctctttaaaatattaaataatcaaaatgtaattttaaagaagctcgctctatgtattaacgcacataatcttcctattgatatttgctataatatatatacttaccttgtatctgaagactgtacaatattaccttgtgaagtttttaaacccattatgagacatttggaaactgaattcctaaaagaaggcgaaactcctgggcagaaaaaaatctcaatgcaaacattatcgacaagcagttaa

SEQ ID NO: 2890 - protein, 121 aa, Unknown
  Obtained from environmental sample
  misc_feature (1)..(121): Xaa is any amino acid
MSVYINSFKPNIELTCYIGWVNACETSKIMLPRSLLDTATLFKILNNQNVILKKLALCINAHNLPIDICYNIYTYLVSEDCTILPCEVFKPIMRHLETEFLKEGETPGQKKISMQTLSTSS

SEQ ID NO: 2891 - DNA, 507 bp, Unknown
  Obtained from environmental sample
  misc_feature (1)..(507): n is a, c, g, or t
ttgctaaatggaaagatatcccagaggcatcatttactcttattgatatttcggaaaaaatgctctatatggcaaaagaaaggttcaaaagtaattgctaaagtaaaatatattgcagcagattattcaaaatacaattttacggacaaatacgatatggtagtttcggctctttctatccatcatctggaagacgaagagaaacgggagctctacaaaagaagttattccatccttaaagagaacgggatttttattaatgcggaccaggtacatggagaaacccctttcatagataacttgaataaggcgacctggagacagtatgtcgaaaatagcggcttgaccgaagaggagataaaggctggttatgaaagaacaaagctcgataaagatataaaattggaccagcagcttgactggcttaaaaaggcaggtttttgcgatgtgaactgtatatataaatattatcagtttgcagtgatgtttgggagaaaaagggcataa

SEQ ID NO: 2892 - protein, 168 aa, Unknown
  Obtained from environmental sample
  misc_feature (1)..(168): Xaa is any amino acid
MLNGKISQRHHLLLLIFRKKCSIWQKKGSKVIAKVKYIAADYSKYNFTDKYDMVVSALSIHHLEDEEKRELYKRSYSILKENGIFINADQVHGETPFIDNLNKATWRQYVENSGLTEEEIKAGYERTKLDKDIKLDQQLDWLKKAGFCDVNCIYKYYQFAVMFGRKRA

SEQ ID NO: 2893 - DNA, 480 bp, Unknown
  Obtained from environmental sample
  misc_feature (1)..(480): n is a, c, g, or t
ttgcacgcagaaccatgcggtgtcagaattaagaatcaattactaaacaaacccttcattttgttatcttgcatttttgtggataacttcggtaagatcacgtcactgcttcccaaaaaccctgtgaatgatctaaaaactctctggacccaaattcttggagaaatcgaggttgaaattggcaaaagtaatttcaaccttttcttcaaaaacagtcaactactgtcatttgacggtggtgtcgccaaacttggtttcaccaacaaggccatcgcacttcaaaccagtcagcgctactatgctctggttcaagccgttcttgaaagacaatcgagttccgaaagagtcagcctcctatttgaatcagtcgataaacctattattgaaaaacaggagtccccagcaaatgacgatcttggaccactaatttgcttctccanaaagatcanaaccnngaagatttacnagtttgccccttaa

SEQ ID NO: 2894 - protein, 159 aa, Unknown
  Obtained from environmental sample
  misc_feature (1)..(159): Xaa is any amino acid
MHAEPCGVRIKNQLLNKPFILLSCIFVDNFGKITSLLPKNPVNDLKTLWTQILGEIEVEIGKSNFNLFFKNSQLLSFDGGVAKLGFTNKAIALQTSQRYYALVQAVLERQSSSERVSLLFESVDKPIIEKQESPANDDLGPLICFSXKIXTXKIYXFAP

SEQ ID NO: 2895 - DNA, 354 bp, Unknown
  Obtained from environmental sample
  misc_feature (1)..(354): n is a, c, g, or t
gtgatcgatcatttggcaaaacccaatattaaagatggtaagacagaagagtggaaaaaagatatggaagcgatcggcaattttgaaaatgtttattgcaaaatatccggtatggtaacagaagcagattggaaaaactggatgactaaagatttctttccttatttagacacagttataaattcatttggttccaataaaataatgtatggttctgactggcctgtatgtttggttgctgcttcttatgaacaagctctaaatattgtacgcgaatatttttcttctttttcaaaaaacgaacaagacttattttttggtggtaatgctgttaaattctataatcttaattaa

SEQ ID NO: 2896 - protein, 117 aa, Unknown
  Obtained from environmental sample
  misc_feature (1)..(117): Xaa is any amino acid
MIDHLAKPNIKDGKTEEWKKDMEAIGNFENVYCKISGMVTEADWKNWMTKDFFPYLDTVINSFGSNKIMYGSDWPVCLVAASYEQALNIVREYFSSFSKNEQDLFFGGNAVKFYNLN

SEQ ID NO: 2897 - DNA, 795 bp, Unknown
  Obtained from environmental sample
  misc_feature (1)..(795): n is a, c, g, or t
ttgatcctttcttttgtgaaatatgaattgagttttgatgatttcaattcgaaaaaagatcgaatccaccgcattaattatgatgtgacgatgggaggcagtcaaaccatttccccgtcagtaccggtttttgttgggcctacacttaaaagtaaatttcctgaagttgaagaggtaacacgctttttgcctgaatggagtttcggagcaatacgccatggtgatgttttgtttgatgagaaaatctgctatgcagattctaattttttcaaggtattcgattttaaatcaatagaaggcaatctgcaaacagcattgaacaagcccaatacgcttgtcatcacaaaaggtatggcgaagaaatatttcgggagtaaaggtccgataggccaaacattgttattcgacaataaaaaagagcttacagtagctgctgtaatggaaaatgttccctcgaactctcatttcagttttgattttctaacttctctttacagtattaaaggcacagacagcctggaaacgcaggtggtttggaacaaccctaattacagcacctatcttttattaaagcccggaacgaacattcatgttctttcaaaaaaaattgataattgggttaatcctccggatgaaggcaatcattcagcttcgcaaaattcacttcacttaaaatggagccgcttaaggatgttcattttaatacagaggtatctaattacaaaaattattttgctattactgattttaaatacgtccacatctttatcacgattgctattcttgtattgctaa

SEQ ID NO: 2898 - protein, 264 aa, Unknown
  Obtained from environmental sample
  misc_feature (1)..(264): Xaa is any amino acid
MILSFVKYELSFDDFNSKKDRIHRINYDVTMGGSQTISPSVPVFVGPTLKSKFPEVEEVTRFLPEWSFGAIRHGDVLFDEKICYADSNFFKVFDFKSIEGNLQTALNKPNTLVITKGMAKKYFGSKGPIGQTLLFDNKKELTVAAVMENVPSNSHFSFDFLTSLYSIKGTDSLETQVVWNNPNYSTYLLLKPGTNIHVLSKKIDNWVNPPDEGNHSASQNSLHLKWSRLRMFILIQRYLITKIILLLLILNTSTSLSRLLFLYC

SEQ ID NO: 2899 - DNA, 309 bp, Unknown
  Obtained from environmental sample
  misc_feature (1)..(309): n is a, c, g, or t
gtgaattggccaggtattctgcctgagattaaaattgtatatatgtccacttcaaaaaatgaacacctgttgttgattgaaaaagttttattacttaaatcactcagcatattttcagatacacctgaaaatgtactggccgaccttgctccattgatgcaggaaatggaactggaagaagggacagtgattttccaggagggagacctgggcgatagtatgtacatcattcaccagggggagatagaaatttataaatcaaaaaccacgcttgccattttaaaggacaaagaagtttcggagaacttc

SEQ ID NO: 2900 - protein, 103 aa, Unknown
  Obtained from environmental sample
  misc_feature (1)..(103): Xaa is any amino acid
MNWPGILPEIKIVYMSTSKNEHLLLIEKVLLLKSLSIFSDTPENVLADLAPLMQEMELEEGTVIFQEGDLGDSMYIIHQGEIEIYKSKTTLAILKDKEVSENF

SEQ ID NO: 2901 - DNA, 756 bp, Unknown
  Obtained from environmental sample
  misc_feature (1)..(756): n is a, c, g, or t
atgttattcgattcagcatttcagctgaaacacaaacaaactattacggtagatacacttaaaatctacaatttcaaagcaataaatgattctgttattttagttcatgaaaccgcaaagcaaatattacctgaactaaaaaaaaaggccagggtggagtacaactctacagattcaacatcaagaacagtagtgaattgggatatcgacttgccaaaacgtccaaaagaattactgcttcacagattgaatatttctacgggaaatattcaatctgtgaagcttcgttcagatgattcgtattatatgggtacgcagcccctgatttccgaaaataaaaatgtttttgttttaaaccggatgtcacttattgaaagcgggctggaaatgtttgagcggactgaatattgttatttaatgaagatcgatcaggattttaaaccaagcgtctatcttcccttatcaagccctgtattggaagattctttaaaattaaaaaccggtgatgggtttagaactatttataccggcttcaataatcttaataacatcgtttgtattgatctggcccggaagcgttcgggtgaatatttgataagaacctctctcatcgattctgcattgaaagaaatgaaatcctcttattttactcttggtaaagaaatttcttcattgagtttgcctgcaatagaacttggaaataaggtaacagtattaaacaaaangcgtgttcagcaatcgatatatgctatacan

SEQ ID NO: 2902 - protein, 252 aa, Unknown
  Obtained from environmental sample
  misc_feature (1)..(252): Xaa is any amino acid
MLFDSAFQLKHKQTITVDTLKIYNFKAINDSVILVHETAKQILPELKKKARVEYNSTDSTSRTVVNWDIDLPKRPKELLLHRLNISTGNIQSVKLRSDDSYYMGTQPLISENKNVFVLNRMSLIESGLEMFERTEYCYLMKIDQDFKPSVYLPLSSPVLEDSLKLKTGDGFRTIYTGFNNLNNIVCIDLARKRSGEYLIRTSLIDSALKEMKSSYFTLGKEISSLSLPAIELGNKVTVLNKXRVQQSIYAIX

SEQ ID NO: 2903 - DNA, 750 bp, Unknown
  Obtained from environmental sample
  misc_feature (1)..(750): n is a, c, g, or t
atgaaggttataggatcaatatcgaagtcccagcaaaaccaatcacacatgagcaagatcaccatagccatagctgacgattacaagatctaccgggaaggtctcaaagtaggcctctcttccgatgagaatcttgatgtggtcatggaagccgacaatggggaagacctgttaaaggctatggaatccctgcagcccgatgttatcatcatggacctgaagatgccgatcatggatggcatggaagcaaccaaagaggtacgtaaaaaattcccgcaggtgaaagttctcgtggtcaccatgtacgaagatgataaattcatcatccacctgatggagataggcgctaatggctacctgcttaaaaatgccgaaccagacgagatccgtaagtccatttacgcagtacatgaaaacggatactatttcaatgatgtggtcaataaagctttactcaagaagctggtactgaaaaataacctgaagccttcttttaaccagaacgtcgaattgaccgagcgggaaatggaagtgctgaaacttatttgcgaagaaaaaacggcggcagagatcgcgaagcagatattcttaagtccgcggtccgtggaaggcatccgccagagattactagaacaagttggtgtgaggactacagcgggcctggtaatgttcgcattaaaagcgggatcgttgattgcaatgtctcctgagaaaactattcaattctccagctatctgctgtctccgggn

SEQ ID NO: 2904 - protein, 250 aa, Unknown
  Obtained from environmental sample
  DOMAIN (168)...(225): Bacterial regulatory proteins, luxR family
  misc_feature (1)..(250): Xaa is any amino acid
MKVIGSISKSQQNQSHMSKITIAIADDYKIYREGLKVGLSSDENLDVVMEADNGEDLLKAMESLQPDVIIMDLKMPIMDGMEATKEVRKKFPQVKVLVVTMYEDDKFIIHLMEIGANGYLLKNAEPDEIRKSIYAVHENGYYFNDVVNKALLKKLVLKNNLKPSFNQNVELTEREMEVLKLICEEKTAAEIAKQIFLSPRSVEGIRQRLLEQVGVRTTAGLVMFALKAGSLIAMSPEKTIQFSSYLLSPG

SEQ ID NO: 2905 - DNA, 777 bp, Unknown
  Obtained from environmental sample
  misc_feature (1)..(777): n is a, c, g, or t
gtgataatattagcgaggaagaactgctttttcatgttaaaaactgccgggaaacaggggatcatcgaaaaagaggaaagtcaggtccaccagaatctttttcattttactgaccaaacggcaaaatccttaatgaccaaccgccacgatgtggaatggatcaattattctgacaatgccaaaactatctcagagaaactgaaggaaagtgttcattcaaaattcatcgtatgtgacggagaaattgataacatcaaaggtgttctgacggctaaagttttttttgaagcttataaaagcaaggattttaccctggatgaattaatgaccccaccgatctttatcacccagaacactctggcttttgagatcctgaatattttcaaaataaggaaacaatatattggcgttgtggttgatgagcatggccgcatcaaaggagtggtcactcttcacgacctgatagaagccattgtaggtgatctgccggatgaagatgagagtgatgaagcatatatatttaaaagggatgatggctcatatctgatcgatggacgtacgttgatctatgaactcaatcaatattttcaaagagaagtgatcccaaataacatttcccagtatacaaccatttccggcttcatactggatgaattgaggcggatccctaattcgggcgataaggtaagcttgccaaattttgaacttgagatcatggacatggatgggatccgtatcgataagatcctgatgaccaaaaggccgaagcctaattga

SEQ ID NO: 2906 - protein, 258 aa, Unknown
  Obtained from environmental sample
  DOMAIN (174)...(255): Transporter associated domain
  misc_feature (1)..(258): Xaa is any amino acid
MIILARKNCFFMLKTAGKQGIIEKEESQVHQNLFHFTDQTAKSLMTNRHDVEWINYSDNAKTISEKLKESVHSKFIVCDGEIDNIKGVLTAKVFFEAYKSKDFTLDELMTPPIFITQNTLAFEILNIFKIRKQYIGVVVDEHGRIKGVVTLHDLIEAIVGDLPDEDESDEAYIFKRDDGSYLIDGRTLIYELNQYFQREVIPNNISQYTTISGFILDELRRIPNSGDKVSLPNFELEIMDMDGIRIDKILMTKRPKPN

SEQ ID NO: 2907 - DNA, 417 bp, Unknown
  Obtained from environmental sample
  misc_feature (1)..(417): n is a, c, g, or t
ttgaaaaatcctgtaggcgttcacccttttatgatacagacggtcaggtcttttgctgaatcggattatatgtatgcacaaggcagaacaaggccggggtctataatcagctatgcaaagggcgggcaatcgtatcacaactacggattggcgttagacttcgttaatctgataggcggtaaaatggtttggcctaaacgtcctgaacttgacgaaaactggatgattgtcgtaaacatttttaaatcatacggtttcgaggcaggtattgattggaaaggtaaaaaacgtgatgcgccacattttcaaaaaacttttggccttcattggagcgaattacttgcgctgcataatgccggaaagattgaaggcgactatgtgaaaataaatttaaacccttctaatatagtttcctga

SEQ ID NO: 2908 - protein, 138 aa, Unknown
  Obtained from environmental sample
  misc_feature (1)..(138): Xaa is any amino acid
MKNPVGVHPFMIQTVRSFAESDYMYAQGRTRPGSIISYAKGGQSYHNYGLALDFVNLIGGKMVWPKRPELDENWMIVVNIFKSYGFEAGIDWKGKKRDAPHFQKTFGLHWSELLALHNAGKIEGDYVKINLNPSNIVS

SEQ ID NO: 2909 - DNA, 600 bp, Unknown
  Obtained from environmental sample
  misc_feature (1)..(600): n is a, c, g, or t
ttgaatcaagtttttgagatactaaggcagacaagggagaataaaggctggaacaaaagccaaatggctgatgaattaggcatatccagccagctttacggccaatatgagaccgggaagaagaaacctgtaaccacattttttttaaaatggaagcaaaagtttggcattgatctgttaacaggtggcgtggatttgaaaaaccaggtttataaatgtgatataaggaaaggcaaacagcaccgggaagtattaagaaccattaaaacaatagcccttcctttttgggaagaagtattggaagatagtaatccggaagattatgttttcagtaaaggattaagacccggccccatacaaataagagctgaccaaattactaagcgttggtataagtatgtaaaaaaaccattaggaataaccgcagatttctacagtttaaaacacgtaaacagttctgaaatggtggatatattgagcgaacatgatgctgctaaattaatggggcatacaacaacaggcatggttcgcaaaatttatgataccaaaagagaagataggcaacatacaagaattaacgatgttgggaataagttttaa

SEQ ID NO: 2910 - protein, 199 aa, Unknown
  Obtained from environmental sample
  DOMAIN (8)...(62): Helix-turn-helix
  misc_feature (1)..(199): Xaa is any amino acid
MNQVFEILRQTRENKGWNKSQMADELGISSQLYGQYETGKKKPVTTFFLKWKQKFGIDLLTGGVDLKNQVYKCDIRKGKQHREVLRTIKTIALPFWEEVLEDSNPEDYVFSKGLRPGPIQIRADQITKRWYKYVKKPLGITADFYSLKHVNSSEMVDILSEHDAAKLMGHTTTGMVRKIYDTKREDRQHTRINDVGNKF

SEQ ID NO: 2911 - DNA, 411 bp, Unknown
  Obtained from environmental sample
  misc_feature (1)..(411): n is a, c, g, or t
atgttattaaacatacatgataatttactgctggaagatatccaggatcatttttcaaagagcttcccatctttaaaaattgaattttatcgtcaccctcataaatggaaaaaaggttctatgcaacaagaccagattgatgccacaatgaaggtggcagatatcaggaaaaagcatgatcctggtgtattggaaataaaatccacacacacaaccggccatgtagaatctatgtttaaagatcgctttggtctgaatgtgcagatattcaggaaagggaaaaattgctggatacaaacaatcacaacggataattatagcttgcaacaacaagctgaattttcgaatacggataatgtttctctttctccaaccataggtcaggaagcagacgagtacgattccatttag

SEQ ID NO: 2912 - protein, 136 aa, Unknown
  Obtained from environmental sample
  misc_feature (1)..(136): Xaa is any amino acid
MLLNIHDNLLLEDIQDHFSKSFPSLKIEFYRHPHKWKKGSMQQDQIDATMKVADIRKKHDPGVLEIKSTHTTGHVESMFKDRFGLNVQIFRKGKNCWIQTITTDNYSLQQQAEFSNTDNVSLSPTIGQEADEYDSI

SEQ ID NO: 2913 - DNA, 546 bp, Unknown
  Obtained from environmental sample
  misc_feature (1)..(546): n is a, c, g, or t
atgaaaaaatacgatgagaaaaatgggatggaaacccttgtccctcaagaggtaattgaagtaacaggggccagggaacataatttaaagaacataaatattgttattccaaaaaataagttggttgttattacgggcattagcggaagcggcaaatcttcgcttgcatttgatactatttatgccgaaggccaacggcggtatatggaaacatttggagcatatgcccgccaatttattggtgaaatggaacggccggatgtggaccagatcaccggactgtcgcctgttatttccattgaacaaaaaaccacgaataaaaatccccgttcaacagtaggtaccgtaacagaagtatatgatttcttgcgtctcttgtttgccagggcaagcgaggcatactcctataacacaggtaagaaaatggttaagtggagtgaggacgaaattgtgaacaatatttttaaaaaatttggagggctgaaaattagtttattggnccctttggtaagaggaagaaaagcgacattacagagagttgtttga

SEQ ID NO: 2914 - protein, 181 aa, Unknown
  Obtained from environmental sample
  misc_feature (1)..(181): Xaa is any amino acid
MKKYDEKNGMETLVPQEVIEVTGAREHNLKNINIVIPKNKLVVITGISGSGKSSLAFDTIYAEGQRRYMETFGAYARQFIGEMERPDVDQITGLSPVISIEQKTTNKNPRSTVGTVTEVYDFLRLLFARASEAYSYNTGKKMVKWSEDEIVNNIFKKFGGLKISLLXPLVRGRKATLQRVV

SEQ ID NO: 2915 - DNA, 654 bp, Unknown
  Obtained from environmental sample
  misc_feature (1)..(654): n is a, c, g, or t
gtgttagatggtgatggacatacgtataccaccgaatctgggcgaggggttggtattaacataataagtgcgtcattatcatttcttgaacagttaaaaataatgattgaaagcaatattaacgttaatgttaaaatatatgataatgacggcaaaatatcaactagcaatttaatcataactacaatttctgatactacgaaatttttagattggatttacgaagacgcagggtactacctcaacagaaaatatcaaaaatatttggatattaaaaataaagttaatcatacgtatttcaaattaaatgatcagatcgagttggttaaaaaattatatgatgaaggattagggactagaaaaatagctaagatacttggagtaagcaggagtgcgattacgaccgcgcttaaaaaaatgaaaattcatgacccgactagaaaacaggcacgaacggtgtatctgcgtacctcatatgtgtgcaaaaattgtcatcaacatttgtctatagataaatttagaaaaaggatcagaggtgaccgaattagctacgaaactagatgttttgagtgtgagtcggctaaaaataaagaactatgcgctaaaagatatgcgattacaaaattgtgtaaaataagtaataatgcagtataa

SEQ ID NO: 2916 - protein, 217 aa, Unknown
  Obtained from environmental sample
  misc_feature (1)..(217): Xaa is any amino acid
MLDGDGHTYTTESGRGVGINIISASLSFLEQLKIMIESNINVNVKIYDNDGKISTSNLIITTISDTTKFLDWIYEDAGYYLNRKYQKYLDIKNKVNHTYFKLNDQIELVKKLYDEGLGTRKIAKILGVSRSAITTALKKMKIHDPTRKQARTVYLRTSYVCKNCHQHLSIDKFRKRIRGDRISYETRCFECESAKNKELCAKRYAITKLCKISNNAV

SEQ ID NO: 2917 - DNA, 564 bp, Unknown
  Obtained from environmental sample
  misc_feature (1)..(564): n is a, c, g, or t
ttggaagaagcaatgctcaggaaaactctttctgataacttacttatatcatacacggaaaacttgaaacaaaatcggctgaatgagcaganacagttttttggaatgctaaacaaaaactttatcagccgattgaaaagaaagcacaaagtgattcttccatttctttccgaaatcgattctaaaaaagcaaataaatatattgataaaagtaaaaataacattaaaaagctgcttaaccagggaaccataaaaaagcgccagcttcatgaacttcgcaagcgattgaaaattcttgattataatataaagagtcttacatcaggaaataagaaaagccttgcaaagaaaagtgttctgcctgttctgttaggcaaatggcacgataaccaggtcatgcttgctcatcttaacaaggaaataaagtcacggaaaattaatctaaaagagatccattatcttgaaaaagtaagaatgaaaatatcttccggcaatgaggtgttattgaataaaataaattatgctatacgcacttcagaatatttgcagaaattaaatcagtga

SEQ ID NO: 2918 - protein, 187 aa, Unknown
  Obtained from environmental sample
  misc_feature (1)..(187): Xaa is any amino acid
MEEAMLRKTLSDNLLISYTENLKQNRLNEQXQFFGMLNKNFISRLKRKHKVILPFLSEIDSKKANKYIDKSKNNIKKLLNQGTIKKRQLHELRKRLKILDYNIKSLTSGNKKSLAKKSVLPVLLGKWHDNQVMLAHLNKEIKSRKINLKEIHYLEKVRMKISSGNEVLLNKINYAIRTSEYLQKLNQ

SEQ ID NO: 2919 - DNA, 627 bp, Unknown
  Obtained from environmental sample
  misc_feature (1)..(627): n is a, c, g, or t
ttgattctttggataggagctatgattaatgctcctttattaattgactaccttgatgatgaaagtaaaaaagattttgaaatagtaaaagaggcattgactaaagctgagataccctatgaaattgatccccggcttgtaaggggattggattattatactaaaactacttttgaaattgttagtggaaaagtaggttcccagagtgccttatgcggcggcggtagatacgatttgcttgttcaggagcttggaggtaaacccactccgggagtaggttttgcagcgggtattgagcgaatacttttagcatgtgaaaatgagaaatctctaaacctggctgaagataagattgatctgtacataataaaacttgataaggagcttactcaaaaagtttttgaaattgctttggactgcagaagaaaaaatatatctgctgaatttgattactttgacaggagtgtaaaagcacaaatgagagaggctaataagtttaatgcaaagtatgttctttttgtcggcggtgatgagtataaagcgggtaatttaaatctgaaaaatatgtcaacgggagaacaagtcccggttccgttagataattttgatgtgttacatttattataa

SEQ ID NO: 2920 - protein, 208 aa, Unknown
  Obtained from environmental sample
  DOMAIN (119)...(207): Anticodon binding domain
  misc_feature (1)..(208): Xaa is any amino acid
MILWIGAMINAPLLIDYLDDESKKDFEIVKEALTKAEIPYEIDPRLVRGLDYYTKTTFEIVSGKVGSQSALCGGGRYDLLVQELGGKPTPGVGFAAGIERILLACENEKSLNLAEDKIDLYIIKLDKELTQKVFEIALDCRRKNISAEFDYFDRSVKAQMREANKFNAKYVLFVGGDEYKAGNLNLKNMSTGEQVPVPLDNFDVLHLL

SEQ ID NO: 2921 - DNA, 987 bp, Unknown
  Obtained from environmental sample
  misc_feature (1)..(987): n is a, c, g, or t
atgaaagtctattatgttaccgatcaaaatttttctgtagtaacaaaagagcaaaacggcccgggtaaaattattagccgtatggtaattacacctaatggaactggctatggtatcagtaacgacggtactgaatttgtacagtttactacgggcaaagaacccaggntgacacaactaggctctttaatagatgctccggaaaataagaccatttcagttcacaacagttgcaccagttatggaggagatatcataagcgatgaaaaaggtaacctggttttattaaccggagtaaatcacatatttaaaattaatcctgaaacaaagctggccacttacaacgggtacatacaagggctgcccaagaattttactaccaatgccgcagtggttaatggcgatgggcagttattgttaagcagtgccataggtaatgtttctaattatctgctagatataaaaactttaaaagccagcgcatttcaaacaaatagtattgcttatcatacctcggatcttgccaatagcaattatttaaccaccaacaaaggtccaaagactataggtagtttacaggcattaaaatccaggttgtcaaaccagattcatatatatcccaatccgatttttgaagattctaaatttaatattgaattcaagggattaaaagctggccaatatttagtggagctcgtggatattgccgggcaaccaggttttcaaaggaagattagcattctttcaaaaacaaacacgcaaaactattcttttaatcctgttattggcaaaggattgtatttggtacgtgtagtgagcatagataaaaagcaatcgtcgaacaaaactaattgttccttaatttttatcgtaaaaattctggcgtatcaatggtgcttcagcatatcatcactttaccaagctaacttgcgcatagaaattgcgaaacattgtgaccgtagaattggtgcaggctgcggacgttaa

SEQ ID NO: 2922 - protein, 328 aa, Unknown
  Obtained from environmental sample
  misc_feature (1)..(328): Xaa is any amino acid
MKVYYVTDQNFSVVTKEQNGPGKIISRMVITPNGTGYGISNDGTEFVQFTTGKEPRXTQLGSLIDAPENKTISVHNSCTSYGGDIISDEKGNLVLLTGVNHIFKINPETKLATYNGYIQGLPKNFTTNAAVVNGDGQLLLSSAIGNVSNYLLDIKTLKASAFQTNSIAYHTSDLANSNYLTTNKGPKTIGSLQALKSRLSNQIHIYPNPIFEDSKFNIEFKGLKAGQYLVELVDIAGQPGFQRKISILSKTNTQNYSFNPVIGKGLYLVRVVSIDKKQSSNKTNCSLIFIVKILAYQWCFSISSLYQANLRIEIAKHCDRRIGAGCGR

SEQ ID NO: 2923 - DNA, 834 bp, Unknown
  Obtained from environmental sample
  misc_feature (1)..(834): n is a, c, g, or t
atggacctgcttcatttgcggtatcataaaacgtgttggcagaaaatggtgagaatggaagtgataacaatcgtacaggtcgcaatggaaaagatattgtgttggaagtgcccttgggtactattgcctttgatgaagaaacaggtgagaaagaagttgaagttttggaacatgacccaagaaattgtttggttgcctgncggtaaaggtggattgggcaatacaaattgtaaaacggcaactaaccaggcccctgaatatgcacaaccaggcttaccaggcattgaaggctggaaagtattagagcttaaagtattggcagacgtgggcttggtaggatttcccaatgccgggaaatcaacattactttcggtaattacggctgcaaaaccaaagattgcagattatgcttttactaccatcactcccaatttaggtatcgtggaatacagggatggaaagagtttttgtattgcagatcttcctggaataattgaaggcgctgctgaaggcaaagggttagggcatcggtttcttcgccacattgaacgaaattctattttgctttttcttattccatccgatagccaggattataaaaaagaatttgacatcctaaaaaatgaattggcagaattcaatcctgagctattgcaaaaacaattcataatcgccatcagcaaatctgatatgctggatgaagagttgatcaaagacataaaaaaagaactgccaaaaacttacccgcatatttttatttcatcactaaccaataaaaatattgcccaactcaaagatttaatctggaagactttgaatgaagagatcgcttaa

SEQ ID NO: 2924 - protein, 277 aa, Unknown
  Obtained from environmental sample
  DOMAIN (10)...(232): GTP1/OBG family
  misc_feature (1)..(277): Xaa is any amino acid
MDLLHLRYHKTCWQKMVRMEVITIVQVAMEKILCWKCPWVLLPLMKKQVRKKLKFWNMTQEIVWLPXGKGGLGNTNCKTATNQAPEYAQPGLPGIEGWKVLELKVLADVGLVGFPNAGKSTLLSVITAAKPKIADYAFTTITPNLGIVEYRDGKSFCIADLPGIIEGAAEGKGLGHRFLRHIERNSILLFLIPSDSQDYKKEFDILKNELAEFNPELLQKQFIIAISKSDMLDEELIKDIKKELPKTYPHIFISSLTNKNIAQLKDLIWKTLNEEIA

SEQ ID NO: 2925 - DNA, 558 bp, Unknown
  Obtained from environmental sample
  misc_feature (1)..(558): n is a, c, g, or t
atgaaccgatttcaaaagcattatgtagtaacaggagggggcggttttattggcagccaggtaataaaagaattattaaaagatgatacgataaagatcacctgcattgataattttgatccattttataagcggcagctaaaactgttgaaccttgctggttttgaaaaaacccataatttttttcttttagatattgatctttccagagtttccataaagcaactacatgacgctgttagccaaccggtagatgtaatcatccatcttgctgccaaagctggagtaaggcccagcattgccaatccagttgcttatgtagaaacaaatattttgggcacgcaaacactattggattttgccgttcagaaaaaagtaaaaaagtttgtttttgcttcttccagtagtgtatatggcataaatgaaaattttccgtggaaagaagatgaattgctgatgccgatcagcccttatgccatgaccaaacttccgggtgacatggctgcactgtttacactaaattataccagcttccatttatcgccttgcgtcttttaa

SEQ ID NO: 2926 - protein, 185 aa, Unknown
  Obtained from environmental sample
  DOMAIN (8)...(183): NAD dependent epimerase/dehydratase family
  misc_feature (1)..(185): Xaa is any amino acid
MNRFQKHYVVTGGGGFIGSQVIKELLKDDTIKITCIDNFDPFYKRQLKLLNLAGFEKTHNFFLLDIDLSRVSIKQLHDAVSQPVDVIIHLAAKAGVRPSIANPVAYVETNILGTQTLLDFAVQKKVKKFVFASSSSVYGINENFPWKEDELLMPISPYAMTKLPGDMAALFTLNYTSFHLSPCVF

SEQ ID NO: 2927 - DNA, 465 bp, Unknown
  Obtained from environmental sample
  misc_feature (1)..(465): n is a, c, g, or t
atgttaaaaaatatttcaatcttttcaattttatttattctattaataaatgcttcaaatgcccagttaattagtaaaaaagagttccgtttaaaggaatccagaatacacagcatagagctgattaaagattacaaacatacttcaaaaagttctgtttcaaaaaataaaagtcctttactggctgggaccctatcgttcatagtgccgggtgctgcattaggtcagttttacaaagaagaatacattaatggtggtatcagggttgggatttcggcaatatgtatagtttggtttttcgtctcacctacatttgattttggtggtggtggcgatgcttcgcaaaaatttttggcaacattgctatatactgctaactggttagtttccgtaattgatgcaattataccggctaagttttcaataacaaatataggaaaaactttcactcgttttgacttttaa

SEQ ID NO: 2928 - protein, 154 aa, Unknown
  Obtained from environmental sample
  SIGNAL (1)...(18)
  misc_feature (1)..(154): Xaa is any amino acid
MLKNISIFSILFILLINASNAQLISKKEFRLKESRIHSIELIKDYKHTSKSSVSKNKSPLLAGTLSFIVPGAALGQFYKEEYINGGIRVGISAICIVWFFVSPTFDFGGGGDASQKFLATLLYTANWLVSVIDAIIPAKFSITNIGKTFTRFDF

SEQ ID NO: 2929 - DNA, 630 bp, Unknown
  Obtained from environmental sample
  misc_feature (1)..(630): n is a, c, g, or t
ttgggaatgagaaaaagattggaaaatttagaacagccgcttttgaatttttttaaaaagatatttttcggctcttttctgatatttttattaactctcacggcatttacacaagaattgcccgataaaatccgcggctacaaagttcataaagaaaaaattttgatccaggacgaaccggaagcgagccgaaaaaataaaaatgtctatgtcgaagtaaaattggagaatcccgaattagcggattttaccgcgctcggcttgaaactcgaactgggcggcgaaatcacgattttcggacaaagcggggcggttgattttatttcattcaaggattttcaagttaacggaatcgccgttgaaattgaagaatatcaggaaacttttgaatttaagaaaaatagtcctttcaaattggaaaagccggtcgaaatgtttatcagcacggcgcaaactttgcgcggcgcctggaaggaagtaaaagattccaaagatgaatggctggtcacgggaaagatttttgttttcgggcggttcaaaaagctggggttcgatttcaagcgcgttgttcccgtcgaattgaaaatcaaaattccaaacccgataaatccaagtaaatatcattcttga

SEQ ID NO: 2930 - protein, 209 aa, Unknown
  Obtained from environmental sample
  misc_feature (1)..(209): Xaa is any amino acid
MGMRKRLENLEQPLLNFFKKIFFGSFLIFLLTLTAFTQELPDKIRGYKVHKEKILIQDEPEASRKNKNVYVEVKLENPELADFTALGLKLELGGEITIFGQSGAVDFISFKDFQVNGIAVEIEEYQETFEFKKNSPFKLEKPVEMFISTAQTLRGAWKEVKDSKDEWLVTGKIFVFGRFKKLGFDFKRVVPVELKIKIPNPINPSKYHS

SEQ ID NO: 2931 - DNA, 771 bp, Unknown
  Obtained from environmental sample
  misc_feature (1)..(771): n is a, c, g, or t
ttgacggtgtttccgattattaccgagccgattcggagcaaaataagttcaaaaatagtttcgacaggcattgcagacttaaacgaaatgctaggtaaaaaaggttattacgcgggaagcagcgttcttatatccggcacagccggtacaggcaaaacgagtatagcagcttcttttgcgttcgatgtttgtaaagaaaatgtgcaatgtctttattgtgcctttgaagaagcacccaaccaggtaatcagaaatatgcggtccattgggatcaatttagaaccgttggttagttctggccgattacttttctattcctcacgtcctactttacaaaatcttgaattgcattttattgctattaagaataaaataaaaaaaatcaagcctcttgttgtcattcttgatccgattacaaatctaatgaccgaaggacccaatagtggtgtaaggctaatgctcacaaggtttgtggactacttaaaaggggagcaaataacggtgatttttactgccgcgataacggaaaagttaatagaacggaatccgagcgatgaaggaatttcgtccatggttgatacctggatcatggttcaagatgctgaatccgatggcgaacgcaaacgcacctgtactgttatgaagtccagaggtatgggacattcaaaaatggtaaagcaattaattatatcagataacggaattgcactaaaaccaatttccgaaaagcaaggnaaggagcgtgaacaatacagagcatctaaggaatag

SEQ ID NO: 2932 - protein, 256 aa, Unknown
  Obtained from environmental sample
  DOMAIN (71)...(170): KaiC
  misc_feature (1)..(256): Xaa is any amino acid
MTVFPIITEPIRSKISSKIVSTGIADLNEMLGKKGYYAGSSVLISGTAGTGKTSIAASFAFDVCKENVQCLYCAFEEAPNQVIRNMRSIGINLEPLVSSGRLLFYSSRPTLQNLELHFIAIKNKIKKIKPLVVILDPITNLMTEGPNSGVRLMLTRFVDYLKGEQITVIFTAAITEKLIERNPSDEGISSMVDTWIMVQDAESDGERKRTCTVMKSRGMGHSKMVKQLIISDNGIALKPISEKQGKEREQYRASKE

SEQ ID NO: 2933 - DNA, 939 bp, Unknown
  Obtained from environmental sample
  misc_feature (1)..(939): n is a, c, g, or t
gtgattgaagcatcaataaaacaaatgccgcctgaggtattccctatttcaggcaatgaactcattgccaaattaaagtcgagacgtgacctcctggaggaatatgcaacggactattataaatttttggcccaggaagttgatgtaacaggttctaaaaaaaatgaattgtttgatataaaaagattgaatgatgacgaaacttccgtgtctatttataaaataagcaaggaaggaaaaattaaaaaagaacctttttattccaggactttcaaaacaggcgaaacaaaagaattacgcttatatggtttatcaggcaacgacaggtacaatattaatggcaaggtaaacgatggtattaaaatccgtattatagcgggtatggaaaaagacagcatcaccgacctatcttcagcacctggcaaaaaaacaatagtttacgataacccaggtaatgcaatacaaaaatcaggaacaaccaagctgcatctatcgacggacactgccataaacaattttaaatacgacgctttccactataacaaaaaaggaattaaagctgcggttttttatgatcatgaagacaaattatatgttgggcttgggtatggatgggaaaattacaaatggcgcaggaatccatttgcatttgaacatagtatcgtaaccaggtattccattcctcaaaatgctttcaattttatttataagggcaggctgaatcaatttattggaaaatgggacctcgatcttaaagcacattatgattttatcctttggactaatttttttggtataggaaatgaatcnaaaccaaatacaaatgaccgttactttttcgtacccgcagtcgcgatgctatgcagcgctgcattatacacgcctttggtaaaagctgatctgaatcaaagatttaccattgtaaattatcagacctga

SEQ ID NO: 2934 - protein, 312 aa, Unknown
  Obtained from environmental sample
  misc_feature (1)..(312): Xaa is any amino acid
MIEASIKQMPPEVFPISGNELIAKLKSRRDLLEEYATDYYKFLAQEVDVTGSKKNELFDIKRLNDDETSVSIYKISKEGKIKKEPFYSRTFKTGETKELRLYGLSGNDRYNINGKVNDGIKIRIIAGMEKDSITDLSSAPGKKTIVYDNPGNAIQKSGTTKLHLSTDTAINNFKYDAFHYNKKGIKAAVFYDHEDKLYVGLGYGWENYKWRRNPFAFEHSIVTRYSIPQNAFNFIYKGRLNQFIGKWDLDLKAHYDFILWTNFFGIGNESKPNTNDRYFFVPAVAMLCSAALYTPLVKADLNQRFTIVNYQT

SEQ ID NO: 2935 - DNA, 384 bp, Unknown
  Obtained from environmental sample
  misc_feature (1)..(384): n is a, c, g, or t
atgcccgttatttgcataaaaactctgccttttgagaagaaacctgatattccggcaattctgaagaaactgtatacccgggttgcgggcgcaataaactacgaagcgcggcatatctggtcatactggcagtttatagagccgggaaactatgccgttggcgataaaacatcgctgttaaccacccatgattcacagtcacccatcgtaagcgtactctcatttgaaggcaaaaagagggatgaaattgaaaaaattctccggactattgccgaagtactctccaaagagcttaatatagatatcggaaatattttcattacgtattcggaagcattatcagggaatgttttcgatggcggagagatagtattcaaaaaataa

SEQ ID NO: 2936 - protein, 127 aa, Unknown
  Obtained from environmental sample
  misc_feature (1)..(127): Xaa is any amino acid
MPVICIKTLPFEKKPDIPAILKKLYTRVAGAINYEARHIWSYWQFIEPGNYAVGDKTSLLTTHDSQSPIVSVLSFEGKKRDEIEKILRTIAEVLSKELNIDIGNIFITYSEALSGNVFDGGEIVFKK

SEQ ID NO: 2937 - DNA, 636 bp, Unknown
  Obtained from environmental sample
  misc_feature (1)..(636): n is a, c, g, or t
atgatatcaattaaagatgtaagcaagacctttggcaggttgaacgttcttaacaatgtagtgctggatttgatcaaaggaagatcttatgcactggttggacccaatggctcaggaaagacaaccctcatcaagagcatactcggcatggtgattccatcatccggcgatatcctgttcgacaacgtctccatcagaaatgattggcggtatagggaaaaggtaggatacatgccacaaattggtcactatccggaatccatgacgattggtcagatcattgatatgatgaagcacattcgtaaaaatgtcagcgagtttgacgaagaactgatcgacaaattcatgttgtataaaatattcgataagcgcatgcacacgctttccggcggcacgcgtcagaaagtaagtgccgcacttgcttttctcttcaatcctccagtgctcattctcgacgagcctactgccggattggatccggtttctgttgaattattgaaggctaaaatcctcgacgaaaagcgaaacggaaaactgatcatcgtatcgtctcacatcctcagcgatctcgatgagctaacgacacacctcatttacctttttgaaggcaaattgaacttnacaacacattcttga

SEQ ID NO: 2938 - protein, 211 aa, Unknown
  Obtained from environmental sample
  DOMAIN (27)...(203): ABC transporter
  misc_feature (1)..(211): Xaa is any amino acid
MISIKDVSKTFGRLNVLNNVVLDLIKGRSYALVGPNGSGKTTLIKSILGMVIPSSGDILFDNVSIRNDWRYREKVGYMPQIGHYPESMTIGQIIDMMKHIRKNVSEFDEELIDKFMLYKIFDKRMHTLSGGTRQKVSAALAFLFNPPVLILDEPTAGLDPVSVELLKAKILDEKRNGKLIIVSSHILSDLDELTTHLIYLFEGKLNXTTHS

SEQ ID NO: 2939 - DNA, 705 bp, Unknown
  Obtained from environmental sample
  misc_feature (1)..(705): n is a, c, g, or t
atggttacaggagcttcgacttctcaggtttctatcattttgatcgatgccagaaaaggtgtaatcgagcaaacttaccgtcactttttcatcaataatttattgagagtaaaagaagtaatcgttgccatcaacaaaatggatttggtggattattctgaagaagttttcaataaaatcaaagctgattttgaggctttaaatgcaaaaagtactttcaaagaacaaaacgtaagctacattccgttaagtgcaatcaacggcggaaacgttgtggacaaatcggagaatatgccttggtacgaaggacaaacggttttagagcatttagaaggattacatgcttctgatgtatacgaagcaggaaaagcacgtttcccagttcagacggttattcgtccaaaaacagaagaatatcacgattttagaggttacgctggaaaattatacggaaactcaatcaaagttggagatgctgtaacagttcttccttctttaacagagtcaaaagttactaaaattcactttttcgataaaacatttgacgaagctacagcaggttcttcaatcacaatcgaattagaaaatgatatcaatgtaacgagaggtgatatgattgtaaaatcaagcgaacttccaaaaattcgaaaagacattaccacaacagttgctggantggacagtaaaaactggttggggaactaa

SEQ ID NO: 2940 - protein, 234 aa, Unknown
  Obtained from environmental sample
  DOMAIN (142)...(207): Elongation factor Tu domain 2
  misc_feature (1)..(234): Xaa is any amino acid
MVTGASTSQVSIILIDARKGVIEQTYRHFFINNLLRVKEVIVAINKMDLVDYSEEVFNKIKADFEALNAKSTFKEQNVSYIPLSAINGGNVVDKSENMPWYEGQTVLEHLEGLHASDVYEAGKARFPVQTVIRPKTEEYHDFRGYAGKLYGNSIKVGDAVTVLPSLTESKVTKIHFFDKTFDEATAGSSITIELENDINVTRGDMIVKSSELPKIRKDITTTVAGXDSKNWLGN

SEQ ID NO: 2941 - DNA, 324 bp, Unknown
  Obtained from environmental sample
  misc_feature (1)..(324): n is a, c, g, or t
atgaaaagtactttagtaacattttttattctattattttcacaatttattgtcgcaggaaatggcgacaaagccgcagacattgataatgtaaggctgatatctggaaaagtagtagataaaatgagcggggaagaattggcaggggttgaaataaagatcgactctaaaacatactatacagatctgaatggcaatttttcggtaagcattattcctgcaaaaacagaagctgttgtttcatttgtttcctatgaccaaactaaaattaacattgatccattttcctatactacaattatcgttgagatggaaccccggtaa

SEQ ID NO: 2942 - protein, 107 aa, Unknown
  Obtained from environmental sample
  SIGNAL (1)...(19)
  misc_feature (1)..(107): Xaa is any amino acid
MKSTLVTFFILLFSQFIVAGNGDKAADIDNVRLISGKVVDKMSGEELAGVEIKIDSKTYYTDLNGNFSVSIIPAKTEAVVSFVSYDQTKINIDPFSYTTIIVEMEPR

SEQ ID NO: 2943 - DNA, 498 bp, Unknown
  Obtained from environmental sample
  misc_feature (1)..(498): n is a, c, g, or t
ttgcggttcatcattaaaaagatgaaatcttatcgaaaagaactttggtttaatatttcccagcgtgttgattttgttaatatcactgcgcaagtaaattcttgtcttgaagaaagcggaataaaagaaggactttgcttagttaatagtatgcatatttcatcttcggtttttataaacgatgatgaaaaaggtctgcatcatgatttcactcaatggcttgaaaaacttgcacctcatgctcccattgcccaatatagacataatgatactggcgaagataatgctgatggacatctcaaaagacaaatcatgggcagggaagtagttgttgccattacaaatggaaaattagattttggtccctgggaacaaatattttatggcgaaattgaatggcatagaaaaaaaaaaattttaattaaaattaattgggacttaaaacgtcctttcttactacattcaaaaaattccttcagcagttttggttttttttaa

SEQ ID NO: 2944 - protein, 165 aa, Unknown
  Obtained from environmental sample
  DOMAIN (25)...(144): Uncharacterised protein family UPF0047
  misc_feature (1)..(165): Xaa is any amino acid
MRFIIKKMKSYRKELWFNISQRVDFVNITAQVNSCLEESGIKEGLCLVNSMHISSSVFINDDEKGLHHDFTQWLEKLAPHAPIAQYRHNDTGEDNADGHLKRQIMGREVVVAITNGKLDFGPWEQIFYGEIEWHRKKKILIKINWDLKRPFLLHSKNSFSSFGFF

SEQ ID NO: 2945 - DNA, 525 bp, Unknown
  Obtained from environmental sample
  misc_feature (1)..(525): n is a, c, g, or t
atgctcgctcctttcaatcttcaaaaatggattaacgacaatagagatctgttgaaaccccctgtaggaaataaaaatctttacaaagaagcaggagattttattgttatgatcgttggtggtccaaatgcccgtaaagattaccattataatgaaagcgaggaattgttttatcagatcgaaggagatataacggttcgtattcaggaagacggaaaagcaaaggatatagaaatcaaagaaggcgaaatgttcttacttccgggaaatgttcctcattctccaatgcgcggaccaaatacggtcggtcttgtaatcgaaaaagtaagaaaaggtactgaccttattgatggattgagatggtattgtgataactgcaataatttattgaaggaatatcgttttccattaacaaatatcgaagtggatttcatcccaagatttaaagaattctattcatcccttgaaatgcggacgtgtaagaattgcggacatgtaatggaagttgatgaacgattcgtttaa

SEQ ID NO: 2946 - protein, 174 aa, Unknown
  Obtained from environmental sample
  DOMAIN (1)...(174): 3-hydroxyanthranilic acid dioxygenase
  misc_feature (1)..(174): Xaa is any amino acid
MLAPFNLQKWINDNRDLLKPPVGNKNLYKEAGDFIVMIVGGPNARKDYHYNESEELFYQIEGDITVRIQEDGKAKDIEIKEGEMFLLPGNVPHSPMRGPNTVGLVIEKVRKGTDLIDGLRWYCDNCNNLLKEYRFPLTNIEVDFIPRFKEFYSSLEMRTCKNCGHVMEVDERFV

SEQ ID NO: 2947 - DNA, 513 bp, Unknown
  Obtained from environmental sample
  misc_feature (1)..(513): n is a, c, g, or t
atgaaatctgttgcgatagtaataccttgcaggaacgaagaaaaatacattggaaaatgtatggattcttttttggcacaggactatccgaaagagttacttcatttgtacgtgtgcgatggtaaaagcaccgataaaacggtagatgtgatcaatgagtacagtaaaagaaacccaaccattcatttgctgatcaatgaaaagcaaacgactccctttgctcttaatttaggaataaaaagtagtcatgcagatgtcctgatcattttaggagcacattctgaattgtaccctgattatgtttctaattgtattaaggcgtttgaagtagatgaacacattggctgtaccggtggtattattgaaaatgtttatgagaatgaaacagcagaagtaatcggaaaagcgatgtcatccggttttggagttggaaatgctcattttcgtacaggcaataaagatgggtatgtggatactgtcgcctttgggagcatacaaaaaagaggtgtttga

SEQ ID NO: 2948 - protein, 170 aa, Unknown
  Obtained from environmental sample
  DOMAIN (5)...(169): Glycosyl transferase
  misc_feature (1)..(170): Xaa is any amino acid
MKSVAIVIPCRNEEKYIGKCMDSFLAQDYPKELLHLYVCDGKSTDKTVDVINEYSKRNPTIHLLINEKQTTPFALNLGIKSSHADVLIILGAHSELYPDYVSNCIKAFEVDEHIGCTGGIIENVYENETAEVIGKAMSSGFGVGNAHFRTGNKDGYVDTVAFGSIQKRGV

SEQ ID NO: 2949 - DNA, 432 bp, Unknown
  Obtained from environmental sample
  misc_feature (1)..(432): n is a, c, g, or t
atgggaacgggggccttttttgtccaattcaataaaaaggggatatgtatccttgaattttgccaggaggctttcaacccttttataccttgttcggggataattaggataatggaggggaaagggggattgcttttgaaattggacttgatgaaacaaattttcagggaacagattttcaaaaattcttattttaccaatccagaaggggggatttcatttatattttttccgatgggttttgccgatcagtttggaggtcccgacggtaaaaagtataaataccgccgtttcaggcatctcttactgaatctgcatcaacttacaatggaaaagcaacatgagattcttgaaaacaatgtacttgaatggcgcggtcagcaggagcaggttgatgatatcctggttataggaattaagattgatttctga

SEQ ID NO: 2950 - protein, 143 aa, Unknown
  Obtained from environmental sample
  misc_feature (1)..(143): Xaa is any amino acid
MGTGAFFVQFNKKGICILEFCQEAFNPFIPCSGIIRIMEGKGGLLLKLDLMKQIFREQIFKNSYFTNPEGGISFIFFPMGFADQFGGPDGKKYKYRRFRHLLLNLHQLTMEKQHEILENNVLEWRGQQEQVDDILVIGIKIDF

SEQ ID NO: 2951 - DNA, 360 bp, Unknown
  Obtained from environmental sample
  misc_feature (1)..(360): n is a, c, g, or t
ttgggactctctttcgaattggctaagcaaagtgggattaatttttatattaatgatattccgattcctggaggtttaatcgaatttgccaaaactaattctctagatatctatgatctaatatttaatggtggtgaagaatatgaaataatagctacgattaatccctcgaatttgccaaaagtaaattttcttgcaaaaaaatttcatttaccgctatttgtaataggaaaagcaatgactggaaatggtaatgtttttgttaaatatgataatgaatttgaattgcatggaagaaaaattgaaaaaaataaagattattttctcttagaaaataagggctttttacatttttcttaa

SEQ ID NO: 2952 - protein, 119 aa, Unknown
  Obtained from environmental sample
  misc_feature (1)..(119): Xaa is any amino acid
MGLSFELAKQSGINFYINDIPIPGGLIEFAKTNSLDIYDLIFNGGEEYEIIATINPSNLPKVNFLAKKFHLPLFVIGKAMTGNGNVFVKYDNEFELHGRKIEKNKDYFLLENKGFLHFS

SEQ ID NO: 2953 - DNA, 795 bp, Unknown
  Obtained from environmental sample
  misc_feature (1)..(795): n is a, c, g, or t
atgcttctcgcagatgctcctaagtttttgaatggtgttattcaggaaagtgatacgcctnttatttatgagaaggttggttcgttttacaggaactttttgatcgatgagtttcaggatacctccggctaccagtggaaaaactttttaccgctgctcacgaacagtctggaccagggtaacagaagtattgtggtaggcgatgtgaagcaagccgtttaccgctggcgtggaggtgatttgaatttattgcagcaagaagtacaacaacaaattggagaaggcagggtgaacatgattgagttggacaccaactaccgaagtgcttctcttattgttgactttaataataagttattcaaaagtgccagcgctctggtagcgcaaaaaacgaacggcaaattaccgatcgatgcctttaaggacgtagcacaaaaaggtgtgaagaagaatgagggattcgttcaggtcaaattcatcaaagaagaaataatagatgaacaaacccgcaagcaaagcatttggaaggaactggcattggagcaggtatcacttcagctggaacaattacagggattgagtgttccgctcagcgatatcgccattctggttcgaaaaaactttgaaggccatgagattgcaacatacctgttgaattacgcagcctctgaaaaagcaaagccaggctgtcgttacgatgtgatatcaaatgaatcgttgcggttggatggtgcggcttctgttaatgtattgcttggcgcgatgcggtattgcaaaaccccgagatcattctga

SEQ ID NO: 2954 - protein, 264 aa, Unknown
  Obtained from environmental sample
  misc_feature (1)..(264): Xaa is any amino acid
MLLADAPKFLNGVIQESDTPXIYEKVGSFYRNFLIDEFQDTSGYQWKNFLPLLTNSLDQGNRSIVVGDVKQAVYRWRGGDLNLLQQEVQQQIGEGRVNMIELDTNYRSASLIVDFNNKLFKSASALVAQKTNGKLPIDAFKDVAQKGVKKNEGFVQVKFIKEEIIDEQTRKQSIWKELALEQVSLQLEQLQGLSVPLSDIAILVRKNFEGHEIATYLLNYAASEKAKPGCRYDVISNESLRLDGAASVNVLLGAMRYCKTPRSF

SEQ ID NO: 2955 - DNA, 936 bp, Unknown
  Obtained from environmental sample
  misc_feature (1)..(936): n is a, c, g, or t
ttgggaaaataccatttaaaggttggccaatgtattgcagagttattagacaattctattgatgctttaataaatatgnatggttctacttctaataaaaagattcaaattcatattccaaagccaaatggcataagaaataatgagcccttaataattgaagattggggaataggaatgactgaggaacaactagagaatgctgttagggcaggatattctaacaaaagttctggtcggagtttgggattatttggaatgggattcaatgtagctactgcaagattagcagatgttgttgaagtttatacttcaacaaaagatatggaaaaagaaattggcgtaaaaatagatttggctgaaatgagtagatctagatcctttattcggccccggcttgaaaagcaaaaatcgtttaaggaatcgggcactacaattaaaatatataattacaaacccaatgcggaacaacttctaaagacgaaggaaataattgagagcattcaaacgacttattctaatttactttttgatgaacataagattgaaattgttatcaataaccatcaaataaagccatttagattttgcgcttggggaaataaccgattcatagtttataaaggagaagagatacctgcaattattcctattgatgaaaaaattggtgaagaatatttctgcgaaagatgcctttattgggttggtcctgtgattgagaatactgcaagtgtttcttgtccaagatgcaacttgacggataaagtaattaagaaaattatcaacattcatggatgggttggaatacaacgctacaatgatatgaaccatttcggaataaacataattagaaacggtagagttattagtaagcttgataaatctttttttacctggaaagacaaaaaaggtattctgcagactattgatccataa

SEQ ID NO: 2956 - protein, 311 aa, Unknown
  Obtained from environmental sample
  misc_feature (1)..(311): Xaa is any amino acid
MGKYHLKVGQCIAELLDNSIDALINMXGSTSNKKIQIHIPKPNGIRNNEPLIIEDWGIGMTEEQLENAVRAGYSNKSSGRSLGLFGMGFNVATARLADVVEVYTSTKDMEKEIGVKIDLAEMSRSRSFIRPRLEKQKSFKESGTTIKIYNYKPNAEQLLKTKEIIESIQTTYSNLLFDEHKIEIVINNHQIKPFRFCAWGNNRFIVYKGEEIPAIIPIDEKIGEEYFCERCLYWVGPVIENTASVSCPRCNLTDKVIKKIINIHGWVGIQRYNDMNHFGINIIRNGRVISKLDKSFFTWKDKKGILQTIDP

SEQ ID NO: 2957 - DNA, 918 bp, Unknown
  Obtained from environmental sample
  misc_feature (1)..(918): n is a, c, g, or t
atggtcagattgggaaaagctcttatttatatagatttatttgctgggtgcggtggtctttcacttggtctttataattcaggatggaaaggaatatttgctattgaaaaaagtcctgatgcttttaaaacacttcactacaacttaattgagaaacgaaatcattttcaatggccagattggttaccccaaaagaatttagacattaaagcagttttaaataatcatagatctcagctattaaaattaagagggaaaattgatatggttacaggaggccctccttgtcaagggttttcgaccgcaggtagaagaaacgagagtgacaagcgtaattctttaataaaggactacattgaatttattaaattagtaaaaccaagagttctttttttcgaaaatgtaaagggatttaccttaggttttagtaaaaataaaacaaagggcgagcaatattcggcatacgtaaaggaacaacttgagcgacttgggtataatgtaagcggacaaatgttagatttttcagagtttggaattcctcaaaaaagatgtaggtttattttagttggtattagaaaggatatttgtaagagcaaaaaaataacagcagagagtttctttagcaatgtcgtagaaaataaaattcatttcctggctagtaaaaacttaaaaacagctattactttagaggaggccatatcagatttattaaaatcacatggacaagttcagtctccagatacaaaaaattttaaagcaggtatttattctaaatcgctaagtaattatcaatacttattacgaaataataagaaaaaaggagaagtagtagatagtcaccgctttgtaaatcattccaaattagtagagactaggtttgctgaaattctaaaaatgcaaagcgtaatacttcattag

SEQ ID NO: 2958 - protein, 305 aa, Unknown
  Obtained from environmental sample
  DOMAIN (8)...(305): C-5 cytosine-specific DNA methylase
  misc_feature (1)..(305): Xaa is any amino acid
MVRLGKALIYIDLFAGCGGLSLGLYNSGWKGIFAIEKSPDAFKTLHYNLIEKRNHFQWPDWLPQKNLDIKAVLNNHRSQLLKLRGKIDMVTGGPPCQGFSTAGRRNESDKRNSLIKDYIEFIKLVKPRVLFFENVKGFTLGFSKNKTKGEQYSAYVKEQLERLGYNVSGQMLDFSEFGIPQKRCRFILVGIRKDICKSKKITAESFFSNVVENKIHFLASKNLKTAITLEEAISDLLKSHGQVQSPDTKNFKAGIYSKSLSNYQYLLRNNKKKGEVVDSHRFVNHSKLVETRFAEILKMQSVILH

SEQ ID NO: 2959 - DNA, 807 bp, Unknown
  Obtained from environmental sample
  misc_feature (1)..(807): n is a, c, g, or t
atggaaagcaaaaaggtactattcatctctcaggaaattaccccgtattctggggaaacaaatttatcgagaataggcagatatcttccccagggaattcaggagcaggggaaagagatccgtacctttatgccaaggtatggttgcataaatgaacgccggaaccagttgcatgaagtgatccgtttgtcgggaatgaaccttataattgacgatacggatcatccgttgataataaaggttgcttctatacagagtgcaagaatgcaggtttatttcattgataatgaagattatttccagagaaaatttcttgtagcggatgctgccggcaaagaattcgaggataatgatgagagagcgttgtttttcgcccgaggggttattgaaactgtaaaaaaactaaggtgggcacctgatattgtgcactgtcatggatggatggcttctctcgttcctgtttacctcaggaatatttataccgatgacccgcttttccataattacaagatcatatattcagtgtacgataatgacttcaaagatcctttccgctctgattttgctgaaaaacttcgttttgacgggattgatggtgagaatctaaaagttgttaaaaaacctgattttgtaaacgtttcaaagctggccattaaatattctgacgggatcataattggcagtgagaaaataaacgaagaattatttaattacatccaaacnattcagaagccggttcttccgtttaaaggtgagtctgaatatattaaagcctataatgatttttatgaccagataccttcttaa

SEQ ID NO: 2960 - protein, 268 aa, Unknown
  Obtained from environmental sample
  misc_feature (1)..(268): Xaa is any amino acid
MESKKVLFISQEITPYSGETNLSRIGRYLPQGIQEQGKEIRTFMPRYGCINERRNQLHEVIRLSGMNLIIDDTDHPLIIKVASIQSARMQVYFIDNEDYFQRKFLVADAAGKEFEDNDERALFFARGVIETVKKLRWAPDIVHCHGWMASLVPVYLRNIYTDDPLFHNYKIIYSVYDNDFKDPFRSDFAEKLRFDGIDGENLKVVKKPDFVNVSKLAIKYSDGIIIGSEKINEELFNYIQTIQKPVLPFKGESEYIKAYNDFYDQIPS

SEQ ID NO: 2961 - DNA, 366 bp, Unknown
  Obtained from environmental sample
  misc_feature (1)..(366): n is a, c, g, or t
atgttgagtaattttttaaataatatttcttctttaaaagaaaaaatattatcaaatatatttacaacaaaaacaattaaaaagaataattatttttatacaaaatttttaaatggtgatattttttattatgatgagcaaggaaattatcataatgatgatgagcccgcaataaatacaagatttagaaaagaatatttttatcatggaaaaagacatcgtctcgatggtccggcagtaacttttttacattcaactgagaaaagaataatatatactgaatattggttatatggcgaaaaacttgattatattaaaacaaatgaacaatttgaaaaattaattaaattaagatcatttatatga

SEQ ID NO: 2962 - protein, 121 aa, Unknown
  Obtained from environmental sample
  misc_feature (1)..(121): Xaa is any amino acid
MLSNFLNNISSLKEKILSNIFTTKTIKKNNYFYTKFLNGDIFYYDEQGNYHNDDEPAINTRFRKEYFYHGKRHRLDGPAVTFLHSTEKRIIYTEYWLYGEKLDYIKTNEQFEKLIKLRSFI

SEQ ID NO: 2963 - DNA, 354 bp, Unknown
  Obtained from environmental sample
  misc_feature (1)..(354): n is a, c, g, or t
ttgaaggttggaagtcgaaaggctggtcagtcaaatattacggttttgaacactgaggaagctcgtaaatttatgcaagggcacagaattaagtctggctgcgttatatttgttgagaaatatgaaagttttttcgagcgcgactcaaaaaatgaaaatctcatcacatcaacaagaaaagcagaaaattcagtcgataacctcaattttcttgttgtagctggtcatgttgtgccgggagtaaaaactacaatcgaagattttttttaccacaaaaacaacgagatgtatggagacatgctagctgatatcaagatcatgacaccattattgaagaaattgatagaaggctaa

SEQ ID NO: 2964 - protein, 117 aa, Unknown
  Obtained from environmental sample
  misc_feature (1)..(117): Xaa is any amino acid
MKVGSRKAGQSNITVLNTEEARKFMQGHRIKSGCVIFVEKYESFFERDSKNENLITSTRKAENSVDNLNFLVVAGHVVPGVKTTIEDFFYHKNNEMYGDMLADIKIMTPLLKKLIEG

SEQ ID NO: 2965 - DNA, 387 bp, Unknown
  Obtained from environmental sample
  misc_feature (1)..(387): n is a, c, g, or t
ttgaataattactgcatggcaaaaggtattctcacggttgttttactcattctctctaatgccttcatgacgttggcctggtatggtcacttgaagtttaaagagatgaagtggagtcaaagcctcgggcttgtgagcatcatccttattagttggggaattgcactcttcgaatatatgttacaagtacccgctaatcggattggttttaaaggatacgatggtccgttttcactggtgcagttaaaagtaattcaggaagtaataaccttggttgttttcatgttgttttcatttctgtttttcaagaatgaaacttttaaattgaatcacctgattgggtttgtgtttcttgttttagccgtgtactttatttttaagaaatag

SEQ ID NO: 2966 - protein, 128 aa, Unknown
  Obtained from environmental sample
  DOMAIN (10)...(127): Protein of unknown function, DUF486
  misc_feature (1)..(128): Xaa is any amino acid
MNNYCMAKGILTVVLLILSNAFMTLAWYGHLKFKEMKWSQSLGLVSIILISWGIALFEYMLQVPANRIGFKGYDGPFSLVQLKVIQEVITLVVFMLFSFLFFKNETFKLNHLIGFVFLVLAVYFIFKK

SEQ ID NO: 2967 - DNA, 402 bp, Unknown
  Obtained from environmental sample
  misc_feature (1)..(402): n is a, c, g, or t
atgaaattcgtggcaatggagaagaaaatcatcaacacgaaaaacgcacctgcacccatcggtccgtacaaccaggccattttagtgaacggcaccttatatatttccggccagatctgcattgagccatcaaacggcaatttgaaaaacagggatatccaggaagaaacccaccaggtcatgcaaaacctgaagtcgatattatcggaagccggcatgaagttcggtcatgtggtgaaaacgaccattttcctgacagatatgaaccgcttcggtgaggtgaatgagatctatggtaaatatttcgagggtgaatttccagcccgtgaaacggtacaggtttcggccctgccaaagtttgtgaacgttgagatcagcatgattgccgtcaaaagtgaatag

SEQ ID NO: 2968 - protein, 133 aa, Unknown
  Obtained from environmental sample
  DOMAIN (13)...(131): Endoribonuclease L-PSP
  misc_feature (1)..(133): Xaa is any amino acid
MKFVAMEKKIINTKNAPAPIGPYNQAILVNGTLYISGQICIEPSNGNLKNRDIQEETHQVMQNLKSILSEAGMKFGHVVKTTIFLTDMNRFGEVNEIYGKYFEGEFPARETVQVSALPKFVNVEISMIAVKSE

SEQ ID NO: 2969 - DNA, 462 bp, Unknown
  Obtained from environmental sample
  misc_feature (1)..(462): n is a, c, g, or t
atgacctggtttaaaaaaatccttttccgctgggtcatgtgggcgtctgagaaattctcttcgcggccggagcgtgatcgcatattcaaagccctgtcttccctgctcgactgcattgtaaaactggagaagaaaaaagggcctgtacttaccttcaactgtgaagccgataagtttattattttttccgatcagcataaaggggcaaagaacggtgccgacgactttatgctttgtgaacccaattatattgctgcactcgattattattaccagcataattatttcttcatagcgcttggtgattgcgaggaattgtgggagaacacactctccggcgtanaaaagcccatcaaccttcttcgaaaaagaaagcagttttttctgaacaacgaggcatcaagaatcttcggcatcatgacctgcattggcagaatgatccccttgcaccctttcagctga

SEQ ID NO: 2970 - protein, 153 aa, Unknown
  Obtained from environmental sample
  misc_feature (1)..(153): Xaa is any amino acid
MTWFKKILFRWVMWASEKFSSRPERDRIFKALSSLLDCIVKLEKKKGPVLTFNCEADKFIIFSDQHKGAKNGADDFMLCEPNYIAALDYYYQHNYFFIALGDCEELWENTLSGVXKPINLLRKRKQFFLNNEASRIFGIMTCIGRMIPLHPFS

SEQ ID NO: 2971 - DNA, 318 bp, Unknown
  Obtained from environmental sample
  misc_feature (1)..(318): n is a, c, g, or t
atgaatatcaaaaacaacatcctcgaaacgatcgggaatacacccctcatcaaactgaataagatcacgaagaattttccctgcgtcgtggctgccaaggtggattatttcaatcccggcaattccataaaagaccgtatggcgctgaagatggtggaagtggctgaacaggaaggtaaactaaaaccggggggaacgatcattgagggtacaagcggaaatacgggaatgggacttgcccttgccgcctgtgtgaaaggttataaatgcatatttgttacgacagataaacaatccagggaaaggctgatatcttaa

SEQ ID NO: 2972 - protein, 105 aa, Unknown
  Obtained from environmental sample
  misc_feature (1)..(105): Xaa is any amino acid
MNIKNNILETIGNTPLIKLNKITKNFPCVVAAKVDYFNPGNSIKDRMALKMVEVAEQEGKLKPGGTIIEGTSGNTGMGLALAACVKGYKCIFVTTDKQSRERLIS

SEQ ID NO: 2973 - DNA, 789 bp, Unknown
  Obtained from environmental sample
  misc_feature (1)..(789): n is a, c, g, or t
atgtacttgaagaaaaagaaccctaatatccagtatggggcaatcgatgtatacggctctctcctgacaaaatatttccggacaggtgaaattgatatgaatgaggtacatccatatatatcagaaggcttcggtgaggatttcgtacccaagaattatgatatgacctggatcgatcattttgagcaggtgacagataaagacgnggctgtgatggcacggaggctggcgaaagaagaaggactgttctgtggatacagcgcaggaagctgcctgcagggattaatgcaactaaaggaccggctcaaaaaagatgacctggtagtctgcatccttcacgatcacggcagccggtatgtagccaagatctataatgaccaatggatgatcgaaagaggattcctcgatgtgaaaacattcagggatgttgtgaattccaggggaacaaagaaactgatcacgatcgaacctgaacaaaccgttgcggaagcttttgaactgatgaaaaaatatgatatcgaacagatcccggttatgaatgggaatggtatcaccggctccatcagtgaagcaggcttgtttaaaaagatatttgacaatcccgaattaaaaaatgtgacagttaaagaggtgctcgaaacttctctccccgttgttgcattcgatacacctgttgagaaactcagcaatctcatcaatcgcgaaaacggcgcagtgatggccaaagatgaggctggtaattttcatatcgttacaaagtacgatgtgatccaggctttaagccattga

SEQ ID NO: 2974 - protein, 262 aa, Unknown
  Obtained from environmental sample
  DOMAIN (146)...(198): CBS domain
  misc_feature (1)..(262): Xaa is any amino acid
MYLKKKNPNIQYGAIDVYGSLLTKYFRTGEIDMNEVHPYISEGFGEDFVPKNYDMTWIDHFEQVTDKDXAVMARRLAKEEGLFCGYSAGSCLQGLMQLKDRLKKDDLVVCILHDHGSRYVAKIYNDQWMIERGFLDVKTFRDVVNSRGTKKLITIEPEQTVAEAFELMKKYDIEQIPVMNGNGITGSISEAGLFKKIFDNPELKNVTVKEVLETSLPVVAFDTPVEKLSNLINRENGAVMAKDEAGNFHIVTKYDVIQALSH

SEQ ID NO: 2975 - DNA, 717 bp, Unknown
  Obtained from environmental sample
  misc_feature (1)..(717): n is a, c, g, or t
ttggacgcggtgacgatggcagttgagccaaaaatagagagtaagaacttaaagttccaatttgcgctgcagcaaagcatgtccaataaaacggcgtttgtatcaaaagatgcagtttctaaatggtcagtaaagccggatgagctgagcacatctccggtgcttcaagtcgataatacatttcttgtaacacaaaccaataataatttgctaattatcgatcagcatgccgcacatgagcgtatcctatatgaacaatttatttatacatttaacagtaagagcgtgaaaagaaaggtattaaacctaaaaagacctataaaagtggagtttccagtaggtgaagcagcaatattagatgaaaacatcgaagtgctaggcaaactcggtttctctattgaaaaagtggatggttcatatttagtgaacaagatccccgatatttatagcggacacagtatacatcagttgctatcagagctaatcgaagatattgctaatgttagatccaaaacagattccctgacccaaagaactttgtcatttctagcctgcaggagcgcaattaaagctggagacgaattatccgaagtggaaagtaaacgattactagaaaagctctataggactaaaactaattatacttgtccccacggtcgtccagtgttaattgagatacctctaagccaattacatatcgcattccgcagaaaataa

SEQ ID NO: 2976 - protein, 238 aa, Unknown
  Obtained from environmental sample
  misc_feature (1)..(238): Xaa is any amino acid
MDAVTMAVEPKIESKNLKFQFALQQSMSNKTAFVSKDAVSKWSVKPDELSTSPVLQVDNTFLVTQTNNNLLIIDQHAAHERILYEQFIYTFNSKSVKRKVLNLKRPIKVEFPVGEAAILDENIEVLGKLGFSIEKVDGSYLVNKIPDIYSGHSIHQLLSELIEDIANVRSKTDSLTQRTLSFLACRSAIKAGDELSEVESKRLLEKLYRTKTNYTCPHGRPVLIEIPLSQLHIAFRRK

SEQ ID NO: 2977 - DNA, 447 bp, Unknown
  Obtained from environmental sample
  misc_feature (1)..(447): n is a, c, g, or t
ttggatgatgccaaggaagatgtagtttttctaaaaccaaatgcagatgctcatgtacattttggagatgccttttcgaaaaatgtaaaagcgatggttgatgattacattgaaaaatttaaaattctttctccactacccgaattagatgttgcggatttacccgatgaaactgcctcttgtgtatcaccgattacctcactaaacctaagagacaaaaatattgccacgataatttgggcaactggatttgttggcaatttcagttacataaaacttccggtctttaatgaggacaaaacattgaggcattgcaatggtgtttcagaaattaaaggactgtattttcttggattcccttggcttcgtaaaagaaagtcaggaattgttttgggaataaaagaagattcggaatatataagtcagagaatcttatactcctattga

SEQ ID NO: 2978 - protein, 148 aa, Unknown
  Obtained from environmental sample
  misc_feature (1)..(148): Xaa is any amino acid
MDDAKEDVVFLKPNADAHVHFGDAFSKNVKAMVDDYIEKFKILSPLPELDVADLPDETASCVSPITSLNLRDKNIATIIWATGFVGNFSYIKLPVFNEDKTLRHCNGVSEIKGLYFLGFPWLRKRKSGIVLGIKEDSEYISQRILYSY

SEQ ID NO: 2979 - DNA, 897 bp, Unknown
  Obtained from environmental sample
  misc_feature (1)..(897): n is a, c, g, or t
gtgaagagacgaattgcagtgggcgataataaaaaggatattgtgactgccctggaagaagaaagcagggaatcgcaggtgatcatcattaccggcggcctgggtccgacagcagatgatattaccaaaccagttctttgtgaatattttggttcaaagctggtaaaaaaccaggaagttgaaaactatatcatagacatttttactaaacttaaacggcaggttggtgaaagaaacctgaaacaggccgaagtgcctgataactgcaaagtgttgcacaacaggcgcggaacagcacctggtatgtggtttgaaaaaaatgaggtgatttatatttcacttccgggagttccacatgaaatgaaaggcctggttgaagcatcagtcattccgctattaaaaaatattgttggtctgcccgttgttttgcataagaatatcttaactgccggcgttggtgaatctgttgttgctgataaacttgaggaatttgaaacaacgctgcccaaccatattaaactggcttatttgcccgcatacggacaggtaaagctgaggcttactgcaaaaggagaaaataaagagccgcttgaaaaagaacttgaatatttttttgaccagctaaaaaaacatgttaaggaatggatggtagctgatgaagacataccacttgagaaactggtcattcaaatgctgcagaactcaaataaaacccttgccactgcagaaagctgcacaggtggttatattgcccacctgataacatccattccaggctcatcaaaaatatttaaaggaagcgtggtggcttattccaatgaaataaaaacaggcctcctggatgtcagcagttcacgcttgaaacccatggcgcggttaatgaagaaactgtcttag

SEQ ID NO: 2980 - protein, 298 aa, Unknown
  Obtained from environmental sample
  DOMAIN (221)...(297): Competence-damaged protein
  misc_feature (1)..(298): Xaa is any amino acid
MKRRIAVGDNKKDIVTALEEESRESQVIIITGGLGPTADDITKPVLCEYFGSKLVKNQEVENYIIDIFTKLKRQVGERNLKQAEVPDNCKVLHNRRGTAPGMWFEKNEVIYISLPGVPHEMKGLVEASVIPLLKNIVGLPVVLHKNILTAGVGESVVADKLEEFETTLPNHIKLAYLPAYGQVKLRLTAKGENKEPLEKELEYFFDQLKKHVKEWMVADEDIPLEKLVIQMLQNSNKTLATAESCTGGYIAHLITSIPGSSKIFKGSVVAYSNEIKTGLLDVSSSRLKPMARLMKKLS

SEQ ID NO: 2981 - DNA, 846 bp, Unknown
  Obtained from environmental sample
  misc_feature (1)..(846): n is a, c, g, or t
ttgattggaatcggtggattcacggtgcaggcgctcgatgctgtcttcaaagaaacagcaggctttgaatacgaggtgattttgattgataatcattcggcagacgcgagtgtggaaacaatcagacgaaaatttcctcaagttattttgattgaaaataaagataatcttggatttggcaaggcaaataatcaaggaatgaaaatagcgcaggggcaatatatttttctcctcaatagtgacacggtcgttctggatcatgcggtcaataccttggtggagtatctcgataaacatccagaagttgcctgtgttggaccgaagctcctcaatggcgatatgacatttcagcacgcatgtcgaaggaatttgccaaatcctgttaacgcttttttccatctctttgggcttgtaaaaatattcaagcgaagtaggcgtataactgcctacaaaagattcagtgataatccggatataaccgaaccagtcgaagcactctccggcgctgccatgatgtttcgaaaagaagtgtttgaaaaaaccggcggcttcgacgaaaagttttttttctatggcgaagatttggatctgtgcaaacgaatacaggatatgggtgaaaaaatcgtatatgtgagtgaggcgcgcattatccattttggagggggaagcagtaaaaaaagaaaagtaaaatccttggtaaatttttatgatgcaatgtggatatattatcaaaaacatttccacaagaatttcttgttcgattttttgattcttttaggcatcaaaataaaattatacctatccttaataaaaaattttcttttaaacatatctaagaaaatatga

SEQ ID NO: 2982 - protein, 281 aa, Unknown
  Obtained from environmental sample
  DOMAIN (1)...(182): Glycosyl transferase
  misc_feature (1)..(281): Xaa is any amino acid
MIGIGGFTVQALDAVFKETAGFEYEVILIDNHSADASVETIRRKFPQVILIENKDNLGFGKANNQGMKIAQGQYIFLLNSDTVVLDHAVNTLVEYLDKHPEVACVGPKLLNGDMTFQHACRRNLPNPVNAFFHLFGLVKIFKRSRRITAYKRFSDNPDITEPVEALSGAAMMFRKEVFEKTGGFDEKFFFYGEDLDLCKRIQDMGEKIVYVSEARIIHFGGGSSKKRKVKSLVNFYDAMWIYYQKHFHKNFLFDFLILLGIKIKLYLSLIKNFLLNISKKI

SEQ ID NO: 2983 - DNA, 828 bp, Unknown
  Obtained from environmental sample
  misc_feature (1)..(828): n is a, c, g, or t
atgaaaacgatactcgtaaccggtgctgccggttttattgggtcgcatctcacagaaaaattactgcaaaatggaaattatgtgattggagttgataatttgtataccggttcactagaaaatttgaaatcaatcagaggaaataaaaatttcaaatttattaaacatgatatcattcaacctcttacgataaaaagaaaaattgaccaaatttacaatcttgcatgtccagcttctccagttcattatcaatcaaatcagatcgaaaccattaaggtatgcacactcggagcgattcacatgcttgaattagcccgcaaatacaaggcacgaatacttcaggcttcgacttcagaagtatatggagatcctgaagtgcatccacaagtcgaggaatatcgaggaagtgtaaacccgattgggccccgagcctgctatgatgagggtaagcgtgttgcagaaactttattttttgactaccaccgagcgtatggccaagagatcaaagtggctcggatttttaacacctatggcccgcgtatgacggtcaatgacgggagagtagtgtcaaactttatcgtacaggcaattcagaataagtcgattaccctgtatggcacaggcactcagactagaagtttttgttatgtgagtgatttggtggatggattgataaaactcatgaattccaataaaaaagtgcagggtccgataaatctgggcaatccagaagagcggactgtgaaagatcttgcgggactaatcatagacctgaccggatcaagaagcaagattgtctataaaaagtgccaaatcttgatccactag

SEQ ID NO: 2984 - protein, 275 aa, Unknown
  Obtained from environmental sample
  DOMAIN (4)...(275): NAD dependent epimerase/dehydratase family
  misc_feature (1)..(275): Xaa is any amino acid
MKTILVTGAAGFIGSHLTEKLLQNGNYVIGVDNLYTGSLENLKSIRGNKNFKFIKHDIIQPLTIKRKIDQIYNLACPASPVHYQSNQIETIKVCTLGAIHMLELARKYKARILQASTSEVYGDPEVHPQVEEYRGSVNPIGPRACYDEGKRVAETLFFDYHRAYGQEIKVARIFNTYGPRMTVNDGRVVSNFIVQAIQNKSITLYGTGTQTRSFCYVSDLVDGLIKLMNSNKKVQGPINLGNPEERTVKDLAGLIIDLTGSRSKIVYKKCQILIH

SEQ ID NO: 2985 - DNA, 846 bp, Unknown
  Obtained from environmental sample
  misc_feature (1)..(846): n is a, c, g, or t
ttgcttcggtctaaatggggctttctcgcattgtgcgcattgttaataagctggcaacaaatctccgttctgttcgcatttcggactggtaaggaattcgattttaacaaaaaggaaaaagcactgcgggtacttacatggaatgtttcgagttggacagaaaatcaccatactgaagataaagtggaacgcatggggcttcgcaatttaatgatcgacgccgtacagatgcaaaatgccgatgtgctttgtttccaggagtattttgacagttttgccccggaactttatcctgcaaacattcctgtctttaaaaaaatgggatttaattattattattttacaccggtactaaaaatggtgaacgaaaaattacaagcaggactatgtattttttcaaagtatccatttgttgatacttcattttacagagtccagaacacaggaaattctgaaggaatgagcattgccgacatacaatttaacggaaaaacaatacggataattaatacccatctcgaatctccccggctttcaaagcaggaatataaccctttgggtgaagtagaagaatcaagaagcgttgcaggaaaaataaaaagagcttattccttccgaagtgcgcaggcggaagcgatcagaaaatgtattgataccagcaaatatcccgttattgtttgcggcgattttaatgatgttccgaattcctattcgtattttaaaataaaaggagatttacaagatgcttttttaaaaaaaggttcaggccttggaaagacattccaattcatatctccaacccttcgcatggattttatgctggctgaaaccgctatcaattcttga

SEQ ID NO: 2986 - protein, 281 aa, Unknown
  Obtained from environmental sample
  SIGNAL (1)...(19)
  DOMAIN (42)...(272): Endonuclease/Exonuclease/phosphatase family
  misc_feature (1)..(281): Xaa is any amino acid
MLRSKWGFLALCALLISWQQISVLFAFRTGKEFDFNKKEKALRVLTWNVSSWTENHHTEDKVERMGLRNLMIDAVQMQNADVLCFQEYFDSFAPELYPANIPVFKKMGFNYYYFTPVLKMVNEKLQAGLCIFSKYPFVDTSFYRVQNTGNSEGMSIADIQFNGKTIRIINTHLESPRLSKQEYNPLGEVEESRSVAGKIKRAYSFRSAQAEAIRKCIDTSKYPVIVCGDFNDVPNSYSYFKIKGDLQDAFLKKGSGLGKTFQFISPTLRMDFMLAETAINS

SEQ ID NO: 2987 - DNA, 372 bp, Unknown
  Obtained from environmental sample
  misc_feature (1)..(372): n is a, c, g, or t
ttgaagaaatatttttatgtagttcatccattgttatgtattcaacatttgaaaacctttccaaatgtgtatcctcctttaactcttcaagacaatttgaaaggaattccttgtcatccaaatcgtgctaaaattcttcaagatttgttggatctaaaaaagaattcaaatgatggacttaaatctggaagcaaaattgaagaattagaagtttggattgaagaattgtttcaagattgtgaagaaattaaagttgaattcgagaaagcatttctttcggaaaacttgaaactgaagaagcaatttccttctcaagaaaatagcgaatttaatgaattgtatgtcaatgtcattcgatccatttggaaataa

SEQ ID NO: 2988 - protein, 123 aa, Unknown
  Obtained from environmental sample
  misc_feature (1)..(123): Xaa is any amino acid
MKKYFYVVHPLLCIQHLKTFPNVYPPLTLQDNLKGIPCHPNRAKILQDLLDLKKNSNDGLKSGSKIEELEVWIEELFQDCEEIKVEFEKAFLSENLKLKKQFPSQENSEFNELYVNVIRSIWK

SEQ ID NO: 2989 - DNA, 768 bp, Unknown
  Obtained from environmental sample
  misc_feature (1)..(768): n is a, c, g, or t
ttgttattcggaagagtcgtgcaaagattaggtttgcggggagcaaaaacgatttcttctggcagaatcgatctcgcatttgacagtctaaaatttattcatccggataattccggtagtattacaggagtacgagcggctaagggtgacattgaattgaagaatttaatgattcccggactaaatacattcaatataaaaatgaatgtagtgggagaggacgatcaatttaacgttatgttttcaagagttgttgaagtgacaaaaaaagaaaaggggaaattttattttgacatttcaaaggagacaccggaatatcgcttacagtacgacgtcagtggggcggatctggaatatttcatcaaaagattttataagaataagtttatgtctggcaaaataaactacatccttgatctaaatgcaacgggcgcaagctgggacagtattaagcaaaacatttcgggtaatatagaaattcttggagactctgttcatctttacggaatagaaattgatgatatcatttcaaaattcaaacaaagtcaaaattttaatcttacggatttaggtgcagtacttgttgccgggcctcttggattagctgttactaagggttcagattttgtttccttggcgagaattaattttgattcgaccaaagaaacaaggataaatgcactttaccttaaatggaaatttgaaaatcatcaactcatttcagaagatgtggctgtagccactaagcaaaatcaaagattgctgtaa

SEQ ID NO: 2990 - protein, 255 aa, Unknown
  Obtained from environmental sample
  misc_feature (1)..(255): Xaa is any amino acid
MLFGRVVQRLGLRGAKTISSGRIDLAFDSLKFIHPDNSGSITGVRAAKGDIELKNLMIPGLNTFNIKMNVVGEDDQFNVMFSRVVEVTKKEKGKFYFDISKETPEYRLQYDVSGADLEYFIKRFYKNKFMSGKINYILDLNATGASWDSIKQNISGNIEILGDSVHLYGIEIDDIISKFKQSQNFNLTDLGAVLVAGPLGLAVTKGSDFVSLARINFDSTKETRINALYLKWKFENHQLISEDVAVATKQNQRLL

SEQ ID NO: 2991 - DNA, 579 bp, Unknown
  Obtained from environmental sample
  misc_feature (1)..(579): n is a, c, g, or t
gtggatatggatggaaaaatattaactgcaggtatttccaacaggaatataattcaaaatatatttttacaaggtatttctttgcctaaggaagaaatggttttccattcggacctgatttatgatattgagaaaaaagctttgacaatagaagccggagaaattaagtacgatgttatttctacaaccctaaatggaacttgtcagcttgcaggaaaacgagtgatggacatccgatttgatgcaacatcgaagaacctggaaattctgtcattcataattaaaccggaattgctacggcaggatccaaatgttttgaaaaatggaaatatgtttgtgaatggaaaaattttcggcgaattaaaaacggagccacttcagtacgacatttcttttggaatgaaaggtctcgatttgcatttaccaaaaatagccggcgattttcataatatcggtttcgatggaaaatattcatccggaaagatgtcggatttaccaggcgcaaaactggaaattaaaaatcttcgagggaaagtccgggaggatttctccaggggcaatttcaatttaaaattttaa

SEQ ID NO: 2992 - protein, 192 aa, Unknown
  Obtained from environmental sample
  misc_feature (1)..(192): Xaa is any amino acid
MDMDGKILTAGISNRNIIQNIFLQGISLPKEEMVFHSDLIYDIEKKALTIEAGEIKYDVISTTLNGTCQLAGKRVMDIRFDATSKNLEILSFIIKPELLRQDPNVLKNGNMFVNGKIFGELKTEPLQYDISFGMKGLDLHLPKIAGDFHNIGFDGKYSSGKMSDLPGAKLEIKNLRGKVREDFSRGNFNLKF

SEQ ID NO: 2993 - DNA, 567 bp, Unknown
  Obtained from environmental sample
  misc_feature (1)..(567): n is a, c, g, or t
atgagcgacgctttaaaacacgaatgtggtatagccttagtcagacttcttaaaccgcttgaatattacaaagaaaaatacggaactgctttttacgggatacaaaaaatgtacctgatgatggagaaacagcataatcgtggtcaggatggagccggttttgccagcatcaaattagatgttgagcctggacagcgttatatcagcagagttcgttcgaatcattcacaaccaattcaggatgtttttaagcagattaatgaccgaatcagtgaagaattaaaagcaaatcctgaaattgctgacgacgttgctaaaattaaagctgaaattccatacgtaggtgaattgttcttaggacatgttcgttacggaactttcggaaaaaacagtattgaaagcgttcatccttttttacgtcagagtaactggatgcaccgtaatttaattttggccggaaactttaatatgaccaatgttaaggaacttttcgaaaatttagtaaagcttgggcagcatcaaaaagagagggtgataccgtacggtatggaaaaatggtccttttaa

SEQ ID NO: 2994 - protein, 188 aa, Unknown
  Obtained from environmental sample
  DOMAIN (40)...(184): Glutamine amidotransferases class-II
  misc_feature (1)..(188): Xaa is any amino acid
MSDALKHECGIALVRLLKPLEYYKEKYGTAFYGIQKMYLMMEKQHNRGQDGAGFASIKLDVEPGQRYISRVRSNHSQPIQDVFKQINDRISEELKANPEIADDVAKIKAEIPYVGELFLGHVRYGTFGKNSIESVHPFLRQSNWMHRNLILAGNFNMTNVKELFENLVKLGQHQKERVIPYGMEKWSF

SEQ ID NO: 2995 - DNA, 696 bp, Unknown
  Obtained from environmental sample
  misc_feature (1)..(696): n is a, c, g, or t
ttgttcgagaacctgcggcccacgcctgaactttcttttgcaatcaggcaattagcttgtaagggtggtgtagtgtgcactgcttctcataatccaaaagaatataatggctacaaagcgtattgggatgatggcgggcaattagttccgccgcatgataaaaatgtaattgtagaagtagaaaagattgcaagtgttagtgatgtaaaatggaatgggaatgatgaaaacattatcatcatcggtaaaaagatggatgaggcttatataaaaatggtaaagggcctgagtgtttatcctgaggtgatacaaaaggaaaaagaccttaagattgtttatacacctattcatggtacaggaataaaactggtgccgcaggtattaaaagaatttggttttaccaatgtgcatattgtagaagaacaaaaaaccccggatggaaattttccaacggttgcttatccaaatcctgaagaaaaagaaaccatgagcattggtcttaagaaagcagaagaactggatgccgatattttgttaggcactgacccggatgcagaccgcgtaggcattggcgtaaaagacagcaatggaaaatggattttaatgaacggcaaccaaactgcggtgcttgcctttaattacatgatagaaagccgtaaagaaaaaggcatagcgcagtcaaacgatatggtgtga

SEQ ID NO: 2996 - protein, 231 aa, Unknown
  Obtained from environmental sample
  DOMAIN (1)...(67): Phosphoglucomutase/phosphomannomutase, alpha/beta/alpha domain I
  misc_feature (1)..(231): Xaa is any amino acid
MFENLRPTPELSFAIRQLACKGGVVCTASHNPKEYNGYKAYWDDGGQLVPPHDKNVIVEVEKIASVSDVKWNGNDENIIIIGKKMDEAYIKMVKGLSVYPEVIQKEKDLKIVYTPIHGTGIKLVPQVLKEFGFTNVHIVEEQKTPDGNFPTVAYPNPEEKETMSIGLKKAEELDADILLGTDPDADRVGIGVKDSNGKWILMNGNQTAVLAFNYMIESRKEKGIAQSNDMV

SEQ ID NO: 2997 - DNA, 360 bp, Unknown
  Obtained from environmental sample
  misc_feature (1)..(360): n is a, c, g, or t
atgaattcctctnggaaaggcaggtttgacaatgtaatcaacagtgcaggcatcaaactgattccggaagaacttgaaaagaaaattcattccatcccgcaaagacggttttttatggccggcaaaaaagatgaaaaattgggagagaaactcatcctgatcattgaaggaagtccatttggcgaaacagaaatgtcttcaattaaaaatgcgttgaaagcttccctcggcaaatatgaaatgcccaaggaaatttattttctggatcaatttattgaaacgaaaaataaaaagctcaatcgcgctgctactaccaaaaaactcaacgagattctgattgatcttggaaatgtaaactga

SEQ ID NO: 2998 - protein, 119 aa, Unknown
  Obtained from environmental sample
  misc_feature (1)..(119): Xaa is any amino acid
MNSSXKGRFDNVINSAGIKLIPEELEKKIHSIPQRRFFMAGKKDEKLGEKLILIIEGSPFGETEMSSIKNALKASLGKYEMPKEIYFLDQFIETKNKKLNRAATTKKLNEILIDLGNVN

SEQ ID NO: 2999 - DNA, 444 bp, Unknown
  Obtained from environmental sample
  misc_feature (1)..(444): n is a, c, g, or t
ttggaaatttctcccaaagccaatancggcattattttttatgtaaatgaaaatccctcaaagtatccacagacatacaataccggcatggaaatgcaggttttggataatggttccgcaacggttgccggccatccggatgctaaaatatatactcaccgggccggcgatctttatgatcttctcccttcaaaagatgcagtaaaacctgccggagaatggaatcatatcgaaatcaaatcgcaaaacggcaaactggatttttatatgaatggtgagcatacgctttccaccactttatgggatgataactggtcgaaaatgattgcgatcagcaagtttaaagacatgccggattttggcacttttaaaaaaggaaaaattgcgctgcaggtgcatggcaacgacgtctggttcaaaaatatcaggataaaacgattgtaa

SEQ ID NO: 3000 - protein, 147 aa, Unknown
  Obtained from environmental sample
  DOMAIN (2)...(146): Domain of Unknown Function (DUF1080)
  misc_feature (1)..(147): Xaa is any amino acid
MEISPKANXGIIFYVNENPSKYPQTYNTGMEMQVLDNGSATVAGHPDAKIYTHRAGDLYDLLPSKDAVKPAGEWNHIEIKSQNGKLDFYMNGEHTLSTTLWDDNWSKMIAISKFKDMPDFGTFKKGKIALQVHGNDVWFKNIRIKRL

SEQ ID NO: 3001 - DNA, 648 bp, Unknown
  Obtained from environmental sample
  misc_feature (1)..(648): n is a, c, g, or t
ttggagaaaggactttttggaaaagggctggttcaggaacaatttgaattaagcgacaaaagcgcactgcggctcactgtcgcaagatattttacgccaactggccggagcattcagcgttcttattcaaaagncggcaaagcatattttgacgagatagcaaacaggtacattgatggtgagataatgaatggcgattcttcaaggtatgataccagccattcttttatgtccactaatggcaaaaaattatatggcggcggagggatcaatccggatcactttgttgcgggcgatacaggcagaattggtatcattacagcaaaagtatttgccaaaggaattgtaagcgattacggttataaatttttacaaaagtatccgggttttcaaaacacttacaaaacaccggaagatttttccgaccgttttgttttgtcagacgataactggaaatacttcctgcaactgtcggctgccgattcagttgacatcgattccataaaccttgtagaaagatcatttcttacacaaagccttaagcgatcagttgcccgtcagttgtggagaaacgaaggctattaccaggtaataaatattgatgataaggccgtaaataaagcagtacagcttttggaaggtaattga

SEQ ID NO: 3002 - protein, 215 aa, Unknown
  Obtained from environmental sample
  misc_feature (1)..(215): Xaa is any amino acid
MEKGLFGKGLVQEQFELSDKSALRLTVARYFTPTGRSIQRSYSKXGKAYFDEIANRYIDGEIMNGDSSRYDTSHSFMSTNGKKLYGGGGINPDHFVAGDTGRIGIITAKVFAKGIVSDYGYKFLQKYPGFQNTYKTPEDFSDRFVLSDDNWKYFLQLSAADSVDIDSINLVERSFLTQSLKRSVARQLWRNEGYYQVINIDDKAVNKAVQLLEGN

SEQ ID NO: 3003 - DNA, 510 bp, Unknown
  Obtained from environmental sample
  misc_feature (1)..(510): n is a, c, g, or t
gtggaattgatacgcgggaagatctttaaaatgagccctgcgccggcgccaaggcatcagcaaatttcgataagcttatcatctgagatttataattttttgaagaaaaaatcctgtaaagtttttaacgcccccttcgatgttcgccttccggtaaaaaataaaaagaaggacaatgaaatcaccactgtagttcaacctgatatttgtgtgatttgcgacgaaggtaagattgatggtcgtggctgtttgggtgcgcctgatcttataattgaaatcctttctcccggcaatacggaaaaagaagtgaaactgaagtttgaattgtatgaagaagtcagcgttaaagaatactgggttgtgtatccatctgaagaaaatgtggctgtttttattttaaatgaaagtgaaaagtatgaaggtgccaaaatttatgcaggaaaggaccgcataaaaagcatcgctgtaaaaggattgatcattaacctcgaagacatttttaccaaataa

SEQ ID NO: 3004 - protein, 169 aa, Unknown
  Obtained from environmental sample
  DOMAIN (1)...(167): Protein of unknown function (DUF820)
  misc_feature (1)..(169): Xaa is any amino acid
MELIRGKIFKMSPAPAPRHQQISISLSSEIYNFLKKKSCKVFNAPFDVRLPVKNKKKDNEITTVVQPDICVICDEGKIDGRGCLGAPDLIIEILSPGNTEKEVKLKFELYEEVSVKEYWVVYPSEENVAVFILNESEKYEGAKIYAGKDRIKSIAVKGLIINLEDIFTK

SEQ ID NO: 3005 - DNA, 339 bp, Unknown
  Obtained from environmental sample
  misc_feature (1)..(339): n is a, c, g, or t
gtgaaatggtgtagaacgaacagacaaacgggattatacatcattccctcaaggcaaaatagatttgaaatgctgccatgcgttttggttatacagatctataaaatttgcgttcgcctgaaaagtacagaatccttcttgatcaagtacaaaaaatacggttctgaaagtttattgagtttcctcatgagctgtaaatgtcataccgtgttcactcaccagtttttctctcaaacacgtgccgcgaccggctgtcacattcggctattacagtccaccattcctccttcaaaacaatcaaacacgttattttctccaaaaaaccaagggcccttttga

SEQ ID NO: 3006 - protein, 112 aa, Unknown
  Obtained from environmental sample
  misc_feature (1)..(112): Xaa is any amino acid
MKWCRTNRQTGLYIIPSRQNRFEMLPCVLVIQIYKICVRLKSTESFLIKYKKYGSESLLSFLMSCKCHTVFTHQFFSQTRAATGCHIRLLQSTIPPSKQSNTLFSPKNQGPF

SEQ ID NO: 3007 - DNA, 399 bp, Unknown
  Obtained from environmental sample
  misc_feature (1)..(399): n is a, c, g, or t
ttgccggtttattatttgggtatatcattcagcataggaaacataattagtttcatactgcttcttattactcttaatgcaaaaattacactaccaaagcttgagattgtaattacatttataaaaattgtgacagcaacttttgttatgggtgttgcgctttatattccaataaagcttttggatcaattagtatttgatacgacaagaaccataaatctttttatcctaaccggaattgcttctatttgtggaataatagcctacgttttctttacatggttgcttgatatcaaagaagcgtattacataattgctgttgccaagcaattcagaaataaaaataaaataataaagcagataggagaactcctagacgggtcaaagctcacgccataa

SEQ ID NO: 3008 - protein, 132 aa, Unknown
  Obtained from environmental sample
  misc_feature (1)..(132): Xaa is any amino acid
MPVYYLGISFSIGNIISFILLLITLNAKITLPKLEIVITFIKIVTATFVMGVALYIPIKLLDQLVFDTTRTINLFILTGIASICGIIAYVFFTWLLDIKEAYYIIAVAKQFRNKNKIIKQIGELLDGSKLTP

SEQ ID NO: 3009 - DNA, 993 bp, Unknown
  Obtained from environmental sample
  misc_feature (1)..(993): n is a, c, g, or t
atggtcaacctttacatcaacgggaaattagcaaatggtgatgttgaatacgtaattacaaatatcgaagatataactcaggcaaaagtaggagacacaatgactctttcaaaaattccggcagaaagcctccctggatacaaagagcaanaaccttttgtctatttatcaatctatcctacttcgtcctctgattttcaaaacttaagaaaagcaatttactcgttgaagcttactgacgcggctttagttattgctcccgattattcatctgtatttggatctggatttaggtgtggatttttaggacttttacattcccagatagttcttgaaagaatcgagcgcgaatacgatctggatgttttttcagctcctccttctattgcttatcttgtagacggagttgaaatttccagtccgaaagaatttgatatttcaaaaaacgatataaaggagccctatatccttggagaggtttacacgcctgctcaatatttgggaggaattcttgatcttgtttataaaggccgtggtcaagagggagacgtatcttattttggaactcaggtaaaagtgacatttgaaatgccattatcaaacattgtgtatgacttttatgacaatctaaaatccgcttctgcaggatacgcgtcatttgactatgaatttttggagtatagaaattcagatttagagcgagtagatatttctgttaatgaattaattgttcctgagctttcctttattgtacataagacaaatacagattctttctcaagaagaattgttgaagttctttcaaaaagtattccaaaacactcatttcaaattgccgtaagggcgcaggttggaggaaagataattgcttcagaaaaaattggtgcatacatgaaagacgtcaccggaaaattgtatgggggagatagaactagaaaagataaactgctcgacaagcaaaaagaaggaaagaaaaagatgaatcattcttga

SEQ ID NO: 3010 - protein, 330 aa, Unknown
  Obtained from environmental sample
  DOMAIN (150)...(238): Elongation factor G C-terminus
  misc_feature (1)..(330): Xaa is any amino acid
MVNLYINGKLANGDVEYVITNIEDITQAKVGDTMTLSKIPAESLPGYKEQXPFVYLSIYPTSSSDFQNLRKAIYSLKLTDAALVIAPDYSSVFGSGFRCGFLGLLHSQIVLERIEREYDLDVFSAPPSIAYLVDGVEISSPKEFDISKNDIKEPYILGEVYTPAQYLGGILDLVYKGRGQEGDVSYFGTQVKVTFEMPLSNIVYDFYDNLKSASAGYASFDYEFLEYRNSDLERVDISVNELIVPELSFIVHKTNTDSFSRRIVEVLSKSIPKHSFQIAVRAQVGGKIIASEKIGAYMKDVTGKLYGGDRTRKDKLLDKQKEGKKKMNHS

SEQ ID NO: 3011 - DNA, 639 bp, Unknown
  Obtained from environmental sample
  misc_feature (1)..(639): n is a, c, g, or t
atgcttttgagaagatggatcgaatgtatcgttatcagcgatacttttatgagtctgacccgtaaatattatctgttggggcgcgacaagctgatcgcccggatggatgttcaggcagatcagaacgttttggaagtcggctgcggaaccgggcgcaacctgaccatcctagccaaaaagtatcctcaatcgaactttttcgggctggatgcttcgagcgtcatgatcgaagaatcgcaaaaaaaggtggaaaagcattcgctcaaaaatgtgaatcttcaaatcgcgctggccgatgattttacccaccagaaaacttttaatttggatcagccttttgacacgatttattgcagttattcgatctcgatgatcccgccctggaaagaaaccatcgccaactctttaaacaacttacgcccgggcgggagtttttacatcgtcgatttttatgaccagaaagatctgccgcgctggtttcagaaaatgctcaagggctggctcaaacaatttcacgttcagttttggggcgatctgatgccgtatctcgaatcgctggaagctgaggatttgggtaaattaaccgtcacctcgattgcccgccgctacgcttttattgcacaatttgaaaagaggtga

SEQ ID NO: 3012 - protein, 212 aa, Unknown
  Obtained from environmental sample
  DOMAIN (26)...(212): Putative methyltransferase
  misc_feature (1)..(212): Xaa is any amino acid
MLLRRWIECIVISDTFMSLTRKYYLLGRDKLIARMDVQADQNVLEVGCGTGRNLTILAKKYPQSNFFGLDASSVMIEESQKKVEKHSLKNVNLQIALADDFTHQKTFNLDQPFDTIYCSYSISMIPPWKETIANSLNNLRPGGSFYIVDFYDQKDLPRWFQKMLKGWLKQFHVQFWGDLMPYLESLEAEDLGKLTVTSIARRYAFIAQFEKR

SEQ ID NO: 3013 - DNA, 405 bp, Unknown
  Obtained from environmental sample
  misc_feature (1)..(405): n is a, c, g, or t
ttggaaaaggctttatacaaatataattttttaacccttatcttcctattgctttctggctttgcccatagtcaaaagacccaaagctttaaagtgcgtaagcccgaaggtgatcttgtgttctaccaaaagggcaccagggtcgacagtcttacaaaaaccaaaggcaacgaatttattttgatagtaccggagggattgaggaactacatccatcttttttcggagaacggacagctcattaaaaccggcaatgacagtactttcaaattgaattttatcaaaggtataggatatgaatgctactattctctgatctctaaaaaaggagagaaagacaagtgggagtttttgaccctggtgaacggagcagctccgcaggcctcgcagaaagttaaaattnnn

SEQ ID NO: 3014 - protein, 135 aa, Unknown
  Obtained from environmental sample
  misc_feature (1)..(135): Xaa is any amino acid
MEKALYKYNFLTLIFLLLSGFAHSQKTQSFKVRKPEGDLVFYQKGTRVDSLTKTKGNEFILIVPEGLRNYIHLFSENGQLIKTGNDSTFKLNFIKGIGYECYYSLISKKGEKDKWEFLTLVNGAAPQASQKVKIX

SEQ ID NO: 3015 - DNA, 837 bp, Unknown
  Obtained from environmental sample
  misc_feature (1)..(837): n is a, c, g, or t
gtggatttgcgttgtccagccattggttttatatatggaattgtgagaggagcataccaatacaagatccacaggntaaaagtaccttctccaaatttacctgaagcttttaatggttttaaaattgttcagttatcagatattcacacagggtcttttatggataattctcccctggagaaagcatttgagattgtaatgaaggaaaatgccgatctgatcctttttaccggagatctggtaaataatgaaagcaccgaaaccattggctttactgatacttataaaaaactgaaagctccttatggtgtttattcagtgctaggtaatcatgattatggagattatgttcattggaacagtgccgaagagaaaaggaacaatttggagaaacttaagtctattcaaaccgcgtcaggatggcgtttgctgatgaacgagcacgtagctttggaaaaaggcggcgaaaagattgctttgttaggaattgagaactggggtggtaagggtggttttccgaagtacggtaaaatggaagatgcgtataaaggaaccgagaactatccttttaaaatactaatgagccatgacccgagtcattgggaaaaacaagtccagccgcagtatcctgacattgatctcaccttaagtggtcacacccatggcatgcaaatgggaattgagattccgggtttaagatggagtccggtacaatacttttacaaacagtgggcagggcttaataagagcggcaaacaattcctgtatgttaacagaggcctgggcttcctgggcctacccgcgtcaattgcgatttggcctgagattccgttatag

SEQ ID NO: 3016 - protein, 278 aa, Unknown
  Obtained from environmental sample
  DOMAIN (40)...(223): Calcineurin-like phosphoesterase
  misc_feature (1)..(278): Xaa is any amino acid
MDLRCPAIGFIYGIVRGAYQYKIHRXKVPSPNLPEAFNGFKIVQLSDIHTGSFMDNSPLEKAFEIVMKENADLILFTGDLVNNESTETIGFTDTYKKLKAPYGVYSVLGNHDYGDYVHWNSAEEKRNNLEKLKSIQTASGWRLLMNEHVALEKGGEKIALLGIENWGGKGGFPKYGKMEDAYKGTENYPFKILMSHDPSHWEKQVQPQYPDIDLTLSGHTHGMQMGIEIPGLRWSPVQYFYKQWAGLNKSGKQFLYVNRGLGFLGLPASIAIWPEIPL

SEQ ID NO: 3017 - DNA, 555 bp, Unknown
  Obtained from environmental sample
  misc_feature (1)..(555): n is a, c, g, or t
ttggcatttattcaacacatgtttgcttgtttaaatgatagagggcaagctgctatcatctgttcgcaaggtgtattgtttagagggaatgaagaacaaacaataagagaaaagatgataaaagaagatattatagaaggtgtaatatctctacctctaaaattattttatggtactggtattccaggttgtgttctcatcttaaacaaaaagaagcctgaaatgagaagaaataaagtaattctgatatatgcagcaaaagagtttgaagaaggaaaagttagaaacaatctaagagaagaagacattaaaaaaattagttctgcttttaaaaaatatgaagaagttgaaggatattgtcatatagcagattttgatgaattaaaggaaaatgaattcaatcttaatgttccaagatatgttgatatttccataacagaggatgaaattgatatccaaaatacaattaatgaactaaagagattggaaaaagaaagacaagaaattgaaattcaagttagtaaaaatttgaaagaattaggatttaagatttag

SEQ ID NO: 3018 - protein, 184 aa, Unknown
  Obtained from environmental sample
  DOMAIN (1)...(134): N-6 DNA Methylase
  misc_feature (1)..(184): Xaa is any amino acid
MAFIQHMFACLNDRGQAAIICSQGVLFRGNEEQTIREKMIKEDIIEGVISLPLKLFYGTGIPGCVLILNKKKPEMRRNKVILIYAAKEFEEGKVRNNLREEDIKKISSAFKKYEEVEGYCHIADFDELKENEFNLNVPRYVDISITEDEIDIQNTINELKRLEKERQEIEIQVSKNLKELGFKI

SEQ ID NO: 3019 - DNA, 471 bp, Unknown
  Obtained from environmental sample
  misc_feature (1)..(471): n is a, c, g, or t
atgaaaattggtttaaaattcaccatttatttcttcctaatttcatttttatccatgttggtagtaggtattatttcataccaacgcgccaaaagttcgcttcaggacgaatcattcaatcgcctcacagcggtgcgtgaaatgaaagcaggacaaattgaagattattttcaattcatttccgaccaggtttcaacctttgccgaagatcgcatgatcgtgcgtgccaccaacaaactcaaagagtcgtttaactccattgaacaggaattgaattacgcgccacaacaaaaacacatggccgattcatctcttaacgcttattttacctatgagtatttaccgcgcctgaataaaaaccttaccgtaaaaaccgatattgaaaaagaatcttcaaaagacattcgtacacggttgcttcaaaatttatatatgtcgggtaatccaaacccggttggacaaaagcacttn

SEQ ID NO: 3020 - protein, 157 aa, Unknown
  Obtained from environmental sample
  misc_feature (1)..(157): Xaa is any amino acid
MKIGLKFTIYFFLISFLSMLVVGIISYQRAKSSLQDESFNRLTAVREMKAGQIEDYFQFISDQVSTFAEDRMIVRATNKLKESFNSIEQELNYAPQQKHMADSSLNAYFTYEYLPRLNKNLTVKTDIEKESSKDIRTRLLQNLYMSGNPNPVGQKHX

SEQ ID NO: 3021 - DNA, 750 bp, Unknown
  Obtained from environmental sample
  misc_feature (1)..(750): n is a, c, g, or t
ttgcttcaaaatttatatatgtcgggtaatccaaacccggttggacaaaagcactaccaggacgctgcctacgacagcagttcgtacactaaatttcataaaacttttcatcccattgtaagaaaatacctcgaaaaattcgggtattacgatatttttattgtggacattgaaacgggtaatatcgtgtattcggttttcaaggaagccgattacggaacatcattgctaacgggtccgtttaaaaacaccaaccttgccgatgcgtttcgtgaagtgcgcaacagcgacagcaaagattttgttaagctggttgactttaaaccttaccgcccatcgtataacgcgcccgcttcatttattgccgcgcccatttacgagaacaatgtaaagataggggcccttatttttcaattacccattgaccggatcaataaaataatgaccagcaatcaacagtggtcaaaagttggtttgggaaaaaccggtgaaacatatattgttggcgaagattttaccctgagaaatcagtcacgttttttgatcgaggatagcaagaactattttaaaatgatcagcgatattggcacgccaaagcatattgttgatgaaataaaaaactttaacagcgccattggcttgcaggaagtgcgtaccgaaggaacaaagtcagctgtgagtggtgaaacagacgccaaaatttttgacgattaccggggagtttcgttttatcggcctaccggccattga

SEQ ID NO: 3022 - protein, 249 aa, Unknown
  Obtained from environmental sample
  misc_feature (1)..(249): Xaa is any amino acid
MLQNLYMSGNPNPVGQKHYQDAAYDSSSYTKFHKTFHPIVRKYLEKFGYYDIFIVDIETGNIVYSVFKEADYGTSLLTGPFKNTNLADAFREVRNSDSKDFVKLVDFKPYRPSYNAPASFIAAPIYENNVKIGALIFQLPIDRINKIMTSNQQWSKVGLGKTGETYIVGEDFTLRNQSRFLIEDSKNYFKMISDIGTPKHIVDEIKNFNSAIGLQEVRTEGTKSAVSGETDAKIFDDYRGVSFYRPTGH

SEQ ID NO: 3023 - DNA, 324 bp, Unknown
  Obtained from environmental sample
  misc_feature (1)..(324): n is a, c, g, or t
ttgaagtggaaatataatattatgaaatactaccggccactcagctcagttctgctactgataattgttcttttctcttgcggaaaaaacaataatgtcacaaagccggtgagaaaagatgtggttcaggcagtgtatgcttcgggtaaattatttccaaaagatcattacatggttctttctaaatttcccggatacattcaacaggtgcatgtgaatgccggagatattgtaaaagccggacagattcttctcacgatccgaaatgaaaccggtaaactaaatacgggaagcgctttgaaccagcttaatcttgccgcgtga

SEQ ID NO: 3024 - protein, 107 aa, Unknown
  Obtained from environmental sample
  misc_feature (1)..(107): Xaa is any amino acid
MKWKYNIMKYYRPLSSVLLLIIVLFSCGKNNNVTKPVRKDVVQAVYASGKLFPKDHYMVLSKFPGYIQQVHVNAGDIVKAGQILLTIRNETGKLNTGSALNQLNLAA

SEQ ID NO: 3025 - DNA, 792 bp, Unknown
  Obtained from environmental sample
  misc_feature (1)..(792): n is a, c, g, or t
gtgatgttcggaattatggttttcatcatgcaggccggactgattaccggattccaggatattttcattgagcaaactattaatacaactgctcacatccgcatttacaacgagcccgaaaaaaaccgtccttccgtgcttgaccgttactatgcaggaagcggaaaactaatttctgtcaataatcaaaagcccaaagaagaattaaataaaatcaaaaacgcctggcagatcattcgtgttcttgaaaaagatcctgatgtttcaggtgtttctccttttatcggtactcaggcaattttacgggcgggaatagttcaatatggcggaaagttagccggtgttgatattgataaggaaaatattcttttcaaagtttccgactacatggttgaaggtgaaatcggaaaattaaaaaccattaataacggtattattcttggctccggacttgctgacaagcttgctgtaatgatgaatgataatattacagtgattgcacctaacggtacaacgcttgagatgaaagtggttggaataaataaaacaggacttacagaagtggataagtcaagagcttatatcagcatccggaatgcgcaaaaattgctgggtgtagataattcatatctgaccgacatcaatattaaactgcattcaattgataaggcagaggaactcgctgctcattacaaaaaccgatttggatatacggcagaagactggaagaaaacgaatgcaaatatttttggagtttttaaaattcaaaacatgtcactatctatccattag

SEQ ID NO: 3026 - protein, 263 aa, Unknown
  Obtained from environmental sample
  misc_feature (1)..(263): Xaa is any amino acid
MMFGIMVFIMQAGLITGFQDIFIEQTINTTAHIRIYNEPEKNRPSVLDRYYAGSGKLISVNNQKPKEELNKIKNAWQIIRVLEKDPDVSGVSPFIGTQAILRAGIVQYGGKLAGVDIDKENILFKVSDYMVEGEIGKLKTINNGIILGSGLADKLAVMMNDNITVIAPNGTTLEMKVVGINKTGLTEVDKSRAYISIRNAQKLLGVDNSYLTDINIKLHSIDKAEELAAHYKNRFGYTAEDWKKTNANIFGVFKIQNMSLSIH

SEQ ID NO: 3027 - DNA, 315 bp, Unknown
  Obtained from environmental sample
  misc_feature (1)..(315): n is a, c, g, or t
ttgccactgagaggggacccatctatgattgccttaggatgggacgtcagcaatttcctgcacaaaaggcgtgaatcttgctccatctggaaggagttggatatggctgtagcaaactcttattcatcaaacgataaagtatttataatgcctgaggtcgctgcctatttgaaaatctcaaaatctaagatctactatttggtgtctcgcaaagagatacctcacttgaaatcagggagaaatgtgaggattcgtgaatcagatcttcagaagtggctggaacatcaagtcgaagaagatctagtgcccccatag

SEQ ID NO: 3028 - protein, 104 aa, Unknown
  Obtained from environmental sample
  misc_feature (1)..(104): Xaa is any amino acid
MPLRGDPSMIALGWDVSNFLHKRRESCSIWKELDMAVANSYSSNDKVFIMPEVAAYLKISKSKIYYLVSRKEIPHLKSGRNVRIRESDLQKWLEHQVEEDLVPP

SEQ ID NO: 3029 - DNA, 861 bp, Unknown
  Obtained from environmental sample
  misc_feature (1)..(861): n is a, c, g, or t
atgcttaatgagactactactgatctaaatgaaattgaagtcaaagtagaaaagtatagaaataaagacaatcctgcagttgctcttattagaaatgtcataaagaataaagacaataatagaaataagagctttgattacttcaattatgaaaagtatgaaaaggtccagttggcttataataacgttacagccaatacccgcaaaaacatattattcagaagtatgaagtttatctttgattttgctgacaccagtaagatcaatggtaaagtaaaccttccgtttttccttagagagagctattcagatgtttattatagaaaagatccaagctcacaaaaggaatatattagggctgagaaaaataccctgatgcctggtatttttgataatgtgggaatagcagattttattgagaatatgtctcaaactattgatatatatgataatgcaataaacctggttaccgttaattttacaagtcctatttctattattgcccccaatctttacaggttttatataattgataccacttattttggagctacccaggtggctcatttatattttgcacccagggaaaaacatgatttggcttttatgggtcatatatggattgcgctggattcaacatatgcggtaaggaaaattgaattgggcattccgcaggagatcaacttaaactgggtaaaagaacttcagcttatccaggaatttgattgggtagaagataagagtaacactcctggcactaaggccaaaagaggtttaatgttaacaaaggacgagatatttatggactttggtttaattagaaaagaaaagactcaatcaatccttggaaataaactatag

SEQ ID NO: 3030 - protein, 286 aa, Unknown
  Obtained from environmental sample
  misc_feature (1)..(286): Xaa is any amino acid
MLNETTTDLNEIEVKVEKYRNKDNPAVALIRNVIKNKDNNRNKSFDYFNYEKYEKVQLAYNNVTANTRKNILFRSMKFIFDFADTSKINGKVNLPFFLRESYSDVYYRKDPSSQKEYIRAEKNTLMPGIFDNVGIADFIENMSQTIDIYDNAINLVTVNFTSPISIIAPNLYRFYIIDTTYFGATQVAHLYFAPREKHDLAFMGHIWIALDSTYAVRKIELGIPQEINLNWVKELQLIQEFDWVEDKSNTPGTKAKRGLMLTKDEIFMDFGLIRKEKTQSILGNKL

SEQ ID NO: 3031 - DNA, 633 bp, Unknown
  Obtained from environmental sample
  misc_feature (1)..(633): n is a, c, g, or t
atgatcaccaaagacagtcgtatacaggtggagtttgaatatgctgacaggaattatcttaatgccaatctgtatgtatcgcaggaatttgaatttaataagaaactgaaaatatttgtcggggcatttaataacagcgattcaaagaattcacagatcaaccagacattggatgatgatcagaaattgttcttaacaaatcttggcgatagcattcaaaaagcattttatccttctgcggtcatcgatacattgttcgatccggggaagattttatacgaaaagttgtattataatcccggtgcaggcgttgattcattttaccagtattcaacaaatccttttgctgctaaatatgatcttgcctttagtgatgtaggagaagggaagggaaattacattcccgatcttaatggggccaatggaaaagtatataaattcattatgcccatatccggtgtaaaacaaggaagatatgaaccggtgatcctgcttgttactccaaagaaacagcaggtgatgaatgtaggaacagattataagatcaacagcaatacctctttgaagacagaggttgctttgagtaactatgatgtaacactttttcagacaaagacaatggcgatgatatag

SEQ ID NO: 3032 - protein, 210 aa, Unknown
  Obtained from environmental sample
  misc_feature (1)..(210): Xaa is any amino acid
MITKDSRIQVEFEYADRNYLNANLYVSQEFEFNKKLKIFVGAFNNSDSKNSQINQTLDDDQKLFLTNLGDSIQKAFYPSAVIDTLFDPGKILYEKLYYNPGAGVDSFYQYSTNPFAAKYDLAFSDVGEGKGNYIPDLNGANGKVYKFIMPISGVKQGRYEPVILLVTPKKQQVMNVGTDYKINSNTSLKTEVALSNYDVTLFQTKTMAMI

SEQ ID NO: 3033 - DNA, 555 bp, Unknown
  Obtained from environmental sample
  misc_feature (1)..(555): n is a, c, g, or t
atgaaaagaaatttgaaaataactcttatcgtaattctatttgtatttgttttgttcttattcttttataaatacaaaattgataaaccatataggattgtgaaagatatttctgatcttacgatcacaagaaatagtaagctttataagtatgataagtttgttgataattttgatggcagttcaaccatggaaattcgattttctataggctacaaggacataaaagaattaaaagagcaaacaaaaaaagaaaagtttaaaatcccacctgttagaggctttaattttggcgatgagattgaaaattatttagtgcctaaagattcagtgtactataagttggagggcgaagatatcatggattattctttaacggtagtaaattttacacaacggaaactaataataaaaaaggtgcaaacttataaattgacttcattcaagtcccatgatactagtcctctgttctttacggagtgtccaatgtccaaaaccattgcagnccgatgtctcacctcccagatctgtgcattggtggactcggngcaataa

SEQ ID NO: 3034 - protein, 184 aa, Unknown
  Obtained from environmental sample
  misc_feature (1)..(184): Xaa is any amino acid
MKRNLKITLIVILFVFVLFLFFYKYKIDKPYRIVKDISDLTITRNSKLYKYDKFVDNFDGSSTMEIRFSIGYKDIKELKEQTKKEKFKIPPVRGFNFGDEIENYLVPKDSVYYKLEGEDIMDYSLTVVNFTQRKLIIKKVQTYKLTSFKSHDTSPLFFTECPMSKTIAXRCLTSQICALVDSXQ

SEQ ID NO: 3035 - DNA, 420 bp, Unknown
  Obtained from environmental sample
  misc_feature (1)..(420): n is a, c, g, or t
atgaatttagtagtaacgattaaagaagcaaccgctaaagcaattgaagatatttacaagctaccagtatttgcagatgatgttttggtaaatcaaaccaaacccgaatttgagggagattacactgtagttttattttcgttcgtaaaaaaattcagtgcctctccggaaaaactgggcaacgaaataggcacatggcttacaaaaaaaaacagcgatctctttacaggttataatgtgatcaaaggtttcctgaatctgacgatcgccgacaagttttttatcgattacttgttcgtcggtgatccatttacaagattaattcctcaaccaggtatgcaaagaaaagttatggtagaatattcgtcgcccaataccaacaaacctttacatctaggccatctccgtaatattttatag

SEQ ID NO: 3036 - protein, 139 aa, Unknown
  Obtained from environmental sample
  DOMAIN (1)...(89): Arginyl tRNA synthetase N terminal domain
  misc_feature (1)..(139): Xaa is any amino acid
MNLVVTIKEATAKAIEDIYKLPVFADDVLVNQTKPEFEGDYTVVLFSFVKKFSASPEKLGNEIGTWLTKKNSDLFTGYNVIKGFLNLTIADKFFIDYLFVGDPFTRLIPQPGMQRKVMVEYSSPNTNKPLHLGHLRNIL

SEQ ID NO: 3037 - DNA, 315 bp, Unknown; identical to SEQ ID NO: 567
  Obtained from environmental sample
  misc_feature (1)..(315): n is a, c, g, or t

SEQ ID NO: 3038 - protein, 104 aa, Unknown; identical to SEQ ID NO: 568
  Obtained from environmental sample
  misc_feature (1)..(104): Xaa is any amino acid

SEQ ID NO: 3039 - DNA, 756 bp, Unknown
  Obtained from environmental sample
  misc_feature (1)..(756): n is a, c, g, or t
ttgaatgatcaggttatagcgattttcaaaaaaaataccacacttcagcctggtatttattcaatcgtattccccggcaaaaataaattagtcgatttttttgttgataaagaacagactttatttatagacgccgataccacagacctgctgaacaagaccctaataaagggttccaaagaaaatgccctgtttcagcagtaccaaaaatatattgcagtaaaaggcaagcaactgcaaaatgaacaacaagctttcaatacgtcggcgtcaaaaactgattcagccttacatgaaaaaaattataaagtacttaatgctgaactgaatgaatacagggaaaatattgttaaacagtatccaacatcaatgctggccacattatttaaaagcatgagaactcctgcaatgccggtagcaaagccacttaacagggaagattcaatagccaattatagttattacaaaaagcattattgggatggaataacctttatggacagcaggataatacgcacacctttctttttaccaaaagttgaaaaatattttagggaagtgcttgtgcccgcaccagattcaattataaaagaagctgattatttattgctattggcaaggagtgacagtgcgatgtatcgctttttgctcaactggctaactgacgaatatatttatccaaagtatatgggccaggatgcagtatttgttcacctgtttgaaaagtatcantccgaangattaccccttggctga

SEQ ID NO: 3040 - protein, 251 aa, Unknown
  Obtained from environmental sample
  misc_feature (1)..(251): Xaa is any amino acid
MNDQVIAIFKKNTTLQPGIYSIVFPGKNKLVDFFVDKEQTLFIDADTTDLLNKTLIKGSKENALFQQYQKYIAVKGKQLQNEQQAFNTSASKTDSALHEKNYKVLNAELNEYRENIVKQYPTSMLATLFKSMRTPAMPVAKPLNREDSIANYSYYKKHYWDGITFMDSRIIRTPFFLPKVEKYFREVLVPAPDSIIKEADYLLLLARSDSAMYRFLLNWLTDEYIYPKYMGQDAVFVHLFEKYXSEXLPLG

SEQ ID NO: 3041 - DNA, 630 bp, Unknown
  Obtained from environmental sample
  misc_feature (1)..(630): n is a, c, g, or t
gtggcggagcagatgagaaataacgtatgcaaaattaattttacaagaacatcgaagcatgaaatggaaaggaaagctcagatgagaaagctttgggtcaaggcctggatcacctttgatggggtctttgatgcggatacgatggatcactggtggcaaaatacgaataaccctgaaagaatggagtacatcatggagcagtattcccagggcgatatttatatgatgggacgcaccacttatgagatgctctggccgggctggtctaaggatacatctgaggtagggcagattctcaatcgcatgcataaatatgtgatctcgaccaccctcaccgaggctccctggaaagaatcaaccatcatccgagaaaatgtggtggaagaaattgccaagctgaaacagcagccgggcaaagacattattatcgacggcagcgcaacgctggtccagtcgctgcaaggcacgggcctgattgacgagtaccgcttcctggtcgaaccattcatcatgggcagaggcaaacggttcttcgcggaaggaacggacatgcacaaattgcggctggccgaaagcaagacgctcaattccggaaccctggcgcttatctatcagcctgctaagaaataa

SEQ ID NO: 3042 - protein, 209 aa, Unknown
  Obtained from environmental sample
  DOMAIN (29)...(201): RibD C-terminal domain
  misc_feature (1)..(209): Xaa is any amino acid
MAEQMRNNVCKINFTRTSKHEMERKAQMRKLWVKAWITFDGVFDADTMDHWWQNTNNPERMEYIMEQYSQGDIYMMGRTTYEMLWPGWSKDTSEVGQILNRMHKYVISTTLTEAPWKESTIIRENVVEEIAKLKQQPGKDIIIDGSATLVQSLQGTGLIDEYRFLVEPFIMGRGKRFFAEGTDMHKLRLAESKTLNSGTLALIYQPAKK

SEQ ID NO: 3043 - DNA, 429 bp, Unknown
  Obtained from environmental sample
  misc_feature (1)..(429): n is a, c, g, or t
atgaaatacacaactgatgcctatcttataacatgccttactaacctgcatgctggtagcggcgatgccaactatggcgttgttgataatcttgttcaacgagactcaatcactgagattcctataattaactcttcttctttgaaaggtgctttaagagagtattttgcggaggagtggaaggatagtcccggtaaacgtaaactgaattatgtctttggccctgatcctaaaagaaatcaaggctctgaacttggaataggtaattacaagttctttgatgctaatttaattgttcttcctgttcgaagcacttcgaaaccgtttttcagagggacagcagaatttatacttaatgaactaaaggataaggcctctcaactgggtgtgaaaaatttgatattataccttataatgcaacaactgtag

SEQ ID NO: 3044 - protein, 142 aa, Unknown
  Obtained from environmental sample
  DOMAIN (8)...(139): Protein of unknown function (DUF324)
  misc_feature (1)..(142): Xaa is any amino acid
MKYTTDAYLITCLTNLHAGSGDANYGVVDNLVQRDSITEIPIINSSSLKGALREYFAEEWKDSPGKRKLNYVFGPDPKRNQGSELGIGNYKFFDANLIVLPVRSTSKPFFRGTAEFILNELKDKASQLGVKNLILYLIMQQL

SEQ ID NO: 3045 - DNA, 777 bp, Unknown
  Obtained from environmental sample
  misc_feature (1)..(777): n is a, c, g, or t
atgaaatacacaactgatgcctatcgtatgacaggccttactaacctgcatgctggtagcggcgatgccaactatggcgttgttgataatcttgttcaacgagactcaatcactgagattcctataattaactcttcttctttgaaaggtgctttaagagagtattttgcggaggagtggaaggatagtcccggtaaacgtaaactgaattatgtctttggccctgatcctaaaagaaatcaaggctctgaacttggaataggtaattacaagttctttgatgctaatttaattgttcttcctgttcgaagcacttcgaaaccgtttttcagagggacagcagaatttatacttaatgaactaaaggataaggcctctcaactgggtgtgaaaaattttgatattataccttataatgcaacaactgtaggtaaagaaagtcctcagattttatctgaaaattcttcgtgcattttagaagactatgtagctatcaacgctttaatattaaatactttagaaaatcatgttggtgataacccggcgctttttcatgaagatgactttaaagagttagctaaaaaacttcctgtaatagccagaaaccaactggagaacgggcagagtaagaacctttggtatgaagaagtagtccccagggaaagccgatttatcttttttgtttctaaaacgaaagacgaagatatagttactcaaaaggagtttgatgacattctagtggataaacaatccagattggtgcaaacgcctcaatag

SEQ ID NO: 3046 - protein, 258 aa, Unknown
  Obtained from environmental sample
  DOMAIN (8)...(256): Protein of unknown function (DUF324)
  misc_feature (1)..(258): Xaa is any amino acid
MKYTTDAYRMTGLTNLHAGSGDANYGVVDNLVQRDSITEIPIINSSSLKGALREYFAEEWKDSPGKRKLNYVFGPDPKRNQGSELGIGNYKFFDANLIVLPVRSTSKPFFRGTAEFILNELKDKASQLGVKNFDIIPYNATTVGKESPQILSENSSCILEDYVAINALILNTLENHVGDNPALFHEDDFKELAKKLPVIARNQLENGQSKNLWYEEVVPRESRFIFFVSKTKDEDIVTQKEFDDILVDKQSRLVQTPQ

SEQ ID NO: 3047 - DNA, 447 bp, Unknown
  Obtained from environmental sample
  misc_feature (1)..(447): n is a, c, g, or t
atgacaaaacaaacaaccaccaggaatattgttttttacgctgatgatgaccaggatgacctggagctggtgcaggatgcctttgcacgctattcaaaaaatgtagaggtgatcactgcaaaagatggcagtcaggctttgaaatggcttcaatcactgggaacaaatgatcccaaaccctgtctgatcatactggatgtcaatatgcctttatacaatggaaaggaagtattaaaggagatcagaaccatgaaacatctggaagaagtacctgtggtattgtttaccacttcttccatgcctcacgaccaggcctttgctgaaaaattaaaagcaggatttataaccaagcccatagatgtatcccagatggaactgatcacagaacttttcattgaccatggcacggacgagatcaggaaaaagatccgcaggcaatttcgatga

SEQ ID NO: 3048 - protein, 148 aa, Unknown
  Obtained from environmental sample
  DOMAIN (9)...(136): Response regulator receiver domain
  misc_feature (1)..(148): Xaa is any amino acid
MTKQTTTRNIVFYADDDQDDLELVQDAFARYSKNVEVITAKDGSQALKWLQSLGTNDPKPCLIILDVNMPLYNGKEVLKEIRTMKHLEEVPVVLFTTSSMPHDQAFAEKLKAGFITKPIDVSQMELITELFIDHGTDEIRKKIRRQFR

SEQ ID NO: 3049 - DNA, 723 bp, Unknown
  Obtained from environmental sample
  misc_feature (1)..(723): n is a, c, g, or t
gtggacaagatgatgtacaaaagtgaagcagataaattaaggatacagttaatccctaaattatattgtacaatatttgtttgcgctaagaaggaatctgataaaacaaatgcgatttttaaaatcctcaaagaatgcactggtaagaaaacgcatttatatattatatcaagtacagcatttaatgatgatacttggatttatattattgattattttgaaaacaaaggaattgacatgacaattagtacatcattatcagaagcaggtattccaaataaagagttagaagacaaagctcggaaagatatggaggatagaaagaatgaagaagaagaaccaaaacaagtattgatgttgttttatgaacaagaagaaaaatctgaacggaaaccaaaaaagatagcacctgagtatatatttgtttttgatgatatgtcctctatgttaagaaataaggacataggtacattaattaaatatcacaggcatttcaaaacaaagattattctctcatcccaatatccaaatgatctagctccagaatcaagaaagcaaactaacatattcctcttatttgcagggcattcagaagaccaattgttggagttatctaaaaatatggatctatcaatacccttcgaattatttgttcaattatatcacaatgcaacatctaaaccatattcatttttatccgtgataccatccatcaggaattag

SEQ ID NO: 3050 - protein, 240 aa, Unknown
  Obtained from environmental sample
  misc_feature (1)..(240): Xaa is any amino acid
MDKMMYKSEADKLRIQLIPKLYCTIFVCAKKESDKTNAIFKILKECTGKKTHLYIISSTAFNDDTWIYIIDYFENKGIDMTISTSLSEAGIPNKELEDKARKDMEDRKNEEEEPKQVLMLFYEQEEKSERKPKKIAPEYIFVFDDMSSMLRNKDIGTLIKYHRHFKTKIILSSQYPNDLAPESRKQTNIFLLFAGHSEDQLLELSKNMDLSIPFELFVQLYHNATSKPYSFLSVIPSIRN

SEQ ID NO: 3051 - DNA, 693 bp, Unknown
  Obtained from environmental sample
  misc_feature (1)..(693): n is a, c, g, or t
ttgacttcaattatcattttcaaagaatgcctgttggattattcaacccactatttgatttcctacacctctttccctatgcaccgtggaacacttgaactaagcgggaaatggattgtaagaaatggtattgtaaaaagcaataatcacctggttatactggatcctgtcgtttcaaaaaggatcaggaataaagataataggtggatgccgataccattggccatggcttttatccgtgagcgcggaaatgtaatagattacgaaatacccataagcggcaactttaacgatccgaaatttcatttacgtgatgccattgttgatgtacttgaaaacatttttatcaaaccggcaacaaccccctaccggctgaaggtaaaaaacattgaaaaagaaatagaaaagtcactttcgttacgatgggaaatgagaggatcaaccctgaatgtcagccagaaaaaattcatcaaaaaaacaggtgtatacctgttaaaaaatccggaagcaagcatagaggtgtctccacatcaatatgccctgaaagaaaaagaatacattctcttttttgaaaccaagaaaaaatattacatgtccatgccaggtaacaaccataaaactgttgatgctgatgctttggaaaaaattgaacaaatgtcggtgaaggattcttccttttatccggttctttaa

SEQ ID NO: 3052 - protein, 230 aa, Unknown
  Obtained from environmental sample
  misc_feature (1)..(230): Xaa is any amino acid
MTSIIIFKECLLDYSTHYLISYTSFPMHRGTLELSGKWIVRNGIVKSNNHLVILDPVVSKRIRNKDNRWMPIPLAMAFIRERGNVIDYEIPISGNFNDPKFHLRDAIVDVLENIFIKPATTPYRLKVKNIEKEIEKSLSLRWEMRGSTLNVSQKKFIKKTGVYLLKNPEASIEVSPHQYALKEKEYILFFETKKKYYMSMPGNNHKTVDADALEKIEQMSVKDSSFYPVL

SEQ ID NO: 3053 - DNA, 630 bp, Unknown
  Obtained from environmental sample
  misc_feature (1)..(630): n is a, c, g, or t
atgtcactggggtgtcagtacgtgagcggagtgtcggaaagacttgcattgcttgaaaaggagatggttcaagtcacagcgtgcaaacgctacaaaggctcaaataaatcctcatttactttcaacagcttcaataccctcattacgatcattgatgaaaactccaggaagccgcaagtggctatagagtatgttgaaaagctttcagattatttcagaagtatcctgcagtaccgggaacaggagacaatttcgcttgaagaggaatgggaactggtccaggattatggttacctgcttaagaaaagatatggcgctaacctgagacttcatatggatgtccccaataaagaatgctgcatcccgactctcacactccagatgctcgtcgaaaacgccgtaaagcacaatgtgatcgcatcccacaagccattggatgtgtttatcacaatagaggatggctatgtgatcgtgaaaaataatttgcaacccaagtccaaagcggaaccttccaaccaattcggacttcagagtatcgtcaacaggtatgaattgatgggagagaaaaaagtaattatcgaaaagagcagtgaacatattagagtacatatacctattatcccaaataat

SEQ ID NO: 3054 - protein, 210 aa, Unknown
  Obtained from environmental sample
  DOMAIN (39)...(113): Histidine kinase
  misc_feature (1)..(210): Xaa is any amino acid
MSLGCQYVSGVSERLALLEKEMVQVTACKRYKGSNKSSFTFNSFNTLITIIDENSRKPQVAIEYVEKLSDYFRSILQYREQETISLEEEWELVQDYGYLLKKRYGANLRLHMDVPNKECCIPTLTLQMLVENAVKHNVIASHKPLDVFITIEDGYVIVKNNLQPKSKAEPSNQFGLQSIVNRYELMGEKKVIIEKSSEHIRVHIPIIPNN

SEQ ID NO: 3055 - DNA, 306 bp, Unknown
  Obtained from environmental sample
  misc_feature (1)..(306): n is a, c, g, or t
ttgaattcaatgaataaggtcttaattttcataattttattgtttagctcagtcagtttttctttttctcaaactgataaacgaatcgaagaaatacataaaatttatcaggaagtaaataaaaatgtagctgaatgcgaagccaacggtgatacttcaacgacttttttgaccgaaataatagtcaataaaaatgacggttcgtatcccgcagtcgggatttataaaacgaaggtgaagttttattacacgttcggcgaccgtgagaaaatccgtatccaaatcgtttgtcaaaaattatggtga

SEQ ID NO: 3056 - protein, 101 aa, Unknown
  Obtained from environmental sample
  SIGNAL (1)...(19)
  misc_feature (1)..(101): Xaa is any amino acid
MNSMNKVLIFIILLFSSVSFSFSQTDKRIEEIHKIYQEVNKNVAECEANGDTSTTFLTEIIVNKNDGSYPAVGIYKTKVKFYYTFGDREKIRIQIVCQKLW

SEQ ID NO: 3057 - DNA, 765 bp, Unknown
  Obtained from environmental sample
  misc_feature (1)..(765): n is a, c, g, or t
gtgctttcaaaagaaatggcaaataagttttttggaaattggaagactgctttaggcaaaagcttcagttttgatgataaggtgaattatacagttagtggtgtaattgatgatgttgctgaaaattattcggtaccggtaaaaattatgcttgcttacaaatctttcaaaagcaatagtttaacgaattggggttcagttagttctagttctgaaagctactttaaactaaaatcaaatgttaacatagaaacacttaacggaccgctaacatcattcattaaaaaatattatgtagaaaaagcacccggtaaagaaggacatctatttcagccattggcagatattcattacaatgaaaaatttggcaatttttcaggtcgcattatgcccaaaaaacaactttacggattagttataattggcttttttctgatgattacagcctctatcaattttattaatctggcaactgcacaggcggtaagtcgttctaaagaggttggagttaggaaagtaatgggtagccaaagaagccagttaatcattcaatttttaacagaaactttaaccatagtattcatttcattgttaattggaagcgtgttaccagaaattgctttgcccggaatgcaaaacttgttcgattcanaaatatcattcaccatattcaagcatcttataattttcttgtctatgatactgtgggttgcggtcgcgagtttcctgccagctttaatccggctatggtactcgctggtttaa

SEQ ID NO: 3058 - protein, 254 aa, Unknown
  Obtained from environmental sample
  DOMAIN (70)...(253): Predicted permease
  misc_feature (1)..(254): Xaa is any amino acid
MLSKEMANKFFGNWKTALGKSFSFDDKVNYTVSGVIDDVAENYSVPVKIMLAYKSFKSNSLTNWGSVSSSSESYFKLKSNVNIETLNGPLTSFIKKYYVEKAPGKEGHLFQPLADIHYNEKFGNFSGRIMPKKQLYGLVIIGFFLMITASINFINLATAQAVSRSKEVGVRKVMGSQRSQLIIQFLTETLTIVFISLLIGSVLPEIALPGMQNLFDSXISFTIFKHLIIFLSMILWVAVASFLPALIRLWYSLV

SEQ ID NO: 3059 - DNA, 336 bp, Unknown
  Obtained from environmental sample
  misc_feature (1)..(336): n is a, c, g, or t
atgttggcatatccggccgtactcacgcaagttccaggaaaacgtacgaaagttttaaaaaatgaagagatagagatcactcggtttgccgatcctatcatcgatcaagaaaataatagggtgacggtaaactaccagattgaggtcaaaaacctacacagcaacgcgatagaaaacattaacgaaagccatcccatgcgacattttggaaaaccagaactagaaattttggctttggccacaggttttgatatgttacatagtgaagaatttaggagtaaagctaagccttcaggacaaacttggggagtaacttacattttaagaaaaaaatag

SEQ ID NO: 3060 - protein, 111 aa, Unknown
  Obtained from environmental sample
  misc_feature (1)..(111): Xaa is any amino acid
MLAYPAVLTQVPGKRTKVLKNEEIEITRFADPIIDQENNRVTVNYQIEVKNLHSNAIENINESHPMRHFGKPELEILALATGFDMLHSEEFRSKAKPSGQTWGVTYILRKK

SEQ ID NO: 3061 - DNA, 387 bp, Unknown
  Obtained from environmental sample
  misc_feature (1)..(387): n is a, c, g, or t
gtggatgtttttgaatatggacatcacatggcgttaatggacatgcaaattaatggtaccatcgatgcatgggatatgcagtggcacggaactaatgtactccatggcagagcaggattatatgccaatcaaacttttgttaaaaatatcggaatcgatggatccggaacccacggagttgttgatgcgaaagaacaaaaacgcgaaatcaaaatgaacaactacgagctgacgattgctgacttcatcagcaaaaaacccatcgtgttttcccaaaaaatagaaactgaattcaaaaaatcctatcagcagaaatctacattaagtgttgctcgaaaagcatttaacttcatcaaaagaagaattcaacaaattatcagactataa

SEQ ID NO: 3062 - protein, 128 aa, Unknown
  Obtained from environmental sample
  misc_feature (1)..(128): Xaa is any amino acid
MDVFEYGHHMALMDMQINGTIDAWDMQWHGTNVLHGRAGLYANQTFVKNIGIDGSGTHGVVDAKEQKREIKMNNYELTIADFISKKPIVFSQKIETEFKKSYQQKSTLSVARKAFNFIKRRIQQIIRL

SEQ ID NO: 3063 - DNA, 612 bp, Unknown
  Obtained from environmental sample
  misc_feature (1)..(612): n is a, c, g, or t
ttgtatttcaaatgtaaagaatgtagtactaaaagaactaaattatattttatctcatcaacaatttataatgaccaaaattgggagaaaatatgcgatttctttgaaaagaaagggaatgaaataaataaatatacttcagtcaaagaagctaatctaaatcagttaattgatgaattagaaaaagaagggcaacaacgtattgaagaaaaaaaaataactaaagttgttaaaccaaaaaaactacttttatttgatgaagaacaagagccaaaacaaagaaaagacaaaaaaattgcaccagaaataatttttgtttttgatgatttatcaactgagttaagagacaatgatattagtactttaattaaaaaacatcgccatttcaagacaaaagtcatatattcctcacaatatgtaaatgatctaactccagactcacgtaataatactgacttttggttattatttgcaggtcattcagatgaaaaattatttacagtattcaaaaattgtgatttaaatatttctttcgaattatttaaggcattatatttggatgcaacaaaagaaatgaatttagaaagaattttaattatttatatgatttga

SEQ ID NO: 3064 - protein, 203 aa, Unknown
  Obtained from environmental sample
  misc_feature (1)..(203): Xaa is any amino acid
MYFKCKECSTKRTKLYFISSTIYNDQNWEKICDFFEKKGNEINKYTSVKEANLNQLIDELEKEGQQRIEEKKITKVVKPKKLLLFDEEQEPKQRKDKKIAPEIIFVFDDLSTELRDNDISTLIKKHRHFKTKVIYSSQYVNDLTPDSRNNTDFWLLFAGHSDEKLFTVFKNCDLNISFELFKALYLDATKEMNLERILIIYMI

SEQ ID NO: 3065 - DNA, 576 bp, Unknown
  Obtained from environmental sample
  misc_feature (1)..(576): n is a, c, g, or t
ttgttgaacaattctgaaattgtattattgtgtaaagcaatataccgtaaaatgaaaaagctgatcattatgttggttgtcacactatttattgcctgtgataaacaggaaaatgaggagttaatttttgaaaatacgatcgacaatgtaaatgcatttacggaaaacaggccttcaactgttatatattctgaagaagctcattccggatattttgtaagcaaaattgatgttagctcaccttatagcccaactttgtatcttcagttatctgagattagtaaagacccattaaaaaaggtaattgtttcagcttggataatgaattcaggttataatgcattacctgaaatcgctgtcgatataatggacgagaacaaaaattccatcgaatggactgcaagtggtgtgagtaaagcggataccgcattgaataaatggcataagatatattttaatgtgaatcttttagctgaagacaaaaataagtctgataattacattaaagtgtatgtatgtaatggaggaaaggatttttcatatgttgatgatattacgattgaatttatcagatag

SEQ ID NO: 3066 - protein, 191 aa, Unknown
  Obtained from environmental sample
  misc_feature (1)..(191): Xaa is any amino acid
MLNNSEIVLLCKAIYRKMKKLIIMLVVTLFIACDKQENEELIFENTIDNVNAFTENRPSTVIYSEEAHSGYFVSKIDVSSPYSPTLYLQLSEISKDPLKKVIVSAWIMNSGYNALPEIAVDIMDENKNSIEWTASGVSKADTALNKWHKIYFNVNLLAEDKNKSDNYIKVYVCNGGKDFSYVDDITIEFIR

SEQ ID NO: 3067 - DNA, 447 bp, Unknown
  Obtained from environmental sample
  misc_feature (1)..(447): n is a, c, g, or t
atgaaagcattaaattccaaatatttgaatatgaaggtttctgataccagatatcccaataccgatagtcttcaggtgcatttacccgattcattttttcataattttaagtaccatctgcctgaaattaacaagttaaatagaaaaatcaggacagttacacccattacaattactaatatgggaaatactccattgttttcaggtagaggccgtgatggaattatgttatcatatacctggtataatgtatctgagcagaaaaacttagaacgtcaaagcaatattaaatcagtaatattagcagatataattaaatcgttggatcagcatataaatatagaaactccaaagaagagcgggaaatacatttttcaattaatggtgtcttttgataatcaaagaaatactgccattggagaaccattggaagtagagtatgattaa

SEQ ID NO: 3068 - protein, 148 aa, Unknown
  Obtained from environmental sample
  misc_feature (1)..(148): Xaa is any amino acid
MKALNSKYLNMKVSDTRYPNTDSLQVHLPDSFFHNFKYHLPEINKLNRKIRTVTPITITNMGNTPLFSGRGRDGIMLSYTWYNVSEQKNLERQSNIKSVILADIIKSLDQHINIETPKKSGKYIFQLMVSFDNQRNTAIGEPLEVEYD

SEQ ID NO: 3069 - DNA, 813 bp, Unknown
  Obtained from environmental sample
  misc_feature (1)..(813): n is a, c, g, or t
ttgatgaacaaatccaaacgatattggtattttttgttttacattctgtttatcctttcctgtaaaagcggtaaagtaaaaactaatgagcttttattttggtgctccaacaataattcggaaatattattgtgtgctgcaatacagcataaatggaatgttaataataagtctgtaaggatgcacatgcagcctatacctgaagggcaatcaagtgaagaagttattcttgccgcagtagtaggcaaatccacacctgatatttatgcaaacatgtggcagggaaatgtagagatgtatgcacatgcaggtgtattgattcctttggatacaattaagggatttctggagtttatcaatgaacgctgtgatagtaatgtaataaaagagatcacatctgttgacgggcatatttaccaggtaccgtggaaagtgaatccaattatgaccatttacaataaaaaacttttttcagcaaataacattaagacagtaccgtattcctattcaacctatctggaagcttcggaactatttaaaaagaaaaatataaattcttccacaccaaaacgttttggttataccgctgtaaaagccatctggtatgaacgattgtttaatttttatcccttgtacctggctgcctcaaatggagctcctttaattataaacaataaagctgcgtttaataataaatatgccattggcgtttttcattttttgcaaagcttatatatcaacgattatttttcaagagaaaacacagcatcatcaagcgatcccttgtactacaaacattctgtgatccactag

SEQ ID NO: 3070 - protein, 270 aa, Unknown
  Obtained from environmental sample
  misc_feature (1)..(270): Xaa is any amino acid
MMNKSKRYWYFLFYILFILSCKSGKVKTNELLFWCSNNNSEILLCAAIQHKWNVNNKSVRMHMQPIPEGQSSEEVILAAVVGKSTPDIYANMWQGNVEMYAHAGVLIPLDTIKGFLEFINERCDSNVIKEITSVDGHIYQVPWKVNPIMTIYNKKLFSANNIKTVPYSYSTYLEASELFKKKNINSSTPKRFGYTAVKAIWYERLFNFYPLYLAASNGAPLIINNKAAFNNKYAIGVFHFLQSLYINDYFSRENTASSSDPLYYKHSVIH

SEQ ID NO: 3071 - DNA, 738 bp, Unknown
  Obtained from environmental sample
  misc_feature (1)..(738): n is a, c, g, or t
ttgtccaagctgagttggcgtcgtttattgaatatggtaagagtgtatagcagttatcatttggctaagtggacaaaaaggacagtacagtggggaatgcccatttctatttcatttgaacctactacgtcatgcaatttgcggtgccctgaatgtcccagtggcttgagggctttttcaagaccaaccggcatgctgcaaaaagattttttcagggataccattgatcaactttcgaaagagttgatgtacctggttttttatttccagggagagccatacttgaatcccgattttttaaatatggttcagtacgcggcatctaagaaaatttacacggccacatctaccaatgcgcattatttaaatgatgaaaatgcaaaaaaaacagtggaaagcggtttagaccgtttaattatttctatagacggcactacacaggatgtgtaccagcaataccgcataggaggtaaattatcaaaagtgctggaaggtgcagcaaacatagtaaaatggaaaaaagaattaaaaagcaaaactccatttatcattttccagtttttagtggtgaagcataatgaacaccagattaatgaagtggagcagttggcaaaagaaataggtatagatgaagtaagactaaaaacggcacaggtatatgattatgaaaatgatccaaaccatttgattccaactattgctaaatacagccgctataaagttgggggaaaatggtaa

SEQ ID NO: 3072 - protein, 245 aa, Unknown
  Obtained from environmental sample
  DOMAIN (39)...(207): Radical SAM superfamily
  misc_feature (1)..(245): Xaa is any amino acid
MSKLSWRRLLNMVRVYSSYHLAKWTKRTVQWGMPISISFEPTTSCNLRCPECPSGLRAFSRPTGMLQKDFFRDTIDQLSKELMYLVFYFQGEPYLNPDFLNMVQYAASKKIYTATSTNAHYLNDENAKKTVESGLDRLIISIDGTTQDVYQQYRIGGKLSKVLEGAANIVKWKKELKSKTPFIIFQFLVVKHNEHQINEVEQLAKEIGIDEVRLKTAQVYDYENDPNHLIPTIAKYSRYKVGGKW

SEQ ID NO: 3073 - DNA, 609 bp, Unknown
  Obtained from environmental sample
  misc_feature (1)..(609): n is a, c, g, or t
atgaaaacaataaaatttacaagcgatgacccggttcaaaagcagtttggacaaatggttaaaaaaaatgtaaatacctattttaaagagaaaggtctttctaccaaaggaaacgcaattatggtaataaaagcaattgccatgttattgatctattttgtaccctttattgttattttaactatacctatgccgccatggttaggaatgttgttggcgatagttattggaattggagaagccgggataggaatgagtgtaatgcacgatgccgcgcacggggccttttcaacaaaaaagtgggttaataatttattttcatcaactatgtttttattaggcaccaatacatttaactggaaggtgcagcataatattttacatcatacatttacaaatatttataatttcgatcaggatattgaaagcaaggcggtgcttcgtttgtgcgaacatgcgcccctgaaaaagttccaccgttttcaatatctatatgcctacttcttttacgggttaatgaccattgttaaattggttggggatattggacaattgagggagttaacncgggcaggaatanccaaagacataaccgaacgcaacaaatga

SEQ ID NO: 3074 - protein, 202 aa, Unknown
  Obtained from environmental sample
  misc_feature (1)..(202): Xaa is any amino acid
MKTIKFTSDDPVQKQFGQMVKKNVNTYFKEKGLSTKGNAIMVIKAIAMLLIYFVPFIVILTIPMPPWLGMLLAIVIGIGEAGIGMSVMHDAAHGAFSTKKWVNNLFSSTMFLLGTNTFNWKVQHNILHHTFTNIYNFDQDIESKAVLRLCEHAPLKKFHRFQYLYAYFFYGLMTIVKLVGDIGQLRELTRAGIXKDITERNK

SEQ ID NO: 3075 - DNA, 462 bp, Unknown
  Obtained from environmental sample
  misc_feature (1)..(462): n is a, c, g, or t
atgctttggttattaaaaaagttgctacatttcttcttctggttgagaggctggaaattcgtggaaaattccattaaggatgtggataaggcggttatcattgtcgccggtcacactagtaattgggactttttaaatggggtggcttgcctggatatcatgaataagccggcccgtttcacgatcaagaaagagtggatgtttttcccgtttaatctcttttttggaacgctgggggccttcccgattgatcgttcgaaaaagaccagcgcggttgagcagatggtaagttatattaattctcaaaaacaaatttctttagtggtgacaccagaagggacgcgtagtcgtcgggataaatggaagacgggtttttatcacgtagcgctgggagcgaagatcccgattgctctagggtatattgattatgccaccaagacttcgtggtttcccaattcttga

SEQ ID NO: 3076 - protein, 153 aa, Unknown
  Obtained from environmental sample
  DOMAIN (16)...(142): Acyltransferase
  misc_feature (1)..(153): Xaa is any amino acid
MLWLLKKLLHFFFWLRGWKFVENSIKDVDKAVIIVAGHTSNWDFLNGVACLDIMNKPARFTIKKEWMFFPFNLFFGTLGAFPIDRSKKTSAVEQMVSYINSQKQISLVVTPEGTRSRRDKWKTGFYHVALGAKIPIALGYIDYATKTSWFPNS

SEQ ID NO: 3077 - DNA, 447 bp, Unknown
  Obtained from environmental sample
  misc_feature (1)..(447): n is a, c, g, or t
ttgcttaagacagaaaattcagaagaaaaaggtctggggctgcctttaccaaaaggacttatacgaatctacaaagccgattcagaaaagcaatttcagttcattggagaagatcagattgaacatatcccaaaagatggaaagataaaagtcattgcaggtaatgcttttgatattaagggcacccggactcagaaaaattatgaaagaattaacgatactatagaacagattacttatgagattgaatttaacaattcgaggtctgaagtccagaaaattaaggtcatagaacacttttctggagattgggaaataatcaaaaattcggatttatatgaaaaaacggatgcttttacagcagaattccaggtttcgattgctgcaaacagtacgaagataatttcctatacagtagaaaacaaactccaatcccaggttagataa

SEQ ID NO: 3078 - protein, 148 aa, Unknown
  Obtained from environmental sample
  misc_feature (1)..(148): Xaa is any amino acid
MLKTENSEEKGLGLPLPKGLIRIYKADSEKQFQFIGEDQIEHIPKDGKIKVIAGNAFDIKGTRTQKNYERINDTIEQITYEIEFNNSRSEVQKIKVIEHFSGDWEIIKNSDLYEKTDAFTAEFQVSIAANSTKIISYTVENKLQSQVR

SEQ ID NO: 3079 - DNA, 315 bp, Unknown
  Obtained from environmental sample
  misc_feature (1)..(315): n is a, c, g, or t
atgatgcatatattcacctctttctatattactaatgatcaaataaacatttttaatttttctattactaaattactactaagtaaagaatttatttatcaattattgatgaacatgaacgaaaaacaggctgccgcaaataaatcaacagagtttataaaagatggaatgactcttggactgggaacaggttcaacagttttttatttagtaaataaattagctgaacttgttaaacagggattaagtgtaaattgtgtttccacttctaatcaaacaagtgaattagcaaaaagtttagggattaaattgtaa

SEQ ID NO: 3080 - protein, 104 aa, Unknown
  Obtained from environmental sample
  misc_feature (1)..(104): Xaa is any amino acid
MMHIFTSFYITNDQINIFNFSITKLLLSKEFIYQLLMNMNEKQAAANKSTEFIKDGMTLGLGTGSTVFYLVNKLAELVKQGLSVNCVSTSNQTSELAKSLGIKL

SEQ ID NO: 3081 - DNA, 633 bp, Unknown
  Obtained from environmental sample
  misc_feature (1)..(633): n is a, c, g, or t
atgattgaggaaattttttcggcttatcactcattaactaaaccactacaaaacgcgaaagttaagctgcacctctcatcgcttgacgacgttatttcccccaaacacgattcagattcaagtgttcttttaggcgacaccaatttactttacaaactcaaagacatttgggcatctcatttctcgcacgattatttaaggtcgcttcaggattttccagacacattccccacaggcaatgccgttataatccaaaatgtagtcgatgcagatgcatcgggtattctctatacggtcaatccgtttactaatgataaaagccaactggtaatagaagcggtgtttggtgacgcagttgcactgaaaatgggtacgataacacccgacaggtatgaggtcaataaagaaggtttaataatcaattcgctaaaaacctcccaacagacagttgcctataaaaaaaccgagtcgggagtaaaagaggtgcttttatcagtaaaaaccgggaaagaacaaaaagtatcatcgcttcaaatactttttctatctgaaattggtaaaaaaattgagcagatatttctgatgccacaggaaattacctgggcgttcaaagatattaatttgtcgtattag

SEQ ID NO: 3082 - protein, 210 aa, Unknown
  Obtained from environmental sample
  misc_feature (1)..(210): Xaa is any amino acid
MIEEIFSAYHSLTKPLQNAKVKLHLSSLDDVISPKHDSDSSVLLGDTNLLYKLKDIWASHFSHDYLRSLQDFPDTFPTGNAVIIQNVVDADASGILYTVNPFTNDKSQLVIEAVFGDAVALKMGTITPDRYEVNKEGLIINSLKTSQQTVAYKKTESGVKEVLLSVKTGKEQKVSSLQILFLSEIGKKIEQIFLMPQEITWAFKDINLSY

SEQ ID NO: 3083 - DNA, 663 bp, Unknown
  Obtained from environmental sample
  misc_feature (1)..(663): n is a, c, g, or t
ttgttttccttttttattatgatgctaaaaacactcataacaacgatcagtctctgcaccatttttgcatgcaattccgaaaaaaaatataagtccatgacatcatcgttgattaacgcacaggttggcgacaaaaccgataccgcaacgtttgcaacaggttgcttttggtgtacagaagccatctttgaagaattgaatggcgttttgagtgttacatccggttattcaggagggacaatctctaacccgacttacaaagaagtatgtaccggtgaaacaggccacgcggaatgtgtgcagatcgtatatgagccgaataaaatcacttatgatgaactgctcgaggttttctttgaggttcatgatccgacaagtcttaatcgccagggagcagatgtaggtacacaatatcgcagcgctgttttctatcataataatgaacaaaaacaaaaggcggaatattataaagatgagttgaataaaagtggtgcttacgacaaaccaattgtaacagaaattgcatccttttctaaattttatcctgcagaaggttatcaccaggaatattacgagaataataaaaactctaatccttattgttcggtggtcatccgtcccaaagctcgaaaaatttcaaaaagtatttgcttaaaaaattaa

SEQ ID NO: 3084 - protein, 220 aa, Unknown
  Obtained from environmental sample
  DOMAIN (47)...(206): Peptide methionine sulfoxide reductase
  misc_feature (1)..(220): Xaa is any amino acid
MFSFFIMMLKTLITTISLCTIFACNSEKKYKSMTSSLINAQVGDKTDTATFATGCFWCTEAIFEELNGVLSVTSGYSGGTISNPTYKEVCTGETGHAECVQIVYEPNKITYDELLEVFFEVHDPTSLNRQGADVGTQYRSAVFYHNNEQKQKAEYYKDELNKSGAYDKPIVTEIASFSKFYPAEGYHQEYYENNKNSNPYCSVVIRPKARKISKSICLKN

SEQ ID NO: 3085 - DNA, 660 bp, Unknown
  Obtained from environmental sample
  misc_feature (1)..(660): n is a, c, g, or t
ttgaacgacnagtcaggaatcgtaattggtgatcccattgataaaaaattttttgttctgcgaactttcgatggtggtaagacctggcagaagtttcccgaaatacacaggcccgtggcagatagtggagaggcctgttttgctgcaagcggtaccaatgttcgtgcattggataatgatgaagccgtttttatttcgggaggattgagttcaaatgtttttataagagatcagaaaattaacttgcccattatacagggacaggaaacaaccggcgccaactccattgcagtttgggaccggtacaaaagaaaaggtggcgaccaattagtagcagttggtggtgattttcaaaaacctgattcggattcattgaattgtgtttacagtataaatcgtggcaaaacatggaagacaccgaaaactcttccacatggttatagaagttgtgtagaatacttaaatccgaaagttttggtgagttgtggtttgaatggagtggattactcaatcgataatgccaatacatggaagtggatatcaaaagaaagttttcatgtatgccggattgccaagatgggaaaaactgtttatttagcaggcaataatggtaaggttgggaaactggtttatcaatacggtacaaggaaaagaacctga

SEQ ID NO: 3086 - protein, 219 aa, Unknown
  Obtained from environmental sample
  misc_feature (1)..(219): Xaa is any amino acid
MNDXSGIVIGDPIDKKFFVLRTFDGGKTWQKFPEIHRPVADSGEACFAASGTNVRALDNDEAVFISGGLSSNVFIRDQKINLPIIQGQETTGANSIAVWDRYKRKGGDQLVAVGGDFQKPDSDSLNCVYSINRGKTWKTPKTLPHGYRSCVEYLNPKVLVSCGLNGVDYSIDNANTWKWISKESFHVCRIAKMGKTVYLAGNNGKVGKLVYQYGTRKRT

SEQ ID NO: 3087 - DNA, 636 bp, Unknown
  Obtained from environmental sample
  misc_feature (1)..(636): n is a, c, g, or t
ttggcggctggatatctgataaaattgaaaaggaaattatccaacccgaaaacaattttggacattggcgccggcacaggattgctaagcctgatgctggcgcagaattcatacgccatggtaaacgctgtagaaatagataaagattcatttgaacaaaccaaagaaaattttgcttcatcgccgtggcaccaacggatgcaggtatttcaccaggatataaaagaatggaaagcaaatcggaaatatgatttcattatttctaatccgccattttatgaaaatgatttaaaaagtaacaggctaaataagaatgtagcaaagcatcatgagaaactgactttaaaagaattgattcaatgtataaaaaataatatcacagacaatggaaatttcgccattcttctaccctatcatcgcataggttattttacaaccatcgcgatagaaaatgatttttatttaaaggaaaagctgatagtaaaacaaactcccggacattctttcttccggggaatattattgtttggcacaaaagaaacaagtgagatacaaagtgaattaagcattaaagatgaagaaggaaattatacgaatgaattccggaagttattgaaagactattatttgaaatag

SEQ ID NO: 3088 - protein, 211 aa, Unknown
  Obtained from environmental sample
  misc_feature (1)..(211): Xaa is any amino acid
MAAGYLIKLKRKLSNPKTILDIGAGTGLLSLMLAQNSYAMVNAVEIDKDSFEQTKENFASSPWHQRMQVFHQDIKEWKANRKYDFIISNPPFYENDLKSNRLNKNVAKHHEKLTLKELIQCIKNNITDNGNFAILLPYHRIGYFTTIAIENDFYLKEKLIVKQTPGHSFFRGILLFGTKETSEIQSELSIKDEEGNYTNEFRKLLKDYYLK

SEQ ID NO: 3089 - DNA, 384 bp, Unknown
  Obtained from environmental sample
  misc_feature (1)..(384): n is a, c, g, or t
ttgaccagtgatcacaataaaaataacatgaaaatcctagttgtagatgacgataaaatgatgctcaaagctatttcacaccagctggaaacagatggatatgaagtagcagtagccgaaaacggttatgatgcattaaatattatagacaaatcaaaaatcgatttaattatatcagatataatgatgcctaaaatgtcaggattaggtttgttaaatctgttgaaacagttttatttcaataagattccggtgatcattatctcttcactggataaggcaagcatggtgctgaattcgattggtatgggagctgcagactttttatgcaaaccactaaattttaaagaattgtcgttggctgttaaaaagtacgtaaaataa

SEQ ID NO: 3090 - protein, 127 aa, Unknown
  Obtained from environmental sample
  misc_feature (1)..(127): Xaa is any amino acid
MTSDHNKNNMKILVVDDDKMMLKAISHQLETDGYEVAVAENGYDALNIIDKSKIDLIISDIMMPKMSGLGLLNLLKQFYFNKIPVIIISSLDKASMVLNSIGMGAADFLCKPLNFKELSLAVKKYVK

SEQ ID NO: 3091 - DNA, 783 bp, Unknown
  Obtained from environmental sample
  misc_feature (1)..(783): n is a, c, g, or t
gtgatatttaaacaacgattccagcagttgcgacaggatttaagatatgagttactatcagaccaccatgctaactacctgcacaaacgtaatatttttagaaagaattgccctcagtatagagttgcttataacacttatttggaggtagaaaatgcaaaacaaaaaaatgagcgcatttctaaaaaggttggttcattaaaacctgatgaaagagagcagtatttgaaagagcatccttatgaaaagatttctaaagagtccaggtacttgcataaatatgtttctcggcttataacctctcgtacatacttcatgttgggcattcaggaggaagcaagactttataataaaatcacagttccttataaatgtaatacagctcaattttcaaaaacattgcaccggctttgcctagataaattaattgagttcattggtgagtttcagataaaagagctaccggaggaagataaggttaagaaccttattgaccaatacaatgccattcataatactaagcttcctgaaatagagatgacgaggttttatacaaagcttaaagaggtcggatcatttaaagagacggcaaggttttataactattcaagagcgtctctttacaggtataaagcatggtttaagaaagttggaataacagaaactaatgttttaccagtgacagatgtaggcgttccaagtgcaccaattgacatggttcaatatcattccattgttagttacaatcccagttttataaaatcaaattcattaatcttctaa

SEQ ID NO: 3092 - protein, 260 aa, Unknown
  Obtained from environmental sample
  misc_feature (1)..(260): Xaa is any amino acid
MIFKQRFQQLRQDLRYELLSDHHANYLHKRNIFRKNCPQYRVAYNTYLEVENAKQKNERISKKVGSLKPDEREQYLKEHPYEKISKESRYLHKYVSRLITSRTYFMLGIQEEARLYNKITVPYKCNTAQFSKTLHRLCLDKLIEFIGEFQIKELPEEDKVKNLIDQYNAIHNTKLPEIEMTRFYTKLKEVGSFKETARFYNYSRASLYRYKAWFKKVGITETNVLPVTDVGVPSAPIDMVQYHSIVSYNPSFIKSNSLIF

SEQ ID NO: 3093 - DNA, 321 bp, Unknown
  Obtained from environmental sample
  misc_feature (1)..(321): n is a, c, g, or t
atgcaaaacaaaaaaaatgagcgcatttctaaaaaggttggttcattaaaacctgatgaaagagagcagtatttgaaagagcatccttatgaaaagatttctaaagagtccaggtacttgcataaatatgtttctcggctttataacctctcgtacatacttcatgttgcggcttcaggagggaagcagatttataataaaatcacgttccttataaatgtaatacaggtcattttcaaaaccttgcccggtttgctagataattatgagtcatgggagttagataaaaacacggagaagatagttagacttttgacataa

SEQ ID NO: 3094 - protein, 106 aa, Unknown
  Obtained from environmental sample
  misc_feature (1)..(106): Xaa is any amino acid
MQNKKNERISKKVGSLKPDEREQYLKEHPYEKISKESRYLHKYVSRLYNLSYILHVAASGGKQIYNKITFLINVIQVIFKTLPGLLDNYESWELDKNTEKIVRLLT

SEQ ID NO: 3095 - DNA, 621 bp, Unknown
  Obtained from environmental sample
  misc_feature (1)..(621): n is a, c, g, or t
ttgatgaaggtttgtacgattttacctgattttcttacgttatttcactttttaactcgattcaacaatcctataggcttaaacatacaagaacttgaggatagaatcattggggtaatggaaaaaagccaaccttcatttaattataaaactgaattagatttctatttgtcggttggagaagaagctgaatttaaggatagcttgaccaaaatcaaactcgtcgctttaaaaattaatgaaaatattcgacgaaagaacttagaggaagaaagtcttgaattgcaagagctgtgttattcaaattttactctcttcacagaaaaactcttggatcggcaaggaaaatatttttataagccagtttttttggattttaatgcagaccagttcttgaaattctataatgagaatccatcacttcggttatctataattaagttattcgcaaaccgttatcaatattattatatggagttaaagccagaaaaaacctttttagcaaatttgcttattcaaatagatagactagatcaacaacaacaaggtaaaaatgttaccggcgatttactaaaaaaatttcaacgatatcttagtaatgctattaatttaatggcctaa

SEQ ID NO: 3096 - protein, 206 aa, Unknown
  Obtained from environmental sample
  misc_feature (1)..(206): Xaa is any amino acid
MMKVCTILPDFLTLFHFLTRFNNPIGLNIQELEDRIIGVMEKSQPSFNYKTELDFYLSVGEEAEFKDSLTKIKLVALKINENIRRKNLEEESLELQELCYSNFTLFTEKLLDRQGKYFYKPVFLDFNADQFLKFYNENPSLRLSIIKLFANRYQYYYMELKPEKTFLANLLIQIDRLDQQQQGKNVTGDLLKKFQRYLSNAINLMA

SEQ ID NO: 3097 - DNA, 621 bp, Unknown
  Obtained from environmental sample
  misc_feature (1)..(621): n is a, c, g, or t
atgttggaaatattattgatggaagcccccaatgctggcacaattttaaaacttacgatggcaccacttgattgtggaagatggagcactggcactcgatgcaaagaaaacccggatggccactggcaggcccccgatggtggtgacatcctgacgaatgatgaatttgaaaattttgaattaaacctggaatggaaaatttctccatgcggcaacagcggcatcatctacaatgtcgtcgaagctgaaggttatgattacgtgtggaattcaggtcctgaaatgcaggtgctggataatgtatgtcatcccgattcccgctatgtaagtcataaagcaggtgatctctatgacctgattgaaagcaaatacccggttgcaaaacctgcgggcgaatggaataaggtacgtatcatcaagaatcagggaaaagttgaacactggatgaatggcgtgaaaatagttgagtatgatatgaattcacctgaatggcctgaactgatcgccaaaagcaagtttaaagacatgaaaggatttggcctggcacccaaggggaaaatttcattgcaggaccatggggataaagtgtggtacaggaatatcaagattaaaacgctttaa

SEQ ID NO: 3098 - protein, 206 aa, Unknown
  Obtained from environmental sample
  DOMAIN (19)...(205): Domain of Unknown Function (DUF1080)
  misc_feature (1)..(206): Xaa is any amino acid
MLEILLMEAPNAGTILKLTMAPLDCGRWSTGTRCKENPDGHWQAPDGGDILTNDEFENFELNLEWKISPCGNSGIIYNVVEAEGYDYVWNSGPEMQVLDNVCHPDSRYVSHKAGDLYDLIESKYPVAKPAGEWNKVRIIKNQGKVEHWMNGVKIVEYDMNSPEWPELIAKSKFKDMKGFGLAPKGKISLQDHGDKVWYRNIKIKTL

SEQ ID NO: 3099 - DNA, 321 bp, Unknown
  Obtained from environmental sample
  misc_feature (1)..(321): n is a, c, g, or t
atgaccatcgatgaaaatgattttgcagtgataatgacgattggttacagaactgatatactcgttttaaaacaattattgaataaagattttttatatcttggtttattaggcagtgaaaaaaagaatgaaaagctctttgtagaattgaaaaccgggggagtaaccagcgataagcttgataaggttttcgctccggttggtataaatattttcagtaaaacagcgagggaaatagcagtaagtatagcggcgcaaataatcctcataaagaataaagatttgccaacgggtagagaaagaatgcgcaaccgtgaatag

SEQ ID NO: 3100 - protein, 106 aa, Unknown
  Obtained from environmental sample
  misc_feature (1)..(106): Xaa is any amino acid
MTIDENDFAVIMTIGYRTDILVLKQLLNKDFLYLGLLGSEKKNEKLFVELKTGGVTSDKLDKVFAPVGINIFSKTAREIAVSIAAQIILIKNKDLPTGRERMRNRE

SEQ ID NO: 3101 - DNA, 372 bp, Unknown
  Obtained from environmental sample
  misc_feature (1)..(372): n is a, c, g, or t
ttgtttgctgacgaaaagaattttattgattacaatacgatcggtgataatatgaccatcgatgaaaatgattttgcagtgataatgacgattggttacagaactgatatactcgttttaaaacaattattgaataaagattttttatatcttggtttattaggcagtgaaaaaaagaatgaaaagctctttgtagaattgaaaaccgggggagtaaccagcgataagcttgataaggttttcgctccggttggtataaatattttcagtaaaacagcgagggaaatagcagtaagtatagcggcgcaaataatcctcataaagaataaagatttgccaacgggtagagaaagaatgcgcaaccgtgaatag

SEQ ID NO: 3102 - protein, 123 aa, Unknown
  Obtained from environmental sample
  misc_feature (1)..(123): Xaa is any amino acid
MFADEKNFIDYNTIGDNMTIDENDFAVIMTIGYRTDILVLKQLLNKDFLYLGLLGSEKKNEKLFVELKTGGVTSDKLDKVFAPVGINIFSKTAREIAVSIAAQIILIKNKDLPTGRERMRNRE

SEQ ID NO: 3103 - DNA, 711 bp, Unknown
  Obtained from environmental sample
  misc_feature (1)..(711): n is a, c, g, or t
gtggatgactctatagaacgtagaggttttttctcagtttacgccttatggaaaaacaaagcttctgtgctggtaggcgactatcttttggcaaaaggattacttctttctctggaaaataatgattttcaaatactcaagtttctgtccgatgcagtaaggcaaatgagtgaaggagaacttcttcaaatggaaaaatcccgctcgctaaatttggatgaaggtgtttattttgagattatcaaaagcaaaacggcatccttactggcttcggcatgtgccgccggcgcctggtccacatcgcaaaacaccgaagccactgaacgcatgagagcctttggtgaaaaggttggaattgctttccaaattaaggatgatctttttgactatacttctcaggacgtgggtaaacctacgggtaatgatattaaagaaaagaaacttaccttaccgttgatctatactttaaacaaagttgacaaagacacacgccgcaaaatgatctatattatcaaaaatgaaaacacccgcagagcaaaagtcaaatacatcattgatgttgtagaaaaatctggtggaattgactatacttatgaaaaaatggcgggctataaaaaggaagccctggacctcctgttttcttttccaaaatctgacatacgagacggctttgagcaacttgtcaattttgttaccgatagaaaatattag

SEQ ID NO: 3104 - protein, 236 aa, Unknown
  Obtained from environmental sample
  DOMAIN (1)...(202): Polyprenyl synthetase
  misc_feature (1)..(236): Xaa is any amino acid
MDDSIERRGFFSVYALWKNKASVLVGDYLLAKGLLLSLENNDFQILKFLSDAVRQMSEGELLQMEKSRSLNLDEGVYFEIIKSKTASLLASACAAGAWSTSQNTEATERMRAFGEKVGIAFQIKDDLFDYTSQDVGKPTGNDIKEKKLTLPLIYTLNKVDKDTRRKMIYIIKNENTRRAKVKYIIDVVEKSGGIDYTYEKMAGYKKEALDLLFSFPKSDIRDGFEQLVNFVTDRKY

SEQ ID NO: 3105 - DNA, 783 bp, Unknown
  Obtained from environmental sample
  misc_feature (1)..(783): n is a, c, g, or t
ttgcatccaagagatacgtttaatttaatccgggttttaaaagagcttcgtgaccttggcaacactgttgttgttgtggaacacgatgaaatgatgatgcgtgaagccgatcatattattgatatgggaccgctggcttcgcatttaggtggagaagtaattgctgagggcaactatgatgcaattatttctaaccccgaaagtcttacggggaaatatctaaagggtgaattaacaatcgatcctccaaaaaaattacgcaagttccaggaatccataattattgaaggcgcccgccagcataatttaaaagacatcacagttgaatttccgttgaatgtgctttgtgtggtaagtggtgttagcggaagcggaaaaacaacgttgatcaaacacattttgtatcctgctttaaaaaaattgcaaggtgaagctgcggataaagtgggcttccatcgtgctattaaaggcaatatagattctatcgcacatgtggaaatggtcgatcaaaatcccattggaaaatcgtcaagaagtaatccggttacgtacataaaagcctgggataatattcgtgacctgtatgcttcgcaacctttgagtaaaatgcgtggctttcagcccaagcatttttcgtttaatgtacatggaggacgatgtgacgcttgcaagggcgagggagagaaacttgtacaaatgccatttttggccgacgttcatcttacgtgcgaagtctgcggaggaaaacggttcacggaagaagtgctggaagtggactacnga

SEQ ID NO: 3106 - protein, 261 aa, Unknown
  Obtained from environmental sample
  misc_feature (1)..(261): Xaa is any amino acid
MHPRDTFNLIRVLKELRDLGNTVVVVEHDEMMMREADHIIDMGPLASHLGGEVIAEGNYDAIISNPESLTGKYLKGELTIDPPKKLRKFQESIIIEGARQHNLKDITVEFPLNVLCVVSGVSGSGKTTLIKHILYPALKKLQGEAADKVGFHRAIKGNIDSIAHVEMVDQNPIGKSSRSNPVTYIKAWDNIRDLYASQPLSKMRGFQPKHFSFNVHGGRCDACKGEGEKLVQMPFLADVHLTCEVCGGKRFTEEVLEVDYX

SEQ ID NO: 3107 - DNA, 330 bp, Unknown
  Obtained from environmental sample
  misc_feature (1)..(330): n is a, c, g, or t
ttgcagtttgacgatgaacctttccagattttagcaatacgatatgcctataaaaaaaacgttccctattttacatttgcaggtagaccaaacccatgtttttctgctaccattaaaaaaactaaacagataataaaaagcaatgacccagtatatctgtcttcgtatgcagttgatatttttaaaattggagtgttctgtattttagccattttgcattttggtttgttatcaaattttatccaaaaaaagaaattgctaacctgctttttcacgcctttttggctccggtgctatggggccttatatttgtatatcaggcgaagatag

SEQ ID NO: 3108 - protein, 109 aa, Unknown
  Obtained from environmental sample
  misc_feature (1)..(109): Xaa is any amino acid
MQFDDEPFQILAIRYAYKKNVPYFTFAGRPNPCFSATIKKTKQIIKSNDPVYLSSYAVDIFKIGVFCILAILHFGLLSNFIQKKKLLTCFFTPFWLRCYGALYLYIRRR

SEQ ID NO: 3109 - DNA, 423 bp, Unknown
  Obtained from environmental sample
  misc_feature (1)..(423): n is a, c, g, or t
ttgctgccattccataaaatcttttttacaaatctatgccttcatcatattcttgcgggcacagtatctttgccgcttatgaatatgagtgatgatctgcaggttcgttggtggaaattagaagaaaaatttttggaaagatttggtaaaaagcctgacgtggaaagtatattgttccttataggtatccaggaatttggtgacatacaaaaaaaattcacaaaggagcagaaacaggacctgatgcatattgccatctgctcagtgctggctccaagcggttattatgagttatcgcatgttgatgaagatgggtggccgcactttaaacaattacagccaatgccggagattgaccctattatgcaggaaaactttttaaaagatcatattctcctttattttcaaaacaatggtttttaa

SEQ ID NO: 3110 - protein, 140 aa, Unknown
  Obtained from environmental sample
  misc_feature (1)..(140): Xaa is any amino acid
MLPFHKIFFTNLCLHHILAGTVSLPLMNMSDDLQVRWWKLEEKFLERFGKKPDVESILFLIGIQEFGDIQKKFTKEQKQDLMHIAICSVLAPSGYYELSHVDEDGWPHFKQLQPMPEIDPIMQENFLKDHILLYFQNNGF

SEQ ID NO: 3111 - DNA, 678 bp, Unknown
  Obtained from environmental sample
  misc_feature (1)..(678): n is a, c, g, or t
atggtcattgagccgcaattcaaagaagcccggcgcttccgggagaatcgcgcattggtgaaagtcagggacgggtggggatacattaataagagcggcacgttcatgattaaaccgatttttgattccgggggaaactttgaaaatggaattgccaaaatagaagcaaacaatggttacggttacattgatacgctcgggaattttgtaatcaaatccatttacccttttatcgggccttttgtggattccattgcaagggtaagagttgatggcggttggaaatatgtaaacatgcggggagaaatactttctaaaaaatctttcagcaatgcagaagatttttcagaccatacagcgcgggtcagggatactgctttgacctggggctatatcaatgaatcaatggaatggatcatcaaaccatgtttcgaaaatggccaggactttatcaatggtattgcgcgggtgcgccagggtcttagctggtattttatcgacaaaaccgggaagcacatttttgataataaggaattcgaaaaagcagaagacttttcaaatggtcttgcaagggtgcgtacaagaaaaggctggggatatctgaaagaaaatggtgaatggttaattcaacctcaatttgaatatgccgtgacttcaaaagtatttacaacaagctga

SEQ ID NO: 3112 - protein, 225 aa, Unknown
  Obtained from environmental sample
  DOMAIN (59)...(75): KWG Leptospira
  misc_feature (1)..(225): Xaa is any amino acid
MVIEPQFKEARRFRENRALVKVRDGWGYINKSGTFMIKPIFDSGGNFENGIAKIEANNGYGYIDTLGNFVIKSIYPFIGPFVDSIARVRVDGGWKYVNMRGEILSKKSFSNAEDFSDHTARVRDTALTWGYINESMEWIIKPCFENGQDFINGIARVRQGLSWYFIDKTGKHIFDNKEFEKAEDFSNGLARVRTRKGWGYLKENGEWLIQPQFEYAVTSKVFTTS

SEQ ID NO: 3113 - DNA, 429 bp, Unknown
  Obtained from environmental sample
  misc_feature (1)..(429): n is a, c, g, or t
atgaagagagcaattttgatcacattcatcattatttttacaaaccaactctatgcgcaaaaagacagggaaaatatcaaagttgccattacgggtttttttaacgggttatcgctaattaattccgatacgctcaggtaccacactaccccggattttcatctccttgaagatggagaggtctggaacatggatactttgataaatgcaatgatgcctaaaaagaatgtcgacttcaaaaggatcaataaatttgagtttatcagaacggagataaaaggtaatatcgcgtggactagctataataattcagcagagatcagttttggggaaaaacaaattattgtaaaatggctggagagtgcagttttaataaaaaataatggcagatggaagatccaaatgcttcattcaacccggcttgaataa

SEQ ID NO: 3114 - protein, 142 aa, Unknown
  Obtained from environmental sample
  SIGNAL (1)...(19)
  misc_feature (1)..(142): Xaa is any amino acid
MKRAILITFIIIFTNQLYAQKDRENIKVAITGFFNGLSLINSDTLRYHTTPDFHLLEDGEVWNMDTLINAMMPKKNVDFKRINKFEFIRTEIKGNIAWTSYNNSAEISFGEKQIIVKWLESAVLIKNNGRWKIQMLHSTRLE

SEQ ID NO: 3115 - DNA, 303 bp, Unknown
  Obtained from environmental sample
  misc_feature (1)..(303): n is a, c, g, or t
atggagtctaaagacttttcccgatcggcaagcataagcccttcaaaaaagaagcttttaaaaatagcagaaaagagcctgtataaaggccttgaaaacgcaactgacggcaagtatataaatgatgtatctcttgctatacagcagcatgtcgagtcagcaggtttttcagtagtaagagatcttgttggtcatggcataggaaaacagcttcacgaagaacccccgattcctaattattataacagcgggtacagaagtaagtttaaattaagcatgacggtgcaattcttgatccactag

SEQ ID NO: 3116 - protein, 100 aa, Unknown
  Obtained from environmental sample
  misc_feature (1)..(100): Xaa is any amino acid
MESKDFSRSASISPSKKKLLKIAEKSLYKGLENATDGKYINDVSLAIQQHVESAGFSVVRDLVGHGIGKQLHEEPPIPNYYNSGYRSKFKLSMTVQFLIH

SEQ ID NO: 3117 - DNA, 510 bp, Unknown
  Obtained from environmental sample
  misc_feature (1)..(510): n is a, c, g, or t
atgaaaacgaaaaccatatttatcctattcttttcaatagtatctttttgttttaagaataaaactgaaagaccatattgtctggaaataagcggaagggtgctctcctcaagcgtggacaaaagcacgacctatagagcgatcctgatcaaggacaatgtaatgattgattcattagagttgctggagaagcaggcctttaaattcgaacttaagaaaaaagaacagtattctatcaagatccttaaaaagggatttcttgatcgccttattattatcaatacaaacattgaggatattaagtatcataacgatctttttaaattcaagtttgatattgatctcgtagatgccgaagatttccagggcatcggcaaggattacattgatccggtgctaatttattttaataataaaataggctggttctcttacaataatcttgttgaccctaaagaaagaacctatggttttgggatggagatcgctaatgtgtttcagtgtaaataa

SEQ ID NO: 3118 - protein, 169 aa, Unknown
  Obtained from environmental sample
  SIGNAL (1)...(19)
  misc_feature (1)..(169): Xaa is any amino acid
MKTKTIFILFFSIVSFCFKNKTERPYCLEISGRVLSSSVDKSTTYRAILIKDNVMIDSLELLEKQAFKFELKKKEQYSIKILKKGFLDRLIIINTNIEDIKYHNDLFKFKFDIDLVDAEDFQGIGKDYIDPVLIYFNNKIGWFSYNNLVDPKERTYGFGMEIANVFQCK

SEQ ID NO: 3119 - DNA, 510 bp, Unknown
  Obtained from environmental sample
  misc_feature (1)..(510): n is a, c, g, or t
atgaaaattattttgctgtatgctgccattgtaggcagcttgtttgtatcctgcaatgcccaggaaggtaattcagaaaatggtggaaaaccaaaagaggaaaaaaagatcagtaaaagagaccgaagtatcacaaaagcaaattcctacagcgatctttttattgatagcatggtagtagaaaaattcattgccgataaaaaaatccctgactcactttcacgccgcattcgcagtttttataatacgcgtaattatcaatttgcatggtttaccagcaaaggcttaaccgaacaagcacgtggtttttggaaccttcacgattatcatactacttataaccacgatactttactgcatagtaaatcgcttcaaaaaacgatggataatttaattgccgaggaagacctttctgttaatgcctctaacaaaacctttatcaatacagagcttacgcttaccaatcattcattcatttgtgatgaaccattacgaagatgggtatgttaa

SEQ ID NO: 3120 - protein, 169 aa, Unknown
  Obtained from environmental sample
  SIGNAL (1)...(20)
  misc_feature (1)..(169): Xaa is any amino acid
MKIILLYAAIVGSLFVSCNAQEGNSENGGKPKEEKKISKRDRSITKANSYSDLFIDSMVVEKFIADKKIPDSLSRRIRSFYNTRNYQFAWFTSKGLTEQARGFWNLHDYHTTYNHDTLLHSKSLQKTMDNLIAEEDLSVNASNKTFINTELTLTNHSFICDEPLRRWVC

SEQ ID NO: 3121 - DNA, 357 bp, Unknown
  Obtained from environmental sample
  misc_feature (1)..(357): n is a, c, g, or t
atgcaacctgacctcgcttacaaattcttctcagataaactcatgcaacatgaaacgcttactgtaaaaaacggcaatggcggattgagctattacaagaatggcgtatttgtctgccatttcaatgccaacccgcagaaaaaacgcgatgacctgggttttgtggattttcgttatgatgccctgcgtccatatcttgatattgaaaagaccatttcagcaattcagcaggaagctttgccagaagtgcaaatcaaaagccataaactgtggtgcactctgcattttcctttatcacagatggaacacatcgcaggtttgtttttaaagcatatcatttccaaggttaatacctaa

SEQ ID NO: 3122 - protein, 118 aa, Unknown
  Obtained from environmental sample
  misc_feature (1)..(118): Xaa is any amino acid
MQPDLAYKFFSDKLMQHETLTVKNGNGGLSYYKNGVFVCHFNANPQKKRDDLGFVDFRYDALRPYLDIEKTISAIQQEALPEVQIKSHKLWCTLHFPLSQMEHIAGLFLKHIISKVNT

SEQ ID NO: 3123 - DNA, 765 bp, Unknown
  Obtained from environmental sample
  misc_feature (1)..(765): n is a, c, g, or t
atgtanacgaagagtaagttttccctccactatatcattacagtgatctttgcccaaagtgaaatagtcggggcaaatgtatttttgcaggatataacaaaaatccgggaaaaacaaaaactcaaagatgactggttcagtatgctttcccatgagctcaaatctccaataacaagcataaaagcttacaatcagctgcttttaagccagatttcggaaaatgaccagaaaagaaagctccttataaatatggatgaccagatagacaggttaaacaggttaattcaggacttttttgagctctccaggctgcaatcgggtaatttaaaatttgataaagagtttattgatattgacctgttcctcaaaaagctaatccataccatgaaaataacctacacccacagaaaatttgtattaaaaggcaatacaaacggttttatttttgcagataaagacagtattgaacaggtgttaataaatttcataacaaatgccataaaatattcagaggataataaaaaaattgaaattattgtttatgacgatgataaatcagtgacttttggagtcagagatttcgggaaaggcatacctgcaaaattccggaaaaaaatatctaaccccttttaccggattaatcattcatcaaaaggcaaaagcggaatgggtatcggattatttattggcggtaccatcattaaagctcacgaaggacaaatctgggttgactcggtagatggaaacgcagtacatttaatttaa

SEQ ID NO: 3124 - protein, 254 aa, Unknown
  Obtained from environmental sample
  DOMAIN (41)...(107): His Kinase A (phosphoacceptor) domain
  misc_feature (1)..(254): Xaa is any amino acid
MXTKSKFSLHYIITVIFAQSEIVGANVFLQDITKIREKQKLKDDWFSMLSHELKSPITSIKAYNQLLLSQISENDQKRKLLINMDDQIDRLNRLIQDFFELSRLQSGNLKFDKEFIDIDLFLKKLIHTMKITYTHRKFVLKGNTNGFIFADKDSIEQVLINFITNAIKYSEDNKKIEIIVYDDDKSVTFGVRDFGKGIPAKFRKKISNPFYRINHSSKGKSGMGIGLFIGGTIIKAHEGQIWVDSVDGNAVHLI

SEQ ID NO: 3125 - DNA, 321 bp, Unknown
  Obtained from environmental sample
  misc_feature (1)..(321): n is a, c, g, or t
gtgcctggcttttttgtaaatatttatcaagtactaagtatggtaattctagctattgctgttacgaaaattgtgggaattgctgccggaatttttaccggaacttcaatgcttcctcagcttataaaaatgtttaaggagaaaaaggcgtcccaggtttcggttttcatgctgatcattttgattattgggttgagtctttggatttggtatggctttcttaaagaagattggccgattctggttacaaatattttttcccttaccgtaaatctgattatgattgtgctgcgatacaaatacagaaacaacaaatcgtaa

SEQ ID NO: 3126 - protein, 106 aa, Unknown
  Obtained from environmental sample
  DOMAIN (18)...(83): PQ loop repeat
  misc_feature (1)..(106): Xaa is any amino acid
MPGFFVNIYQVLSMVILAIAVTKIVGIAAGIFTGTSMLPQLIKMFKEKKASQVSVFMLIILIIGLSLWIWYGFLKEDWPILVTNIFSLTVNLIMIVLRYKYRNNKS

SEQ ID NO: 3127 - DNA, 648 bp, Unknown
  Obtained from environmental sample
  misc_feature (1)..(648): n is a, c, g, or t
atgacagcaagagacacccataagattaatatacttgtcgttgacgattccccagagacagtggaactggtgaaacgcaatcttgagagcgtaggataccacgtctatagtgcgagtaacgttcagtctgcggtgaagttgctgaatgcactaaacatcgctttggtgatcacagatctaaaaatgccgggcgaaagcggtatggaactggtgcggcatgtcgtagaaaattgtaagggtaccggcattctggtggtgacagggtttccctccatacaaggcgcggtcgagtcgatcaagatcggcgctgaagaatacctggtcaagcctttcaccgatgaggagcttttcaaagcaacggaacgggtactggctaagacctccaagctcaaaaaagaagatgcgacgaaaacccctgcgaactttggcatcatcggcgaatctgagggtatgcaaaacgtgttcaagacaatcaataaggccaagaatacgaatgccacggctttgattcatgggggagagcggcacagtgaaaagactcgttgcgcgagcacttcattacgggagtcaacgcatccggtgcaacgtttgtgccccgtaattgggtggattactgattcgtattggaaacgaacttttggtatgtga

SEQ ID NO: 3128 - protein, 215 aa, Unknown
  Obtained from environmental sample
  DOMAIN (9)...(128): Response regulator receiver domain
  misc_feature (1)..(215): Xaa is any amino acid
MTARDTHKINILVVDDSPETVELVKRNLESVGYHVYSASNVQSAVKLLNALNIALVITDLKMPGESGMELVRHVVENCKGTGILVVTGFPSIQGAVESIKIGAEEYLVKPFTDEELFKATERVLAKTSKLKKEDATKTPANFGIIGESEGMQNVFKTINKAKNTNATALIHGGERHSEKTRCASTSLRESTHPVQRLCPVIGWITDSYWKRTFGM

SEQ ID NO: 3129 - DNA, 606 bp, Unknown
  Obtained from environmental sample
  misc_feature (1)..(606): n is a, c, g, or t
ttggccaatgatattactaccggaacttccttccaggtgaattccgataccgcggagatcgggtttaaaagcaaatcatttaatatacccctacgggctaccgttcatgttgagattttgaatcggtatcgcattggtggcggattctcgtatgagtttcaaaaagtaaatgatttcaagccaaccagttatgggaatgatattcagaatttttctccttcattttcaagcttcttcctgacgaagtattttttgatccttggtggatcggtataccggtataaaaaatttctgttaaccgttgatgccaacattggtggctacggactcgggaaaaaatttgagaaaagtcagatcacaaaaggtgtgtttgtgaatttgggtgctactatagagtacgaaatgtctgaatacttccggctgtttgtgcgcccgtcatatgagataaaaagctataagctcaatattcctgagaccggtcaaagcatccagcacaagttcaatgcactatatttcaatgtgggtgtgagctatcgattcccggaattacgcaggtgttttcataagcaatgcaaagcacaggttaacccatgcgcacggcaataa

SEQ ID NO: 3130 - protein, 201 aa, Unknown
  Obtained from environmental sample
  misc_feature (1)..(201): Xaa is any amino acid
MANDITTGTSFQVNSDTAEIGFKSKSFNIPLRATVHVEILNRYRIGGGFSYEFQKVNDFKPTSYGNDIQNFSPSFSSFFLTKYFLILGGSVYRYKKFLLTVDANIGGYGLGKKFEKSQITKGVFVNLGATIEYEMSEYFRLFVRPSYEIKSYKLNIPETGQSIQHKFNALYFNVGVSYRFPELRRCFHKQCKAQVNPCARQ

SEQ ID NO: 3131 - DNA, 327 bp, Unknown
  Obtained from environmental sample
  misc_feature (1)..(327): n is a, c, g, or t
ttgctggtattccttggcctcccttgcatttccaaacctggtatatatagtttaagtggtgtaaaagcgattaaagctactgttaagccaaccaatattacaaataacatacacaacgcaacatacacacttagcctggttagtttaaaggtcactaattcttcaaaagtatcttcattcataactattagcctatacctgtttcgcagcctcttcagcgtagtatttacttcgggttttaacacaatatttttttacttgttaaaaataatacagcgcttctatttaatacggcattcgcttaaaataaccgtatttttaaaataa

SEQ ID NO: 3132 - protein, 108 aa, Unknown
  Obtained from environmental sample
  misc_feature (1)..(108): Xaa is any amino acid
MLVFLGLPCISKPGIYSLSGVKAIKATVKPTNITNNIHNATYTLSLVSLKVTNSSKVSSFITISLYLFRSLFSVVFTSGFNTIFFYLLKIIQRFYLIRHSLKITVFLK

SEQ ID NO: 3133 - DNA, 465 bp, Unknown
  Obtained from environmental sample
  misc_feature (1)..(465): n is a, c, g, or t
atgcgttattggattttaaaatgtgcctttagcattttgcctgtcttgtttttttcgcctcttgtttttgcccaactgggaaaaattaccattgatcttgagaaagataagccaacgaagtataaaaccaagacccttaagtcagaaaagacaggtcagaagaaatttacactgccgcgaagagtgattcaaaacacagtctctcattacaattattattttaatgccaacaataaaattaatgaagttattgaaagagcccgtttaagtaataacgatatttattataagctgctcccgttctacagctactctttaaaaaatacatcatctcaggccagcgaacttgattcagtaatttataaagccactgcaggtatcctgattcatgatttgagaagtgcgtgggtagataatttttacctgctcataggtaaagcttacctgttgaaaacagccccttga

SEQ ID NO: 3134 - protein, 154 aa, Unknown
  Obtained from environmental sample
  misc_feature (1)..(154): Xaa is any amino acid
MRYWILKCAFSILPVLFFSPLVFAQLGKITIDLEKDKPTKYKTKTLKSEKTGQKKFTLPRRVIQNTVSHYNYYFNANNKINEVIERARLSNNDIYYKLLPFYSYSLKNTSSQASELDSVIYKATAGILIHDLRSAWVDNFYLLIGKAYLLKTAP

SEQ ID NO: 3135 - DNA, 822 bp, Unknown
  Obtained from environmental sample
  misc_feature (1)..(822): n is a, c, g, or t
ttggggaaaaagtggcctgaaaaaatttcaccagccggtattgatatagacaatgtaaagaaaataatgtacgtggtgacaagggaaaataattcgctttacattattgatttgaaaacaaaaaaaatagctggccaaattaaactacccgctgaagcatttagttgtttgttatcgccggataaaaaagaactctatatcagttgctggggctgtgacaaattattagtatttaatactgccggaaaaaatattgtcagcgaaatccaggttggcgataatccaaatgaattatgtctttcaaaaaaaggcagctatctttttgttgctaacgccaatgataattctgtttctgttattgatgttaaaaaaagaaaagttatagaaactttagatgctgctttgtttccaggtgccgtcgccggttctacttccaatggactggctttaagtgacaatgaaaaaaatctctacatagccaatgccgataataattgccttgctgtttttgatgtaagcaaaccaggttacagcacaagcaaaggatttattccggtaggctggtatcccaccaatgtaaaactgatcgggaaaaagatctttgttgccaatggaaaaggattttcatcgcaggcaaatcctatgggcccaaatcccataagagaaaagggacaggtaatttctcacatgggtgacaccagcacaaaagaacaatatataggcgggctttttaagggcaccatgagcattattaatgagccaactgannatgcactcagtatttattcgcaggcagtgtatcacaatacgccttacacntaa

SEQ ID NO: 3136 - protein, 273 aa, Unknown
  Obtained from environmental sample
  misc_feature (1)..(273): Xaa is any amino acid
MGKKWPEKISPAGIDIDNVKKIMYVVTRENNSLYIIDLKTKKIAGQIKLPAEAFSCLLSPDKKELYISCWGCDKLLVFNTAGKNIVSEIQVGDNPNELCLSKKGSYLFVANANDNSVSVIDVKKRKVIETLDAALFPGAVAGSTSNGLALSDNEKNLYIANADNNCLAVFDVSKPGYSTSKGFIPVGWYPTNVKLIGKKIFVANGKGFSSQANPMGPNPIREKGQVISHMGDTSTKEQYIGGLFKGTMSIINEPTXXALSIYSQAVYHNTPYT

SEQ ID NO: 3137 - DNA, 576 bp, Unknown
  Obtained from environmental sample
  misc_feature (1)..(576): n is a, c, g, or t
atgataaacgttgccattattgcaggcgggaattccgcagaaaggggcatctctttaaagagcgccaaaacgattgaaaaccaactgcctgctgataagtacaggaccttcttaatagatataacagcagacggatgggtggaaatgcagtcaggtctgaaggtggacctgaacaccttcatgatcaaggatcgggaaaatgatcaatggcagaagctgcagtttgcatttatcattattcacggcacccctgcggaagatggcaagctccagggttattttgaaatgatgggaatcccgcatagcgcctgtggtgtcctatcaagtgcgttgacattcaataagcagatgtgcaaggaccatcttcgacagtttaatatacctcttgcagaaagcatgatcgtatacaagaccgtgtcgcangaagatgtcgaacgacgcaacatccacctgccagtatttgtaaagccaaaacacaatggnctcagctatggggtggacaaggtcaaagaatggaaccagcttgaagaatgcgtgaagctggcgctggatatgatcacgagtcatgatggaccc

SEQ ID NO: 3138 - protein, 192 aa, Unknown
  Obtained from environmental sample
  DOMAIN (2)...(113): D-ala D-ala ligase N-terminus
  misc_feature (1)..(192): Xaa is any amino acid
MINVAIIAGGNSAERGISLKSAKTIENQLPADKYRTFLIDITADGWVEMQSGLKVDLNTFMIKDRENDQWQKLQFAFIIIHGTPAEDGKLQGYFEMMGIPHSACGVLSSALTFNKQMCKDHLRQFNIPLAESMIVYKTVSXEDVERRNIHLPVFVKPKHNGLSYGVDKVKEWNQLEECVKLALDMITSHDGP

SEQ ID NO: 3139 - DNA, 558 bp, Unknown
  Obtained from environmental sample
  misc_feature (1)..(558): n is a, c, g, or t
gtggttagtagtattgtcacactatttatactctcgtggcttgttcccctcatttgtatagtcattcttttagaatcaagagggtggccattcttttcacaattacgtaccggaaaaaataaaaaaactttcccatgttataaattccgcagtatgtatgttaataaagattctgatttaaagcaagccaccaaaaatgataaccgtgttacaaaagttggaagaattttacggaggactagtcttgacgaatttccccagtttataaatgttctgcttggaaacatgagtatagtggggccgcgacctcacatgataaaacatactgacgattattcaaaaatagtaaatcagtatatggtgcgtcatttttctaaaccaggaataacaggctgggcccaaattcacggttaccgcggggagattagtgatttagttcaaattaaaaatcgaatacaatatgacatctggtacatggaaaactggagtttacttttagatataaaaatcatgtttctaactgtttttaaaatactgaaggatgaaaaggcatattga

SEQ ID NO: 3140 - protein, 185 aa, Unknown
  Obtained from environmental sample
  DOMAIN (5)...(185): Bacterial sugar transferase
  misc_feature (1)..(185): Xaa is any amino acid
MVSSIVTLFILSWLVPLICIVILLESRGWPFFSQLRTGKNKKTFPCYKFRSMYVNKDSDLKQATKNDNRVTKVGRILRRTSLDEFPQFINVLLGNMSIVGPRPHMIKHTDDYSKIVNQYMVRHFSKPGITGWAQIHGYRGEISDLVQIKNRIQYDIWYMENWSLLLDIKIMFLTVFKILKDEKAY

SEQ ID NO: 3141 - DNA, 303 bp, Unknown
  Obtained from environmental sample
  misc_feature (1)..(303): n is a, c, g, or t
atggaaataatcctttgtcaatgcttaatccgagttcgattgaatcaattgcttcctaacccagctacaaagacaatcacgctacaatttagtggaatgcagaatcaagttagcggaatacagactcgaaaagcaaatttatatgtacaaagctcatcagggaaaactctaaaaaagatctctctaatgttggtgaatgaaaaaatcgaacttgatatttcttctttaagtgcgggtgcgtatattataaccctatcangtgacaattttattattcacaaaaaattcttgaaaaataaatag

SEQ ID NO: 3142 - protein, 100 aa, Unknown
  Obtained from environmental sample
  misc_feature (1)..(100): Xaa is any amino acid
MEIILCQCLIRVRLNQLLPNPATKTITLQFSGMQNQVSGIQTRKANLYVQSSSGKTLKKISLMLVNEKIELDISSLSAGAYIITLSXDNFIIHKKFLKNK

SEQ ID NO: 3143 - DNA, 339 bp, Unknown
  Obtained from environmental sample
  misc_feature (1)..(339): n is a, c, g, or t
atgaatgaatatgtgaaaaaatctgctggaaatattcctgttcattacacaaatatgttggaaaaggaattagaattctggaaaaagatcagtaaagattttgtagctgaagactacgatttttttaatgataaaaaggaaatcctcgatacattgccagataaactgaccaataaatccatccggaaatttattcattataccttatatgaactgcaggtaatatctggtcatttagatgattacagtttggataatgtccgtaaatttatggaagacatttattataattatgcatttattcagcctttcattaccacacagcaaacgaactattga

SEQ ID NO: 3144 - protein, 112 aa, Unknown
  Obtained from environmental sample
  misc_feature (1)..(112): Xaa is any amino acid
MNEYVKKSAGNIPVHYTNMLEKELEFWKKISKDFVAEDYDFFNDKKEILDTLPDKLTNKSIRKFIHYTLYELQVISGHLDDYSLDNVRKFMEDIYYNYAFIQPFITTQQTNY

SEQ ID NO: 3145 - DNA, 429 bp, Unknown
  Obtained from environmental sample
  misc_feature (1)..(429): n is a, c, g, or t
ttgagcaaggaacgcaccaaattatcaaaacaggttactagggacgttagaattcaaaatcctcaagctgctatcgaaaatgcgtttacacattttgaagactctttacgaaaacgtatcggtggtgattacaaattgtatagcaacaatttgataaaagccgcatacggaaaagaagaaggtcgtctgttgtttatattcgatggaaaaaactctactgagcatctttattatctgatgtctggtgcctattcactttttcgtaatccccgtcatcacaaaatcatcgacgacggtgaacaaaaagcgcaggtaataatttcattggcagagttactaatggagtttgtcgatgcatctgaggatagaacaaccaatttgcaaaacttatcgaaagtacatgctatagatcaaaagagtctggattga

SEQ ID NO: 3146 - protein, 142 aa, Unknown
  Obtained from environmental sample
  misc_feature (1)..(142): Xaa is any amino acid
MSKERTKLSKQVTRDVRIQNPQAAIENAFTHFEDSLRKRIGGDYKLYSNNLIKAAYGKEEGRLLFIFDGKNSTEHLYYLMSGAYSLFRNPRHHKIIDDGEQKAQVIISLAELLMEFVDASEDRTTNLQNLSKVHAIDQKSLD

SEQ ID NO: 3147 - DNA, 318 bp, Unknown
  Obtained from environmental sample
  misc_feature (1)..(318): n is a, c, g, or t
atggtcaatgaaccgtttctaaattcctttcaaaaatcaatttactttataaatacttcaagaggaaaaattgttcatactgattccctgataaatgctatggataccggaaaagtaagcggtgcagctctggatgttctggaatttgaaagcatttcatttgaaaatctcgctaccaatgaaattccaaaacaactggattatttatatcattcagataaagttgtgttatcacctcatattgccgggtggactattgaatcttacagaaagatttcggagatactggctgataaaattttgaatgtattaaaataa

SEQ ID NO: 3148 - protein, 105 aa, Unknown
  Obtained from environmental sample
  misc_feature (1)..(105): Xaa is any amino acid
MVNEPFLNSFQKSIYFINTSRGKIVHTDSLINAMDTGKVSGAALDVLEFESISFENLATNEIPKQLDYLYHSDKVVLSPHIAGWTIESYRKISEILADKILNVLK

SEQ ID NO: 3149 - DNA, 300 bp, Unknown; identical to SEQ ID NO: 2663
  Obtained from environmental sample
  misc_feature (1)..(300): n is a, c, g, or t

SEQ ID NO: 3150 - protein, 99 aa, Unknown; identical to SEQ ID NO: 2664
  Obtained from environmental sample
  misc_feature (1)..(99): Xaa is any amino acid

SEQ ID NO: 3151 - DNA, 300 bp, Unknown; identical to SEQ ID NO: 2663
  Obtained from environmental sample
  misc_feature (1)..(300): n is a, c, g, or t

SEQ ID NO: 3152 - protein, 99 aa, Unknown; identical to SEQ ID NO: 2664
  Obtained from environmental sample
  misc_feature (1)..(99): Xaa is any amino acid

SEQ ID NO: 3153 - DNA, 480 bp, Unknown
  Obtained from environmental sample
  misc_feature (1)..(480): n is a, c, g, or t
atgatgcaaaaagaactggcagactggaaatcaaaaggcaattattttctttttaataagcataagatattctacataaaagaaggaagcggtcctgtactgactatctttcatggatacccatacaatagctttgactttgaaaaggtatggagtgaattaataaaaaagtttacagttattattcctgatatgctgggcatgggcttttctgataaaccacaaaaacatgcttacagttttgaagaaatggcagctttatatactgctttacttagcgaattgcgaattagtgaaacacatattctcgcacatgacctcggtaacagtgtggtgcaggaattgctggcaagaaatgaagagaataaaaatccgtttgctataaaaagtattgcatttttaaatggtggcctatttagcgatgtgtacaaaccgagattaatacaactattactgtcgaaatcacccaagccaatctga

SEQ ID NO: 3154 - protein, 159 aa, Unknown
  Obtained from environmental sample
  misc_feature (1)..(159): Xaa is any amino acid
MMQKELADWKSKGNYFLFNKHKIFYIKEGSGPVLTIFHGYPYNSFDFEKVWSELIKKFTVIIPDMLGMGFSDKPQKHAYSFEEMAALYTALLSELRISETHILAHDLGNSVVQELLARNEENKNPFAIKSIAFLNGGLFSDVYKPRLIQLLLSKSPKPI

SEQ ID NO: 3155 - DNA, 708 bp, Unknown
  Obtained from environmental sample
  misc_feature (1)..(708): n is a, c, g, or t
atgatgatgttaaaaatcaaatcattaagttatgggcattcgggtgtacaaattgatacggtaaagcgattgatggatatgtataataatgatgtacttcctgtaatttatacgcaaggttctttaggagcatcaggagatttagcaccattgagccatttaagcttaccattgttaggtttaggcgaagtctgtcacgaaggaaaaaaaatgcaatcagccgatgcattgaaaaaatttgattggaaacctatacaattacaaagtaaggaaggactggctttaattaatggcactcagtttatgagtgcatatggattatataatttaatgcaggcagatcgattattaaaatgggcagatattattgctgccatttcatttgatgcatttaattgtactattgaaccactgcatgaaaaaatacattcgataaggtctcacaaagggcaggtacataccgcagcaagattaagggaattattaaaagatagcaaaattgctgctcaaaaaaaatcacaggtacaagacccttattcatttagatgtataccccaggtgcatggtgctacaaaagatacatttaattatgtattaagtgtttttatgaaagaagtaaattcggtaaccgataatcctaatgtttttcctgaggaagacctaattgtaagtggagggaatttcacgggcaaccatagcgtaacttag

SEQ ID NO: 3156 - protein, 235 aa, Unknown
  Obtained from environmental sample
  DOMAIN (1)...(235): Phenylalanine and histidine ammonia-lyase
  misc_feature (1)..(235): Xaa is any amino acid
MMMLKIKSLSYGHSGVQIDTVKRLMDMYNNDVLPVIYTQGSLGASGDLAPLSHLSLPLLGLGEVCHEGKKMQSADALKKFDWKPIQLQSKEGLALINGTQFMSAYGLYNLMQADRLLKWADIIAAISFDAFNCTIEPLHEKIHSIRSHKGQVHTAARLRELLKDSKIAAQKKSQVQDPYSFRCIPQVHGATKDTFNYVLSVFMKEVNSVTDNPNVFPEEDLIVSGGNFTGNHSVT

SEQ ID NO: 3157 - DNA, 987 bp, Unknown
  Obtained from environmental sample
  misc_feature (1)..(987): n is a, c, g, or t
gtggtaaagggtatagacgcagtgataaagcaaattgcagtatttgaggaaaaaagggatgaactcgaatacgagatgatgtatggggtaattaaggtgaatagtcttgagctgcaggataagcttggtatgacctcacaccatccccggtgggctatagcttacaaattcaaggcaaggcaggccaccagcaaattgttgtctgtaagtttttatgttggcagaacaggcgctattaccccggcggcgcatatagaaccaacgcaggtgggaggcgtaactatatccaatatctcattgcataatgagaattacataaaggaaaaagatcttaggataggcgatacagtgttgatcgagcgcagcggagacgttattccacagatcgtaaaatcgatggctgaactccggaagggaaaagaaaaaaaagtggtcttccccacgcattgccccgtttgcaacgataagctttttaaaacagaagaagaagcggtttggcgctgcataaatatcaactgtgaagcacaggtgctggaaaggatcattcattttgtgagtaaggatgccatggatatacgaagttttggggaatcgaatgtccgtcggttttatggacttggtttattgaaggacattcctgggatatatcaactggattacgacaaaatcagtgacctggagggttttgggtccaaatccatatccaaattacgggaagccatagaagcaagtaagcagcaaccgctcaacaggcttatctatggtttgggcatccgctatgttggagagaccacagccaaaacccttgcccgtgcagtacataacgtgatggaacttaaggactataccgaagaacagcttcagcaacttgaagacgtgggaaccaaggtggcaaagagcgtagcccaatttttcaggaacaaggataatgtgaagatgctcgaaaagctacaacggctaggggtcaaacgaaaaccaaaaaaataa

SEQ ID NO: 3158 - protein, 328 aa, Unknown
  Obtained from environmental sample
  DOMAIN (148)...(175): NAD-dependent DNA ligase C4 zinc finger domain
  misc_feature (1)..(328): Xaa is any amino acid
MVKGIDAVIKQIAVFEEKRDELEYEMMYGVIKVNSLELQDKLGMTSHHPRWAIAYKFKARQATSKLLSVSFYVGRTGAITPAAHIEPTQVGGVTISNISLHNENYIKEKDLRIGDTVLIERSGDVIPQIVKSMAELRKGKEKKVVFPTHCPVCNDKLFKTEEEAVWRCININCEAQVLERIIHFVSKDAMDIRSFGESNVRRFYGLGLLKDIPGIYQLDYDKISDLEGFGSKSISKLREAIEASKQQPLNRLIYGLGIRYVGETTAKTLARAVHNVMELKDYTEEQLQQLEDVGTKVAKSVAQFFRNKDNVKMLEKLQRLGVKRKPKK

SEQ ID NO: 3159 - DNA, 864 bp, Unknown
  Obtained from environmental sample
  misc_feature (1)..(864): n is a, c, g, or t
ttgtttggtggaaaagtctgtttagagagaataactatgaaaatccttgattatgaatattctggtacaggatggaaaatccataaaacagaatttcaggacataaatcttattgtcggagattcgggtactggtaaaactaggctcttaaatacgatgttcaatcttggaacatgggtagctcaagggggccttggtagggaagctgaatggaacttaacattacaagtagatgataataagtataggtggagtattgttaccgacgtcgaggatgaaaaaactttcgtaaaatctgaaactatcgttctgaacgcggatcaaatacttacccgtgaaggaacagacttcacttttcaaggggattccttgccgaaattgccaaaagatcaaatgtcaatcgcgctgctaaaagaggaggaattaataaaaccgcttcacgacggtttctcgaaaatgctacggagaagattttttgctgacgaactctctaagaattctagcatttattttagtggagaaaaagctctaaaaaagattggggaaacaagggatttacacgaactatataaagctgatctaggactcaacataagactctcaattctaaaagactattttagtgatatttacgaanatatcacaaatttctataaagagtcttttgactacatcgaaaatattgatataagagatagccgagaattcccacacttagatattccagccggtacccctttagtctgcataaaagagcgacttgtagatcaatggataattcttccagacatgtcctctggtatgcagaaagcattgctagttgccacagatttacttgccctcccacctggaacaattatctga

SEQ ID NO: 3160 - protein, 287 aa, Unknown
  Obtained from environmental sample
  misc_feature (1)..(287): Xaa is any amino acid
MFGGKVCLERITMKILDYEYSGTGWKIHKTEFQDINLIVGDSGTGKTRLLNTMFNLGTWVAQGGLGREAEWNLTLQVDDNKYRWSIVTDVEDEKTFVKSETIVLNADQILTREGTDFTFQGDSLPKLPKDQMSIALLKEEELIKPLHDGFSKMLRRRFFADELSKNSSIYFSGEKALKKIGETRDLHELYKADLGLNIRLSILKDYFSDIYEXITNFYKESFDYIENIDIRDSREFPHLDIPAGTPLVCIKERLVDQWIILPDMSSGMQKALLVATDLLALPPGTII

SEQ ID NO: 3161 - DNA, 498 bp, Unknown
  Obtained from environmental sample
  misc_feature (1)..(498): n is a, c, g, or t
atgattgcaacaaaagaaacgatctatgaaaaagatctcgaaaacaaaaagatccgtgtaacacgggattttgacgccccaataaataaagtctggagagcatggactgaacctgcgatcctcgaccagtggtgggcacccaaaccctggaaggcaaataccatttcaatggatttccgggaaggaggccgctggttttattatatgcagggaccagatgatacccgtcattattgttgcgtggattatcattccatccagaaagaaaaaatgttttcaggacttgatgcattttgtgatgagaaaggaaatatcaataccgaaatgccctctatgaactggaaatgtgattttacttcctcgggtcagggcacaagattaaatgtggacatcacttttaattctctggaagacctggaaaagatcgtagaaatgggcttcaaagaaggatttgctgcagcgcataataacctcgatgaggtgcttgcgactttataa

SEQ ID NO: 3162 - protein, 165 aa, Unknown
  Obtained from environmental sample
  misc_feature (1)..(165): Xaa is any amino acid
MIATKETIYEKDLENKKIRVTRDFDAPINKVWRAWTEPAILDQWWAPKPWKANTISMDFREGGRWFYYMQGPDDTRHYCCVDYHSIQKEKMFSGLDAFCDEKGNINTEMPSMNWKCDFTSSGQGTRLNVDITFNSLEDLEKIVEMGFKEGFAAAHNNLDEVLATL

SEQ ID NO: 3163 - DNA, 312 bp, Unknown
  Obtained from environmental sample
  misc_feature (1)..(312): n is a, c, g, or t
ttggatgatgatctatccaacaaaacgctatcggttggcaaagtgataatctggtcaagccctgctacagacgtgggtgctttgctattatctctgcatctttcaaaggaaatttcttttttcaaagaagcaaatacaaaacaagcgatgaataaaaaaaagatcgatgccccaataaaatgctttcccatattcatgaggttaatggaaagtttaaaattccagtttatacaacattgctccattcgtcacgtatatcacgttatttacggtaacagcggaagtaccctcaaagtagctgcctgctggtaa

SEQ ID NO: 3164 - protein, 103 aa, Unknown
  Obtained from environmental sample
  misc_feature (1)..(103): Xaa is any amino acid
MDDDLSNKTLSVGKVIIWSSPATDVGALLLSLHLSKEISFFKEANTKQAMNKKKIDAPIKCFPIFMRLMESLKFQFIQHCSIRHVYHVIYGNSGSTLKVAACW

SEQ ID NO: 3165 - DNA, 468 bp, Unknown
  Obtained from environmental sample
  misc_feature (1)..(468): n is a, c, g, or t
ttggaagtctattgtttggggaaaagcttcaataacagtgaagaggctgactcacttcgaaaatttcttattgccaaaactttggaagacagaaaggcgttttcgccaaaaggtataggctttcatcagtcaaaccaaattccaggtatttgcaaatttgcaggctggccagctggccaggtgattgacctacatcctttaggcaaccgcgttgtccttattttctcaatatatgccagactaattagcgtcatcgaggtttgcgaactccgagagacttatctggacttattgggtaacgacggtatttgttatataatagtccctaaacgccaaaaagtaatcggacccatcaagcgaatggtgctcatcaatcacaggtttaatccagactatagcgacgagcgattagctgaaatcgaagttgaattagaaaaatacaaaataaaaccaccgtttaagatataa

SEQ ID NO: 3166 - protein, 155 aa, Unknown
  Obtained from environmental sample
  misc_feature (1)..(155): Xaa is any amino acid
MEVYCLGKSFNNSEEADSLRKFLIAKTLEDRKAFSPKGIGFHQSNQIPGICKFAGWPAGQVIDLHPLGNRVVLIFSIYARLISVIEVCELRETYLDLLGNDGICYIIVPKRQKVIGPIKRMVLINHRFNPDYSDERLAEIEVELEKYKIKPPFKI

SEQ ID NO: 3167 - DNA, 846 bp, Unknown
  Obtained from environmental sample
  misc_feature (1)..(846): n is a, c, g, or t
atggatgccatggggcctaaaaaacaaaaaggtaagtttcgtatggacagtcctgaatatttaatgaaaggtggcaaggaaggtgaaactattattgcaggcaaagcggaagaaagtgaaatgataaaacgtttgttgttggcaagagaagccgagcaccacatgccgccaaaagaaaaaccacaattaaacgaacgccagattgccttaattcattggtggatagaagaaggcgccgattttacaaaaaaagtaaaagagctgccgcagccggaaaaaataaaacctgtgcttttaagcatgcagggaaaaccggaacaaaaagcattaagtagcgtaccgtcaataccggtagaaagtgccgacgaaaaagcaattaatgttttaagagatagaggcgttgtggtgatacctgtatcccaaaacagcaattaccttcaggcaaattttattactgccactaatatttttaatgaagacatcaagctgttgttgccgataaaaaaacagctggtttggttaaaactgggtaatacatatgtgggcgatagcgctttgaaaattattagccaatgtactaatattagttttctacagcttaataatacctgtgtaacggatggaggattgccttttctaaaatcccttgacagcctccagtctttaaatcttgtcggcacgataattacttctgaaggtctaaggcatcttcggtctttaaagaaattaaaaaatatttatgtgtatcanactggtgtgaaagaaaaagattttgatgtactacaaaaggcattttcaaaatctgtcattgatacaggtggttacacactaccttttcttagctaa

SEQ ID NO: 3168 - protein, 281 aa, Unknown
  Obtained from environmental sample
  DOMAIN (5)...(59): Planctomycete cytochrome C
  misc_feature (1)..(281): Xaa is any amino acid
MDAMGPKKQKGKFRMDSPEYLMKGGKEGETIIAGKAEESEMIKRLLLAREAEHHMPPKEKPQLNERQIALIHWWIEEGADFTKKVKELPQPEKIKPVLLSMQGKPEQKALSSVPSIPVESADEKAINVLRDRGVVVIPVSQNSNYLQANFITATNIFNEDIKLLLPIKKQLVWLKLGNTYVGDSALKIISQCTNISFLQLNNTCVTDGGLPFLKSLDSLQSLNLVGTIITSEGLRHLRSLKKLKNIYVYXTGVKEKDFDVLQKAFSKSVIDTGGYTLPFLS

SEQ ID NO: 3169 - DNA, 420 bp, Unknown
  Obtained from environmental sample
  misc_feature (1)..(420): n is a, c, g, or t
ttgcaaagaggcaggcatgcctatagatttttttgcagcggagaaactatacgggaattgcaggaccagcaaaagagccaaaagcaagagggaaaaatgaacttttatgagttcagtaattgggatgattttttgatcttcagccgagaagtgagaaaaaatgatctgctcattattttatcatcaagaaaaggacatgtttcttaccaaagccagttagaaaaattaccttattatctttctaactatttcaaagaaaatagtttcattatgctgtatccacagcaaattgaaagaggcataaaaatggacgatgttcaatacgttgacagttctttaggagaaacgatttctcagaaagtaggatcgggcggaatttttaaaagattgttcaagaaaaataaaccccctgatacataa

SEQ ID NO: 3170 - protein, 139 aa, Unknown
  Obtained from environmental sample
  misc_feature (1)..(139): Xaa is any amino acid
MQRGRHAYRFFCSGETIRELQDQQKSQKQEGKMNFYEFSNWDDFLIFSREVRKNDLLIILSSRKGHVSYQSQLEKLPYYLSNYFKENSFIMLYPQQIERGIKMDDVQYVDSSLGETISQKVGSGGIFKRLFKKNKPPDT

SEQ ID NO: 3171 - DNA, 630 bp, Unknown
  Obtained from environmental sample
  misc_feature (1)..(630): n is a, c, g, or t
atgataaagtataaagaaacgttacanncctggaataaagtagcagagttataccaggaaaagttcatggatcttactttatataacgattcctatgatttattttgtaatgaattaaagaaacaaaattccggtgttttagaaattggctgcggacccggcaatatatcaaaatacctgctgtcaaaaaggaatgacttaaaaattaccggaattgacattgcaccggctatgattaaactcgctaaagtcaacaatccggcggctgagtttttcgaattagatatcagatcccttaatcaaattgaaaaaagattcgaaggaattattggtggattttgtttaccgtatttatccggtgatgattgcttaaaattatttaatgactgcagaaatttactgagcgatgatggaatactgtatttaagttatattgaaggcgatggtaaatcagactatttaacaggaagcagtggccatcgtacttatttttatgatcatcagctgcataatattaaagatcagcttaaagaacatgatttcgaaattgcccgcacgttgcagaaggatttcaataataatggtactgatgaagtacataccatattaatagcaaaaaaaactgcctga

SEQ ID NO: 3172 - protein, 209 aa, Unknown
  Obtained from environmental sample
  misc_feature (1)..(209): Xaa is any amino acid
MIKYKETLXXWNKVAELYQEKFMDLTLYNDSYDLFCNELKKQNSGVLEIGCGPGNISKYLLSKRNDLKITGIDIAPAMIKLAKVNNPAAEFFELDIRSLNQIEKRFEGIIGGFCLPYLSGDDCLKLFNDCRNLLSDDGILYLSYIEGDGKSDYLTGSSGHRTYFYDHQLHNIKDQLKEHDFEIARTLQKDFNNNGTDEVHTILIAKKTA

SEQ ID NO: 3173 - DNA, 630 bp, Unknown
  Obtained from environmental sample
  misc_feature (1)..(630): n is a, c, g, or t
atgaataagtataaagaaacgtttacaacctggaataaagtagcagagttataccaggaaaagttcatggatcttactttatataacgattcctatgatttattttgtaatgaattaaagaaacaaaattccggtgttttagaaattggctgcggacccggcaatatatcaaaatacctgctgtcaaaaaggaatgacttaaaaattaccggaattgacattgcaccggctatgattaaactcgctaaagtcaacaatccggcggctgagtttttcgaattagatatcagatcccttaatcaaattgaaaaaagattcgaaggaattattggtggattttgtttaccgtatttatccggtgatgattgcttaaaattatttaatgactgcagaaatttactgagcgatgatggaatactgtatttaagttatattgaaggcgatggtaaatcagactatttaacaggaagcagtggccatcgtacttatttttatgatcatcagctgcataatattaaagatcagcttaaagaacatgatttcgaaattgcccgcacgttgcagaaagatttcaataataatggtactgatgaagtacataccatattaatagcaaaaaaaactgcctga

SEQ ID NO: 3174 - protein, 209 aa, Unknown
  Obtained from environmental sample
  misc_feature (1)..(209): Xaa is any amino acid
MNKYKETFTTWNKVAELYQEKFMDLTLYNDSYDLFCNELKKQNSGVLEIGCGPGNISKYLLSKRNDLKITGIDIAPAMIKLAKVNNPAAEFFELDIRSLNQIEKRFEGIIGGFCLPYLSGDDCLKLFNDCRNLLSDDGILYLSYIEGDGKSDYLTGSSGHRTYFYDHQLHNIKDQLKEHDFEIARTLQKDFNNNGTDEVHTILIAKKTA

SEQ ID NO: 3175 - DNA, 735 bp, Unknown
  Obtained from environmental sample
  misc_feature (1)..(735): n is a, c, g, or t
atgttagacttcggatccacattattcatagtgattgcactattcaccgttctgttcctggcgggcagtgcggtgctcatctcgcgcttttatcgcaaggttgagcaaggccaggcgctcgtccgcaacggaatgggcggcaccaaagtgtctttctccggcatgatcgttctgccgatcttgcaccaaccggaatacatggatatttccgtgaagcgcgttgagatcgaccggaacggcaagaatggattgatctgcatggataatctccgcgcggacatcaaggtcgccttcttcgtgcgcgtgaaccagacgccgcaggacgtgctcaaggtagcgcagtccgtcggttgtattcgagcttcgagtcacagtgcgatcacggaactgttcgacgcgaaattctccgaagccctgaagacggtcggccgtcaatttcatttcgtcgatctgtataattcccgcgacaagctaaaggaagggattcttaagacgattgggacggacctgaacggattcgttctggaagatgtcgccattgattatctcgagcagacttcgctcggattgctcaatccagacaacattctcgacgctgaaggcataaagaaaatcacggaactcacagcgacgcagaagatcctggccaaccagatcgatcgcgaccgggagaagacgattacgaagcagaacgtgaagcgcaggaagcgatcttcgaataaaccgacaatctga

SEQ ID NO: 3176 - protein, 244 aa, Unknown
  Obtained from environmental sample
  misc_feature (1)..(244): Xaa is any amino acid
MLDFGSTLFIVIALFTVLFLAGSAVLISRFYRKVEQGQALVRNGMGGTKVSFSGMIVLPILHQPEYMDISVKRVEIDRNGKNGLICMDNLRADIKVAFFVRVNQTPQDVLKVAQSVGCIRASSHSAITELFDAKFSEALKTVGRQFHFVDLYNSRDKLKEGILKTIGTDLNGFVLEDVAIDYLEQTSLGLLNPDNILDAEGIKKITELTATQKILANQIDRDREKTITKQNVKRRKRSSNKPTI

SEQ ID NO: 3177 - DNA, 516 bp, Unknown
  Obtained from environmental sample
  misc_feature (1)..(516): n is a, c, g, or t
atgggctgcttattaaaaatattgtttgtgttatttcttgcacttggtttatgtggctgcaatacagaaaagcaagcacaaaaaaaagtaagctggcttttatcacatgataaaatggctggtgagtgtgcaagattatatccaaaccgggatagcacggtaagagacacgctgataaattttgatactctttacgtagagaatgaagtttacctgaatgatactatttaccgggaaggacaaacgatttacgtaactaagaaatgcccgccgcatgaaatagttacaaagacaatttatataagggatactgtttacagaactaatacggcagaagttgaacgttggcgctcgcttgcatccgataaagacaggcagataaaagataaagacgatatagtaattaagcagcaaaagaagatcagtaataatgattggtggcgaattgcttgcataataacatggtcgcttttaattattggtgggttacttaaactatttgtatttcataaataa

SEQ ID NO: 3178 - protein, 171 aa, Unknown
  Obtained from environmental sample
  misc_feature (1)..(171): Xaa is any amino acid
MGCLLKILFVLFLALGLCGCNTEKQAQKKVSWLLSHDKMAGECARLYPNRDSTVRDTLINFDTLYVENEVYLNDTIYREGQTIYVTKKCPPHEIVTKTIYIRDTVYRTNTAEVERWRSLASDKDRQIKDKDDIVIKQQKKISNNDWWRIACIITWSLLIIGGLLKLFVFHK

SEQ ID NO: 3179 - DNA, 951 bp, Unknown
  Obtained from environmental sample
  misc_feature (1)..(951): n is a, c, g, or t
gtgggtaaagactatccaatttcaattctaccactcacgccagcaatttattcaaaaattactaaattcaaacctgatatcgtgcatactcatcacccgtaccatataggtttttttgcgaacttcatatcagaaacactaaaaattccactagtatttacatatcatacaaaacatgattactatgcaactaagtatttcaaatttttaccaaatgacttgaagaaaaaatttatagaatattcagttttagatttctgtaaaaaatgtagtttagtagttgccccgtcagaaactattcagaaatatcttaatagaagtaaaataaggaatacaaagattgtcccatcagtagttgatgacttaaagaaactaagattaacaaaactaactttacgaaagaaattaaaattaccacttaaaaaaattattctattgtatgttggtagacttgctcctgagaaaagcccaatgcttcttttaaattccttaaaatatctggataaaaattatcatctagtaatttgtggctctgggccaatagaagctaatatgaagaaaaaagttgccctgttgggaattaaaaaacaggtctcatttataggatcagtcgatagggaaaaattaggagcttactattccatggcggattatttatattatgcttctaaatcagaaacacaaggtgttgtgtattgggaagcactacactttggattaccaattgtaagtgttgactcaagcgttgctagagaatgggtaactaataaatttggagagttgactgagagtaaggctgataaattagctgagggcgtaattaaaattagcaagaaaaaatatagtttactttctaaaaatgcagtcacattttcaaagaaattctcaagtcagaaaacagccagacagatggttaaggtctatgaaaatctaattaataaaaatgattaa

SEQ ID NO: 3180 - protein, 316 aa, Unknown
  Obtained from environmental sample
  DOMAIN (129)...(295): Glycosyl transferases group 1
  misc_feature (1)..(316): Xaa is any amino acid
MGKDYPISILPLTPAIYSKITKFKPDIVHTHHPYHIGFFANFISETLKIPLVFTYHTKHDYYATKYFKFLPNDLKKKFIEYSVLDFCKKCSLVVAPSETIQKYLNRSKIRNTKIVPSVVDDLKKLRLTKLTLRKKLKLPLKKIILLYVGRLAPEKSPMLLLNSLKYLDKNYHLVICGSGPIEANMKKKVALLGIKKQVSFIGSVDREKLGAYYSMADYLYYASKSETQGVVYWEALHFGLPIVSVDSSVAREWVTNKFGELTESKADKLAEGVIKISKKKYSLLSKNAVTFSKKFSSQKTARQMVKVYENLINKND

SEQ ID NO: 3181 - DNA, 336 bp, Unknown
  Obtained from environmental sample
  misc_feature (1)..(336): n is a, c, g, or t
atggttaaacttaaagttgaaaccgttttaagcattttgcgcttgtttactaataagaaaaactgcatgaacttgtttgagtctaatcgcctcaccaaacttttttcaatagactatccaatcattcaggcgggaatggtatggtgcagtggatggagactcgcctccgcggtgagtaacgctggtggacttggccttctgggcgcaggctccatgtatcccgaagtattgcgtgagcatattgtgaaatgtaaggcagcaacaacgaaaccttttggtgtaaacgttccacttctttatcgggacatcgataagctgatccagatcatcgtttga

SEQ ID NO: 3182 - protein, 111 aa, Unknown
  Obtained from environmental sample
  misc_feature (1)..(111): Xaa is any amino acid
MVKLKVETVLSILRLFTNKKNCMNLFESNRLTKLFSIDYPIIQAGMVWCSGWRLASAVSNAGGLGLLGAGSMYPEVLREHIVKCKAATTKPFGVNVPLLYRDIDKLIQIIV

SEQ ID NO: 3183 - DNA, 315 bp, Unknown
  Obtained from environmental sample
  misc_feature (1)..(315): n is a, c, g, or t
gtgagtcttgtaaattctatatttgattttttacgcttcaataaacgaaactggaaggccgtagtattgtgcttatttgctgctacggtcttctggttttttaatgcccttaataaaaactattcaaccaatattaatttcccacttgctttcgattataatcaagaaggctacatacccgtaaccaaacttcctgaacacattcgtatgaatgtaagtggtattggttgggatctctttcgtaaaagttcaggacttaaagttccaccgcttgttattccgttggagcgcccatccgacataaaaaaaatttag

SEQ ID NO: 3184 - protein, 104 aa, Unknown
  Obtained from environmental sample
  misc_feature (1)..(104): Xaa is any amino acid
MSLVNSIFDFLRFNKRNWKAVVLCLFAATVFWFFNALNKNYSTNINFPLAFDYNQEGYIPVTKLPEHIRMNVSGIGWDLFRKSSGLKVPPLVIPLERPSDIKKI

SEQ ID NO: 3185 - DNA, 411 bp, Unknown
  Obtained from environmental sample
  misc_feature (1)..(411): n is a, c, g, or t
gtggtgaaggcaattgcgcttggcgttttgaaaattttaatttttacaataaatattcccgtttatctgcatgatacaaatcaacgttctttttttgggtctgattcaagggcattgagtcatggttgtgttcgggtccaggaatggaaaaaaatggcttattatatcatggagaatgagaagaacgtgaccaatgcgggcaaatcaaagcaaattccggtagattcactcactcattggctggaaataaaagaaaaacacagcataccaatacgatccaaagtgccggtttttatcaggtattttacctgcgaggcaaacaggggacaaatcagtttttttgaagatatttatggcgaagataagaaaatgagtgagctgctttttgctaacaaaaagaatggcgaatga

SEQ ID NO: 3186 - protein, 136 aa, Unknown
  Obtained from environmental sample
  misc_feature (1)..(136): Xaa is any amino acid
MVKAIALGVLKILIFTINIPVYLHDTNQRSFFGSDSRALSHGCVRVQEWKKMAYYIMENEKNVTNAGKSKQIPVDSLTHWLEIKEKHSIPIRSKVPVFIRYFTCEANRGQISFFEDIYGEDKKMSELLFANKKNGE

SEQ ID NO: 3187 - DNA, 951 bp, Unknown
  Obtained from environmental sample
  misc_feature (1)..(951): n is a, c, g, or t
gtgacaagaaggctttttgaatctggttatattgattcattaaccattcagcccgactcgctgcagtttgctatcatcctgaaaaaataccagcgggacaaaaaactaaaagcagatggcaaaattggcgcacaaacaatacgaatgttgaatttgtccgaccaggaaaaattcaatcgtattgctattacaatggatagatataaaatgttgcccgaaaagatgcccgggaagtatatctgggtgaacattccttcattttcattaaagttgctgagtaatgatacattgatagtgagcagcaaggtcgtggtcggtaaaccacaaacaaggactcctgtacttaccagcgctgtatcagaaatgatcacctatccgcaatggaccattccggaaagcattattgaaaaagaaatcttaccgggaataaaaaaagacacagcatatcttacaaaaaagggatatagtttactgaatagtaagaacgaagaagtagatccggattctgtcgattggtcaaagtatacaaagcggataccttataaagttatccagggcagtggtgatgacaatgcgcttggcgttttgaaatttaatttttacaataaatattccgtttatctgcatgatacaaatcaacgttctttttttgggtctgattcaagggcattgagtcatggttgtgttcgggtccaggaatgggaaaaaatggcttattatatcatggagaatgagaagaacgtgaccaatgcgggcaaatcaaagcaaattccggtagattcactcactcattggctggaaataaaagaaaaacacagcatacccatacgatccaaagtgccggttttttatcaagtattttacctgcgaggcaaacaggggacaaatcagttttttttgaagatatttatggcgaaaataangaaaataagtgagctgcttttttgctaa

SEQ ID NO: 3188 - protein, 316 aa, Unknown
  Obtained from environmental sample
  misc_feature (1)..(316): Xaa is any amino acid
MTRRLFESGYIDSLTIQPDSLQFAIILKKYQRDKKLKADGKIGAQTIRMLNLSDQEKFNRIAITMDRYKMLPEKMPGKYIWVNIPSFSLKLLSNDTLIVSSKVVVGKPQTRTPVLTSAVSEMITYPQWTIPESIIEKEILPGIKKDTAYLTKKGYSLLNSKNEEVDPDSVDWSKYTKRIPYKVIQGSGDDNALGVLKFNFYNKYSVYLHDTNQRSFFGSDSRALSHGCVRVQEWEKMAYYIMENEKNVTNAGKSKQIPVDSLTHWLEIKEKHSIPIRSKVPVFYQVFYLRGKQGTNQFFLKIFMAKIXKISELLFC

SEQ ID NO: 3189 - DNA, 471 bp, Unknown; identical to SEQ ID NO: 497
  Obtained from environmental sample
  misc_feature (1)..(471): n is a, c, g, or t

SEQ ID NO: 3190 - protein, 156 aa, Unknown; identical to SEQ ID NO: 498
  Obtained from environmental sample
  misc_feature (1)..(156): Xaa is any amino acid

SEQ ID NO: 3191 - DNA, 402 bp, Unknown
  Obtained from environmental sample
  misc_feature (1)..(402): n is a, c, g, or t
ttgcaaatgaagaccaaaattgtaatcaatccgaagtatagttttctcagccaatacattaatcagatacctgaacactttgaagctcttaccgaagttctgtacaaagacagaaatgtgatcaaggctgataaggtctccaacgtagaggtagtgatcaaatcctttcatcgaaattatctttccaatcgcattcgttatacattttttcatccgtcaaaggctaagagagccttcgacaacggaatggaattgataaagcgtggttttctaacacccgatccggttgcatttatagaacgttttgagtacggcctgatgaacgagagtttttttatttgcctgaggtcggacttcaccaagctggaatttcactttacaagcggtggtgaacaattctga

SEQ ID NO: 3192 - protein, 133 aa, Unknown
  Obtained from environmental sample
  misc_feature (1)..(133): Xaa is any amino acid
MQMKTKIVINPKYSFLSQYINQIPEHFEALTEVLYKDRNVIKADKVSNVEVVIKSFHRNYLSNRIRYTFFHPSKAKRAFDNGMELIKRGFLTPDPVAFIERFEYGLMNESFFICLRSDFTKLEFHFTSGGEQF

SEQ ID NO: 3193 - DNA, 966 bp, Unknown
  Obtained from environmental sample
  misc_feature (1)..(966): n is a, c, g, or t
atggccgcaaaaaagaaagaatccgataaaaattacacgcatatttttcgcattaaagcgccattgctgaagaagcatcaatccgtatgtattgcaggaagcggagaaagactggggaattggtctgaaaaaaagccgatactgctgaataaaaagggtgattggtggatggttgatctcgacctgagcaaggaaatcttcccgctggcttataagtatgggattcatgactctcataaggatgagttccatgagttcgaaaaaggagataaccgcattcttaacagtgacgcttctaagaataagatcactatcctgcatgatgggttccttcatgttcccaatgatacatggaaaggagcgggggtagcgatcccggtttttagtttgcgttcaaccaacagttttggtgtcggcgaattccaggacatcaaattgcttgtcgactgggcgaagaccaccggtttgaaactaattcagcttttgccggtcaacgatacgatctctaccaactgttggcaggactcatatccgtattccgccatctccgcatttgcccttcatcccctgtatattgatctttttaaagttgccggaaaagaatttggaaccccgctggaatcactgacattaaaacagcagcaactgaatgaactggctgttgtggattatgaggaggtgatgaaaattaaattatcagtgctgaaagaactttatgaggtaatgggtgaagagtgcatgagatcagaagattacaaaaaattttatgagcagcataggggttggttgaatccatatggagcattttgctggctccgggataaatatggtaccgctgactttgctcactggcggtccaattccgtttatgataaggaggagatcagcaggctttgttctaaaaagtcatcggcctataaagaaattggcttttattattcacccagtaccatcttcaccgcataa

SEQ ID NO: 3194 - protein, 321 aa, Unknown
  Obtained from environmental sample
  misc_feature (1)..(321): Xaa is any amino acid
MAAKKKESDKNYTHIFRIKAPLLKKHQSVCIAGSGERLGNWSEKKPILLNKKGDWWMVDLDLSKEIFPLAYKYGIHDSHKDEFHEFEKGDNRILNSDASKNKITILHDGFLHVPNDTWKGAGVAIPVFSLRSTNSFGVGEFQDIKLLVDWAKTTGLKLIQLLPVNDTISTNCWQDSYPYSAISAFALHPLYIDLFKVAGKEFGTPLESLTLKQQQLNELAVVDYEEVMKIKLSVLKELYEVMGEECMRSEDYKKFYEQHRGWLNPYGAFCWLRDKYGTADFAHWRSNSVYDKEEISRLCSKKSSAYKEIGFYYSPSTIFTA

SEQ ID NO: 3195 - DNA, 381 bp, Unknown
  Obtained from environmental sample
  misc_feature (1)..(381): n is a, c, g, or t
atgccaaatcttgacccttgggtaaatcaaaataataattatgaagataatgaaacaaaaacaataagcaaaattgaaaatcatttgttatttattaaaacggaatgccaaaaaatgattcatcctaactcgccttttatctataatgaacgtcaacgaaaaattatagagatgatagattggactttggagaaatataaaacaggaacaaataaaaaaatgacgaaccagcagattgaagaacaagtaataatagataatatcatcaaagaacttaataaaaaaagagaagtagctctaatcaggaaacaaaaactctgcagaaagatgaagttttggagcatgaagaagaagatactnattaatatattctttatataa

SEQ ID NO: 3196 - protein, 126 aa, Unknown
  Obtained from environmental sample
  misc_feature (1)..(126): Xaa is any amino acid
MPNLDPWVNQNNNYEDNETKTISKIENHLLFIKTECQKMIHPNSPFIYNERQRKIIEMIDWTLEKYKTGTNKKMTNQQIEEQVIIDNIIKELNKKREVALIRKQKLCRKMKFWSMKKKILINIFFI

SEQ ID NO: 3197 - DNA, 306 bp, Unknown
  Obtained from environmental sample
  misc_feature (1)..(306): n is a, c, g, or t
atgatctcaaacgtaaatctccaaagcaataagcgtaactgccagccattgaagtacattgcttcgttgtatttgtttaacgataacaactcaatattacccctaaggtcagcgaaccttcgtttaacgggattatctgttaccaacacaagcaccactatcaggagtattgaaaatgcgccaagtatctggggccaaatggcggtctttgcgctcctgatcgataaaatcaattgtgatattaaatacaaagcagtcatcaaaagaaccattttcgacgacaataaaaaaagcaacaccaggtaa

SEQ ID NO: 3198 - protein, 101 aa, Unknown
  Obtained from environmental sample
  misc_feature (1)..(101): Xaa is any amino acid
MISNVNLQSNKRNCQPLKYIASLYLFNDNNSILPLRSANLRLTGLSVTNTSTTIRSIENAPSIWGQMAVFALLIDKINCDIKYKAVIKRTIFDDNKKSNTR

SEQ ID NO: 3199 - DNA, 891 bp, Unknown
  Obtained from environmental sample
  misc_feature (1)..(891): n is a, c, g, or t
atgaataatattcttgttacctataatggaaaaaaacatgatgttacttatcagagtgaaaaacaaaagtattctttgcatagataccttaaaaatatagacgaagtaaaaaagtatgtttttgtttcaaattttatttggttgaaaaatatcacatcaaaagagttattagagttgacaaataagggcgaacataatattttaccaaaagaatttagtttagactggttgttgatgcttcttctttctcaatctaagccttttgaaaacacccaagctcaacacccttacatgcttttccaatcatggaaatcaagtgatattgaatttggaaaccttgaaaaagcctttgatctctttgaaagcataaaaaaaagcgttggcagtattacacgggcacattttgagagaatgtcaaagaagattcttcgagatcagaaatttgcagaagctattcttgacaattctgacaaaggtggaaagttcgtaataattcaaggaaaggcaggcacagggaaaactgttaaacttctaaatattgcctgcgacctttgtctgaactatcaaaagagatgtttaattttaacctataacttcacacttgttgctgatataaggagaactttaacctttgcgcatattccagatggagtgggaaaggaaagtgttagaataatgacactttttaaattctttattgatttgtttgaaggttttgggatttatactgggcaagatgttttagacgatgccgagtttttcaaaaattacgaaccctattgtaagacactggcagagtttattaaacagaatcatgatcccaataatgatattgaggcaataatgaagcaaattcatcaattagtaagttgggatacattttatagatga

SEQ ID NO: 3200 - protein, 296 aa, Unknown
  Obtained from environmental sample
  misc_feature (1)..(296): Xaa is any amino acid
MNNILVTYNGKKHDVTYQSEKQKYSLHRYLKNIDEVKKYVFVSNFIWLKNITSKELLELTNKGEHNILPKEFSLDWLLMLLLSQSKPFENTQAQHPYMLFQSWKSSDIEFGNLEKAFDLFESIKKSVGSITRAHFERMSKKILRDQKFAEAILDNSDKGGKFVIIQGKAGTGKTVKLLNIACDLCLNYQKRCLILTYNFTLVADIRRTLTFAHIPDGVGKESVRIMTLFKFFIDLFEGFGIYTGQDVLDDAEFFKNYEPYCKTLAEFIKQNHDPNNDIEAIMKQIHQLVSWDTFYR

SEQ ID NO: 3201 - DNA, 423 bp, Unknown
  Obtained from environmental sample
  misc_feature (1)..(423): n is a, c, g, or t
atgagtaaagagggaaaaagctacgctgataagttaaaagaccctcgctggcagaaagtcagactgaaggttatggaaagggatgggtttaaatgtaccctttgtggggatgaaaaaaccatgctccaagtccatcacgaagaatattcgggagaaccatgggaagcgccgctggataaattgaaaaccacctgctcacattgtcatagtgtaattgagacttcaaaaactatagttcctgatattaaaatagttaggtgtgttaagacggctgatgttaatggggagtatttgttcgtgtttgcgaaaactaatattaattcagttggtgtatttgcgattgaagaaaacactactcgactcgtcgctgctattgaacttaacgaggctattaacattttcaatgatttaaaaaatggctaa

SEQ ID NO: 3202 - protein, 140 aa, Unknown
  Obtained from environmental sample
  misc_feature (1)..(140): Xaa is any amino acid
MSKEGKSYADKLKDPRWQKVRLKVMERDGFKCTLCGDEKTMLQVHHEEYSGEPWEAPLDKLKTTCSHCHSVIETSKTIVPDIKIVRCVKTADVNGEYLFVFAKTNINSVGVFAIEENTTRLVAAIELNEAINIFNDLKNG

SEQ ID NO: 3203 - DNA, 714 bp, Unknown
  Obtained from environmental sample
  misc_feature (1)..(714): n is a, c, g, or t
atgatcttcaccagcttcccggtggcaaatttagttatttcatgtaaaacgtttacccgcatgataccagtcccttacacaaggtttggtatttacatggaacagctgtatgaaggcaccggagaattgggccattcgcacctgatgaaagtaaacctgcaaaaaggcgagatcgaaaaaaaaatctcgctggcgccggaatatttgggcgaaggcatcactatattaaacgacactgtttaccagctcacctggaaaaataaaaaggtttttgtttacacccttcccgattttaaaaaaataaaagagtacaatattaatactgaaggctggggcattaccaatgatggcaagtcgctgattgtaagtgacggcaccaataatttatatttttattcacctgaaaatttttcattaataaaaacgcagcctgtatatgaagccagtgcacctgcctttaacctgaatgagttggagtatattgacggctttgtttatgccaatcaatggcagtatccctatattcttaaaattgatccgttgcagggaacagttgttgcaaaagccgatcttacagaactgattcaaaaagtaaaagcaaaagaccgtggtatagaagccttaaatggcattgcgtatgattctgcttcaaagaaactttatgttaccggtaaattatggccggagctttacgagatccgtttcaatcaataa

SEQ ID NO: 3204 - protein, 237 aa, Unknown
  Obtained from environmental sample
  DOMAIN (1)...(236): Glutamine cyclotransferase
  misc_feature (1)..(237): Xaa is any amino acid
MIFTSFPVANLVISCKTFTRMIPVPYTRFGIYMEQLYEGTGELGHSHLMKVNLQKGEIEKKISLAPEYLGEGITILNDTVYQLTWKNKKVFVYTLPDFKKIKEYNINTEGWGITNDGKSLIVSDGTNNLYFYSPENFSLIKTQPVYEASAPAFNLNELEYIDGFVYANQWQYPYILKIDPLQGTVVAKADLTELIQKVKAKDRGIEALNGIAYDSASKKLYVTGKLWPELYEIRFNQ

SEQ ID NO: 3205 - DNA, 516 bp, Unknown
  Obtained from environmental sample
  misc_feature (1)..(516): n is a, c, g, or t
ttgtttgattcttttggagaatatttttctgaagcttttattcaacccaaggttactagagaaatcataattcctaaacttaaaaatctaatagctataaggaacactatagcgcataatagacacatttctttctatgagtataatgacattctttctattgatcaattacttatttcaggtataaaaaaagaatatttagaaaactataatgatttagtttttaataatctcgaacaaattagagaacaattattattggttaaagaagatattcttagaaacctgaaaaatggtgcaataataaaaagagaattattaagaaaactaaaatcctttggaagtgcaatatcaccatctcaaaaggaaaacttttttgtggaaatcgataggttggtcagcgttctagaattatataataaaaatgctccacaaaaacctggaaggatagatgaaataaaatcctatattgaagaaaacaaaatctattcatttttgaacgggctaattttatga

SEQ ID NO: 3206 - protein, 171 aa, Unknown
  Obtained from environmental sample
  misc_feature (1)..(171): Xaa is any amino acid
MFDSFGEYFSEAFIQPKVTREIIIPKLKNLIAIRNTIAHNRHISFYEYNDILSIDQLLISGIKKEYLENYNDLVFNNLEQIREQLLLVKEDILRNLKNGAIIKRELLRKLKSFGSAISPSQKENFFVEIDRLVSVLELYNKNAPQKPGRIDEIKSYIEENKIYSFLNGLIL

SEQ ID NO: 3207 - DNA, 825 bp, Unknown
  Obtained from environmental sample
  misc_feature (1)..(825): n is a, c, g, or t
atggaggtaaatttttaccaattgtcaacgtgtagtttgttatgtggtaatagtttagatattttaaaaactataaaagataaatcaatagatctgattttaacgagtcctccctactttaaccttcgggattataaacacttagggcaaataggtaatgagaaaaaagcagaagaatacattatgaatttgttttatgtatttagagaatgttcacgagttttgaaagatactggttcattttacttgaacataagtgatactacaataaaaggtaaaatgcaacgaataccagaagaattagatagtgttattaatcaacttggttttatcaaacgtgatactattatttggcacaaacctaattgcactccacaaggcaataaaaattacacaaaagactttgaatatgtgtattattatgttaaaacaaaccagtttacatggaacgtgcagtatgaacctatgacttataaatataacaacctagaatataatggtaatgaaacgaaagattacaaaggagcaaaagcacaagaaccaagtaaaaccaaaaaaagaatccttgaaagttataaacgacaatctatccgatttggaggtaataaataccctgaagaagtgggaggattgtattcagggaaagtgtgggttccaaataatcagctcatgcgagtaaaacgttctgtttggaaaataccagtcaaaccttacaaaggtagtcattttgcgacattcccaccagaattaatagaaacacctatcttagcttcaagcaacanaggagatactgtattagatcctttctgtggaacggaaccgtag

SEQ ID NO: 3208 - protein, 274 aa, Unknown
  Obtained from environmental sample
  DOMAIN (71)...(273): DNA methylase
  misc_feature (1)..(274): Xaa is any amino acid
MEVNFYQLSTCSLLCGNSLDILKTIKDKSIDLILTSPPYFNLRDYKHLGQIGNEKKAEEYIMNLFYVFRECSRVLKDTGSFYLNISDTTIKGKMQRIPEELDSVINQLGFIKRDTIIWHKPNCTPQGNKNYTKDFEYVYYYVKTNQFTWNVQYEPMTYKYNNLEYNGNETKDYKGAKAQEPSKTKKRILESYKRQSIRFGGNKYPEEVGGLYSGKVWVPNNQLMRVKRSVWKIPVKPYKGSHFATFPPELIETPILASSNXGDTVLDPFCGTEP

SEQ ID NO: 3209 - DNA, 507 bp, Unknown
  Obtained from environmental sample
  misc_feature (1)..(507): n is a, c, g, or t
gtgtctgggacgagaagtctgtttggcgatgtggtgaacggcgtaatgaagttgagcaaatccggcgaggttgttcaatgggaatggaaagcattgccgcaaagattccgatacatcgaattgggtgcctacgtggtaatgccaaatcatttgcatggtatcttaattttccatgaacacgtaggggcgagccgccctgatttaattcacgcacgttcaagcaaagatacattactttctgtgaccagggatggtgtcgaaggctcgcccctaccagaaggaatcaaacctgcttccttgggcgcggtcatcgcacaattcaaatcgcgtgtgacaaaaaggttgtggaagttatcctcattaaaagacagaccgatctggcagcgcaattattatgaacatatcatccgcaacgaaaaggatctccaaaacaaaacagattacattaacgccaatcccttgttgtgggaacaggatgaagaaaatccaataaatatcaaaaagtag

SEQ ID NO: 3210 - protein, 168 aa, Unknown
  Obtained from environmental sample
  misc_feature (1)..(168): Xaa is any amino acid
MSGTRSLFGDVVNGVMKLSKSGEVVQWEWKALPQRFRYIELGAYVVMPNHLHGILIFHEHVGASRPDLIHARSSKDTLLSVTRDGVEGSPLPEGIKPASLGAVIAQFKSRVTKRLWKLSSLKDRPIWQRNYYEHIIRNEKDLQNKTDYINANPLLWEQDEENPINIKK

SEQ ID NO: 3211 - DNA, 378 bp, Unknown
  Obtained from environmental sample
  misc_feature (1)..(378): n is a, c, g, or t
atgcaactgctggaaggacaattgatgaaagattcagggcttttccatttcattggaaatgtggaaggaagcgatttattcggcgacaaagcagacattatggtatgtgatggttttgtgggaaatgttatgcttaaggaagccgaagctttttataccatggtgagaaagcgtaaaatccttgatgatttttttgaaaaattcaattttgtaaattatggtggtacacccattctgggaatcaatgaacctgtgcttatagcgcatggtatttcaaatgatgtggccataaaaaatctgatattgcacacggcagatgttataaaaagtaacctttgccaaaaaattaaagaagcgtttaaagaatgtcccgaataa

SEQ ID NO: 3212 - protein, 125 aa, Unknown
  Obtained from environmental sample
  misc_feature (1)..(125): Xaa is any amino acid
MQLLEGQLMKDSGLFHFIGNVEGSDLFGDKADIMVCDGFVGNVMLKEAEAFYTMVRKRKILDDFFEKFNFVNYGGTPILGINEPVLIAHGISNDVAIKNLILHTADVIKSNLCQKIKEAFKECPE

SEQ ID NO: 3213 - DNA, 387 bp, Unknown
  Obtained from environmental sample
  misc_feature (1)..(387): n is a, c, g, or t
atgcccaacacctacacccaaatacacattcaggcagtttttgctgtacagaaccgacagtcacttattcaaacttcatggaaagttgaactatataaatacattagtggcattctcactagcaacactcataagttaatcattataaacggaatgcccgatcacctgcatgttttatttggaatgagaccagttcaatcactatcagatttgatgcaggatataaaaggaaattcatcaaaatggatcaatgataaaaaattagttaaaggaaagttttcatggcaggaaggttatggagcattttcatatagcaaatctcagttaccttccgtaataaaatatatcgaaaatcangaagaacatcatanaaaaatactttcttag

SEQ ID NO: 3214 - protein, 128 aa, Unknown
  Obtained from environmental sample
  DOMAIN (13)...(109): Transposase IS200 like
  misc_feature (1)..(128): Xaa is any amino acid
MPNTYTQIHIQAVFAVQNRQSLIQTSWKVELYKYISGILTSNTHKLIIINGMPDHLHVLFGMRPVQSLSDLMQDIKGNSSKWINDKKLVKGKFSWQEGYGAFSYSKSQLPSVIKYIENXEEHHXKILS

SEQ ID NO: 3215 - DNA, 432 bp, Unknown
  Obtained from environmental sample
  misc_feature (1)..(432): n is a, c, g, or t
atgactttaaatgaagtcattaaaatatttgataaacaatctggtttaaaatactggtggattttagctgtaaaacataatggagtaaaacaaagagttcatccacgttctgtatttgcagaatggaaacctatgttgtggtatgtcaaaggtgaaaaacccaccaatttgttagacacaatgtttgatcatattgaatctagtccaccttcaaaagtagaacatgaatgggaacaatcaacagaagaagctgatgcagtaataagatatcttacagtagaaaatcaaatagtatgtgatccatttatgggaaatggaacattcggagtatctacacttaaaagaaaaaggaatttcattggaatcgaaatagatccagaaagattcgaaacagggaaaaatagaattggccgtgataccgtcatcatttga

SEQ ID NO: 3216 - protein, 143 aa, Unknown
  Obtained from environmental sample
  DOMAIN (4)...(136): DNA methylase
  misc_feature (1)..(143): Xaa is any amino acid
MTLNEVIKIFDKQSGLKYWWILAVKHNGVKQRVHPRSVFAEWKPMLWYVKGEKPTNLLDTMFDHIESSPPSKVEHEWEQSTEEADAVIRYLTVENQIVCDPFMGNGTFGVSTLKRKRNFIGIEIDPERFETGKNRIGRDTVII

SEQ ID NO: 3217 - DNA, 432 bp, Unknown
  Obtained from environmental sample
  misc_feature (1)..(432): n is a, c, g, or t
atgactttaaatgaagtcattaaaatatntgataaacaatctggtttaaaatactggtggatnttagctgtaaaacataatggagtaaaacaaagagttcatccacgttctgtatttgcagaatggaaacctatgttgtggtatgtcaaaggtgaaaaacccaccaatttgttagacacaatgtttgatcatattgaatctagtccaccttcaaaagtagaacatgaatgggaacaatcaacagaagaagctgatgcagtaataagatatcttacagtagaaaatcaaatagtatgtgatccatttatgggaaatggaacattcggagtatctacacttaaaagaaaaaggaatttcattggaatcgaaatagatccagaaagattcgaaacagggaaaaatagaattggccgtgataccgtcatcatttga

SEQ ID NO: 3218 - protein, 143 aa, Unknown
  Obtained from environmental sample
  DOMAIN (4)...(136): DNA methylase
  misc_feature (1)..(143): Xaa is any amino acid
MTLNEVIKIXDKQSGLKYWWXLAVKHNGVKQRVHPRSVFAEWKPMLWYVKGEKPTNLLDTMFDHIESSPPSKVEHEWEQSTEEADAVIRYLTVENQIVCDPFMGNGTFGVSTLKRKRNFIGIEIDPERFETGKNRIGRDTVII

SEQ ID NO: 3219 - DNA, 828 bp, Unknown
  Obtained from environmental sample
  misc_feature (1)..(828): n is a, c, g, or t
atggccaataaaaacatcagtacgccaaccaatagattgctcacatcacttttcagcaagaaccggctttcaatgcttttaaagtacggcatagcttatgttatgacccaaactgggattgaaaagcatatcatgaggtatccgcagttttttgccaccaaagctattgaaagcaaattggaaaacggagagagaaaagggatcatttggcatacacagggaagcgggaagactgccttagccttctacaatgttcattacctgacagactattttgataaaaagggaatcattccaaagttttatttcatcgtagataggcttgatctaatgatccaagcagaacgagaatttacgagtagaggactcattgttcacaccgtaaactcaagagaagaactcttaaacgacttccgcacacaaaaggtcatccataatctttccggtaaaagagagattacggttgtaaacatccaaaagttcaaggatgagtccaatatccttcaacctaaagactacgatatcgacgtgcagcgtatttactttttggatgaagtacacagaagctatgaccccaaaggtagttttttggcaaatctctataactcagaccgaaatgctattctcattggtttaactggtacaccacttatcagtgctgatcgaaggtcaagagatatttttggcaaatacatacataagtattattacaattcctccatcgcagacggctacactttaaaactaattcgcgaaggcattgaaaacaactacagaatgcagctcaccgaagcactcaaagaagtggaaattttaaaagcgaagtaa

SEQ ID NO: 3220 - protein, 275 aa, Unknown
  Obtained from environmental sample
  DOMAIN (43)...(218): Type III restriction enzyme, res subunit
  misc_feature (1)..(275): Xaa is any amino acid
MANKNISTPTNRLLTSLFSKNRLSMLLKYGIAYVMTQTGIEKHIMRYPQFFATKAIESKLENGERKGIIWHTQGSGKTALAFYNVHYLTDYFDKKGIIPKFYFIVDRLDLMIQAEREFTSRGLIVHTVNSREELLNDFRTQKVIHNLSGKREITVVNIQKFKDESNILQPKDYDIDVQRIYFLDEVHRSYDPKGSFLANLYNSDRNAILIGLTGTPLISADRRSRDIFGKYIHKYYYNSSIADGYTLKLIREGIENNYRMQLTEALKEVEILKAK

SEQ ID NO: 3221 - DNA, 765 bp, Unknown
  Obtained from environmental sample
  misc_feature (1)..(765): n is a, c, g, or t
atgatcaaggcaaagattttttccggtttactgctttttatttcaactgctttattttctcaaaaaggaaaaatcgaaggctatatttcagatgctgaaaatagaacgccaattaatggggccactgtaattattttaaataataaaggagacaatacagatggatttggaaaattcgccattactggggtcaatccgggacaatatgaactggtggtttctcatataagttataaaacggagatcattcctgttgaagtaaaagaaaatctgatctcttcagttttagtggcaatgaaaaaagcaagtcttgatctttcggaaataaaaatcaatggtaagagaagttctccgttaaatatgatcggttcagtggatataatgcttcgtcctctaaatacttcgcaggatgttttaaggattgttcccggcttatttattgcgcaacatgccggcggcggtaaagctgaacaaatatttttaagaggttacgatattgatcacggaacagatataaatgtaagtgtggatggaatgccggtgaatattgtaagtcatgcacatgggcagggctatgctgatcttcacttcctaattcctgaaacagtggagaaagtaagttttgacaaaggcccatatttcaccaacaaaggaaatcttgcaactgcaggttatgctgaattttatacaaaagagtttctgaaagataatctagttaagtttgaagctggtcaatttacacacagcgtgccgttgctatgttga

SEQ ID NO: 3222 - protein, 254 aa, Unknown
  Obtained from environmental sample
  SIGNAL (1)...(20)
  misc_feature (1)..(254): Xaa is any amino acid
MIKAKIFSGLLLFISTALFSQKGKIEGYISDAENRTPINGATVIILNNKGDNTDGFGKFAITGVNPGQYELVVSHISYKTEIIPVEVKENLISSVLVAMKKASLDLSEIKINGKRSSPLNMIGSVDIMLRPLNTSQDVLRIVPGLFIAQHAGGGKAEQIFLRGYDIDHGTDINVSVDGMPVNIVSHAHGQGYADLHFLIPETVEKVSFDKGPYFTNKGNLATAGYAEFYTKEFLKDNLVKFEAGQFTHSVPLLC

SEQ ID NO: 3223 - DNA, 636 bp, Unknown
  Obtained from environmental sample
  misc_feature (1)..(636): n is a, c, g, or t
atgatcttggtaggcggtgattggagtgataaaggaatatccggcgttgagcgttttgtgatccgtagttatgaattatttaatcagtataaagatattatcaaacaagcatctgcaaaagataaatatgatatttcaactttatcagataatgagaaaaaaatttaccgcaaattaaatcaaacattattcaagtttaacgaagagattgaacattttagattcaatactgcaattgcgtctttaatggaattaattaatgaacttaaagttttagaaagttgcagtaaagaaattcagaattatgttttacaaagatttgcttcaatgttagcgccagttgctccacatcttggggaagaatgctggcagataattggaaatgaaaaatctattttccaaaacccggtagtatttgaagtagataaagaagcattgattgaagattctgtaaatattgctgttcaggtaaatggaaaattaagagcaacgattccggttccaatgaacagtgaacaggacacagtaaagccacttgtatttgctgatgaaaaagtaaataagtttactgttggcaaaacaatcgttaaagaaatattcgtaaaaaataaaatttataacatagttgtaaagtaa

SEQ ID NO: 3224 - protein, 211 aa, Unknown
  Obtained from environmental sample
  misc_feature (1)..(211): Xaa is any amino acid
MILVGGDWSDKGISGVERFVIRSYELFNQYKDIIKQASAKDKYDISTLSDNEKKIYRKLNQTLFKFNEEIEHFRFNTAIASLMELINELKVLESCSKEIQNYVLQRFASMLAPVAPHLGEECWQIIGNEKSIFQNPVVFEVDKEALIEDSVNIAVQVNGKLRATIPVPMNSEQDTVKPLVFADEKVNKFTVGKTIVKEIFVKNKIYNIVVK

SEQ ID NO: 3225 - DNA, 945 bp, Unknown
  Obtained from environmental sample
  misc_feature (1)..(945): n is a, c, g, or t
ttggannngccatgggatcagatttcgtttcctcaaagtaacggaagttatgtatatcttgaatccgggggaatgaatgttactgataaagataatgttaccggggtagtggtaaattcccgtgatgtaacagcaaaacgcgaccgtgaagtaaatatccgaaagcttacccaggcagttgagcagagctcgaataccgttgttatcactgacataaacggaagaatagaatatgtaaacaaaaaatttgaagatcttaccggatatttaaaagatgaggtcattggcggtaaccccaatttattgagaagctcttccacaacccctgagcagtataaagagctttggacgaccatcctgacagggaaagtctgggaaggcgagttccagaataccaagaagaacggagaaacctactgggaaaagataaagataactcctataatagattctgatgaaagaataacgaactttatcgctatcaaagatgatattaccgataagaagctaaaggatgaacagcttgaaaaaagcctgaaggaaaaagaaatgatgctgaaggaaatacatcacagggtgaaaaataacctccagatcgtttcaagcctacttaaccttcaggcagaatctgttgaggatacgaagcttaaggcgcagcttacaataagccagaacagggtcaggtctatgtcgataatccaccagctactttacagggcggctgaccttagcagtataacaatagaagagtatttatacagcatttcagggcagcttctggcctcatatgctgagcttagggataagatcactatcaaaattgatgctgaagatatcaagttcacgattganactgccgtgccgtttggtttgcttataaatgagctgataacaactcgcttaacacgttttcccaatacagaaaggctcataatatcacgctaa

SEQ ID NO: 3226 - protein, 314 aa, Unknown
  Obtained from environmental sample
  DOMAIN (54)...(117): PAS domain
  misc_feature (1)..(314): Xaa is any amino acid
MXXPWDQISFPQSNGSYVYLESGGMNVTDKDNVTGVVVNSRDVTAKRDREVNIRKLTQAVEQSSNTVVITDINGRIEYVNKKFEDLTGYLKDEVIGGNPNLLRSSSTTPEQYKELWTTILTGKVWEGEFQNTKKNGETYWEKIKITPIIDSDERITNFIAIKDDITDKKLKDEQLEKSLKEKEMMLKEIHHRVKNNLQIVSSLLNLQAESVEDTKLKAQLTISQNRVRSMSIIHQLLYRAADLSSITIEEYLYSISGQLLASYAELRDKITIKIDAEDIKFTIXTAVPFGLLINELITTRLTRFPNTERLIISR

SEQ ID NO: 3227 - DNA, 630 bp, Unknown
  Obtained from environmental sample
  misc_feature (1)..(630): n is a, c, g, or t
ttgatgcgcggcgaaaccctgagtgattttgttgagggcaggcatgtagataagtataaaaaaagacagcggatattttctgaaggaaatcacccaatacgcctttactatgtgcaaaaagggaaggtgaaagtttttaaaaccaataatgatgggaaagaactaattgtaaaaattgtgaatgaaggagagttttttggatatacagctatgcttgaaaactgtgtttacaaggtgagtgccgatgctctggaagattcggaaatagccgcgataccaagaaacgaattcgaagagttgataaactcaaattacgaggtctctaaaaaattcataaagcttcttgccagcgatgttacacaaaaagaagagcagttgttacatattgcctacaattctctcaggaaaaaagtagccgatactttactggcggtggaaaaaagatttaagaacagccctgaaaaatttaatatcaacctaagcagggaaaatcttgctgctgtagccggaactgcaaccgaatcattgatcaggacactcacagacttcaaatctgaaaaacttattgatatccaggatggaaaaataaccatcttgaattatcaaaaactggaaggcatggtgaactga

SEQ ID NO: 3228 - protein, 209 aa, Unknown
  Obtained from environmental sample
  DOMAIN (158)...(189): Bacterial regulatory proteins, crp family
  misc_feature (1)..(209): Xaa is any amino acid
MMRGETLSDFVEGRHVDKYKKRQRIFSEGNHPIRLYYVQKGKVKVFKTNNDGKELIVKIVNEGEFFGYTAMLENCVYKVSADALEDSEIAAIPRNEFEELINSNYEVSKKFIKLLASDVTQKEEQLLHIAYNSLRKKVADTLLAVEKRFKNSPEKFNINLSRENLAAVAGTATESLIRTLTDFKSEKLIDIQDGKITILNYQKLEGMVN

SEQ ID NO: 3229 - DNA, 333 bp, Unknown
  Obtained from environmental sample
  misc_feature (1)..(333): n is a, c, g, or t
atgaaacagtcaatgtttattacttccgtgtccagcaatattaaattgccaaacaaagtattggaaaaaataataaatcacaggttaagaaatgaagaatataaattgcccgtgaccggtattgataaaagttattttggtcgggattttgaaccgatagtaacctgcaatagtcaaatcactttaaatggagatgtgatgatctattactgccacactggtcatggagaagtggagaggctggaaattcctatgcgttcctcgtttttagtaacctgcattaaagggaaagagggcaagtacagagtaggtatcagcgcttcattatcctga

SEQ ID NO: 3230 - protein, 110 aa, Unknown
  Obtained from environmental sample
  misc_feature (1)..(110): Xaa is any amino acid
MKQSMFITSVSSNIKLPNKVLEKIINHRLRNEEYKLPVTGIDKSYFGRDFEPIVTCNSQITLNGDVMIYYCHTGHGEVERLEIPMRSSFLVTCIKGKEGKYRVGISASLS

SEQ ID NO: 3231 - DNA, 321 bp, Unknown
  Obtained from environmental sample
  misc_feature (1)..(321): n is a, c, g, or t
atgcgaattataattgctataatattaatcattgttctgcctttgataagtcaagggcaaactgaaaggacaatttccagtgtttgcaacgaagtctcaaggcaatggaagttcgactcaaattcttgtaacggagatcggttaaagcttgccaaactattctcaaacgctcgaccagactcaataactaaaaaattcctgttctcgatgcttggtaagcccaacttaatacagaaatattatgtcggctatcccgaaaataaaaactatgttgaatacatctattacatatacagggatgattgtcctaaaataaactga

SEQ ID NO: 3232 - protein, 106 aa, Unknown
  Obtained from environmental sample
  SIGNAL (1)...(19)
  misc_feature (1)..(106): Xaa is any amino acid
MRIIIAIILIIVLPLISQGQTERTISSVCNEVSRQWKFDSNSCNGDRLKLAKLFSNARPDSITKKFLFSMLGKPNLIQKYYVGYPENKNYVEYIYYIYRDDCPKIN

SEQ ID NO: 3233 - DNA, 702 bp, Unknown
  Obtained from environmental sample
  misc_feature (1)..(702): n is a, c, g, or t
atgaaaaaagaccttattttaaccctccttattttcttatttacggtgtctttgacggcacagaataccacggaacgggagatcgaaaaaatcagcaaagacctggtcctcaaaataaataaaaagtcaactatcaggaaggtcgttattaaagattttacgcagaataaaaaagtaactaaactcggcgtctatttggcacaggagttaacacttgcattgagtttagttgatgataagtcatttgaaattattgatttcaaagaaagtaccaagaagaataatcaaaaagataccagcggggtacaggcttctgtatttggtaaaatagctgaaaaagctggaaatgagttgaagaataataacagcacttcaaagcccggtgtttatttggcaaaaagtggtgtgttaattaatgagatcactaaagtcaaaaatccgaaaataggtaaaaaagaaaagaaagcggaatatgatgccatcattaccggtgagttgacagacaatccaaatgataatgagattcgactgattattaatgtggtcgatatctccagcaatgtgctcatcccattaaggngatatattacaaaaacaataagtgtaatagagatggcgtcggataaaagtggaactggatctgaaacggggactgtcgatccgaatatgacttaccggcaggataattttaccttcatttaa

SEQ ID NO: 3234 - protein, 233 aa, Unknown
  Obtained from environmental sample
  SIGNAL (1)...(20)
  misc_feature (1)..(233): Xaa is any amino acid
MKKDLILTLLIFLFTVSLTAQNTTEREIEKISKDLVLKINKKSTIRKVVIKDFTQNKKVTKLGVYLAQELTLALSLVDDKSFEIIDFKESTKKNNQKDTSGVQASVFGKIAEKAGNELKNNNSTSKPGVYLAKSGVLINEITKVKNPKIGKKEKKAEYDAIITGELTDNPNDNEIRLIINVVDISSNVLIPLRXYITKTISVIEMASDKSGTGSETGTVDPNMTYRQDNFTFI

SEQ ID NO: 3235 - DNA, 897 bp, Unknown
  Obtained from environmental sample
  misc_feature (1)..(897): n is a, c, g, or t
atgaaaaaagaccttattttaaccctccttattttcttatntacggtgtctttgacggcacagaataccacggaacgggagatcgaaaaaatcagcaaagacctggtcctcaaaataaataaaaagtcaactatcaggaaggtcgttattaaagattttacgcagaataaaaaagtaactaaactcggcgtctatttggcacaggagttaacacttgcattgagtttagttgatgataagtcatttgaaattattgatttcaaagaaagtaccaagaagaataatcaaaaagataccagcggggtacaggcttctgtatttggtaaaatagctgaaaaagctggaaatgagttgaagaataataacagcacttcaaagcccggtgtttatttggcaaaaagtggtgtgttaattaatgagatcactaaagtcaaaaatccgaaaataggtaaaaaagaaaagaaagcggaatatgatgccatcattaccggtgagttgacagacaatccaaatgataatgagattcgactgattattaatgtggtcgatatctccagcaatgtgctcatcccattaaggggatatattacaaaaacaataagtgtaatagagatggcgtcggataaaagtggaactggatctgaaacggggactgtcgatccgaatatgacttaccggcaggataattttaccttcaatttaatggaatgcaaacaggtaggacaaacattggaatgttcttttgaaataattaatgcaggccggaaggatttggatttacatgtctacggcaatgaaagcagatcattgaataaagaaggtggatatgaatatctggtcagttcaattaaagtatctgataaaatcaacagcagttatgtgtcaaaaacaatctga

SEQ ID NO: 3236 - protein, 298 aa, Unknown
  Obtained from environmental sample
  SIGNAL (1)...(20)
  misc_feature (1)..(298): Xaa is any amino acid
MKKDLILTLLIFLXTVSLTAQNTTEREIEKISKDLVLKINKKSTIRKVVIKDFTQNKKVTKLGVYLAQELTLALSLVDDKSFEIIDFKESTKKNNQKDTSGVQASVFGKIAEKAGNELKNNNSTSKPGVYLAKSGVLINEITKVKNPKIGKKEKKAEYDAIITGELTDNPNDNEIRLIINVVDISSNVLIPLRGYITKTISVIEMASDKSGTGSETGTVDPNMTYRQDNFTFNLMECKQVGQTLECSFEIINAGRKDLDLHVYGNESRSLNKEGGYEYLVSSIKVSDKINSSYVSKTI

SEQ ID NO: 3237 - DNA, 642 bp, Unknown
  Obtained from environmental sample
  misc_feature (1)..(642): n is a, c, g, or t
gtgcactttttgcccgcatcggccgctgactttcctgcgcccactgaattacgcacactaatcgaaatgaaacagaacctcgcatccataagagaaaacattttaaaaacaaatgacggcgaccggggtacaactcgagttcagatccgaaatcaaattttaacgctagacaaaaattttaatgaattggaaaaaaacaattctcccgttagccaaactaaaccttgggcaaaaatgaagaaactaaaacataaacttatttctctcacggattacgtgccaacgatggtgattgtacttattgctttttcattgggcctcggaacaaccgtgggatggaaaagagtcgtcgttaccatcggcgagaaaattggaaaaagtcatttaacttatgctcaaggattcgccgcacaattagttgcgatgtgcacaatcggaatttcagctttgcttggtttaccagttagtacaactcacgtactgtcttctggtattgccggcagcatggtggccaataaatctggagtgcatgtcggcacagtaaataaaattttatcggcttgggttctcactttaccggtgaccatgtttatttcttgcgttacgtactatctgattcttaaattcgtattacattattag

SEQ ID NO: 3238 - protein, 213 aa, Unknown
  Obtained from environmental sample
  DOMAIN (20)...(199): Phosphate transporter family
  misc_feature (1)..(213): Xaa is any amino acid
MHFLPASAADFPAPTELRTLIEMKQNLASIRENILKTNDGDRGTTRVQIRNQILTLDKNFNELEKNNSPVSQTKPWAKMKKLKHKLISLTDYVPTMVIVLIAFSLGLGTTVGWKRVVVTIGEKIGKSHLTYAQGFAAQLVAMCTIGISALLGLPVSTTHVLSSGIAGSMVANKSGVHVGTVNKILSAWVLTLPVTMFISCVTYYLILKFVLHY

SEQ ID NO: 3239 - DNA, 381 bp, Unknown
  Obtained from environmental sample
  misc_feature (1)..(381): n is a, c, g, or t
ttgaagggaaataatacaattatcctcgacgcctataatgcgaatcctacaagcatggaagctgcgctgaagaattttgaaacgatcggttcggaaaataaaattgttttcataggggaaatggcagagttgggagatgaaagtgaaaaggagcacaggcatattgcagagctgcttaaacaaattcattgcgataaaattgtgctggtaggtgaaaaatttgcaggctataaatcaattctgaattatcagcattttgaaaattcccagaaagcttctgaatggctgaagcaaaatccgctaaagaattcttatatactcattaagggggtcagaagtacaaaaatggaaaagattatgggagcccttttaatctgttag

SEQ ID NO: 3240 - protein, 126 aa, Unknown
  Obtained from environmental sample
  DOMAIN (1)...(81): Mur ligase family, glutamate ligase domain
  misc_feature (1)..(126): Xaa is any amino acid
MKGNNTIILDAYNANPTSMEAALKNFETIGSENKIVFIGEMAELGDESEKEHRHIAELLKQIHCDKIVLVGEKFAGYKSILNYQHFENSQKASEWLKQNPLKNSYILIKGVRSTKMEKIMGALLIC

SEQ ID NO: 3241 - DNA, 549 bp, Unknown
  Obtained from environmental sample
  misc_feature (1)..(549): n is a, c, g, or t
atgcaaaggcgaactgccctaaaaaatttattgatcattgcaggaggtacagtattacttccttcctgtgtgcagcaggataaaaaagtttccatccctttagataatttaaaattatccgcagagcaggagaacttacttgcccaaattgccgaaaccattattcctgcaacagatacaccaggtgcaaaagctttaggtgtacatcagtttgtgttaacgatgatggatgattgtgcagacaaagaacaacaggatgattttatgaaaggattgaacgaaataaatgatctttcaaaaaaacaatacaataatttatttatcaaatgcagccctcaacaacagttggaattattgacacgaattgataaaaaagaatttgatggtaaggtgaatgatgtttttaaagcgactaaaggattgaccatacaaggctatactaaatcgaaatacgtaatgagcaacctgttggtatatgaattagtgcctggtcgttttcatggcagctttcctataaaagataaaaaaagatttgaacaaaatgggtaa

SEQ ID NO: 3242 - protein, 182 aa, Unknown
  Obtained from environmental sample
  misc_feature (1)..(182): Xaa is any amino acid
MQRRTALKNLLIIAGGTVLLPSCVQQDKKVSIPLDNLKLSAEQENLLAQIAETIIPATDTPGAKALGVHQFVLTMMDDCADKEQQDDFMKGLNEINDLSKKQYNNLFIKCSPQQQLELLTRIDKKEFDGKVNDVFKATKGLTIQGYTKSKYVMSNLLVYELVPGRFHGSFPIKDKKRFEQNG

SEQ ID NO: 3243 - DNA, 444 bp, Unknown
  Obtained from environmental sample
  misc_feature (1)..(444): n is a, c, g, or t
atgtacaaaaaagtcaaagaagtcattttgggcaaggttaagattgatgaagctgatttggaaaagtcttttgactacagtactctatataattataaaaaaggtgatcacatacttaaggctggagactattgccgttttataggctttcttaataaagggcttattgttactactattaacgcagacggaaaagaaatagcctgcaactttatctatgaaggatgtttttttacatacacggaaggtatcagtttgcatacaccctcacataaaaatttcgtagcgcttgaagattgtgaagtactaatgatatgtaaaggagacctcccgcacatatntgcattaaacccaaagtttgaaacactttttagtcaactgctggctgaagaattaagaaacctattattatcagaacagcaaagccgtacacaacccctttga

SEQ ID NO: 3244 - protein, 147 aa, Unknown
  Obtained from environmental sample
  misc_feature (1)..(147): Xaa is any amino acid
MYKKVKEVILGKVKIDEADLEKSFDYSTLYNYKKGDHILKAGDYCRFIGFLNKGLIVTTINADGKEIACNFIYEGCFFTYTEGISLHTPSHKNFVALEDCEVLMICKGDLPHIXALNPKFETLFSQLLAEELRNLLLSEQQSRTQPL

SEQ ID NO: 3245 - DNA, 444 bp, Unknown
  Obtained from environmental sample
  misc_feature (1)..(444): n is a, c, g, or t
gtgaaaacaaatctgaaactgttcttgctgataatgttatcaataagcatagaagccaaatcacaaacaaagacagatgatgttataggcgtatggttaacaggtggcaaagagccagctaagattcaaatctataaagttggcaaaaagtattacggtaagattgtgtggttaaagaatcccttacaaaaagacaagccaaaactggacgcaaacaacccagataaaaacaaacgtaaccaaccaattattggaatcatcattttaacaggatttgaatttgatggtaatgaatgggcaaatggtaaaatttacgaccctgaaagtgggaaaacttatagctgtaatttgtctctgaaggataacgccacgttaaaagtgagaggttgcgttggattttcgatgtttggaagaacagaaacctggacaaggacaaacttgtga

SEQ ID NO: 3246 - protein, 147 aa, Unknown
  Obtained from environmental sample
  SIGNAL (1)...(19)
  misc_feature (1)..(147): Xaa is any amino acid
MKTNLKLFLLIMLSISIEAKSQTKTDDVIGVWLTGGKEPAKIQIYKVGKKYYGKIVWLKNPLQKDKPKLDANNPDKNKRNQPIIGIIILTGFEFDGNEWANGKIYDPESGKTYSCNLSLKDNATLKVRGCVGFSMFGRTETWTRTNL

SEQ ID NO: 3247 - DNA, 309 bp, Unknown
  Obtained from environmental sample
  misc_feature (1)..(309): n is a, c, g, or t
ttgatttataaaccacgagccgctctcaacggaccagccatcaaaatctccatcgttaaaatcatctacaaacataatttcatcatccggggtagattgggcatgcaaagtggagggaaaaagagcagcaaacaaacaaataataattaccagagtcaggcgaaacaaggtaaatatggctatacaattaaagtattacccgaatttaacccaatgtcaaatagtttatttttgaaaactatcagaaagctcactagaatgcaaagtaaagctgactggcggattgtaataattggcgattgggtttag

SEQ ID NO: 3248 - protein, 102 aa, Unknown
  Obtained from environmental sample
  misc_feature (1)..(102): Xaa is any amino acid
MIYKPRAALNGPAIKISIVKIIYKHNFIIRGRLGMQSGGKKSSKQTNNNYQSQAKQGKYGYTIKVLPEFNPMSNSLFLKTIRKLTRMQSKADWRIVIIGDWV

SEQ ID NO: 3249 - DNA, 714 bp, Unknown
  Obtained from environmental sample
  misc_feature (1)..(714): n is a, c, g, or t
gtgttaaaccaggtaagaaataatgagcttgatgaagaaggaagaaatattttagagaaaaggtatttacctgattttaaaagaatgaaagacgatggttatgtaattctaacaacacataacgaaagagcaagaggaaaaaatgaatcagaattaaacaaattaaattccaaaacatttatttacaaagcagagatcgaaggagatttttcagagagtgcttatcctgtagaagaacaactgcaattaaaagttgggtcacaggtcatgtttgttaaaaatgatacagacaggataaaaagatatttcaatggaaaaatcggaaccgtgaccgagcttaatgaagaaaaaattcttgttcagtgtaaggatgaaccagatgagatagaagtaaaaaaagaaaaatgggaaaacatccgttattctgtagataaagcaagtcgccagttaaaagaagaagtattgggttcgtttactcaataccctcttcggcttgcatgggcaataactattcataaaagccagggattaacatttgaaaaagtaattattgatgccggcgaagcatttgcaccgggacaggtttatgttgcattaagtcgctgtaccacattagacgggatcgtgcttcaaagtcagatcaggcaaacaagaatgttcagtgatgaaagaatagttagattttctcagtccagttcttcaaaaatacaatag

SEQ ID NO: 3250 - protein, 237 aa, Unknown
  Obtained from environmental sample
  misc_feature (1)..(237): Xaa is any amino acid
MLNQVRNNELDEEGRNILEKRYLPDFKRMKDDGYVILTTHNERARGKNESELNKLNSKTFIYKAEIEGDFSESAYPVEEQLQLKVGSQVMFVKNDTDRIKRYFNGKIGTVTELNEEKILVQCKDEPDEIEVKKEKWENIRYSVDKASRQLKEEVLGSFTQYPLRLAWAITIHKSQGLTFEKVIIDAGEAFAPGQVYVALSRCTTLDGIVLQSQIRQTRMFSDERIVRFSQSSSSKIQ

SEQ ID NO: 3251 - DNA, 618 bp, Unknown
  Obtained from environmental sample
  misc_feature (1)..(618): n is a, c, g, or t
ttgaattcttggtggattgtaagttctagtatggaagatacaaaaaataaaagattaattgcatatcatgaagttggtcatgctattgtagcatcattactagaaaagcatgatgaagttgaaaaagttagtataatcccaagaggatctgctaaaggggttacttggtttacatctgaagacgaccaaattcttgttactcgttcacagttattacaacgaattatgacaatcttaggtggtcgtatggcagaaatcattgtttttggtcaacctgaactttcaacaggtgctactgatgatttacaacaatgtacaaaaattgcacgacaaatggtaactcgttatggaatgtcaggtattggtccacgtgctcttgaaaataatactaatgaaagactattttcaaatggtaaaaagaatcctcttgcagatagaattgataaagaagtccacaaaattgtaaaatcttgtgaatatttaacaatgaaaattgtattagataacagagttattatagatcttcttgttgacaaattattagaagatgaaaatatgaatggtgacgacttccgaaaaatggtaattaaatatacacttcctccaagcaaaaaataa

SEQ ID NO: 3252 - protein, 205 aa, Unknown
  Obtained from environmental sample
  DOMAIN (7)...(194): Peptidase family M41
  misc_feature (1)..(205): Xaa is any amino acid
MNSWWIVSSSMEDTKNKRLIAYHEVGHAIVASLLEKHDEVEKVSIIPRGSAKGVTWFTSEDDQILVTRSQLLQRIMTILGGRMAEIIVFGQPELSTGATDDLQQCTKIARQMVTRYGMSGIGPRALENNTNERLFSNGKKNPLADRIDKEVHKIVKSCEYLTMKIVLDNRVIIDLLVDKLLEDENMNGDDFRKMVIKYTLPPSKK

SEQ ID NO: 3253 - DNA, 570 bp, Unknown
  Obtained from environmental sample
  misc_feature (1)..(570): n is a, c, g, or t
ttgccgcctgcaagaaataaatcatcaattatgcctgatcaaaaggaatttctgggagtaggatcccgcgtgaaacacccggcttatggggatggtgtcatcatccgccttcatactgccgcttatgaggtcgcatttatgatctatgggatcaaaaatgttggcaaggattacaaccaatgggaagtgatcgagcgcatcgaaacgacagaaccggtcagcttttcagaagctgaaaagtcattaatgaagatccttcgccaatggagcgacatctctgaagttgtccctattgccgataaatggaaaaatggcaacctggtgcttcaaccatatgacaactcactgaagccaaaagatattcctatcgatacgttttttcataaaatcgtcatgctgcgtgataggttacgcgttttggaacaaaagatcaatgcgcatacaaagctgagtgaggaagagaaaatcgatatgcagcaatatatcacacggatctatggaagccttaccactttcaatgttctctttcgtgaaaaggatcatcaatttgtaggcgaaaaatcttcatga

SEQ ID NO: 3254 - protein, 189 aa, Unknown
  Obtained from environmental sample
  misc_feature (1)..(189): Xaa is any amino acid
MPPARNKSSIMPDQKEFLGVGSRVKHPAYGDGVIIRLHTAAYEVAFMIYGIKNVGKDYNQWEVIERIETTEPVSFSEAEKSLMKILRQWSDISEVVPIADKWKNGNLVLQPYDNSLKPKDIPIDTFFHKIVMLRDRLRVLEQKINAHTKLSEEEKIDMQQYITRIYGSLTTFNVLFREKDHQFVGEKSS

SEQ ID NO: 3255 - DNA, 852 bp, Unknown
  Obtained from environmental sample
  misc_feature (1)..(852): n is a, c, g, or t
ttggattgcattatgatttcagggcgttttattaaacacgcggtggaccccaaaaagagcctcgaaaaaacagagataaagtcagggcaggagatcctggacgatgcacaagttcaacgggcaagagaccgcaaggaaaaggtattcgtttccacgcgtgttgccacatgggaacgttattgcaaggatataaaacaaacaatcgccaaaaagatgatctatattgagtatagcgaccccaagccctcgaacgttgataaattggaatatgaattgaatcatgtgttcaaggaaatcgtccttcctcgaattgaagacgaactcaataagttaaaaaagctggtcgcagcccaggataagcttgaaaaacggaaagaagagtttgctgagcgggtggagaaactggtcgaggagagagaacgcattctcaaagagcttgtgaaaccacagaaggatcgactgaccctcgaagctgacaagtccaggctcgaacatgaaatctcacgcctgaagaatccaccaacgatcgatggcatgctggaatatttttccaggcccaacatttacaagaatatcgagagctatttaacagccggaaaatctgccacccatcagccgatcgtcgatgcggttctcgccgctattcgaaacgcgatcaatgatgatgacaataagttctatcttgattttctgagccttgtaagacagtggcttgctaaaagcacatctcctggacaggctgatcctggttggatagtgcaatggatcaataatcaatccactcgctttcaggacgctcaaaagaaactggaccgaaatattgacgcactggagtccggactgtatccatga

SEQ ID NO: 3256 - protein, 283 aa, Unknown
  Obtained from environmental sample
  misc_feature (1)..(283): Xaa is any amino acid
MDCIMISGRFIKHAVDPKKSLEKTEIKSGQEILDDAQVQRARDRKEKVFVSTRVATWERYCKDIKQTIAKKMIYIEYSDPKPSNVDKLEYELNHVFKEIVLPRIEDELNKLKKLVAAQDKLEKRKEEFAERVEKLVEERERILKELVKPQKDRLTLEADKSRLEHEISRLKNPPTIDGMLEYFSRPNIYKNIESYLTAGKSATHQPIVDAVLAAIRNAINDDDNKFYLDFLSLVRQWLAKSTSPGQADPGWIVQWINNQSTRFQDAQKKLDRNIDALESGLYP

SEQ ID NO: 3257 - DNA, 408 bp, Unknown
  Obtained from environmental sample
  misc_feature (1)..(408): n is a, c, g, or t
ttggaatcgaatagaatagaattattaagccattcatctacaagaggagcggaaatgactggtgagaagatttatttccaatggcagaatccaatcttacggaagaccatttaccctgtgcgcgagatgaaattgcgtcactttcttttgtatttcatggaggtggatctttgggaaaagtaccggaagtgggacggtcttccggtcgagaatcttccaaaagaaaagaaggaatatgaagatgcgcaaaaactggcgattcgagatgcatttatcaatgaaagatcgctaaaagcgtattttacaaatgatgcaccagaggtcgaggatgaatctgctcacagtgaagtcgtcaagttaaatgacctgctgattggattgcataatgatttcagggcgtttatttaa

SEQ ID NO: 3258 - protein, 135 aa, Unknown
  Obtained from environmental sample
  misc_feature (1)..(135): Xaa is any amino acid
MESNRIELLSHSSTRGAEMTGEKIYFQWQNPILRKTIYPVREMKLRHFLLYFMEVDLWEKYRKWDGLPVENLPKEKKEYEDAQKLAIRDAFINERSLKAYFTNDAPEVEDESAHSEVVKLNDLLIGLHNDFRAFI

SEQ ID NO: 3259 - DNA, 882 bp, Unknown
  Obtained from environmental sample
  misc_feature (1)..(882): n is a, c, g, or t
atgtggctgaagttggctaacaccagatatggaatcgcacttaagaaatacctattggacgaatttgaaattaaccagatcatcggtttagataggagtgtatttgaaaatgcccaagtcaaagctgttttacttctggcagcgaagaaaaaagacaaagtcaaaaaacaatactcgataaaatttgcaagagttagaaatggtttaccaataaaccatctctcgtcatttgtgctccatggtaaagtagtattgcctgatgatattgtagtaaagagaataaagagcaacgagctaaaaattaaatccccctggggagcaatattaaaatcatccactgtttatgatgacattaagcaaaacaaggttattaagccaatctgcgagacagcggattgccaaattggtctggagaccttggcgaaaggtttttttgttttaacttctcgcgccaaagaaaatggcatcgttgaagatgaatatttaaaaccctttgcttattctgtttacgacttcgatactcctgttattgatgaagctgatgttcctcggcaatatcttttctactgcgctgaatcaaaaaacaatctgctcggtactaaagctcttgaacatattttgcgaggagaagcagatgaggtgcaagtaagagggacagataaaactgttgttggctaccacaacaaagagcgaattcagaaagcaaagcgcccaaactggtacgatgtaaaaactgaatgtgacaagaaaccaatagctgcaatactattacctcgttttatttataaggactatcaagtactttggaatagcgctggttatattcctgggagggccgttgtccaattttttccaaaagtgatttatcaaccaggcgactga

SEQ ID NO: 3260 - protein, 293 aa, Unknown
  Obtained from environmental sample
  misc_feature (1)..(293): Xaa is any amino acid
MWLKLANTRYGIALKKYLLDEFEINQIIGLDRSVFENAQVKAVLLLAAKKKDKVKKQYSIKFARVRNGLPINHLSSFVLHGKVVLPDDIVVKRIKSNELKIKSPWGAILKSSTVYDDIKQNKVIKPICETADCQIGLETLAKGFFVLTSRAKENGIVEDEYLKPFAYSVYDFDTPVIDEADVPRQYLFYCAESKNNLLGTKALEHILRGEADEVQVRGTDKTVVGYHNKERIQKAKRPNWYDVKTECDKKPIAAILLPRFIYKDYQVLWNSAGYIPGRAVVQFFPKVIYQPGD

SEQ ID NO: 3261 - DNA, 369 bp, Unknown
  Obtained from environmental sample
  misc_feature (1)..(369): n is a, c, g, or t
ttgattatcaaagaagattttagtaaaacaggtgagctgtatgatatagtttttgataccgtaggctacagtccttttaagggttcaataaggtcactgaaagtaaatggcaattacctgaggctggtacatatgtcgcctggcgcaatactgcgtggtttatggatctccatgaccggcaataaaaaagtaattggcggagtagcaagtggtagtgcggaggacctgctttttcttaataaacttattgaggccaggcaaataaaacccgtgatagatagaaccttcccactggaacaaattgttgaagcgcatagctatgttgaagcagggcataaaaagggaaatgttgcaatcactattagctga

SEQ ID NO: 3262 - protein, 122 aa, Unknown
  Obtained from environmental sample
  misc_feature (1)..(122): Xaa is any amino acid
MIIKEDFSKTGELYDIVFDTVGYSPFKGSIRSLKVNGNYLRLVHMSPGAILRGLWISMTGNKKVIGGVASGSAEDLLFLNKLIEARQIKPVIDRTFPLEQIVEAHSYVEAGHKKGNVAITIS

SEQ ID NO: 3263 - DNA, 354 bp, Unknown
  Obtained from environmental sample
  misc_feature (1)..(354): n is a, c, g, or t
atgaaattgctcaccaggttggttatgcaaaagaaaatgaagccaattttatttcatacctctctggcaaagagcatccttccattggcggccggtatagtatttattttgaaatgtaccggtattcagtattcgaaatctataaaagagatacatccctggcggcagtttaccggcaaaaactacatccgcaggttacgcaagacctgttggaacttagaagattcagcgagaaatatgaaagtgtggcagaagaatattttatggggattttcacctgtttctaaaagccgaataaccaacctgccggtaacgcaagctacaacccaggttgtgccctggcttgaagcttaa

SEQ ID NO: 3264 - protein, 117 aa, Unknown
  Obtained from environmental sample
  misc_feature (1)..(117): Xaa is any amino acid
MKLLTRLVMQKKMKPILFHTSLAKSILPLAAGIVFILKCTGIQYSKSIKEIHPWRQFTGKNYIRRLRKTCWNLEDSARNMKVWQKNILWGFSPVSKSRITNLPVTQATTQVVPWLEA

SEQ ID NO: 3265 - DNA, 753 bp, Unknown
  Obtained from environmental sample
  misc_feature (1)..(753): n is a, c, g, or t
gtgttgtcaggatctggtgctgacaggaagattggcagggagaaggcagtgagtccttcatcactgtctacggcaatgcgcagaatattaaagtggtatgcggataacggctatccgttttcaagagtatcgcttaaggatgtttctattaaaggggaaagaatttctgcagcactgaaagttgatcagggagaagctgtttattttgattcactgatcattaagggaaattcgcgcattacttattcttacttgctgaattatctgggactgaagaaaaatgatgtttaccgcgaaggtaaatttgaaaaggttgggtcgagattacgtgaaataccatttgttacggaaaagcaaaagcatgaactggagtttacggcgggaaaagtaaggctgattatatatattgatgacaagaaggccagtcagttcagcggtgttgcgggaattcttcctgataatgcaaaccccgganaggttaatgtaacaggtgacatcaaattaaggctgttgaattcctttaatcatgctgagctgtttgatctcaactggagtaatccgcttcctaaatcgcaggatctgaaaatcaagctgaattatcctttccttttcgatctgccattcgggctcgatctcaaccttaacttttcaaaaaagatccacttttctggagttcaaccgcgagcttggatccagcattacctccagggcaataattatatcaaagtattcggagcacttttttaccagtga

SEQ ID NO: 3266 - protein, 250 aa, Unknown
  Obtained from environmental sample
  misc_feature (1)..(250): Xaa is any amino acid
MLSGSGADRKIGREKAVSPSSLSTAMRRILKWYADNGYPFSRVSLKDVSIKGERISAALKVDQGEAVYFDSLIIKGNSRITYSYLLNYLGLKKNDVYREGKFEKVGSRLREIPFVTEKQKHELEFTAGKVRLIIYIDDKKASQFSGVAGILPDNANPGXVNVTGDIKLRLLNSFNHAELFDLNWSNPLPKSQDLKIKLNYPFLFDLPFGLDLNLNFSKKIHFSGVQPRAWIQHYLQGNNYIKVFGALFYQ

SEQ ID NO: 3267 - DNA, 807 bp, Unknown
  Obtained from environmental sample
  misc_feature (1)..(807): n is a, c, g, or t
atgaaaaaaaaacaacagctcagcgatgaggagttgcagttcgagaatgaattcctcagagtgaaaatcaaactggaaaccggggcatctttttatgagcccgactatgatgagatagcccatttttgcccggagtatgaaaaccaggcattgaatgacattttaaaattcgaacaggcgtacaaacattcggagcatattactatttacgaatttattggtagtcctgtttttaaaaaagttgaagatatcagtgagagcgacattttatcagaacttaggtgtgtcgaggatcttttagctgttcataatatcgaatgtgattacaattcacccatcagttaccgggaattttataagttcattacagaagaactttttgtgaaagtcattcccaacataaaaataacgggcctggtcaaactattccattatgaagaatttcatcccaaccatgaacttaaatctgaacaaaattgcaccacttttctgaatgattattttgacaatgataccactcaattcacgcaactgtataaatccgggaaaatcatgaattatactgagcttttattattccgggaatccttccatgaaatccgaaatctgaaattcgaatttatatcgttcgaacataatggtaacaaatgtacgcgcaaaatccacctcagcttcgacggtgtggtcagccagggcttacctccngtccattatgatagtgaaggaatcataatgctggaatatcaatggaactggtggacagtagtttttatgcagattccggggatggtatcccgctcgaaatga

SEQ ID NO: 3268 - protein, 268 aa, Unknown
  Obtained from environmental sample
  misc_feature (1)..(268): Xaa is any amino acid
MKKKQQLSDEELQFENEFLRVKIKLETGASFYEPDYDEIAHFCPEYENQALNDILKFEQAYKHSEHITIYEFIGSPVFKKVEDISESDILSELRCVEDLLAVHNIECDYNSPISYREFYKFITEELFVKVIPNIKITGLVKLFHYEEFHPNHELKSEQNCTTFLNDYFDNDTTQFTQLYKSGKIMNYTELLLFRESFHEIRNLKFEFISFEHNGNKCTRKIHLSFDGVVSQGLPPVHYDSEGIIMLEYQWNWWTVVFMQIPGMVSRSK

SEQ ID NO: 3269 - DNA, 567 bp, Unknown
  Obtained from environmental sample
  misc_feature (1)..(567): n is a, c, g, or t
atgccttttgtaacggaagaaatttaccaccagttaaaagacagaagcgaaggcgatgatatttgtatcaaacaatttaaaccaatcaccgatagtaacgggctaattttaaaacatgcttttttgttaaaagagatgataaccgctatcagggaagtgcgggttaaaaataatattaaacagagggaaagcattgtactcaatattgaaacagatgatgaacctgctttttcatcatttgagggaattttaaaaaaacaaacgaatgccacagcaatcaaccttgtatcaaatcccgttagtgatagtttaaatattgttgtcggcaaatcaagagtatatattcaatcagaaaagcctgtagatacgtcggggcaaaaggaagaattaaaaaaagaactggattatctgcttggctttttaaattcagtggaaaaaaaattgagtaacgaacgttttgtgcataatgcaaagccagaagttgtagatattgaacgaagaaaaaaagcagatgcggaacaaaagatcaaagcaatagaggagagtttggccacactctcgcaatag

SEQ ID NO: 3270 - protein, 188 aa, Unknown
  Obtained from environmental sample
  misc_feature (1)..(188): Xaa is any amino acid
MPFVTEEIYHQLKDRSEGDDICIKQFKPITDSNGLILKHAFLLKEMITAIREVRVKNNIKQRESIVLNIETDDEPAFSSFEGILKKQTNATAINLVSNPVSDSLNIVVGKSRVYIQSEKPVDTSGQKEELKKELDYLLGFLNSVEKKLSNERFVHNAKPEVVDIERRKKADAEQKIKAIEESLATLSQ

SEQ ID NO: 3271 - DNA, 675 bp, Unknown
  Obtained from environmental sample
  misc_feature (1)..(675): n is a, c, g, or t
ttgaacttaattattcagcaaaacccaaatacagcactcgcggaaaaagcaggcactatgatacaggtgcttgcaaaacgcaaccagatagaagaagaattacgcaagcttcaaattgtacgtccgcaggaagacactatagttgttcaggattacaccccggcacctactgccctcagaagagatagtactaccattcaaaaaaataacattgtaataaatgcaccgggaataaaacagcgcacagatacaggtatgggtaaaactgttatccctgcaccagctgtgtctttttatacttatgatgcaaatgccactcattatgtgttggtcattctaaataaagtggataatgtttttggcaatgaagctaaaaatgctttcacccgctataataaagaacgctattataacctgccgcttactaacgaaatacttcctcttgacacagaaaataaattattgcttattggcaacttcagtaatatactacaggcaacagagtatgttcaaaaagtaattcccctggcgccgaaagaaattgttccctggttaaaagcagataaatattctttcaccattatttctggccaaaacctggaagttttaaaaaagaaattggatctcagcaattacaaaacatttttggaactaaactccgggcttaaattttaa

SEQ ID NO: 3272 - protein, 224 aa, Unknown
  Obtained from environmental sample
  misc_feature (1)..(224): Xaa is any amino acid
MNLIIQQNPNTALAEKAGTMIQVLAKRNQIEEELRKLQIVRPQEDTIVVQDYTPAPTALRRDSTTIQKNNIVINAPGIKQRTDTGMGKTVIPAPAVSFYTYDANATHYVLVILNKVDNVFGNEAKNAFTRYNKERYYNLPLTNEILPLDTENKLLLIGNFSNILQATEYVQKVIPLAPKEIVPWLKADKYSFTIISGQNLEVLKKKLDLSNYKTFLELNSGLKF

SEQ ID NO: 3273 - DNA, 420 bp, Unknown
  Obtained from environmental sample
  misc_feature (1)..(420): n is a, c, g, or t
atgggtaaaactgttatccctgcaccagctgtgtctttttatacttatgatgcaaatgccactcattatgtgttggtcattctaaataaagtggataatgtttttggcaatgaagctaaaaatgctttcacccgctataataaagaacgctattataacctgccgcttactaacgaaatacttcctcttgacacagaaaataaattattgcttattggcaacttcagtaatatactacaggcaacagagtatgttcaaaaagtaattcccctggcgccgaaagaaattgttccctggttaaaagcagataaatattctttcaccattatttctggccaaaacctggaagttttaaaaaagaaattggatctcagcaattacaaaacatttttggaactaaactccgggcttaaattttaa

SEQ ID NO: 3274 - protein, 139 aa, Unknown
  Obtained from environmental sample
  misc_feature (1)..(139): Xaa is any amino acid
MGKTVIPAPAVSFYTYDANATHYVLVILNKVDNVFGNEAKNAFTRYNKERYYNLPLTNEILPLDTENKLLLIGNFSNILQATEYVQKVIPLAPKEIVPWLKADKYSFTIISGQNLEVLKKKLDLSNYKTFLELNSGLKF

SEQ ID NO: 3275 - DNA, 303 bp, Unknown
  Obtained from environmental sample
  misc_feature (1)..(303): n is a, c, g, or t
ttgttgttcaagagcagggtcgtaatgcacaagttttgtctgcaactctgtcgccaatacgttggttgtgtttgccatagcaacaatgactctacaatccaagaaacacaaaagatgtctctacaaaaacattgcaatggagttgccacttgtcccgtcttgttgtcaaccactgncagtttcagaattcgtttggcaatactgcgtccgttgataatgtctttgcagaaatacaatacaaagccgaataaaccgatatacttcattggtccttccatgaaattaaagtcggtctgttcgtga

SEQ ID NO: 3276 - protein, 100 aa, Unknown
  Obtained from environmental sample
  misc_feature (1)..(100): Xaa is any amino acid
MLFKSRVVMHKFCLQLCRQYVGCVCHSNNDSTIQETQKMSLQKHCNGVATCPVLLSTTXSFRIRLAILRPLIMSLQKYNTKPNKPIYFIGPSMKLKSVCS

SEQ ID NO: 3277 - DNA, 447 bp, Unknown
  Obtained from environmental sample
  misc_feature (1)..(447): n is a, c, g, or t
atgagaaacagtttgacacttttaatatttgcgttactactgacaaactgcaataattcgcagactaaaactgttaataaaaacgacagacttgaacttgtgcctgaaccagacaaacacgaaagactattaggtgaagcaattcaaaaactcaaaacaattaattgtgacttttccgagccggacacttcattaaacggaatagctttgagaaattccaaaagtgccgacagtattattggtatagacaataaagttgacgaaaaagaacaatatcatttctattcacttatggacgcagaaacactaacattgacacaacatccaggtgacgggaaaaatcaaatttccatttttagtgtttcatattctgacaaagctgaccacggctataaacaactaaaagtagagacttttcaaacagaaaaaggaattaactcgggctaa

SEQ ID NO: 3278 - protein, 148 aa, Unknown
  Obtained from environmental sample
  SIGNAL (1)...(20)
  misc_feature (1)..(148): Xaa is any amino acid
MRNSLTLLIFALLLTNCNNSQTKTVNKNDRLELVPEPDKHERLLGEAIQKLKTINCDFSEPDTSLNGIALRNSKSADSIIGIDNKVDEKEQYHFYSLMDAETLTLTQHPGDGKNQISIFSVSYSDKADHGYKQLKVETFQTEKGINSG

SEQ ID NO: 3279 - DNA, 882 bp, Unknown
  Obtained from environmental sample
  misc_feature (1)..(882): n is a, c, g, or t
ttgcttacnatggagttgcaaacaacactagaaaaatttggtgctaaatctggctcggtcatagtgcttgatacaaaaagaggagaaatactcgcaatagcgaatgctccatcatttaatccaaataaaaggggccattattccctagatcgttatcgcaataaagcgattacagatgctttcgagcctggttctgttatgaaaccatttagtattgctagtgcactcgacagtggtctttttacacccaaaagtataattgacacgcgtccaagctggatgacagtgcatggtcatgtcattagagatattaaaaattatggtatcttagatgttacaggggtgttgcagcattcaagtaacgttggtgttactaaaatgattttatctaaccctccagaacaactgatacagttacttcgacgcgcaggattagggcaacgtaccgaaagtttatacccaggtgagaatgaaggtacattaataaaagcttccaaggttaatccatttatgttagcaactttaggctttgggtatggggtttccgccacgcctttacaattagcgaaaagttatttaattttcgcacgagaaggtaaacttatcccgataaagcttctccatgataataataaaattagcgaagaagttgctattatttcacctaaaattgcaaaagatgtactaactatgatggaggcagttgtatctagtgaggggacaggcaaattagccagggtcccgggttatcgagttgctggcaaaaccggcacagcaagaattgctggaaaacaagggtatgaagaaaacggcatattgcagttttgtgggtatagcaccagtttcaaatccaaaaataatagntgcagtcataattcatga

SEQ ID NO: 3280 - protein, 293 aa, Unknown
  Obtained from environmental sample
  DOMAIN (18)...(291): Penicillin binding protein transpeptidase domain
  misc_feature (1)..(293): Xaa is any amino acid
MLTMELQTTLEKFGAKSGSVIVLDTKRGEILAIANAPSFNPNKRGHYSLDRYRNKAITDAFEPGSVMKPFSIASALDSGLFTPKSIIDTRPSWMTVHGHVIRDIKNYGILDVTGVLQHSSNVGVTKMILSNPPEQLIQLLRRAGLGQRTESLYPGENEGTLIKASKVNPFMLATLGFGYGVSATPLQLAKSYLIFAREGKLIPIKLLHDNNKISEEVAIISPKIAKDVLTMMEAVVSSEGTGKLARVPGYRVAGKTGTARIAGKQGYEENGILQFCGYSTSFKSKNNXCSHNS

SEQ ID NO: 3281 - DNA, 918 bp, Unknown
  Obtained from environmental sample
  misc_feature (1)..(918): n is a, c, g, or t
ttgacatcaatccctcggggtatcgcaaatttgaggtacctgaaaattcttgatcttttccacaatcaacttactaccatcccttatgaactcttcgatctcaaagacttgaaggaactttacttgagggataatcctctctctttaccaccagaaatagtggacaaatcaaatcaaccttcaataatattcgaatatttcaagacgatccaaactggattcctgcaaccactccatgaggccaaaattgttctggtcggacagggaagtgtaggaaaaacatcgctggtgaagagactcattcacaaccagtttgacctatacgaaagtaagactgaggggatcgctatagaacgatatagcacacaagttgcagctggggaaataaaacttcacgtttgggattttggtgggcaagaaataatgcatgcaacccatcagtttttcctcacaaaacgaactctttacctgttggttctcgacgcaaggttaggtcaggaagaaaatcgagttgaatactggttaaagctaattaaatcatttggcgccaactctcccatcataattgtgggcaacaagagtgatcaacaacatctcgacattgacaaacgcggtctgcaaaaaaaatatcccacgataagaagatttatagatacatcgtgcttgagaggcgatggtattgatgatcttaaggacgtcatcgccaacgaaatagaaaatctacctcacattcacgatatgcttccaaaacgctggttcgacatcaaggaaaaactcggtctgatgaaaaaagattacatcagctacaatgaatacgtcactttgtgcaaccgacgtggtattgatgacagtaatgcgcaaagaacgctcattggttttcttcatgatctaggtgttattctggaattccaaagatga

SEQ ID NO: 3282 - protein, 305 aa, Unknown
  Obtained from environmental sample
  DOMAIN (69)...(238): ADP-ribosylation factor family
  misc_feature (1)..(305): Xaa is any amino acid
MTSIPRGIANLRYLKILDLFHNQLTTIPYELFDLKDLKELYLRDNPLSLPPEIVDKSNQPSIIFEYFKTIQTGFLQPLHEAKIVLVGQGSVGKTSLVKRLIHNQFDLYESKTEGIAIERYSTQVAAGEIKLHVWDFGGQEIMHATHQFFLTKRTLYLLVLDARLGQEENRVEYWLKLIKSFGANSPIIIVGNKSDQQHLDIDKRGLQKKYPTIRRFIDTSCLRGDGIDDLKDVIANEIENLPHIHDMLPKRWFDIKEKLGLMKKDYISYNEYVTLCNRRGIDDSNAQRTLIGFLHDLGVILEFQR

SEQ ID NO: 3283 - DNA, 780 bp, Unknown
  Obtained from environmental sample
  misc_feature (1)..(780): n is a, c, g, or t
atgaacattaaaataaaccgatttttgttcagtcaaaccactatcgacagtgggtccctcacaccacattctacccttgtttgtaaatttgcagatcctggagaatatcagggtataataatgaaaggttcaggaatagttagcagatttaaattaaatgttcttgatgaaagaccatctagtgggttatcgtctttatctacgataaattctaaggagacctctcaactcactgatgtaaataagcaagtaagtgatacttctaatcagataaacatcgatttaagcaatattacgagcatttatacactaaaaaaaggggactatgcggttttttatgtctctacaggcgccggtggttattctatagagatttatcgcttcgaaaaggggtcacaaataaaaacatttgatagcaaagaactaaaggatggagtgatcttctcagcgatggtaattagacccggtacttatttgataacaaataccataaatgatgctaaggcagaattagttataaactatccagaacttgggaagatgaagaaaatccttatacccattaatatagaaagcaataccaaagaaattgtcccaaacaaaataaacatcgatccatcacaaggattgatttttagaattaatactctatcaagaataagaattgaattgacaaaacctgaagaccgacccctaaaattacatagagaacagtttattataagaaccanaggagatgaaaaattcctcaaacgatttaggatgatgccccgtaaataa

SEQ ID NO: 3284 - protein, 259 aa, Unknown
  Obtained from environmental sample
  misc_feature (1)..(259): Xaa is any amino acid
MNIKINRFLFSQTTIDSGSLTPHSTLVCKFADPGEYQGIIMKGSGIVSRFKLNVLDERPSSGLSSLSTINSKETSQLTDVNKQVSDTSNQINIDLSNITSIYTLKKGDYAVFYVSTGAGGYSIEIYRFEKGSQIKTFDSKELKDGVIFSAMVIRPGTYLITNTINDAKAELVINYPELGKMKKILIPINIESNTKEIVPNKINIDPSQGLIFRINTLSRIRIELTKPEDRPLKLHREQFIIRTXGDEKFLKRFRMMPRK

SEQ ID NO: 3285 - DNA, 510 bp, Unknown
  Obtained from environmental sample
  misc_feature (1)..(510): n is a, c, g, or t
gtggaagaactggaaaacaagatggcaacaacactaacatcccttgggatcgatctggagaaacaattaaaattaaccgacctcgcgagtaattttaagaagtattttttacagcagaaagatgttcttaaaagtaaatcttatgaactcctggtttacgatgggttgacagcaggcagagtgatcgttgctttggaaaatattaatatttcaaataccaatcttgaaagaacagaatattccagaatcgaagaactcaaacttcacttgctgggaaaagcagttgaaaaagcaaaacaacaagccgtagccatgctacaaccattaatgcaaaatccaggtaaagcgatttatgtgagtgaaaccattccttatactaaaaatagtcttgcgggtgtgtcaacaggaatttatgtgatacaggacaaagcaaggtacgagccaatagagatcgaatttgaaaaaatacccattgaggcaatggttgaagtggtattcaaacttgactaa

SEQ ID NO: 3286 - protein, 169 aa, Unknown
  Obtained from environmental sample
  misc_feature (1)..(169): Xaa is any amino acid
MEELENKMATTLTSLGIDLEKQLKLTDLASNFKKYFLQQKDVLKSKSYELLVYDGLTAGRVIVALENINISNTNLERTEYSRIEELKLHLLGKAVEKAKQQAVAMLQPLMQNPGKAIYVSETIPYTKNSLAGVSTGIYVIQDKARYEPIEIEFEKIPIEAMVEVVFKLD

SEQ ID NO: 3287 - DNA, 384 bp, Unknown
  Obtained from environmental sample
  misc_feature (1)..(384): n is a, c, g, or t
atgttaatttttttttgtagttttgttctgcaaatgaaaagcaaacccttcattaaacattacatcaggcgaaaactagtgactgcagtatttattactgcttcgttagtaacgtttgctgctttgggtgatgggaaaaaagataatactaaaaaaactcagaaaaatcttctttctgctaaaacaaacccttacaatttcaagaacttctctttaagatcccgttataattaccgaggtagtaccattctcaaccagtccgaacaaaacaaatacattacgttaaacaccgtggctacctatcaaaaaggcaacattacttacatattgcccttaaagaaaaaagttttattagataaaattaagttcaaccctgttcattaa

SEQ ID NO: 3288 - protein, 127 aa, Unknown
  Obtained from environmental sample
  misc_feature (1)..(127): Xaa is any amino acid
MLIFFCSFVLQMKSKPFIKHYIRRKLVTAVFITASLVTFAALGDGKKDNTKKTQKNLLSAKTNPYNFKNFSLRSRYNYRGSTILNQSEQNKYITLNTVATYQKGNITYILPLKKKVLLDKIKFNPVH

SEQ ID NO: 3289 - DNA, 354 bp, Unknown
  Obtained from environmental sample
  misc_feature (1)..(354): n is a, c, g, or t
atgttaatttttttttgtagttttgttctgcaaatgaaaagcaaacccttcattaaacattacatcaggcgaaaactagtgactgcagtatttattactgcttcgttagtaacgtttgctgctttgggtgatgggaaaaaagataatactaaaaaaactcagaaaaatcttctttctgctaaaacaaacccttacaatttcaagaacttctctttaagatcccgttataattaccgaggtagtaccattctcaaccagtccgaacaaaacaaatacattacgttaaacaccgtggctacctatcanaaaggcaacattacttacatattgcccttaaagaaaaagttttattag

SEQ ID NO: 3290 - protein, 117 aa, Unknown
  Obtained from environmental sample
  misc_feature (1)..(117): Xaa is any amino acid
MLIFFCSFVLQMKSKPFIKHYIRRKLVTAVFITASLVTFAALGDGKKDNTKKTQKNLLSAKTNPYNFKNFSLRSRYNYRGSTILNQSEQNKYITLNTVATYXKGNITYILPLKKKFY

SEQ ID NO: 3291 - DNA, 615 bp, Unknown
  Obtained from environmental sample
  misc_feature (1)..(615): n is a, c, g, or t
atgggtatggtggatggaataactaccaatcctactcttctttcaaaagaaggtggagatccggaagagattattagagaaattgtaaaaatggtccaaggcccggttagcctggaggttatttctacggaagttaaccaaataatggaagaagcttatattctcaagcaatatggctcaaatgttgtgattaaagttccaatgattccaaatggattaaaagcagttaaaaaattaagagaagaaggaatagacacaaatgttacgcttgttttttctgctactcaagctttattagctgcaaaggctggagcatcatatgtaagcccctttattggaaggcttgatgatataggtaatgatggaatgagtcttatcagcgacataaaccaaatttttcaaaattatcaatacaatactaaaattcttgtggcgagtgtacgtcatccaattcatgtgattgaatctgctaaagttggtgccgatgtagtaactttaccacccgatattcttggaaaaatgtttttacatcctcttacagataaaggcttaaaaacatttatttcagattgggaaaatctcaagaaaacaaatccctctattaagatattataa

SEQ ID NO: 3292 - protein, 204 aa, Unknown
  Obtained from environmental sample
  DOMAIN (1)...(198): Transaldolase
  misc_feature (1)..(204): Xaa is any amino acid
MGMVDGITTNPTLLSKEGGDPEEIIREIVKMVQGPVSLEVISTEVNQIMEEAYILKQYGSNVVIKVPMIPNGLKAVKKLREEGIDTNVTLVFSATQALLAAKAGASYVSPFIGRLDDIGNDGMSLISDINQIFQNYQYNTKILVASVRHPIHVIESAKVGADVVTLPPDILGKMFLHPLTDKGLKTFISDWENLKKTNPSIKIL

SEQ ID NO: 3293 - DNA, 765 bp, Unknown
  Obtained from environmental sample
  misc_feature (1)..(765): n is a, c, g, or t
atgtcgggaaattgttcttttttaaatttttttgatagggccgggagggttacgattgtaagggaaaattgttggttcccccaagagattctttttcattcccactataaactgtttcaaaaagaaatttgtgttgatagacacagcttgaatttcgcaaaaaagcaaagggtgcatgaggatctggaattctattctgtcattcgtgctatcaaagccatggatgaggcagacgtttgtctgttacttatcgatgcaacaaaaggaatttcggcacaggacgtcagtatattcagtcttgccacaagaaaaggcaagggtatcgttgttcttgtaaacaagtgggatctggcagaaaaagaaacaaatactgcccgtgactatgaaatgaagctcaaacaaaagctggcgccattcactgatgttcctgtattgtttatttcagcaaaagaaaaaacaagaatttttaaagcgatagaagtggcattggaagtagcggaaagcaagaaaagaaaaatacctacttcggagttaaatgaaacgatcttaaaagctattgaatcataccatccgccggtggtgagaggtaacccggtaaagatcaaatatgttacgcaactgccaaccgcggtcccttcttttgccttcttttgtaattttcctgatgatgtaaaacaaccgtataaaaactaccttgaaaaccaacttcgggaaaattttaatctcaaaggcgttccgatcaggttattcttcagaaaaaaatag

SEQ ID NO: 3294 - protein, 254 aa, Unknown
  Obtained from environmental sample
  DOMAIN (30)...(194): Elongation factor Tu GTP binding domain
  misc_feature (1)..(254): Xaa is any amino acid
MSGNCSFLNFFDRAGRVTIVRENCWFPQEILFHSHYKLFQKEICVDRHSLNFAKKQRVHEDLEFYSVIRAIKAMDEADVCLLLIDATKGISAQDVSIFSLATRKGKGIVVLVNKWDLAEKETNTARDYEMKLKQKLAPFTDVPVLFISAKEKTRIFKAIEVALEVAESKKRKIPTSELNETILKAIESYHPPVVRGNPVKIKYVTQLPTAVPSFAFFCNFPDDVKQPYKNYLENQLRENFNLKGVPIRLFFRKK

SEQ ID NO: 3295 - DNA, 480 bp, Unknown
  Obtained from environmental sample
  misc_feature (1)..(480): n is a, c, g, or t
atggaactccttgaaagattgccccaaaagcacggcaaattaaaacctcctgatctcgtgcaatcgtttaaaatcctatggcaaaaaactcatctccttcttgaaaaaataaaaagcatcggcttttcaaaaaccatggatgattatgaaaagcgcaagcttggcatttttaaccaacttaattttttgcaactgcttactggtattgttatccccatggttggcgcattgcgaaatggtaacctgccttttaccgtatggattacggcctgtattcctgcgataacaagcattctcatcctatatcttaacaacaaaaaaagttaccaggccgcacttttttcttactttcttctttatccttttttaacctgtgtggtgtacctgaagggcatcaatcccggaattgaattgtcttttatcttttatggaattttatcggtgttttttttaaaagacatttcggttacatgcttttag

SEQ ID NO: 3296 - protein, 159 aa, Unknown
  Obtained from environmental sample
  misc_feature (1)..(159): Xaa is any amino acid
MELLERLPQKHGKLKPPDLVQSFKILWQKTHLLLEKIKSIGFSKTMDDYEKRKLGIFNQLNFLQLLTGIVIPMVGALRNGNLPFTVWITACIPAITSILILYLNNKKSYQAALFSYFLLYPFLTCVVYLKGINPGIELSFIFYGILSVFFLKDISVTCF

SEQ ID NO: 3297 - DNA, 693 bp, Unknown
  Obtained from environmental sample
  misc_feature (1)..(693): n is a, c, g, or t
ttgtatgaaatttctgaattgatggcggaaacagaaaatacaataaaggaatggttaaatcgatttgacttaatgaatgaatatctcgtttatttaaatactcctaaactatacacacgactagataaacgtgaagggcatttcatagatctaagaagctatttaagtagctattattcgaaaataaatagttcgtcgaattactctcaggtaaatattgaggatttaaaattttcatattttgattacatacgacttggaattcctgtgcagagagctagagtaattgccaaaccttctaaaggcaatagtttttttacaaatcaagatatttggattgattttattacagagcataataaaataaaggctagtgtcattgaaaagagttttgaacagttaaaaattcaattccctgaatacagcaatgaagagattattaaaataattgatgctcattggcaaagcgaaataaaagactatttgctaaagaatttatcctttaatgaaataatattaaaggaaattaatgaatcctttatgccattaaaaaatctaaaacgagtaagaaatactttaaaaaatattaatatcaacaatacagatcatggcactatacaagaaatgcgaagcatagttaatgatatcgcanaaaggacaaatgaaattgaaatagctcttagcaaaatataa

SEQ ID NO: 3298 - protein, 230 aa, Unknown
  Obtained from environmental sample
  misc_feature (1)..(230): Xaa is any amino acid
MYEISELMAETENTIKEWLNRFDLMNEYLVYLNTPKLYTRLDKREGHFIDLRSYLSSYYSKINSSSNYSQVNIEDLKFSYFDYIRLGIPVQRARVIAKPSKGNSFFTNQDIWIDFITEHNKIKASVIEKSFEQLKIQFPEYSNEEIIKIIDAHWQSEIKDYLLKNLSFNEIILKEINESFMPLKNLKRVRNTLKNININNTDHGTIQEMRSIVNDIAXRTNEIEIALSKI

SEQ ID NO: 3299 - DNA, 318 bp, Unknown
  Obtained from environmental sample
  misc_feature (1)..(318): n is a, c, g, or t
atgagcaaaaactcacttggcgagctcaagctctctcccatcaaagaaaacggaaagtttgtgtttataaacactgaggttcgtgtgaatggcaaattaaataagggagatgccatcaaaatatttgttgatggctacgaacaaacaaacgggcagtacataattaaaaacctttctcatcccacatcaaagatcgtcgtgcgaggccagccaatggtacatgatctcccccctgatattgcaacgatcgacgatctttatgataaggttggtgagatgtacaagaatcaattctatttcgggaagactgagatttga

SEQ ID NO: 3300 - protein, 105 aa, Unknown
  Obtained from environmental sample
  misc_feature (1)..(105): Xaa is any amino acid
MSKNSLGELKLSPIKENGKFVFINTEVRVNGKLNKGDAIKIFVDGYEQTNGQYIIKNLSHPTSKIVVRGQPMVHDLPPDIATIDDLYDKVGEMYKNQFYFGKTEI

SEQ ID NO: 3301 - DNA, 645 bp, Unknown
  Obtained from environmental sample
  misc_feature (1)..(645): n is a, c, g, or t
ttgcagtcaatgttcaggatctgtgttatattattagtgattggtttctgggtttcaagtttgaaatccaccggacaaacaattcctttcttttcacaattaatagccaacacttcaagtgacactttaaatgaaaaagagaaaaagaagatcgaaaacgattcaacagacactttatcacaaaagtcattatactttgataatcatgtagataaaaataaacacagttcaattaagcagaatgaacaaaatctttctgaagtggttgttacaggaaccatgaaagaaataagccggctggaaagcccgattccaatcgaagtaattacgcctgcattatttaaaaagaatcctgttcccagcctttttgaagcagtagggatgataaatggagtaaagccacagataaattgcaatgtctgcaacaccggcgacattcatattaatggcatggaaggaccttatactatggtcctcatagatggtatgcccatagttagtaacctggctacagtttatggtctaagtggaatccctaatagcattgtggaaaggatcgaaagtatgaaaggaccaggatcatccttgtatggatcagaagcattgggaggaattcattattatcattacaaaaaacccatttaa

SEQ ID NO: 3302 - protein, 214 aa, Unknown
  Obtained from environmental sample
  misc_feature (1)..(214): Xaa is any amino acid
MQSMFRICVILLVIGFWVSSLKSTGQTIPFFSQLIANTSSDTLNEKEKKKIENDSTDTLSQKSLYFDNHVDKNKHSSIKQNEQNLSEVVVTGTMKEISRLESPIPIEVITPALFKKNPVPSLFEAVGMINGVKPQINCNVCNTGDIHINGMEGPYTMVLIDGMPIVSNLATVYGLSGIPNSIVERIESMKGPGSSLYGSEALGGIHYYHYKKPI

SEQ ID NO: 3303 - DNA, 384 bp, Unknown
  Obtained from environmental sample
  misc_feature (1)..(384): n is a, c, g, or t
ttgctgcaaagaataacggcggttcatgcggaaaggttccactggaaaaatgaggctggtatcattcctgtagaatatggcttcaaatattttttcattaataagtccctttgttgtctccagctcttcaccaaagtattttctcaactcgaccaaagctttctctctaagaaaatcaacgttaataccccaaatagcaatcattctttccggcagaaaatgtgcctgctcaaaagcaaaataagctgctataaaaggggatttagaaaagtcgagcagccttgtaggagcaccgtggtgctgcatgatggcaagccactcgatcaggtgttcgggcaactgatctcctaccaggtaattacgtgctccccgctggaactctga

SEQ ID NO: 3304 - protein, 127 aa, Unknown
  Obtained from environmental sample
  misc_feature (1)..(127): Xaa is any amino acid
MLQRITAVHAERFHWKNEAGIIPVEYGFKYFFINKSLCCLQLFTKVFSQLDQSFLSKKINVNTPNSNHSFRQKMCLLKSKISCYKRGFRKVEQPCRSTVVLHDGKPLDQVFGQLISYQVITCSPLEL

SEQ ID NO: 3305 - DNA, 390 bp, Unknown
  Obtained from environmental sample
  misc_feature (1)..(390): n is a, c, g, or t
atgattatcataatacacggagatgatatttcgcaatcagcctcgaaatttgacagcatttcaaaagattggaccgtacgtattgatgctaaaaaaacttccattgacgaaatcgaacggggttttcagaccgacagtttgtttgacgaaaaacgcaccattattattgaaaatattgaatcggctaaaaaagatattgttgaatcactcgtcaagaattctatacaacttagtgaacttacaacagtgatcatgtacagtgctacgaccattcatgctcgaattcttaaaaaatttaccaattcacaaatatatgattacaaacttccgaaattgtactttaattttcttgatggcttgactcccggtaatggtaaacaacgcggttaa

SEQ ID NO: 3306 - protein, 129 aa, Unknown
  Obtained from environmental sample
  misc_feature (1)..(129): Xaa is any amino acid
MIIIIHGDDISQSASKFDSISKDWTVRIDAKKTSIDEIERGFQTDSLFDEKRTIIIENIESAKKDIVESLVKNSIQLSELTTVIMYSATTIHARILKKFTNSQIYDYKLPKLYFNFLDGLTPGNGKQRG

SEQ ID NO: 3307 - DNA, 402 bp, Unknown
  Obtained from environmental sample
  misc_feature (1)..(402): n is a, c, g, or t
atgggtaataatacgatgccaaacgtaggtgagttttgctggaatgaacttttaacgtcagacacaaacaaagctaaggacttttatacatcagtattaggatgggaaacaaaagatatagaggtaaatatagaaagcaaaacctatactatgtttatggcagagaacaaaggttttggagggataatgcaaattcctagtgataaaaaagggtcgaccccttctcattggataagctatatcgccgtgaaggatgtgatggagactctcgaaaaagcaaaaaaacttggagctagcattttaaagcctgtcactgtcattcctgaaaaagggcgctttgtaattattatagacccagctggcgcaacaatcggtttctgggagtcttttttacgaacttaa

SEQ ID NO: 3308 - protein, 133 aa, Unknown
  Obtained from environmental sample
  DOMAIN (8)...(126): Glyoxalase/Bleomycin resistance protein/Dioxygenase superfamily
  misc_feature (1)..(133): Xaa is any amino acid
MGNNTMPNVGEFCWNELLTSDTNKAKDFYTSVLGWETKDIEVNIESKTYTMFMAENKGFGGIMQIPSDKKGSTPSHWISYIAVKDVMETLEKAKKLGASILKPVTVIPEKGRFVIIIDPAGATIGFWESFLRT

SEQ ID NO: 3309 - DNA, 900 bp, Unknown
  Obtained from environmental sample
  misc_feature (1)..(900): n is a, c, g, or t
ttgaaagctcaacttgctttcccagccatactatggcccttattttttcttatcataccaactttcatagaggtaattgttgtctcattgttgctggcttatttatatggattaccatatgggtttttgatgatagcaaccgtagtcatatttcttacgttttcaatcaaagctttaaattggtggcttatatctcaaagagaaagcaatgaaaaacactacaaatctcaaagtaacattgttgatagttttataaactttgccacaattaagctttttaataatcaaaaatatgaatttgataagtgtttaaatttgcttaatgagcgacaagaatctcaagtcaaagcattacttcatgggcgctatatttgcttaggccaagactttattatagggattacattaataatttttagtcttatgtgtgcttataaagttctttacgaagggtatggtgttagtgattttatattaattaattcatatgtattacagttctctattccacttagtagtttaggcttcattcttggtgattttcacaaacaacttacccagatggaaaaaatcatagaacttcttgggtacaaacctaggattaaagatgggagcaagcccattgtagtgaacgacaataaaatagttatatcatgtaaagatattcactttggatatgagtctaaaagaccgatccttaaaggtgtgtcgtttactttactgccgggaaaaaccttagcatttgtaggacccactggttctgggaagtcaactgctacaaatcttttgttacgtttttacgagtacaaatctggagaaatacatataaatggagaagatattcgcacaataaaacaagaaagtctaattaagcatgtaaagtgtgttccgcagatatag

SEQ ID NO: 3310 - protein, 299 aa, Unknown
  Obtained from environmental sample
  misc_feature (1)..(299): Xaa is any amino acid
MKAQLAFPAILWPLFFLIIPTFIEVIVVSLLLAYLYGLPYGFLMIATVVIFLTFSIKALNWWLISQRESNEKHYKSQSNIVDSFINFATIKLFNNQKYEFDKCLNLLNERQESQVKALLHGRYICLGQDFIIGITLIIFSLMCAYKVLYEGYGVSDFILINSYVLQFSIPLSSLGFILGDFHKQLTQMEKIIELLGYKPRIKDGSKPIVVNDNKIVISCKDIHFGYESKRPILKGVSFTLLPGKTLAFVGPTGSGKSTATNLLLRFYEYKSGEIHINGEDIRTIKQESLIKHVKCVPQI

SEQ ID NO: 3311 - DNA, 564 bp, Unknown
  Obtained from environmental sample
  misc_feature (1)..(564): n is a, c, g, or t
atgaatatcagtatttatttaaaagagattggagaagggaaactagtagtaataggattaattggggcgatcatttgtctgatgtcaatcaacatttctgagggcgtctcaagcgcattaaatgaagagctggaacacaagatgttaaccacggggaaaataaatggtactctgaaaaatgaggatgaaaacgcgacctggttactatctggtacttggaatagtaacttgttcactaatgctaaatttaatcacacaaatccagccaaattttcaggtaaaattaacatggtaatggcaaatggctcctctcctcacatacataaaatatcccattttactcttaccaacatatcaacacaagatcattcaacaatgtatgaaggttaccttgccgtaagtatgaagttaggtccagtttttgccattccggtcataattaaaaattaccaaaatgagacaatcagtatttcacttcaatcacttgatgatataactttagatcagactaaagtaatcagtcattttgaaagtaaacctataattggaatatttgcaaaataa

SEQ ID NO: 3312 - protein, 187 aa, Unknown
  Obtained from environmental sample
  misc_feature (1)..(187): Xaa is any amino acid
MNISIYLKEIGEGKLVVIGLIGAIICLMSINISEGVSSALNEELEHKMLTTGKINGTLKNEDENATWLLSGTWNSNLFTNAKFNHTNPAKFSGKINMVMANGSSPHIHKISHFTLTNISTQDHSTMYEGYLAVSMKLGPVFAIPVIIKNYQNETISISLQSLDDITLDQTKVISHFESKPIIGIFAK

SEQ ID NO: 3313 - DNA, 528 bp, Unknown
  Obtained from environmental sample
  misc_feature (1)..(528): n is a, c, g, or t
ttggaaaaaaaagttggaattttttcgatgccgatttctggtttgggggaacgcncgattttttatgggggcgttaccgccgaaagttttattttggaacagtttgtcgccggaatcaaggaacttcgaggaaatttcgatccatttagccgaaaacgtttcgctcatcccgggcggaagcgggcattgaagaactggcgatttttcctttatttcgcgcccatacatttattcgcaattgatcctatttctacaaacattccggctaaattcagcctaaatcaaaattatccgaatccgtttaatcctgttacatctatcagatttgatgttcctaaatcaacttttgttaagattactatctntgatgtgttgggaagagaaattgaaaatctggttaatgaacggctaaaagcaggggaatatatggttaaatgggatgcggcgagattttcaagcggtatttatttctacagcatcgcaaccgatggataccagacaactaagaaaatgatactcacaaaatag

SEQ ID NO: 3314 - protein, 175 aa, Unknown
  Obtained from environmental sample
  misc_feature (1)..(175): Xaa is any amino acid
MEKKVGIFSMPISGLGERXIFYGGVTAESFILEQFVAGIKELRGNFDPFSRKRFAHPGRKRALKNWRFFLYFAPIHLFAIDPISTNIPAKFSLNQNYPNPFNPVTSIRFDVPKSTFVKITIXDVLGREIENLVNERLKAGEYMVKWDAARFSSGIYFYSIATDGYQTTKKMILTK

SEQ ID NO: 3315 - DNA, 681 bp, Unknown
  Obtained from environmental sample
  misc_feature (1)..(681): n is a, c, g, or t
atggaaggcgancggaagtgccaagttttgattttggaccgaaatcaaaaacaaanaaaatcggattcgtttaaaagcctggggaaaaacatttttttgatttgttttgacgatttcanncaatttcggattcnatttttttattgtttgggaagttatttgattacgaacaaaaaagcttccgttccaaagctgagtttggtgttccaaaaaggagaaattaatttttatgcttgcgctattaaagttttggaaggcgacatcaactctcattatgactggaccgaagacattatgaatgacgattgggatgcgaaaaaagccattaaaaagctgaaagaaattccagataagatgatntgcgatgcacttttggaccaagatattttttcaggattgggaaacattatcaagaatgaagttttgtaccgcgccagaattcatccggaatcattggtagggaaaattccgagtaaaaaaataaaggaaatcgtggacgaatctcgaatttatagttttgaattcttgaaatggaaaaagaaaaatgaactgaaaaaacattggcttgcccacacaaaaaaaatctgcaaacgatgcgatcttccgatgtttaaagaatatacgggaatcaaaaaacgcagaagtttcttttgtactaattgtcaaaaactgcacgattga

SEQ ID NO: 3316 - protein, 226 aa, Unknown
  Obtained from environmental sample
  DOMAIN (97)...(180): Formamidopyrimidine-DNA glycosylase H2TH domain
  misc_feature (1)..(226): Xaa is any amino acid
MEGXRKCQVLILDRNQKQXKSDSFKSLGKNIFLICFDDFXQFRIXFFYCLGSYLITNKKASVPKLSLVFQKGEINFYACAIKVLEGDINSHYDWTEDIMNDDWDAKKAIKKLKEIPDKMXCDALLDQDIFSGLGNIIKNEVLYRARIHPESLVGKIPSKKIKEIVDESRIYSFEFLKWKKKNELKKHWLAHTKKICKRCDLPMFKEYTGIKKRRSFFCTNCQKLHD

SEQ ID NO: 3317 - DNA, 576 bp, Unknown
  Obtained from environmental sample
  misc_feature (1)..(576): n is a, c, g, or t
atgccaaagatcaacggctttgaaatgcttgaattaattgaacagccaccagcagtaatatttgctactgcttttgacgaatatgccatcaaggcctttgaagcacatgctgtggattatttattaaaaccttttagtaaagagcgttttgataaagcaatacaaaattggttatcacaaaccaatcacaagcaacaaaaaacagcaactgaatcactacttcaatcagttaatgaactgcctggacaatctgaacggattgtagtaaaaacaggagggaagatcaaaattattgttgtgtcagaattatattatatagaagcggctgatgattatgtaaaactttataccaaagatggaagctatctcaaaaacaaaaccatgggtttttttgaacagactttaaatccatctcagttcgttcgcactcaccgctcctacatcataaacatccaggaaataacccgcattgaaccttatgaaaaagaatcgcaccttgctattttaaaatcaggtgctaaaattccggtaagcaaaacaggctatgtaaaattgcgcacggttttagggttataa

SEQ ID NO: 3318 - protein, 191 aa, Unknown
  Obtained from environmental sample
  DOMAIN (93)...(190): LytTr DNA-binding domain
  misc_feature (1)..(191): Xaa is any amino acid
MPKINGFEMLELIEQPPAVIFATAFDEYAIKAFEAHAVDYLLKPFSKERFDKAIQNWLSQTNHKQQKTATESLLQSVNELPGQSERIVVKTGGKIKIIVVSELYYIEAADDYVKLYTKDGSYLKNKTMGFFEQTLNPSQFVRTHRSYIINIQEITRIEPYEKESHLAILKSGAKIPVSKTGYVKLRTVLGL

SEQ ID NO: 3319 - DNA, 1011 bp, Unknown
  Obtained from environmental sample
  misc_feature (1)..(1011): n is a, c, g, or t
ttgaatcttttctttttggttatgacatcggaactaagagattatgatattatcgtagctgggggaggattagccggtatgatagttgcatcttccgctgcttattattcaaaacaatctcttaagatcctagtggtagatagaaatgcatcaccacagctaggtaagaagacaatatcaggatgggtgtgcggtgacgctgtcggcaaaaatagtgtagattacatgacatcaaggataggaataaagtggcagagtccagaaattgaacacccagttaagggagttaaagcgttctcaccggaccatgaaacatcaatatcgtttgacggtgaaggatatattctcaatagaaaagttttgccgcaaaagcaactcaatgacgcacttaatgtcggcatagaaattaaatataatatagcattaagaaatgtgctaaccgataataacaatgtaattggagtagagggcgaggatctagaaacaaaatccccgtttaaaaagacatgtaaaatcgtggtagactgcacaggagttacttctgtactacgaacaaatcttccaataaattcacatattcaaaagaaaattaacagggatgatctggaagcaactggaagatacatatataattttgaaaatgaagtagaagataacacgttttttgatcccgattattgtctaatccatttggatcagaatattgcacctggcggatatgcgtgggtgtttcccaagggaaaaagcaaagtcaacataggtcttggagttcaacanaaggcaatggaagaatatnacagaaaacagggacatcgtaaagattttgagacaaagatagatgattacgttaggacccatcctgtgataaaaaatcccacaatagctgatggtgaatctgatgatggaaatagctgggggacatggcaagtttctgtcagacacagaatgattgcttggtggcccatggaaacatgttggttggtgactctgcgtggatgccaagccacttga

SEQ ID NO: 3320 - protein, 336 aa, Unknown
  Obtained from environmental sample
  misc_feature (1)..(336): Xaa is any amino acid
MNLFFLVMTSELRDYDIIVAGGGLAGMIVASSAAYYSKQSLKILVVDRNASPQLGKKTISGWVCGDAVGKNSVDYMTSRIGIKWQSPEIEHPVKGVKAFSPDHETSISFDGEGYILNRKVLPQKQLNDALNVGIEIKYNIALRNVLTDNNNVIGVEGEDLETKSPFKKTCKIVVDCTGVTSVLRTNLPINSHIQKKINRDDLEATGRYIYNFENEVEDNTFFDPDYCLIHLDQNIAPGGYAWVFPKGKSKVNIGLGVQXKAMEEYXRKQGHRKDFETKIDDYVRTHPVIKNPTIADGESDDGNSWGTWQVSVRHRMIAWWPMETCWLVTLRGCQAT

SEQ ID NO: 3321 - DNA, 630 bp, Unknown
  Obtained from environmental sample
  misc_feature (1)..(630): n is a, c, g, or t
gtgcattcgcttgaacttgtagctgagtgtagtgatacgatggaagcttacaactacctcaacagtggcctggttgatctaatgtttttagatattgagatgcccgggatgacgggcattgaactcactaaaaagctgggcaataaaaaagcacttattattttcactactgccaaaactgattatgcagtggaagcttttgaattgaatgtagtagattaccttttaaaaccagtttcactttcccgttttttacaagccgttgaaaaagcaaaagagacttttgacagcaacaaacaggaggtaaaaattgaagcccaggaatttgtttttgttaaagacaatggcattcttaaaaaattgaatgttgatgatattctatacctggaggctatgggtgattatgtaaaagtgcatactgctcaaaaatttcatgtgcttcattctacattaaaatccattgaagaaaaattgccgccaaataaatttttacgcatacaccggagctatattgtttcgttgcaaaaaattgatttcatccaggatggcattattaacattggcaaggccaacatacccgttgcagaaacctacaggccctctttaaataaacgcttaaacctactctag

SEQ ID NO: 3322 - protein, 209 aa, Unknown
  Obtained from environmental sample
  DOMAIN (1)...(96): Response regulator receiver domain
  misc_feature (1)..(209): Xaa is any amino acid
MHSLELVAECSDTMEAYNYLNSGLVDLMFLDIEMPGMTGIELTKKLGNKKALIIFTTAKTDYAVEAFELNVVDYLLKPVSLSRFLQAVEKAKETFDSNKQEVKIEAQEFVFVKDNGILKKLNVDDILYLEAMGDYVKVHTAQKFHVLHSTLKSIEEKLPPNKFLRIHRSYIVSLQKIDFIQDGIINIGKANIPVAETYRPSLNKRLNLL

SEQ ID NO: 3323 - DNA, 618 bp, Unknown
  Obtained from environmental sample
  misc_feature (1)..(618): n is a, c, g, or t
atgacagaggccgcaattgattttaatgaggaagcatttattcggattattgatgcactaatagaaaaaatcgggtttgaaaaatgcatcacagatgtttgttatcctttcttaaaacgcataggtatgccatggaagaagaataatctaattccggcccaacaacatttttctagctatattattcaaaacaggataattgccgaaacggacaagtttaaagcaagcaataagatgccaggcatgatactgttttcacctggagaagcccataacgagctacctctactttttatttattacctgttacgaaaaaatgattggaacgtaatgtacctggggactaatattaataaaaaaacaatcacccggtttagcgaaaagaattctgtaaaatatatttttcttcacctcattcacgatttcgccggctgggatgcagatgtgtatttcgaagatttatgtaaatctattcccggtaaaaaaattattgttacgggtacagccgtgcatcagtttcaaagaaagtttacaaacttaatcttgttaaaatccgacaaagaaatttatcaatttatagaaaacaataaattagaacctgtagtgggtgaaagatga

SEQ ID NO: 3324 - protein, 205 aa, Unknown
  Obtained from environmental sample
  misc_feature (1)..(205): Xaa is any amino acid
MTEAAIDFNEEAFIRIIDALIEKIGFEKCITDVCYPFLKRIGMPWKKNNLIPAQQHFSSYIIQNRIIAETDKFKASNKMPGMILFSPGEAHNELPLLFIYYLLRKNDWNVMYLGTNINKKTITRFSEKNSVKYIFLHLIHDFAGWDADVYFEDLCKSIPGKKIIVTGTAVHQFQRKFTNLILLKSDKEIYQFIENNKLEPVVGER

SEQ ID NO: 3325 - DNA, 363 bp, Unknown
  Obtained from environmental sample
  misc_feature (1)..(363): n is a, c, g, or t
atgaagaattttttaagctacgcaaggttttcaaccctttttatttttgtattctttattacaaaccacctccaggcacaaaacctgccggtaagtattaaaatagttaactcgaaaaaggaacctgttgccttcgcctccataaaaattatttctgttcctgataccgtgaatacacaacaaaagttttcagatagttcaggtgttgcttcatttaatcttttgcaggaccatctttataaaattgaagcaacagctattaactataagcctatacagaaaacaattaatctttccgggacacaatctgtgtttacacttgtggcagaagatttagataaaacacttgaccaggttatgtaa

SEQ ID NO: 3326 - protein, 120 aa, Unknown
  Obtained from environmental sample
  misc_feature (1)..(120): Xaa is any amino acid
MKNFLSYARFSTLFIFVFFITNHLQAQNLPVSIKIVNSKKEPVAFASIKIISVPDTVNTQQKFSDSSGVASFNLLQDHLYKIEATAINYKPIQKTINLSGTQSVFTLVAEDLDKTLDQVM

SEQ ID NO: 3327 - DNA, 357 bp, Unknown
  Obtained from environmental sample
  misc_feature (1)..(357): n is a, c, g, or t
atgcaaacatatatttctattttaagaggcattaatgttagcggacagaaaaaaattttgatggctgatttgaaactgctttttgaaaaactgaagtgtgaaaatgtaactacttatattcaaagcgggaatgtggtttttaaaagtagtactgaattgacagaccttgaattgtccaaaaagattgaaacagaaatttttaaaaaatacaaatttgaagttcctgtgataacaagaacgaagaaggaattagaaaatgtaatttcatcaaatccctttttgaaagaaaaaaatatcaacattgaaaagcttcatgttacttttctatcagaaaaaccaaacaaagcttgtgaataa

SEQ ID NO: 3328 - protein, 118 aa, Unknown
  Obtained from environmental sample
  misc_feature (1)..(118): Xaa is any amino acid
MQTYISILRGINVSGQKKILMADLKLLFEKLKCENVTTYIQSGNVVFKSSTELTDLELSKKIETEIFKKYKFEVPVITRTKKELENVISSNPFLKEKNINIEKLHVTFLSEKPNKACE

SEQ ID NO: 3329 - DNA, 312 bp, Unknown
  Obtained from environmental sample
  misc_feature (1)..(312): n is a, c, g, or t
ttgtgtaagaaagcaaataataaaatatttcttcagattaaaaaacctttaaaaatgaatattgataacacagcaagccagatgcggaaaggggtcctggagttttgcattttatcaataataaaattgggagaagcttacccgagtgatattattgacatgatgaaatcggccaacctgcatattctggaaggtacattgtatccactgctcacacgattaaaaaacgcgaagttccttacttatcgctgggtagaaagcaacnagcggccgccnacgcnaatatttttctttgacagaaaaaagcgctga

SEQ ID NO: 3330 - protein, 103 aa, Unknown
  Obtained from environmental sample
  DOMAIN (27)...(101): Transcriptional regulator PadR-like family
  misc_feature (1)..(103): Xaa is any amino acid
MCKKANNKIFLQIKKPLKMNIDNTASQMRKGVLEFCILSIIKLGEAYPSDIIDMMKSANLHILEGTLYPLLTRLKNAKFLTYRWVESNXRPPTXIFFFDRKKR

SEQ ID NO: 3331 - DNA, 573 bp, Unknown
  Obtained from environmental sample
  misc_feature (1)..(573): n is a, c, g, or t
ttgcttcgcacctacgaaggaatctttggtttcccagcttttatctcagaaaatcttttgagccgtctcctgcgtgttgaggatgaaaaaataaaagatgatttaaaaaaacttacagcttttcacattatagaatatgtaccacaaaacgatgcaccttttattatttttaaaaagaaccgggtggcaacagaaaatcttaccatcaatttatcattatacaaaaaaagaaaagaagcatttattgaacgtgtaaaaaaaattattgagtatatacaaacaaaagaatgcaggagcatttttgtcaaccattattttggagaccatgatattaaagcctgcggtatttgtgataattgccgcagggcaaagactttgcacttaacaacggaagaattcgaaaagattaaaaacagtatttgcgtggctcttaaaaagaaaagcattggctcatcggaattactcggaacgctgcagggcatcagcaaagaaaaagcctggcgtgttttaaactttctccaggctgaacaaaaggtttttataaatgaaaaaggggaattgtctttgaactaa

SEQ ID NO: 3332 - protein, 190 aa, Unknown
  Obtained from environmental sample
  misc_feature (1)..(190): Xaa is any amino acid
MLRTYEGIFGFPAFISENLLSRLLRVEDEKIKDDLKKLTAFHIIEYVPQNDAPFIIFKKNRVATENLTINLSLYKKRKEAFIERVKKIIEYIQTKECRSIFVNHYFGDHDIKACGICDNCRRAKTLHLTTEEFEKIKNSICVALKKKSIGSSELLGTLQGISKEKAWRVLNFLQAEQKVFINEKGELSLN

SEQ ID NO: 3333 - DNA, 888 bp, Unknown
  Obtained from environmental sample
  misc_feature (1)..(888): n is a, c, g, or t
atggatcagcagtcatttttaatatataatcagccagacaaatcaaaaagagattatgcgtggtatgacctaagtatcacaacccttcgcagggacatgaggccaatcgttaacccaatcacagactcttataacaaggaattattggatggtcggcaatccatgaaggatgtaattgcatcttttgatgacaaggattttaaaagagatgtaaagataatccctttggggataatgaacgtctttgttaatgaaatgattgaaaccctgaagaaaacccctcccaaagctgaagtaaaggctatcgatcctgccgctatgactgccaaacaagaggatattaacaaactcaaataccgtaaaatattagaaagggataggacagaattacagaagagggtaggcatgggcaattataaagtcccaaaggaaatgtttgaggggaatgtagatgaatttgataagttaggattggatgagcgtgatcccgatgacataaacttttttgaagggacttatcatcggcttgactctgaaatagcagcccagcagttagtaaatggatgcctgaaactatcaaagtttgataaaaatcacatcacaaaatatgtacgggatgcaatggcaagttgcgtagtatgtgggcaatcctatgtcaaccgggttacaggccaaatatccaatgattatatttatccttcagagtattatttcatcccttcagatactgaagatgggcatgatgatgtggcgaaaggatggttcaggcaggtaacagtttcagaatggttatcaagagtagggaatgagtttaactgggatgcagattggccctatcttttatgggctataaattactgtaacaatacaaagtatactgggttgtaa

SEQ ID NO: 3334 - protein, 295 aa, Unknown
  Obtained from environmental sample
  misc_feature (1)..(295): Xaa is any amino acid
MDQQSFLIYNQPDKSKRDYAWYDLSITTLRRDMRPIVNPITDSYNKELLDGRQSMKDVIASFDDKDFKRDVKIIPLGIMNVFVNEMIETLKKTPPKAEVKAIDPAAMTAKQEDINKLKYRKILERDRTELQKRVGMGNYKVPKEMFEGNVDEFDKLGLDERDPDDINFFEGTYHRLDSEIAAQQLVNGCLKLSKFDKNHITKYVRDAMASCVVCGQSYVNRVTGQISNDYIYPSEYYFIPSDTEDGHDDVAKGWFRQVTVSEWLSRVGNEFNWDADWPYLLWAINYCNNTKYTGL

SEQ ID NO: 3335 - DNA, 477 bp, Unknown
  Obtained from environmental sample
  misc_feature (1)..(477): n is a, c, g, or t
ttgctactgatgtatgatgccacattagctggaaaccatttggctaaacaggtaaaacagacataccctcatgtaaaaatattagccttgtccatgagcggccagggtgacctggtaaatgaaatgatcgaagacgctgatatttcaggctatgtcctgaagaacatcggcaagcaggaattggtccaagccctggaaaaaattgcgggcgggggaatttacttcagtgaagaagtattaaaagaactggaacggagcagtcggcgtaaaaaacaaaaagaagaagcccatcttaccggtcgtgaagttgagatcatcaacctgatcgaaaaagaattcaataataaaaagattgcctgtacactatatatttcggaaagaacggttgaaacacataggaaaaatattttcagaaagacaaataccaattccgtgataggattggtgaaatatgcgtatgagcataggttgatctaa

SEQ ID NO: 3336 - protein, 158 aa, Unknown
  Obtained from environmental sample
  DOMAIN (95)...(152): Bacterial regulatory proteins, luxR family
  misc_feature (1)..(158): Xaa is any amino acid
MLLMYDATLAGNHLAKQVKQTYPHVKILALSMSGQGDLVNEMIEDADISGYVLKNIGKQELVQALEKIAGGGIYFSEEVLKELERSSRRKKQKEEAHLTGREVEIINLIEKEFNNKKIACTLYISERTVETHRKNIFRKTNTNSVIGLVKYAYEHRLI

SEQ ID NO: 3337 - DNA, 321 bp, Unknown
  Obtained from environmental sample
  misc_feature (1)..(321): n is a, c, g, or t
atgaaaaaaatagtaagcatacttgtatttgttctcttagcaaacctgtcacaagctacctatattttgattccaatggacctaaaccaaaagaatcatttaaaagcatatggtgttgcctattgggtattgaaacaagatgtggaagtgcattggctactgaattaccgtggaggcagttttatggtgaaaggtgcaaaagaaattgaaagtgaatgtacgatacgaggcgtttcatttgaagtaattccagatgcgaagtcgagcgctattttaacagagatctccaatcctgaagtgaacatggaggatgtgaaatag

SEQ ID NO: 3338 - protein, 106 aa, Unknown
  Obtained from environmental sample
  SIGNAL (1)...(19)
  misc_feature (1)..(106): Xaa is any amino acid
MKKIVSILVFVLLANLSQATYILIPMDLNQKNHLKAYGVAYWVLKQDVEVHWLLNYRGGSFMVKGAKEIESECTIRGVSFEVIPDAKSSAILTEISNPEVNMEDVK

SEQ ID NO: 3339 - DNA, 468 bp, Unknown
  Obtained from environmental sample
  misc_feature (1)..(468): n is a, c, g, or t
atgatacgactaaaaaatattttcaaatggtacaacaccggcattaaccgcactttcattttgaaagatataaacctagatgtaaaagaaggtgaatttatctccattatgggaccatccggttcgggtaaatccactttgctgaatattattggaatgcttgatgaacccaatgaaggcctttatgattttaatggagaaaatgttttctcactcaaagaaaagcaacgttcagaaatatacaaaaagcacattggctttgttttccaggcatatcatttaatagatgagttgacagtttatgaaaatatagaaacgccattaatctatcagaatataaagggaagtgaaagaagagcaatggtagcagatatgctggatcgctttcagattgtagggaaaaaagatctttttccaagccagctttcgggcggacacaacaattggtgggtattgcaagagcactaa

SEQ ID NO: 3340 - protein, 155 aa, Unknown
  Obtained from environmental sample
  DOMAIN (31)...(155): ABC transporter
  misc_feature (1)..(155): Xaa is any amino acid
MIRLKNIFKWYNTGINRTFILKDINLDVKEGEFISIMGPSGSGKSTLLNIIGMLDEPNEGLYDFNGENVFSLKEKQRSEIYKKHIGFVFQAYHLIDELTVYENIETPLIYQNIKGSERRAMVADMLDRFQIVGKKDLFPSQLSGGHNNWWVLQEH

SEQ ID NO: 3341 - DNA, 330 bp, Unknown
  Obtained from environmental sample
  misc_feature (1)..(330): n is a, c, g, or t
ttggatggccgcgataccggtatagaccttgtagccaaaacncaaggcaccgatgaataccatgcaattcagtgcaagtgttatgcggaagattaccgtgtaaaaaggtcagatatagacagcttctttaccgcgtctggcaaaaagcccttcacccgccgcattattgtgaccactaccaataattggagcgagcacgccgaagatgcgcttcaaggccagcagccaccagtcaataaaattgatcttaccgatcttgaaaatagcagattgattggagtaaataccagcccgcaaaagcccccgagcttaaagaaaagaaaaaattaa

SEQ ID NO: 3342 - protein, 109 aa, Unknown
  Obtained from environmental sample
  DOMAIN (1)...(88): Restriction endonuclease
  misc_feature (1)..(109): Xaa is any amino acid
MDGRDTGIDLVAKTQGTDEYHAIQCKCYAEDYRVKRSDIDSFFTASGKKPFTRRIIVTTTNNWSEHAEDALQGQQPPVNKIDLTDLENSRLIGVNTSPQKPPSLKKRKN

SEQ ID NO: 3343 - DNA, 783 bp, Unknown
  Obtained from environmental sample
  misc_feature (1)..(783): n is a, c, g, or t
atgaaattcttggggtttataataaacatgaaaaggatattatatttcgcaattattatccccttatcatttctgacaaaaattcaagctcaacgacttgtcccagatagtatcccttattattcgttagatcatatttacgacgaaataacacagctagacaaatattccatcaaagagggtgaaaactttggtagcatattggcaaattatgacttgaagaatggtactaagagatttctggtgtcttatggcatgttttatgacgcttgcaatacctgtcaacaccataagtttggctattctgagactaatatcggatcaggttgtatttactacgaaacctcaaatgcttttaaatcaacctacaattcaataatgaaaagtattttgaaggaaaatgaacttgcggagatggaaaagataatgccagaaaatggagttttcaacagttatgcgactacacttttaaactttgatcacgatcagaaaaacaaaaaagactctatattttattttcatatctattcagacactttggagactctttttaaagacaatatccgttttcttaaaatgactgttaccgttgattccgttgaaagagagtatgattatttccaaataaaaaataaaggcatattacttaatacgaagggtagaaagaaaatggatatcttaattttattagattttagtgatgttcccaacaattatgatatttgttggtgtactgctctaggcaaaaaatattggcttagacaaccgcttaatctaaaatga

SEQ ID NO: 3344 - protein, 260 aa, Unknown
  Obtained from environmental sample
  misc_feature (1)..(260): Xaa is any amino acid
MKFLGFIINMKRILYFAIIIPLSFLTKIQAQRLVPDSIPYYSLDHIYDEITQLDKYSIKEGENFGSILANYDLKNGTKRFLVSYGMFYDACNTCQHHKFGYSETNIGSGCIYYETSNAFKSTYNSIMKSILKENELAEMEKIMPENGVFNSYATTLLNFDHDQKNKKDSIFYFHIYSDTLETLFKDNIRFLKMTVTVDSVEREYDYFQIKNKGILLNTKGRKKMDILILLDFSDVPNNYDICWCTALGKKYWLRQPLNLK

SEQ ID NO: 3345 - DNA, 771 bp, Unknown
  Obtained from environmental sample
  misc_feature (1)..(771): n is a, c, g, or t
gtgacccgcgatctgactgaaagaaaattatcggaggaaaaggaaaaaaaatatatagcagcgcttgaattcagaaacagggaacttgaacagtttgcttatatcgcaagtcatgacatgcaggagccactcaggaagatcagcatgttttcagaaattattgagaatagggccgaagacaaagacgcggtaagtctttacctccataagattactaaagccgcatcgagaatgtcgaatcttataaacgacgtattgaactattcaaaactttcggatagcagtgatatttccagggacattgacctcaataaaatccttgaagaagtaaaggatgatctcgaagtagtcattaataagaaaaatgttacgatcagttcggataaacttccggtcataaaaggaatttcttaccagtttcaccagctgtttctaaacttacttagcaatgctattaagtttaatacctccgaaccattcataagaatcagcactgaaaaggtcgcacaggaagaactcgatatgcaccctgaactcgacagggaggttgaacatatcaggctgctgtttgaggataatggaattggaatcgaccctaaataccagggccagattttcaagttgttccagagattgaatgataagaattatgagggaacaggaatcggccttgctttgtgcaagcgaattgtagagaatcatcatggccttatttatctgaagagtaacattcatcagggatcaatcttcgaagtcttattgcctgcctga

SEQ ID NO: 3346 - protein, 256 aa, Unknown
  Obtained from environmental sample
  DOMAIN (28)...(94): His Kinase A (phosphoacceptor) domain
  misc_feature (1)..(256): Xaa is any amino acid
MTRDLTERKLSEEKEKKYIAALEFRNRELEQFAYIASHDMQEPLRKISMFSEIIENRAEDKDAVSLYLHKITKAASRMSNLINDVLNYSKLSDSSDISRDIDLNKILEEVKDDLEVVINKKNVTISSDKLPVIKGISYQFHQLFLNLLSNAIKFNTSEPFIRISTEKVAQEELDMHPELDREVEHIRLLFEDNGIGIDPKYQGQIFKLFQRLNDKNYEGTGIGLALCKRIVENHHGLIYLKSNIHQGSIFEVLLPA

SEQ ID NO: 3347 - DNA, 408 bp, Unknown
  Obtained from environmental sample
  misc_feature (1)..(408): n is a, c, g, or t
ttggnncccatgacagatgctttgctctctgctttcgcaggatgcacaaattgcggtgtagaagtatcgctgaagactgccggcggcgaatttaataaagtctggatctacatgcattacgccgacaaaaatactctgaccgagttgcttatcaaggaagagaatgacaaagtcgttctcaaacagcggatcaataaatcggtcgtttcaaaaaacaaagcaataataacaatcaatccaaacacagaatatgttttccggattgcttttgatggcactcagtatacggtcttcattgacggcactttactctttaccatgaatccggtcggtcctgtaccggatgctactgtcgggttctccgcaaagaagacttcgatgtcagtcggctatatcatcgtcaagtaa

SEQ ID NO: 3348 - protein, 135 aa, Unknown
  Obtained from environmental sample
  misc_feature (1)..(135): Xaa is any amino acid
MXPMTDALLSAFAGCTNCGVEVSLKTAGGEFNKVWIYMHYADKNTLTELLIKEENDKVVLKQRINKSVVSKNKAIITINPNTEYVFRIAFDGTQYTVFIDGTLLFTMNPVGPVPDATVGFSAKKTSMSVGYIIVK

SEQ ID NO: 3349 - DNA, 819 bp, Unknown
  Obtained from environmental sample
  misc_feature (1)..(819): n is a, c, g, or t
ttgctacgaaggggctgggcggattataaattnttctggctggaaaacagtgaagttgtttttaaagctgaaaaaggaaaattcagaactgcaacgataacaggcctcgaactacaaaaatcttatgacgtttttcttgcgaagcaaagacctttggaaaaagcatacgatagtcttttcgatattagtgatggttcttttcccaatgaagagcgcgaacaaataaaacagtcaatgacggatctccagaagaagataacggagaacgaacaaaagtatgtacgcgataacccggacaatataatcagcgctaacatcctcgatgtttataaaacaacatggggccgatctgttgccagcgagctgttcgagtcgatgagttttgaaataaagaaatcgcactacggaaaaaatattgaaacgtacttgagtctcaataaggatctgaagatcggcgatcacttcgcagactttgaacttcctgatacggaaggtgaaatagtaaaggcttctgacttcaatggaaaatatttgctcgttgaattttgggcttcgtggtgcggcccatgcagaaaggagaatccagcgttggttaaactatataaagagtatagtaataaaggtttcgaaattctggcagtttctctggacagcgagaaagatgcgtggatcggtgcagttacaaaagatgaactgccctggcagaacgtaagtaatctggaaggagatatgactgcacccgctataatctatggcgttagtgcgatacccgacaatgtattcattgatccatccggaaaaattatcggaagaaattaa

SEQ ID NO: 3350 - protein, 272 aa, Unknown
  Obtained from environmental sample
  DOMAIN (151)...(270): AhpC/TSA family
  misc_feature (1)..(272): Xaa is any amino acid
MLRRGWADYKXFWLENSEVVFKAEKGKFRTATITGLELQKSYDVFLAKQRPLEKAYDSLFDISDGSFPNEEREQIKQSMTDLQKKITENEQKYVRDNPDNIISANILDVYKTTWGRSVASELFESMSFEIKKSHYGKNIETYLSLNKDLKIGDHFADFELPDTEGEIVKASDFNGKYLLVEFWASWCGPCRKENPALVKLYKEYSNKGFEILAVSLDSEKDAWIGAVTKDELPWQNVSNLEGDMTAPAIIYGVSAIPDNVFIDPSGKIIGRN

SEQ ID NO: 3351 - DNA, 522 bp, Unknown
  Obtained from environmental sample
  misc_feature (1)..(522): n is a, c, g, or t
atggaaaagacaaagtggatactcgatcctatacatagcgagctaaaatttaaaataagacacctgatgataagcaacgtatccggttctttaaaaaacttccaggccgaggtggaaatgaatgaagcagattttagttcagcgcaaattaatttaaccggggaaatgagttctattacaacaaataatgagcagcgtgatggccatttacgcacttccgattttttcgaggtagaaaaatatcctgagctaaaattcatttcaacaaaggtggaaaaattagacaatgaaacttttgcattatatggtgaattaacgctcaaaggcataacaaaaccagttcagctgaatgttgagtataatggattaacgaaggatccatggggtggtgaaagatcaggcttttttgtaaccggtaaaatcaaccgaactgaatggggcattaatttcaacagcgttttggaaacaggtggtgtggcgctaagtgaggaagtaagaatagatagtgaacttcagtggtga

SEQ ID NO: 3352 - protein, 173 aa, Unknown
  Obtained from environmental sample
  DOMAIN (3)...(172): YceI like family
  misc_feature (1)..(173): Xaa is any amino acid
MEKTKWILDPIHSELKFKIRHLMISNVSGSLKNFQAEVEMNEADFSSAQINLTGEMSSITTNNEQRDGHLRTSDFFEVEKYPELKFISTKVEKLDNETFALYGELTLKGITKPVQLNVEYNGLTKDPWGGERSGFFVTGKINRTEWGINFNSVLETGGVALSEEVRIDSELQW

SEQ ID NO: 3353 - DNA, 717 bp, Unknown
  Obtained from environmental sample
  misc_feature (1)..(717): n is a, c, g, or t
atgatgtttgctgagataagagtgagaattatcaaaccatttttagcaggaagagatgtgaagcgatttgaaactccgcggagtaataagtatttgattttatttccgaaaggatttacaaattcaaaaggcaacaatccaaaaaatggttggaaatggctagaggaaaattattcttctatcgcagcctatctaaaaccatttgaagaaaaaggaaagaaaagatttgataaaggagaatattggtgggaattgagagcctgcgattattatgcggaatttgaaaaggacaagattatccttcctgacattgctctacaaatgcaagcaacttttgattccaggaaattttatttagtaaatacatgctatataattccaactgatgataaatttttattaggaattttaaattcatcattaatacaatttctttattccagaattagctcttcaataagaggcggatatttaagatttataaggcaatatttagaaatactcccgattcaaaccaataaatctttggagacccaaatcattcatttagtagaaacgatgttgcaattacaagaagaaaaacaacaaaccacccttccccataaactggatcaattaaatgcaagaatagaatacaccgatgaaaaaataaacaacctggtgtttgagttgtatggattggatgaagaagaaataaaaattataggaaaagaataa

SEQ ID NO: 3354 - protein, 238 aa, Unknown
  Obtained from environmental sample
  misc_feature (1)..(238): Xaa is any amino acid
MMFAEIRVRIIKPFLAGRDVKRFETPRSNKYLILFPKGFTNSKGNNPKNGWKWLEENYSSIAAYLKPFEEKGKKRFDKGEYWWELRACDYYAEFEKDKIILPDIALQMQATFDSRKFYLVNTCYIIPTDDKFLLGILNSSLIQFLYSRISSSIRGGYLRFIRQYLEILPIQTNKSLETQIIHLVETMLQLQEEKQQTTLPHKLDQLNARIEYTDEKINNLVFELYGLDEEEIKIIGKE

SEQ ID NO: 3355 - DNA, 516 bp, Unknown
  Obtained from environmental sample
  misc_feature (1)..(516): n is a, c, g, or t
ttgaagaaaaaggaaaagaaaggatttgataaagggagaatattggtgggaattgagagcctgcgattattatgcgaatttgaaaaggacaagattatccttcctgacattgctctacaaatgcaagcaacttttgattccaggaaattttatttagtaaatacatgctatataattccaactgatgataaatttttattaggaattttaaattcatcattaatacaatttctttattccagaattagctcttcaataagaggcggatatttaagatttataaggcaatatttagaaatactcccgattcaaaccaataaatctttggagacccaaatcattcatttagtagaaacgatgttgcaattacaagaagaaaaacaacaaaccacccttccccataaactggatcaattaaatgcaagaatagaatacaccgatgaaaaaataaacaacctggtgtttgagttgtatggattggatgaagaagaaataaaaattataggaaaagaataa

SEQ ID NO: 3356 - protein, 171 aa, Unknown
  Obtained from environmental sample
  misc_feature (1)..(171): Xaa is any amino acid
MKKKEKKGFDKGRILVGIESLRLLCEFEKDKIILPDIALQMQATFDSRKFYLVNTCYIIPTDDKFLLGILNSSLIQFLYSRISSSIRGGYLRFIRQYLEILPIQTNKSLETQIIHLVETMLQLQEEKQQTTLPHKLDQLNARIEYTDEKINNLVFELYGLDEEEIKIIGKE

SEQ ID NO: 3357 - DNA, 339 bp, Unknown
  Obtained from environmental sample
  misc_feature (1)..(339): n is a, c, g, or t
atgtggactgactcactcgtcaatatcagttcccggaaaaagccggtagtcagcatcacaactgaacaggttaagggaaacgaattctcaaagggtaattcatatccggaaaaaatctttcataaaatttcatttaccgataacggaatcggattcgatcccgaattttcggaaaagatcttcgaactctttcaacgcctgcacggcaaaagcgaatacccgggaaccggtatagggctcgccatatgcaagaagatcgtcgaatcacattctggatttatagaggcggaatcatcgacagggaatggcgcaacattcatcgtttaccttcctgcataa

SEQ ID NO: 3358 - protein, 112 aa, Unknown
  Obtained from environmental sample
  DOMAIN (3)...(112): Histidine kinase-, DNA gyrase B-, and HSP90-like ATPase
  misc_feature (1)..(112): Xaa is any amino acid
MWTDSLVNISSRKKPVVSITTEQVKGNEFSKGNSYPEKIFHKISFTDNGIGFDPEFSEKIFELFQRLHGKSEYPGTGIGLAICKKIVESHSGFIEAESSTGNGATFIVYLPA

SEQ ID NO: 3359 - DNA, 531 bp, Unknown
  Obtained from environmental sample
  misc_feature (1)..(531): n is a, c, g, or t
atgctaaacttctttagaaataccgaccttgtagatagcagctcattactacaaatcttaaatgagatcattactcccaagctttccgaccgtggctttgcgtggaacgagaagtatttatggtttgatcaacctatgaattcaataagacatgtttttctatattcccgattgaagggtgagacgggaacttttgcttggggtgtttgtcttgattttgttccgataattgcttccaataaactgaaatattctagaactgataaaagcgttacacttcacttattcgaatggccagatgagtactcaaactccttcttctacggaaattccgaaggtggaaaaacaacccactgggggaagcatcaaaccaaaaaatcaatcaaatatctgtttgacaaatacgaacagaagataatggcctggtatgatcatgcgtcaacaatcgaaaatttaattgaaattgctaatcaacaaactgcgactgggaaaagctataatatacacaatcctccaccaaggcttgactag

SEQ ID NO: 3360 - protein, 176 aa, Unknown
  Obtained from environmental sample
  misc_feature (1)..(176): Xaa is any amino acid
MLNFFRNTDLVDSSSLLQILNEIITPKLSDRGFAWNEKYLWFDQPMNSIRHVFLYSRLKGETGTFAWGVCLDFVPIIASNKLKYSRTDKSVTLHLFEWPDEYSNSFFYGNSEGGKTTHWGKHQTKKSIKYLFDKYEQKIMAWYDHASTIENLIEIANQQTATGKSYNIHNPPPRLD

SEQ ID NO: 3361 - DNA, 351 bp, Unknown; identical to SEQ ID NO: 2665
  Obtained from environmental sample
  misc_feature (1)..(351): n is a, c, g, or t

SEQ ID NO: 3362 - protein, 116 aa, Unknown; identical to SEQ ID NO: 2666
  Obtained from environmental sample
  misc_feature (1)..(116): Xaa is any amino acid

SEQ ID NO: 3363 - DNA, 840 bp, Unknown
  Obtained from environmental sample
  misc_feature (1)..(840): n is a, c, g, or t
atgtatagcaacgacttaatcttcggaaaagataaaactgagcggattgtcagtattgaagcaaatgaggatcttatcgagatcttcactcgtgacaagaacggcaaactcagttctaggtttgagcctaattcctattggcttctgaccaaccacccagccaatagctctttcattacccttaacggtgacttacattttaaatacgctaaaacctttaaagatcgcaaggacttctttaaatataaacaatatctaagatcgaaacatattgacttttatgccgtaggtgacgttaaagaatctattatgcttcgtaacggttatacatacttcaaaggtttaatgcctaaagaactttctatattaagttttgacttagaaactaccggattaactcacgatgacacatctaaaatcctttgcatttcgactacgagtcgggaccatagtggccgaattagaaaagttctctgggaccacaaggaatattcctcacaagccgaaatgcttacaagatttagtgaatacgttcaagaacaagatccagatatccttataggtcataacattataatgttcgatattccctatatgcaatttattgctgatcgggaaggcgttcaattagaatggggaagaaataaagctcccattgagattgataattacgaatctaagttccgtanagacggtagtcagtcataccattatcacaaagttcgttgttacggtcgtgagatatgcgatactttatttcttacgattaaacacgatgccactgaacgtaaaatagaaagctatgggattaaaaccagtaatcaaacaactttgggttag

SEQ ID NO: 3364 - protein, 279 aa, Unknown
  Obtained from environmental sample
  DOMAIN (29)...(273): DNA polymerase family B, exonuclease domain
  misc_feature (1)..(279): Xaa is any amino acid
MYSNDLIFGKDKTERIVSIEANEDLIEIFTRDKNGKLSSRFEPNSYWLLTNHPANSSFITLNGDLHFKYAKTFKDRKDFFKYKQYLRSKHIDFYAVGDVKESIMLRNGYTYFKGLMPKELSILSFDLETTGLTHDDTSKILCISTTSRDHSGRIRKVLWDHKEYSSQAEMLTRFSEYVQEQDPDILIGHNIIMFDIPYMQFIADREGVQLEWGRNKAPIEIDNYESKFRXDGSQSYHYHKVRCYGREICDTLFLTIKHDATERKIESYGIKTSNQTTLG

SEQ ID NO: 3365 - DNA, 984 bp, Unknown
  Obtained from environmental sample
  misc_feature (1)..(984): n is a, c, g, or t
ttgattggaaatgccgccaacttcatcgacataaaaacatttcactcctattgtttcgacttgttgggaaaggttggaactattgacagagttgatggaattatcaaatcgacagttgagaaaataagaaacagtgaagtagaagcaagcagaattacaaaaacagttttggtaattgacgaagcacaggacatggacgaggaagagtttgaattgataaaagctctgatggagaagaatgaagaaatgagagtaatcgcggttggagatgatgatcaaaatatttatgaatggcggggagcaaattcaaaatacttaacgagtttcataacagagagagaggcaaccaaatacgaactgattacaaattatagaagcaaaagcaatttagtttcattcgctaaccaatttgtaaaaacaattggtaaacgactcaaagaaattcccattaatgcatatcaaatcgacaacggaaaaattaaaatagttcaatacaaaaacgggaatctaatcaatcctttaattgaggatatactttcgacagggctctcgggaacaacttgcattctgacacacaagaacgaagaagcatttcaaattgccgggctattgaccaagctcggacaacaggcaaagttgattcagagtaatgacggctttagtttgtacaatcttgcagaggttcgttattttttgaatgaattaagattagacgatgaggtatttattgtcagtgatgatgtttgggaaaacgcanagaggaaattgataganagatacaagacaagttcaaagtttgaaatctgtaacaaccttatcnaagattttgaangggacaaatacccnaaaagaaatacaaatcggactttgaaagtttcattcgggaatcaaagctggaagactttatcagcaccnacggcgaaaacattttttgtttcnnacattcacaaagcaaaaggaaaagaaattcgacaacgtgtttaa

SEQ ID NO: 3366 - protein, 327 aa, Unknown
  Obtained from environmental sample
  misc_feature (1)..(327): Xaa is any amino acid
MIGNAANFIDIKTFHSYCFDLLGKVGTIDRVDGIIKSTVEKIRNSEVEASRITKTVLVIDEAQDMDEEEFELIKALMEKNEEMRVIAVGDDDQNIYEWRGANSKYLTSFITEREATKYELITNYRSKSNLVSFANQFVKTIGKRLKEIPINAYQIDNGKIKIVQYKNGNLINPLIEDILSTGLSGTTCILTHKNEEAFQIAGLLTKLGQQAKLIQSNDGFSLYNLAEVRYFLNELRLDDEVFIVSDDVWENAXRKLIXRYKTSSKFEICNNLIXDFEXDKYPKRNTNRTLKVSFGNQSWKTLSAPTAKTFFVSXIHKAKGKEIRQRV

SEQ ID NO: 3367 - DNA, 378 bp, Unknown
  Obtained from environmental sample
  misc_feature (1)..(378): n is a, c, g, or t
atgatgatcaaattctggctgaaactgggaaagtgcgatgtattgtatttaccccgttatggagtctgtgaaactaaggaaagaaaagagcaagttacaacaggttttccacccaaaacacttgatattttcctttgtcataagccaattttgctccacggtaataaggagtattttgtagcgaaattctgtgcaaggtttaattgctgttacatagtagatggtggaccgcgcgacttaaaagctgccctggttcacctaagcgctgatgaaattttgagagaaacgttatcaaggaatactattcgtgccttatcctatttcaaaggatcaataattgccgatgtttttcgtgaagaggtaggtaatgctaactag

SEQ ID NO: 3368 - protein, 125 aa, Unknown
  Obtained from environmental sample
  misc_feature (1)..(125): Xaa is any amino acid
MMIKFWLKLGKCDVLYLPRYGVCETKERKEQVTTGFPPKTLDIFLCHKPILLHGNKEYFVAKFCARFNCCYIVDGGPRDLKAALVHLSADEILRETLSRNTIRALSYFKGSIIADVFREEVGNAN

SEQ ID NO: 3369 - DNA, 558 bp, Unknown
  Obtained from environmental sample
  misc_feature (1)..(558): n is a, c, g, or t
gtggccttcagagaaaacaaaaaatacttacaggacattttccctaaaaaacttaccggtattcaaatagaaaagcttcaacttctatatgagcaaatgattgaagatgacgaacttatgcaggaactcgaagaaatcatcatgtactcagcagaagaaatgagaactacaatcagcagtggtacagaaatatatgaatttgtggaagaaaaactaagtattaatccggtaggtctaattccactggatatgcaggaaggttatttttttcttagtgcagggaattctaaagcaacacgggtttatcattacaggttatccatttttgaaaagcatgatgaaaaataccgtagtattaaaaccacctacctggatttaatgcatcgcagtattgttaatacatacgaaaacatcaaatatgaccttattaaacaacgcaccagtttgccaaatcctgcggtgtatagtattgaaactgaactaagttttccttttgaagaaacgctgcttcctattgcaaaaagaagcctggtaaaatatctaacaccgactgcgtaa

SEQ ID NO: 3370 - protein, 185 aa, Unknown
  Obtained from environmental sample
  misc_feature (1)..(185): Xaa is any amino acid
MAFRENKKYLQDIFPKKLTGIQIEKLQLLYEQMIEDDELMQELEEIIMYSAEEMRTTISSGTEIYEFVEEKLSINPVGLIPLDMQEGYFFLSAGNSKATRVYHYRLSIFEKHDEKYRSIKTTYLDLMHRSIVNTYENIKYDLIKQRTSLPNPAVYSIETELSFPFEETLLPIAKRSLVKYLTPTA

SEQ ID NO: 3371 - DNA, 843 bp, Unknown
  Obtained from environmental sample
  misc_feature (1)..(843): n is a, c, g, or t
ttgaaagacctttgtttaccccaccaaaaatttataaaaagcnccatgagagtggtatcaaaatggcgctttgggaagaataactttgggctaaatcaagagaaacaccaccttggccctcacagcgattggttttgggatatggagcaagcaggaggcggatgcattttagacctcggttgtcattgtgtggaaataacccgcagttatattggtaaagacattaaacctattgaagtaatgtgctgggccgatacacaggtgaaacctatagatgctgaagaccatgctattgggctggtaaaatatgagaacggcgctatcggtcagtttgaagtgagctggacctttcgcggcggattagaccttcgtgatgaagtaatgggcagcgaaggaacgatttggaccaataattttttacgtacaggatttgaaatgttcacgacgggaaagggcggaaattatattgccgaaaaagcagagagtaatacaggctggttatttcctgtgggagatgaattaaatgaattaggttacaaccatatgttcatggatatgtttaactcgttggaagcaggtaaagctccaaaagaaactttttatgatggctatgtagtaaatgctgttttagatgccgcataccgttcagcaaaaagtaaactatgggagccggtgaagttagaaatatggagaggcagagaaggaataagcaaagacagccatttaatagagtatgatgcagaacattattttgtaaaagaggaagtaacgcattacggtgcaaaaaaaatgatcttaaaaaataaacaatcaggaaagattatagaaaaggtggtagaatag

SEQ ID NO: 3372 - protein, 280 aa, Unknown
  Obtained from environmental sample
  misc_feature (1)..(280): Xaa is any amino acid
MKDLCLPHQKFIKSXMRVVSKWRFGKNNFGLNQEKHHLGPHSDWFWDMEQAGGGCILDLGCHCVEITRSYIGKDIKPIEVMCWADTQVKPIDAEDHAIGLVKYENGAIGQFEVSWTFRGGLDLRDEVMGSEGTIWTNNFLRTGFEMFTTGKGGNYIAEKAESNTGWLFPVGDELNELGYNHMFMDMFNSLEAGKAPKETFYDGYVVNAVLDAAYRSAKSKLWEPVKLEIWRGREGISKDSHLIEYDAEHYFVKEEVTHYGAKKMILKNKQSGKIIEKVVE

SEQ ID NO: 3373 - DNA, 723 bp, Unknown
  Obtained from environmental sample
  misc_feature (1)..(723): n is a, c, g, or t
ttgcgtgtgctggggtttacagctatcaacgatattcgaatggtggataagaaaggtgttcagaaggcttctctgcaaagtaaaaccaggcaggatcgaaaagaaaattgtcgcagcatggaagtgttggagcaaaccgtgaccggggacatacttgataagaatggcaatttcaattattacaccggccagctttatgcaggcctcttcttcactaatggtaaggtgtgtggggaggataatattgtagcaggaagagaattttcgacaaagaatttaagtgggatggaaaagcataaggagcaacttaaaatgctcttcttcaatcccggaaaaaaaattaaagggattcctttcatcggggataaaacggcaatctttgatgaggatatggctgaccgttatgaatttaatattgatatggacgcttataataaaacaagttgttacgttttcgatataaaagctgtgaagaagggagtagtgatcgaccgcatgaccacatggttcaatgataagacatttgaaatagtagcgcggaagtattctatcagttacgacgcaggagtttacgactttgatgtacagatggaagtcgagatgacgagggtaggcgaactcctggtgccttctcttcttagatacaatggcaactggaaagccatcttcaaaaaaagagaacgtgggatatttactgctacgctcttcgattttaagttctaa

SEQ ID NO: 3374 - protein, 240 aa, Unknown
  Obtained from environmental sample
  misc_feature (1)..(240): Xaa is any amino acid
MRVLGFTAINDIRMVDKKGVQKASLQSKTRQDRKENCRSMEVLEQTVTGDILDKNGNFNYYTGQLYAGLFFTNGKVCGEDNIVAGREFSTKNLSGMEKHKEQLKMLFFNPGKKIKGIPFIGDKTAIFDEDMADRYEFNIDMDAYNKTSCYVFDIKAVKKGVVIDRMTTWFNDKTFEIVARKYSISYDAGVYDFDVQMEVEMTRVGELLVPSLLRYNGNWKAIFKKRERGIFTATLFDFKF

SEQ ID NO: 3375 - DNA, 573 bp, Unknown
  Obtained from environmental sample
  misc_feature (1)..(573): n is a, c, g, or t
gtgggcaaaagaaccaactgtgttcatgctttgtgtgatgaatatttaaggcgtgcttatcacggcatgagggctaaagacaactcatttaatgcagaaatcaaaagtgactttgatagttccatcggaaaaataaatgtagttccgcaggacatcggaagagtgttgttgaatttatacaacaacgcattttatgcaatgaacgaaaaatttaagcaacacccgaatgactatcagccatcaattttggtagctactgaaaaattaaataacgcaattaaattaacggttaaagataacgccaatggcataccgcaaaatattactgataaaatctttcagccattctttaccacaaaaccaacagggcaaggaacaggactagggttgagtttaagctatgatgttattaaagcacatgggggagaaattaaagtaaatactaaagaaggtgaatggagtgaattcgtaatccagtatatcctcaaaagcaaaaaatattgtgtaatcatgtataaaatcgacaaccgagggggaattcgtcaagacaccttacgatgtacaaaagagtaa

SEQ ID NO: 3376 - protein, 190 aa, Unknown
  Obtained from environmental sample
  DOMAIN (47)...(163): Histidine kinase-, DNA gyrase B-, and HSP90-like ATPase
  misc_feature (1)..(190): Xaa is any amino acid
MGKRTNCVHALCDEYLRRAYHGMRAKDNSFNAEIKSDFDSSIGKINVVPQDIGRVLLNLYNNAFYAMNEKFKQHPNDYQPSILVATEKLNNAIKLTVKDNANGIPQNITDKIFQPFFTTKPTGQGTGLGLSLSYDVIKAHGGEIKVNTKEGEWSEFVIQYILKSKKYCVIMYKIDNRGGIRQDTLRCTKE

SEQ ID NO: 3377 - DNA, 948 bp, Unknown
  Obtained from environmental sample
  misc_feature (1)..(948): n is a, c, g, or t
ttgatcgacaaaaaaagaaatttaatgctaatnancgagtcattagagttgtcaaactcgaaacttgaagctcaacaaaaagaattaaaattaaaaaataaagaattaagcgattatcaaaaggaaattgaaaaatctcaaaagaaatatatagaattatatgacttggctccaacgggatacctaacaataaataagcactcaagaatatttgaagttaatctaaaaggtgcaagattgcttgaagatgaccgttcacgtttgatcgattgtaattttaaagattttgtagatgatgaaatgggtaatattcttgattatttcctggatcagatttttgaaaataaaacttctacaggatgtgagattaagttaaaaacaaaaactggaaaatcagtttttgtttatctggaaggctctgtaggtgatgaaaagcccaaatgttttttatcaatggtagatataactgaacttaagatggcacaattagctcttaaagaatctgaagagttgtaccattcattattacgcacctctccggatggcattctaataactgatttaacgggaagaattacagaagcttctgatgttgcttatgagcttttaggaattaataaaaattcaactatcgaaaatttacatttcatccaatttataccaaaatcttcatttaaagaaatagttaaaatacaagatatcattaaacaagaaggtatagttcaaaatcttgaactaaaattaaaaagagaagataatagcgaatttatgggtgaaataagttgtactcaaataaaagaccaatatggtaaattaaaagcatatatgaccgatataagaaatatctcggaaagaaaattacttgaaaaacaaattaggcattctgaaagaatggccggtatcggagaattggcaactggtatggctcatgaaataaatcaaccttaa

SEQ ID NO: 3378 - protein, 315 aa, Unknown
  Obtained from environmental sample
  DOMAIN (170)...(234): PAS domain
  misc_feature (1)..(315): Xaa is any amino acid
MIDKKRNLMLXXESLELSNSKLEAQQKELKLKNKELSDYQKEIEKSQKKYIELYDLAPTGYLTINKHSRIFEVNLKGARLLEDDRSRLIDCNFKDFVDDEMGNILDYFLDQIFENKTSTGCEIKLKTKTGKSVFVYLEGSVGDEKPKCFLSMVDITELKMAQLALKESEELYHSLLRTSPDGILITDLTGRITEASDVAYELLGINKNSTIENLHFIQFIPKSSFKEIVKIQDIIKQEGIVQNLELKLKREDNSEFMGEISCTQIKDQYGKLKAYMTDIRNISERKLLEKQIRHSERMAGIGELATGMAHEINQP

SEQ ID NO: 3379 - DNA, 849 bp, Unknown
  Obtained from environmental sample
  misc_feature (1)..(849): n is a, c, g, or t
atgcctgatgatttttccaatttaaacgaagaacaaaagcttaaagctgaaaatgaattcctgaaaatgaaactcatgttggagcggagtgcatcttttggtactgacaatgatacagctttacccgctggtgtcgaaaatgaatttctgaattacatagaggagtttgaaaagcaatttgagcagcataaaacaattagtgtttttgaacgaatagaaaaaccaacaaaatttaaatcagtaaatgaaattccggattcagaaatagagcatgcttggaaagagctttcggattacctgaataaatatggtatcagtctcgatgtgtgcagtcccaatatttcaacaatggagttatatcggtttacaacagaagaattatttaaatatgaaatgaatcacatttccattcccggcatgatgaccaattttatttatgatgagttttatcctgatcccatctatgataattcaaggttggtcgaccagaacttattacatgacattttcagaaaagagaatctgttttatgaaatacattattcaaaagacggatttgtttttaatgagctgcaatacgatgactttaaaatatatagcgaaaagataaatcgggttaagtcattatttgatcaaatagaattagaggaatgtaatattgttgacagtacggtaaatgaaaaagagagtcgggtaattggcaagtacaaagccattgccaaaagcggaaatagcgaaacaatttttgccggagagnttcaggtaaaaactgttataagtgaattgggctactgggatatgaaagaaattcaaatcagcggaattaatccgggattaaaaatattttaa

SEQ ID NO: 3380 - protein, 282 aa, Unknown
  Obtained from environmental sample
  misc_feature (1)..(282): Xaa is any amino acid
MPDDFSNLNEEQKLKAENEFLKMKLMLERSASFGTDNDTALPAGVENEFLNYIEEFEKQFEQHKTISVFERIEKPTKFKSVNEIPDSEIEHAWKELSDYLNKYGISLDVCSPNISTMELYRFTTEELFKYEMNHISIPGMMTNFIYDEFYPDPIYDNSRLVDQNLLHDIFRKENLFYEIHYSKDGFVFNELQYDDFKIYSEKINRVKSLFDQIELEECNIVDSTVNEKESRVIGKYKAIAKSGNSETIFAGEXQVKTVISELGYWDMKEIQISGINPGLKIF

SEQ ID NO: 3381 - DNA, 825 bp, Unknown
  Obtained from environmental sample
  misc_feature (1)..(825): n is a, c, g, or t
ttgttcgcactcacgagatgcaattttcanaaaacacttgatggaataattaccagctggaacccggctgctgagcggatgtatggttattcagccaaagagatgattggtaaacatattagtatcattgttcctttagaattacggaaagatcttaagggtattttctctaagttaagaaagggtattcctattgagaattatgagacgattcgagttcgtaaagatgggatgcatttaaatgtatccatatcaatttcaccgatcaaaaataaagaaggtaaaatccttggtgcatcagtgattgcacgagatataagtgagcggaaacaagcatctgtcgatgaacaatttatggctcaggcgagtataatacttgcttcatcgcttgattacaataaaacattggaatctattgcaaaactagctgtgcctaatttagctgattggtgtggtattgatctccttaatgaaaatggagagattaatcaggtggttgttgcgcatgtagatccaaagaaagttgagtgggcaagggaactacgtaaaaaaaccccggttgatcttaatcaggacacaggaattgcaaaagttttaaaaacagggaagtcagaattttacccatatattagtgatgaggtcataaagatgactaattctgatccaaaacagctaaagcttattaaaagattaggattacgttctgcaattattgtacctcttattataagaaataagccgattggcacgatcacttttatttcgaccaatgaagcgaatctctataatgaaagaaggcttgccataggccgaagatctggctag

SEQ ID NO: 3382 - protein, 274 aa, Unknown
  Obtained from environmental sample
  DOMAIN (67)...(109): PAC motif
  misc_feature (1)..(274): Xaa is any amino acid
MFALTRCNFXKTLDGIITSWNPAAERMYGYSAKEMIGKHISIIVPLELRKDLKGIFSKLRKGIPIENYETIRVRKDGMHLNVSISISPIKNKEGKILGASVIARDISERKQASVDEQFMAQASIILASSLDYNKTLESIAKLAVPNLADWCGIDLLNENGEINQVVVAHVDPKKVEWARELRKKTPVDLNQDTGIAKVLKTGKSEFYPYISDEVIKMTNSDPKQLKLIKRLGLRSAIIVPLIIRNKPIGTITFISTNEANLYNERRLAIGRRSG

SEQ ID NO: 3383 - DNA, 540 bp, Unknown
  Obtained from environmental sample
  misc_feature (1)..(540): n is a, c, g, or t
ttgcttttcctaacaacagcgggacagaaaatattttctacaaaagggttagaaaaaattggcaacaactatggtattgactctgccctgaaaaccgcaaatccatttacagaaatttttcaaattgacactgcatttgctctttcagttgctctcaaatgtgatgatttaaaaaactattccaggcagttcactttctttacaacgataggacaggttataaaagacaagaggattaactcaaaagcagccaataatttaaagacatatgaaaatctactttcttacacaacaaagccgcaattcaaagcgattgtaattccagatgaaatatttcatgtattggtttttcaaaacggtaattccgttattcctgatttaaaaactgaatacattttttgggaaagaaacgcagatagcataagaaatacttatccttccaaaataaaaagattttttcaaagattaaaagaacaccaccctccgaacaattatttagcgactgtaaagagaacagctacaaacttgcctggacattaa

SEQ ID NO: 3384 - protein, 179 aa, Unknown
  Obtained from environmental sample
  misc_feature (1)..(179): Xaa is any amino acid
MLFLTTAGQKIFSTKGLEKIGNNYGIDSALKTANPFTEIFQIDTAFALSVALKCDDLKNYSRQFTFFTTIGQVIKDKRINSKAANNLKTYENLLSYTTKPQFKAIVIPDEIFHVLVFQNGNSVIPDLKTEYIFWERNADSIRNTYPSKIKRFFQRLKEHHPPNNYLATVKRTATNLPGH

SEQ ID NO: 3385 - DNA, 552 bp, Unknown
  Obtained from environmental sample
  misc_feature (1)..(552): n is a, c, g, or t
gtgaaacaggatcgactcaatattgcactcgtcggcaatcccaactgcgggaaaagctcgattttcaactgtcttacaggtttgaaccagcaggttggtaatttcccgggggttacagttgataaaaaaattggctttacccggatcactccaaaaaacaacgcagctgttattgatctgccgggcacatatagcctgtacccgggacgcgaagatgaatgggtcagttacaaagttttactcgggcaggataaaaacatcaggcccgatgtggtagttgtggtagctgacgcgagcagcctcaagcgcaacctgttgttctgcacccagatcatcgacctcaaaattcccgtagttatcgcccttacgatgatggaccttgccaaacggaagggaatcaaaatagacatacccgcacttgaaagagagcttggcgttccagtagtggcagtcaatccgcggaaaaacaaaggtattattcaattaaaaaaagcgcttgagcttaccattgaaaagcagtaccannggtacctgttccgtgnattttattga

SEQ ID NO: 3386 - protein, 183 aa, Unknown
  Obtained from environmental sample
  DOMAIN (10)...(183): Ferrous iron transport protein B
  misc_feature (1)..(183): Xaa is any amino acid
MKQDRLNIALVGNPNCGKSSIFNCLTGLNQQVGNFPGVTVDKKIGFTRITPKNNAAVIDLPGTYSLYPGREDEWVSYKVLLGQDKNIRPDVVVVVADASSLKRNLLFCTQIIDLKIPVVIALTMMDLAKRKGIKIDIPALERELGVPVVAVNPRKNKGIIQLKKALELTIEKQYXXYLFRXFY

SEQ ID NO: 3387 - DNA, 468 bp, Unknown
  Obtained from environmental sample
  misc_feature (1)..(468): n is a, c, g, or t
atggcatttccaacatttacttttgcgcaatcgctgcaaaaaataaagcaatactgtgcttaccaggaacggtgccattcagaggtgcgtgataaattatattcatttgggctgcaccaatcagaagtggaagaaatgatcagccaattaattgttgaaaactatttgaatgaagaacgcttcgccattcattatgccggtggaaaattcagaatgaaacaatggggtaaaaataaaataaagcaagccctaaagctgaaaagagtaagcgactattgcatcaataaagccttgaaggatattgatacaaaagaatacgaaagaacgtttcaaaagctaaccgaacagaaattgaaaacactgaaaagcgaaaagaatatttttattaaaaaaagaaagttgcaggattttttattgcagaaggggtatgaaagtgagcggataagaaaggctgtaaacgggatttag

SEQ ID NO: 3388 - protein, 155 aa, Unknown
  Obtained from environmental sample
  DOMAIN (33)...(151): RecX family
  misc_feature (1)..(155): Xaa is any amino acid
MAFPTFTFAQSLQKIKQYCAYQERCHSEVRDKLYSFGLHQSEVEEMISQLIVENYLNEERFAIHYAGGKFRMKQWGKNKIKQALKLKRVSDYCINKALKDIDTKEYERTFQKLTEQKLKTLKSEKNIFIKKRKLQDFLLQKGYESERIRKAVNGI

SEQ ID NO: 3389 - DNA, 477 bp, Unknown
  Obtained from environmental sample
  misc_feature (1)..(477): n is a, c, g, or t
atgagcaaagtgtacgaacccaaggagttgaagcgggctattcaaaaagcgtttgaagaggacgaccaggtgctcgttgagcaaatgataaaaggaagggaatttacaatcggcgtgttcaaaacgaaaggcaacattgttacactgccgatcacagaagtgataagcaacaaagatttttttgactacgaggcaaaatatgaaggggcatccactgaagtgacccctgcagaattggatgaggtatcagcagataaaataagggatgccgcaaaaaagatatactcggtttttaattgcaggggagtagtgcgtatagattttattctcgacaacgattcgggtcatccatttatgcttgagataaatacgatcccggggcaaagtgaagcaagcattgtaccgcagcaggtgaaagcgatggggtggagtctgaaggaattttataccaagctcgttgaagaatgttttaattag

SEQ ID NO: 3390 - protein, 158 aa, Unknown
  Obtained from environmental sample
  DOMAIN (1)...(154): D-ala D-ala ligase C-terminus
  misc_feature (1)..(158): Xaa is any amino acid
MSKVYEPKELKRAIQKAFEEDDQVLVEQMIKGREFTIGVFKTKGNIVTLPITEVISNKDFFDYEAKYEGASTEVTPAELDEVSADKIRDAAKKIYSVFNCRGVVRIDFILDNDSGHPFMLEINTIPGQSEASIVPQQVKAMGWSLKEFYTKLVEECFN

SEQ ID NO: 3391 - DNA, 864 bp, Unknown
  Obtained from environmental sample
  misc_feature (1)..(864): n is a, c, g, or t
gtggcaggaaaccaaacaaaaagccagtttgataatcccctgtttattcctgaatttactgatacagcggccagcaacatcgcaagtcaatttttggatgagcaaaagcttattaactgggcctcgtcctatacgattcaaccatcagttgcaaaaaaaattggtatcgtaatggccggtaatattccgctggttggttttcacgattttctttgcgtttttatttcggggcataaagcaattataaaggcctcctcaaaagacgaagtgctgataaaacacctcgtgcaaaaactgaaagagtggaatagcgaaatcattgaattggcagtctttcaggaaatgctgaaagattgtgacgcctatattgcaacgggtagcaataactccgcacgatattttgaatattacttcagtaaatatgcgcatatcattcgccgaaaccggacatcagtagctgttctcgatggcagtgaaagcaccggagaactcgaacggctagccgatgacgttcaccttttttttggaatgggttgccgcaatgttaccaagatattcatcccaaaggaatatgattttgttcccctgctttctgcttttaaaaaatatgattatttcaaggaccaccacaaattcaaaaacaactacgattattatcttgccttgcatatgctcaatggcaaattttacatgaccaacgagtcaataattttagtggaaaatagttccatcttctctcctatcagccaattgaattatgaattttatgcacataaaaacgccctggaggatacgttaacatcccttaaaaatcttcaatgttccgttggtcatggatatattccatcgggaaggctcatctga

SEQ ID NO: 3392 - protein, 287 aa, Unknown
  Obtained from environmental sample
  misc_feature (1)..(287): Xaa is any amino acid
MAGNQTKSQFDNPLFIPEFTDTAASNIASQFLDEQKLINWASSYTIQPSVAKKIGIVMAGNIPLVGFHDFLCVFISGHKAIIKASSKDEVLIKHLVQKLKEWNSEIIELAVFQEMLKDCDAYIATGSNNSARYFEYYFSKYAHIIRRNRTSVAVLDGSESTGELERLADDVHLFFGMGCRNVTKIFIPKEYDFVPLLSAFKKYDYFKDHHKFKNNYDYYLALHMLNGKFYMTNESIILVENSSIFSPISQLNYEFYAHKNALEDTLTSLKNLQCSVGHGYIPSGRLI

SEQ ID NO: 3393 - DNA, 315 bp, Unknown
  Obtained from environmental sample
  misc_feature (1)..(315): n is a, c, g, or t
ttgaatcgtataggacgaggcccagttaataagcttttgctcatccaaaaattgacttgcgatgttgctggccgctgtatcagtaaattcaggaataaacaggggattatcaaactggctttttgtttggtttcctgccactcagagccattggctaaaatatattcaccaagttgtgctgcccgtccgattctcatttgtaaattcatttcagcggtatatatttgtcgaacaaaattaagtctcaacccgttaaataaaattttatggctatcagaattacagaagaatgtatttacttgtggaccctggtga

SEQ ID NO: 3394 - protein, 104 aa, Unknown
  Obtained from environmental sample
  misc_feature (1)..(104): Xaa is any amino acid
MNRIGRGPVNKLLLIQKLTCDVAGRCISKFRNKQGIIKLAFCLVSCHSEPLAKIYSPSCAARPILICKFISAVYICRTKLSLNPLNKILWLSELQKNVFTCGPW

SEQ ID NO: 3395 - DNA, 648 bp, Unknown
  Obtained from environmental sample
  misc_feature (1)..(648): n is a, c, g, or t
gtggagagcaagtctatggccagaaaaaacttaacaagtgtcattaccggcgacctaatcaattctcggaagataaaaaaaccttcacaatggttagcgccgttaaaaaaagcgctgcgtacggaaggcaaaacaccacaaatctgggagatttacagaggcgacagcttccaggtggagatcaaaaatccggccgatgcctttctcatggccatacggataaaagccacgatcaaatgcattaaaaacctggacgttcgcatggccatcggcattggcacaaaagaatttacgggctcaaaactaaccgaatcgaacggagaggcttttatatattcaggcgaaaaactggaaagcattaaaaaggaaaaatacacgctggccctaaaaacaccctgggtggatttcgacaaggaaatgaacctatgcattcgcctagccctgatcgccatggacaactggagccgtggctccgctgaattgattactgtattaattgaccgccaggatacaactcaaaaaaaattagcgggcatcctgggcatctatcagtcgtccgtgagcgaacgacaaaaaagagcccattataccgagatcatggaattggaaagtctgtatcgcgagagaatcaaccgcttaatgctgtaa

SEQ ID NO: 3396 - protein, 215 aa, Unknown
  Obtained from environmental sample
  misc_feature (1)..(215): Xaa is any amino acid
MESKSMARKNLTSVITGDLINSRKIKKPSQWLAPLKKALRTEGKTPQIWEIYRGDSFQVEIKNPADAFLMAIRIKATIKCIKNLDVRMAIGIGTKEFTGSKLTESNGEAFIYSGEKLESIKKEKYTLALKTPWVDFDKEMNLCIRLALIAMDNWSRGSAELITVLIDRQDTTQKKLAGILGIYQSSVSERQKRAHYTEIMELESLYRERINRLML

SEQ ID NO: 3397 - DNA, 336 bp, Unknown
  Obtained from environmental sample
  misc_feature (1)..(336): n is a, c, g, or t
atggaggaatcgatgcgactgttcgttctgctctttttaattttcccggtggtggccatggcatatgaagaaaaatctgatgatcataactttttgcagcttggaatcataaccaagaaagaaatcttggcaggacgcaaaatttacaatcaaaattatgtagattatgttcctaaatcggatccggttcaggcaattcacaactgctcacaaccngtggaaataaaggtcatttttggcgattggtgcaaagacagcaaaaagcatattcctgcatttcatcagacgatggattttgcggaacataaagcgattcaaattgttacattcacgtag

SEQ ID NO: 3398 - protein, 111 aa, Unknown
  Obtained from environmental sample
  SIGNAL (1)...(19)
  misc_feature (1)..(111): Xaa is any amino acid
MEESMRLFVLLFLIFPVVAMAYEEKSDDHNFLQLGIITKKEILAGRKIYNQNYVDYVPKSDPVQAIHNCSQPVEIKVIFGDWCKDSKKHIPAFHQTMDFAEHKAIQIVTFT

SEQ ID NO: 3399 - DNA, 693 bp, Unknown
  Obtained from environmental sample
  misc_feature (1)..(693): n is a, c, g, or t
gtggataaggctaaactcatagggtatttaacagattttatcagcgaaaggcgtaggcaacgctttgacgaggtaatgaaacacagaatgagccaccttcaaattgtggtggaggatctttttcaaggtcataatgccagcgctgttttacgtagttgcgattgttttggtgtgcaatacgttcattttattgagaataagtttaaaatgaaggtgaataatgatgttgctttaggcgctgagggttgggtaagtattaaaaagtataatggcgaagaaaataatacgcgcgcatgcttacagaagttaaaggatgaaggttttagaattgtggccacaacaccgcataccaatagcatgaccattgataagatcccaatagataaaaaaattgcattggtgtttggtacagaattagaaggcatttcaaaggatgtagaaaaaatggctgacgaatttgtaaagatccctatgtatggttttaccgaaagtttcaatatcagtgtcagcgcagcactgtgcatgtacgaattaactacaccgcatcgtaaggatgttgagaactaccggctaagtgaagagaaaagactgaatatttacttggatgggctcatgaacagtattgaaatgaacgaaaaaatagggagtgattttaaagaaaaaaaaaatgatctttcttttaagaaattttaa

SEQ ID NO: 3400 - protein, 230 aa, Unknown
  Obtained from environmental sample
  DOMAIN (32)...(176): SpoU rRNA Methylase family
  misc_feature (1)..(230): Xaa is any amino acid
MDKAKLIGYLTDFISERRRQRFDEVMKHRMSHLQIVVEDLFQGHNASAVLRSCDCFGVQYVHFIENKFKMKVNNDVALGAEGWVSIKKYNGEENNTRACLQKLKDEGFRIVATTPHTNSMTIDKIPIDKKIALVFGTELEGISKDVEKMADEFVKIPMYGFTESFNISVSAALCMYELTTPHRKDVENYRLSEEKRLNIYLDGLMNSIEMNEKIGSDFKEKKNDLSFKKF

SEQ ID NO: 3401 - DNA, 447 bp, Unknown
  Obtained from environmental sample
  misc_feature (1)..(447): n is a, c, g, or t
atgatctgttcggagctaaatgaactcctgaaccctgaaaaagtgatcattatctcaagtgctaaaaatagaagtgaactgcccgtgcgctatcgttttcaaaagtatatcccagtttacgctttgttccctggaaagctgttgcattggggtgctaaactcatgcagcctttagtagaacctgacagaaataagaataaagaagcgttcaaagccatgttgtatgctaaagatcccatttacctaaagcggaccataggaatgatcataaattgggataacaggaaaaattctaagaagatctatcatatccatggcaccaaagatcatacccttccttatagaaagatcaaacatgttgatcataccattaaaaaaggctcgcatatgatgaccttaacacgcgccgatgaattaagcgctgtattaaatgtactgctgaagtaa

SEQ ID NO: 3402 - protein, 148 aa, Unknown
  Obtained from environmental sample
  misc_feature (1)..(148): Xaa is any amino acid
MICSELNELLNPEKVIIISSAKNRSELPVRYRFQKYIPVYALFPGKLLHWGAKLMQPLVEPDRNKNKEAFKAMLYAKDPIYLKRTIGMIINWDNRKNSKKIYHIHGTKDHTLPYRKIKHVDHTIKKGSHMMTLTRADELSAVLNVLLK

SEQ ID NO: 3403 - DNA, 426 bp, Unknown
  Obtained from environmental sample
  misc_feature (1)..(426): n is a, c, g, or t
ttgtatgtgagaaaccactttaagaagatattttccggagaaattcatgaaccgctgttcaagaaagcgtacgaaagaacaaaaaatcatagtaaaataaaattgttccttggaaatactgaagaaatgcttcgtaaaattaaacctgatattgaaggtcggtgtttgttttggcttgatgctcactattccggtaatggcactggaagaggcgccaccgaatgcccgatcgttgaagagttgaaaattattaaatcgtactcgcgaaacgaccacgtgatactgattgatgacgctagggaattcaaaggacaaaacgattatcctccaatttttacagtgcttgaactgatctacgagatcaatccgaactatcaaattgaaataaaaaacgattgcattattgcaacgcctcacaatgaataa

SEQ ID NO: 3404 - protein, 141 aa, Unknown
  Obtained from environmental sample
  misc_feature (1)..(141): Xaa is any amino acid
MYVRNHFKKIFSGEIHEPLFKKAYERTKNHSKIKLFLGNTEEMLRKIKPDIEGRCLFWLDAHYSGNGTGRGATECPIVEELKIIKSYSRNDHVILIDDAREFKGQNDYPPIFTVLELIYEINPNYQIEIKNDCIIATPHNE

SEQ ID NO: 3405 - DNA, 570 bp, Unknown
  Obtained from environmental sample
  misc_feature (1)..(570): n is a, c, g, or t
atgataaaaaaaggattaagcctgctgagaggcatcttatcacccagtataacttggaaaggtaattatggaagttggaaagaagccaaggccgcatccaaaggctataacgacgacttgattttcaataaggttaaaagtgccgctttggaagtacgcgataaagaagattcttttgaaagggacggctttgtattcaatagaataacagttaatccgttttttttaagcgctgtatatcgtataaaagctaaagagaagaaagcaacattgaacgtacttgattttggcggttctttgggaagtgtttataaacagcataagaaatatctagacttatttagttccataaaatggtcggtcattgaacaacataaatttgttgaaataggtaatacaaactttaagcacaataatcttttcttttacagcaaaatatcagagtttaccgtcgaacaaggcactcctgacctgatccttatttccagcacgcttcaatacttagaagccccctattctattttgaaagaacttatagccttaggatcgaaatatctgattatgatctaa

SEQ ID NO: 3406 - protein, 189 aa, Unknown
  Obtained from environmental sample
  SIGNAL (1)...(20)
  misc_feature (1)..(189): Xaa is any amino acid
MIKKGLSLLRGILSPSITWKGNYGSWKEAKAASKGYNDDLIFNKVKSAALEVRDKEDSFERDGFVFNRITVNPFFLSAVYRIKAKEKKATLNVLDFGGSLGSVYKQHKKYLDLFSSIKWSVIEQHKFVEIGNTNFKHNNLFFYSKISEFTVEQGTPDLILISSTLQYLEAPYSILKELIALGSKYLIMI

SEQ ID NO: 3407 - DNA, 804 bp, Unknown
  Obtained from environmental sample
  misc_feature (1)..(804): n is a, c, g, or t
ttgtactatgcatctttagccatgaaacataaccctaatcataataaaaaggattcaaaaatccctggtgaggaatcgaaaataaatacagttatcccatcacctacacaaacttttttaccgtctattacgtcgttaaagtttcctttcagtttaaaggatgatcagttagcagcagtcaacgcctggatggaaaataacaataggggaactattctctacagtacaggaacagggaaaactgaaatcgcatttgaatgtgccagaagactagtgggtcaactcctctcgcacaaaaggagaggatccccatcgcaaatggctgaagtgtactccaccgatttgatatcaaatgacgataaaaatgccacttctgtttctaaacagtttgaaactaatgtagagcccattagcaaaaaagataccatgtctttttcatttttcaatattttgtttttggtaccacggatatccttaatagatcaaactctaaatagattaatttcatatggcatccctaaagagaaagttggggtgtattttggagaacgaaaagaaaaaaaggaaataatgatatgcacttaccatagtgtattaagaaacccactactagttcgacgttctaatatggtgatatttgatgaagtgcatttgataagagacacttcaaaatcattcattaaaatatttgatattgtaatcgaagattcaaaaaaggcaatcttaggtcttactgccactttagatgagagagatttaaaaacagcactatactgcaatataccgccagaaaaagaatcataa

SEQ ID NO: 3408 - protein, 267 aa, Unknown
  Obtained from environmental sample
  DOMAIN (52)...(256): DEAD/DEAH box helicase
  misc_feature (1)..(267): Xaa is any amino acid
MYYASLAMKHNPNHNKKDSKIPGEESKINTVIPSPTQTFLPSITSLKFPFSLKDDQLAAVNAWMENNNRGTILYSTGTGKTEIAFECARRLVGQLLSHKRRGSPSQMAEVYSTDLISNDDKNATSVSKQFETNVEPISKKDTMSFSFFNILFLVPRISLIDQTLNRLISYGIPKEKVGVYFGERKEKKEIMICTYHSVLRNPLLVRRSNMVIFDEVHLIRDTSKSFIKIFDIVIEDSKKAILGLTATLDERDLKTALYCNIPPEKES

SEQ ID NO: 3409 - DNA, 345 bp, Unknown
  Obtained from environmental sample
  misc_feature (1)..(345): n is a, c, g, or t
atggggatctatcaaaacatagatacgcagacggtaggtaaagaaacagataatattttcgaaatagatttccataatatcaaaaaggcttctttaatcttacggtcattaaatcacaagcttcgtcagcaaattctgagaataatttacgaagaaaaaaagattacagttactgaaatttatgttaagcttcgcctggaacaatctgttgcctctcaacacctggcaattttacgaaaggcaggcattgtcagcacacagcgtgatgggaagtttatttattacaccattaacagtcagcgggtggaagctatagagaagtttgtgaaagatctggtggggtaa

SEQ ID NO: 3410 - protein, 114 aa, Unknown
  Obtained from environmental sample
  DOMAIN (34)...(112): Bacterial regulatory protein, arsR family
  misc_feature (1)..(114): Xaa is any amino acid
MGIYQNIDTQTVGKETDNIFEIDFHNIKKASLILRSLNHKLRQQILRIIYEEKKITVTEIYVKLRLEQSVASQHLAILRKAGIVSTQRDGKFIYYTINSQRVEAIEKFVKDLVG

SEQ ID NO: 3411 - DNA, 510 bp, Unknown
  Obtained from environmental sample
  misc_feature (1)..(510): n is a, c, g, or t
atgagcttaattaggggtataaaaataaaaagaataattaaaaaattatttataatttataaaacaaaaaataagttcaataagatgaacgtacaacaacaaatcaaagattatattgcaagccagcctgaaccaaaacgcagtgatatggaagagctgcatctcttcattttgcaaataatgccaaaatgcaaactatggttcctggatgggaaaaatagtgaaggtaaaactgtttctaatcccaatataggatatggagcttacacgataaaatatgctgacggaaaaacaagggaattttatcaaatcggtatgagcgcaaacacaagcggaatatctgtatatattcttggtctagatgataagaaatacttaagcgaaacgtatgcaaaaaaaattggcaaggcgagcgtaaagcgatattgcatcaagttcaaatctctgaaagatatcaacatggatatactggaagaagcaataagatatggagtagaagcccagaaatga

SEQ ID NO: 3412 - protein, 169 aa, Unknown
  Obtained from environmental sample
  misc_feature (1)..(169): Xaa is any amino acid
MSLIRGIKIKRIIKKLFIIYKTKNKFNKMNVQQQIKDYIASQPEPKRSDMEELHLFILQIMPKCKLWFLDGKNSEGKTVSNPNIGYGAYTIKYADGKTREFYQIGMSANTSGISVYILGLDDKKYLSETYAKKIGKASVKRYCIKFKSLKDINMDILEEAIRYGVEAQK

SEQ ID NO: 3413 - DNA, 702 bp, Unknown
  Obtained from environmental sample
  misc_feature (1)..(702): n is a, c, g, or t
atggcaatgggcattccgttatctggttaccgcaaaatggaattgaaccccgtttaccattacgatgtggcaatagctggcggcggcctggccggactttcgttatctattcttttagcacggcaaggtgtaaaaactattttgtttgaaaagaacaaatacccgtttcatcgtgtttgcggtgaatatatttccatggaagcagtgcctttcctgcagaaattaggggtcaacacaaatgccatgaaattgccggtcataaaaaaactcgtggtctcctccccttccgggaaaacgattacaaccggcatgcaaacaggaggcatcgggattagcaggtacctgcttgatgatacgctaaaaaatattgcattaaactcaggagttactgtgatagagggtaccgctgtagaaaatatcacttatgaaaatgataacatgatcatttcagtacgggataacaggtacactgcaaaagtagccgcaggtgcattcggcaaaaaatcaaaactggatctccagcttaaccgtgaaacagatccgtcaaaggacccatcaggaaattacgtgggcatcaaatatcacgtggagggcgatcttccgaaggataccatcggtttacataattttaaaaacngggtattgcgggatctcagctgtggaagacaacaggtactgcctgtgctatcttacaacagctga

SEQ ID NO: 3414 - protein, 233 aa, Unknown
  Obtained from environmental sample
  DOMAIN (23)...(151): FAD binding domain
  misc_feature (1)..(233): Xaa is any amino acid
MAMGIPLSGYRKMELNPVYHYDVAIAGGGLAGLSLSILLARQGVKTILFEKNKYPFHRVCGEYISMEAVPFLQKLGVNTNAMKLPVIKKLVVSSPSGKTITTGMQTGGIGISRYLLDDTLKNIALNSGVTVIEGTAVENITYENDNMIISVRDNRYTAKVAAGAFGKKSKLDLQLNRETDPSKDPSGNYVGIKYHVEGDLPKDTIGLHNFKNXVLRDLSCGRQQVLPVLSYNS

SEQ ID NO: 3415 - DNA, 540 bp, Unknown
  Obtained from environmental sample
  misc_feature (1)..(540): n is a, c, g, or t
atgactttcgcaaaacgtttacggtattacatcattggtttcggtatgggcattgtggtatgctttgccatttttggtcagcgtggttgtgactggacacccagtaaccgagtattgaaacaaatcgccacttccgaaattctgatcaccgattcggttcggtgtattttagctgagaataatattgaagaagatgaaatttataaaacgctgaacaatggttcggttattttcagcgaaagtgaaacacaaaaagttcccaagtattatgttttggaagatcctaccgaacgttttaaagtaggttttgttgtgcgtaacgataccgtgagcgtaattgatggagtaatgggtggtaaaataggaaaatgcaaaggttttggcatggaccccgaaaatattttttacctggcccgaaaaaccggtaaaacgtttgctaaaagcgcaggagaacaatgcctgccaaatacgtattggcccaatttaaaaaagcttaacctccaggacggggaaatttccaacatgaaccgaaagcggtaa

SEQ ID NO: 3416 - protein, 179 aa, Unknown
  Obtained from environmental sample
  misc_feature (1)..(179): Xaa is any amino acid
MTFAKRLRYYIIGFGMGIVVCFAIFGQRGCDWTPSNRVLKQIATSEILITDSVRCILAENNIEEDEIYKTLNNGSVIFSESETQKVPKYYVLEDPTERFKVGFVVRNDTVSVIDGVMGGKIGKCKGFGMDPENIFYLARKTGKTFAKSAGEQCLPNTYWPNLKKLNLQDGEISNMNRKR

SEQ ID NO: 3417 - DNA, 360 bp, Unknown
  Obtained from environmental sample
  misc_feature (1)..(360): n is a, c, g, or t
gtgattttcttctatattcgcaaaagcatgattgcaaagaatacgatacagcagatactgaacaggcttgacattgttgaggttataggcggattcgtgaaacttaaaaaacgcggcagcaattacctgggtctttgccctttccataacgagaaaacaccatcttttactgtttcccctgccaaagaattatttaaatgttttggctgcgggaaaagtggcaataccattagctttctaatggagcatgagaagtatagttatgtagaaccgctaaaatggctggccactaaatatgggattgagatcgaaaaaatataccagtcggatgaacagaaacaaaccccgcttgttggctga

SEQ ID NO: 3418 - protein, 119 aa, Unknown
  Obtained from environmental sample
  DOMAIN (11)...(108): CHC2 zinc finger
  misc_feature (1)..(119): Xaa is any amino acid
MIFFYIRKSMIAKNTIQQILNRLDIVEVIGGFVKLKKRGSNYLGLCPFHNEKTPSFTVSPAKELFKCFGCGKSGNTISFLMEHEKYSYVEPLKWLATKYGIEIEKIYQSDEQKQTPLVG

SEQ ID NO: 3419 - DNA, 732 bp, Unknown
  Obtained from environmental sample
  misc_feature (1)..(732): n is a, c, g, or t
atgtacatagccccctctaaactactcgatcgcatttacgtccttaacgtcaaaaaatttaccgagcgccgggctttcatggaaaagcaactcgctaaaacaggattgcaggcggaatttatttttgattgggatgccgatgagttgaacgatgagataatcgaccggtatttttcgaaaaataacaaattatcagtcgcgcaaaaatcctgtgctctcaaacatattaccgctttacgaaaaattacggaaagtaacggcagattcaatttgattttagaagatgatgccgttcttgcgaaagagtttggtttaggcttacaacgcgcattagcacaaagcgagcagtttttggaaaacaaagttatttatataggttcaggagggaatttttttacgccgaaaagccagcgaagaccagggcaatatctatatcttggtacacgcggtcgatttacagattcctatattgtcgatagtgccaccgcacaaaaaaggttggattggatcattacccataaagtcagtgaacccattgataatcaatttgataaaatcgataagcaattaggtatcaaaatactgtggctagaagaccctattgttgagcaaggcagtaaaaatggtttgtttgacagtgccatagagtcagccccgccaacttggttacaaaggctgcgttttaactttgaaaagttaaagcgaanatatatctatcaactatggcgttaa

SEQ ID NO: 3420 - protein, 243 aa, Unknown
  Obtained from environmental sample
  DOMAIN (9)...(179): Glycosyltransferase family 25 (LPS biosynthesis protein)
  misc_feature (1)..(243): Xaa is any amino acid
MYIAPSKLLDRIYVLNVKKFTERRAFMEKQLAKTGLQAEFIFDWDADELNDEIIDRYFSKNNKLSVAQKSCALKHITALRKITESNGRFNLILEDDAVLAKEFGLGLQRALAQSEQFLENKVIYIGSGGNFFTPKSQRRPGQYLYLGTRGRFTDSYIVDSATAQKRLDWIITHKVSEPIDNQFDKIDKQLGIKILWLEDPIVEQGSKNGLFDSAIESAPPTWLQRLRFNFEKLKRXYIYQLWR

SEQ ID NO: 3421 - DNA, 540 bp, Unknown
  Obtained from environmental sample
  misc_feature (1)..(540): n is a, c, g, or t
ttgagtggagacttactttcttcctatccttttggtaatttgtcaaatattattccatccaaaaccagtattgcctctatgaacagaatctaccttatgctcgcatttgtcagtgtggtaattccctcaatgagtcaaaattcgtcgcgcccaaatctcagcaaactaaactggatacaaggtacctggataagcaccaaccctaaaccagggcgtacattgcaggaacattgggacaagttttcggatgaagaattacgaggatacagtgtatctatgaagggaactgataccctttcttttgaaaaaatgaaaattctgatgaaggataacgagctctactttgtggctgacgtaccagaaaataaaaagttaatctacttcaggctagtcgaaataaatgaaagcggtttcgtctgcgagaatccagatcatgattttccaaaacggataagctattcagtcaatgaaagtaaactaaaggccacaatttcaggaaacggaaaatctattgactacctcttcgagcgaaataaatga

SEQ ID NO: 3422 - protein, 179 aa, Unknown
  Obtained from environmental sample
  misc_feature (1)..(179): Xaa is any amino acid
MSGDLLSSYPFGNLSNIIPSKTSIASMNRIYLMLAFVSVVIPSMSQNSSRPNLSKLNWIQGTWISTNPKPGRTLQEHWDKFSDEELRGYSVSMKGTDTLSFEKMKILMKDNELYFVADVPENKKLIYFRLVEINESGFVCENPDHDFPKRISYSVNESKLKATISGNGKSIDYLFERNK

SEQ ID NO: 3423 - DNA, 951 bp, Unknown
  Obtained from environmental sample
  misc_feature (1)..(951): n is a, c, g, or t
ttggggggcccatggtactcaaaggtaatccggcatccctactttcatttcagtagttcaataggaatggcaaaagcttacaatttgcctaaattattaaattctaaagactatctggcagtgagaaatgccgcgataaaaaacgcgaatactttaagggagccggttcgccaattggatacaattccgactgatgtcctcgatacactaccggatattgactggctcgaccaggttttcagaacagcccctattcagaaatatggtctgagtgcaagtggtggaagtgaaaacagtaaatattatatcacaggagaatatctcaatcaggatggaacctataaaggtcagggctttaaaaaatacagtgtcagattcaatggagaaaccggaagtaaatggttcaaaattggaaataatatctcctatgctttcactgaccgccaggttagtaatagtaccggagacggctttggtccaggcaatgagttgagcgggatcagatatgcgctgattgcagcccccgtattcaagccttacaaacctgacggatcttattataatgtctcgtcagaattaggtgatcctacacttttcggtgatggtaatgccaatcctctggccctgatcgatgcaactaactggaatattcaaaggtcaaggatctttggtaacatctatgcagaactgactttattaaaatcgatcaagataaagacaaacctgggaggtgatttcacatttgaaaatgaaaagaaatttaaaaggaaattatcggaagccatttacaatcctacttcactatctgagggcagggtttttagcagaaaccttatctggacaaatacagcagactacgaaaagcgggttggcaaaagcaggatttccggtttgatcggaatggaaacgattgaaaacaggggaccatttcctgggagcttctgtaaataa

SEQ ID NO: 3424 - protein, 316 aa, Unknown
  Obtained from environmental sample
  misc_feature (1)..(316): Xaa is any amino acid
MGGPWYSKVIRHPYFHFSSSIGMAKAYNLPKLLNSKDYLAVRNAAIKNANTLREPVRQLDTIPTDVLDTLPDIDWLDQVFRTAPIQKYGLSASGGSENSKYYITGEYLNQDGTYKGQGFKKYSVRFNGETGSKWFKIGNNISYAFTDRQVSNSTGDGFGPGNELSGIRYALIAAPVFKPYKPDGSYYNVSSELGDPTLFGDGNANPLALIDATNWNIQRSRIFGNIYAELTLLKSIKIKTNLGGDFTFENEKKFKRKLSEAIYNPTSLSEGRVFSRNLIWTNTADYEKRVGKSRISGLIGMETIENRGPFPGSFCK

SEQ ID NO: 3425 - DNA, 678 bp, Unknown
  Obtained from environmental sample
  misc_feature (1)..(678): n is a, c, g, or t
atgaaaattttgattgtagaagacgagaaagaattatcgcaaagtatttgcacttatttaagcgacgaacagtttaggtgcgagcaggctttcgattatcctactgcaatagaaaaaatttcattgtatgattatgcctgtattgtcttagatataacgctgactggcggaagtggaatggatattttgaaagaattgaaaaaggaaaacaaactggatggcgtattgatcatttctgcgaaaaattctcttgacgataaagtgcatggactcaaagcgggagcggatgattatctcacgaagccgtttcatcttcctgaactggcagcaagaatagatgctattattaggcgtaagtcatttgatggaaagccacttattcattttgatgtgctacatgttgatttaaataaaaaagaagtttgcattcatgaaaagcctgtcgatcttaccaggaaagaattcgagttgttgatttattttataggcaacaaaggaaaagtgatcaacaaaaatgcgattgccattcatttgtggggagatgaaatggatgtagcgggtaactatgattttatttatacgcatattaaaaacctgcgcaaaaaacttttgcaggccggcgcanaagactacataaaatcggtgtatggaatgggctataaattcacagaggcatga

SEQ ID NO: 3426 - protein, 225 aa, Unknown
  Obtained from environmental sample
  DOMAIN (145)...(222): Transcriptional regulatory protein, C terminal
  misc_feature (1)..(225): Xaa is any amino acid
MKILIVEDEKELSQSICTYLSDEQFRCEQAFDYPTAIEKISLYDYACIVLDITLTGGSGMDILKELKKENKLDGVLIISAKNSLDDKVHGLKAGADDYLTKPFHLPELAARIDAIIRRKSFDGKPLIHFDVLHVDLNKKEVCIHEKPVDLTRKEFELLIYFIGNKGKVINKNAIAIHLWGDEMDVAGNYDFIYTHIKNLRKKLLQAGAXDYIKSVYGMGYKFTEA

SEQ ID NO: 3427 - DNA, 810 bp, Unknown
  Obtained from environmental sample
  misc_feature (1)..(810): n is a, c, g, or t
gtgcttcattttaagatcaatacactcagggaaatttatgaagaggaaggcaccgcctttttaaaggataaagatttccaggatttttttgatcaaaacaaatattggctaaaatcttatgctgctttttgtttattaagagacaggtttggcacaagtgaattcagtaaatggaaaaattattccgtttataatcccgaggaaatagatcgtctttgttctcacaaatcaaaacaatataagtctattgcattctggtattttgtacaatatcatttgcatttgcaattaaaggaatcggtaaagtatgcgcataaaaaaagtgtcgcaataaaaggcgatattcctataggtgtgtataggaatggttgcgatgcatggtcccatgctgaactatttaacatggatcaacaggccggagctccgcctgatgattttgcagtaaaaggccagaactggggatttcctacttacaactggcagaaaatgcaggaagatcattttgaatggtggcaacagaggtttaaacaaatgagtcattattttgatgcttttcgcattgaccatattcttggtttttttagaatatggaccatacccattgattcagtggaaggcattatgggacgatttgttccggctattccaatagacatacaagagttttcagaaaatggtatctggtttgattacgacaggttttgcaaaccttttattaatgataaactactagaagaaacttttcgtgaacaaacacattttgcaaaaaattcttccttcaacccaatgaaaaaagcttttacgatttaa

SEQ ID NO: 3428 - protein, 269 aa, Unknown
  Obtained from environmental sample
  DOMAIN (2)...(267): 4-alpha-glucanotransferase
  misc_feature (1)..(269): Xaa is any amino acid
MLHFKINTLREIYEEEGTAFLKDKDFQDFFDQNKYWLKSYAAFCLLRDRFGTSEFSKWKNYSVYNPEEIDRLCSHKSKQYKSIAFWYFVQYHLHLQLKESVKYAHKKSVAIKGDIPIGVYRNGCDAWSHAELFNMDQQAGAPPDDFAVKGQNWGFPTYNWQKMQEDHFEWWQQRFKQMSHYFDAFRIDHILGFFRIWTIPIDSVEGIMGRFVPAIPIDIQEFSENGIWFDYDRFCKPFINDKLLEETFREQTHFAKNSSFNPMKKAFTI

SEQ ID NO: 3429 - DNA, 906 bp, Unknown
  Obtained from environmental sample
  misc_feature (1)..(906): n is a, c, g, or t
atgagcgctaaaagaaaattacgcgtgctcatgcttgctgtctgcagtccaggtgcaatcggaggacaagctgcatgcgcaaggatgcttcttcagcatttcaaagaagtggagtggaggtcgatatctttccctttgccgaaacaatacaattcagttttaagattttttcattcctacaggattctcctgcaatctttcctcatctgcattacaagaaaagcagatgtagttcacatcctcaccgcttgcgccaaaaccgcactttttgaaaagctcatcatcgcaagcattttaaaaatgacaggcgtcaaagtgattctcaatttccagggagcatttgatcattattacaattcgtttacacaacgtgagcagcgctgggtgcaaagacttttggagaatgttgatgtagtgctttgtctgcacacggacattcaaaaattttttatcgaagaaaatattgttcctggagaaaaaattaaagtaatacccaatgccgtcgaagtttcttccaaattagagtatacaacaccttccgacaacaaataccatctcttatatcttggctggctggttacaaataaaggtttgtatacactcgtgcagtctgccggtatattgtatgaaaagctcaaaaaaggaaattttatcatcgacatcattggtcctgaaatcgaagaaggtattatcaccggacttaaggaggaagcagcaaagcacaacgtaaagaatctgggcaggattcaattcccctgtctttggcgaaggagaaaagaaaattctttgctttcgccaaggaaattcgttttttcccaccgcaaggaaaggatttccctttgtattggcttgaaacccctgaaaacaggaaaggctttttgttacaacggaaattcatcccaatga

SEQ ID NO: 3430 - protein, 301 aa, Unknown
  Obtained from environmental sample
  misc_feature (1)..(301): Xaa is any amino acid
MSAKRKLRVLMLAVCSPGAIGGQAACARMLLQHFKEVEWRSISFPLPKQYNSVLRFFHSYRILLQSFLICITRKADVVHILTACAKTALFEKLIIASILKMTGVKVILNFQGAFDHYYNSFTQREQRWVQRLLENVDVVLCLHTDIQKFFIEENIVPGEKIKVIPNAVEVSSKLEYTTPSDNKYHLLYLGWLVTNKGLYTLVQSAGILYEKLKKGNFIIDIIGPEIEEGIITGLKEEAAKHNVKNLGRIQFPCLWRRRKENSLLSPRKFVFSHRKERISLCIGLKPLKTGKAFCYNGNSSQ

SEQ ID NO: 3431 - DNA, 636 bp, Unknown
  Obtained from environmental sample
  misc_feature (1)..(636): n is a, c, g, or t
ttggtataccataaagcaaaagttccggtgaatggggtactcccgcaaagcataggtaatgtgattaatacaaagtatgatgagcgttcgccgaatatttctctcgatggtcagacactttattttgcctccaagggacataacacgatgggtggatatgatatttttttcagtacctatgattctgcttcttctaaatggagtaatcctgtgaacatcggatacccattgaatactgcctccgatgaaatttctttcgcaaggaatggaaccggacagtttggatatatgggagcggttagaccggaaggacttggcgatagagacatttacaaggtaactttcgaagagagtaaagcgcagccattctatacggtgatatcaggaacagttgctgcttcaaatcccggaaaggttgaactgagaaatgtttcacttatccggaaatcagacaaaaaaataattgcagtttacagcccttattacctgagcaacaaatatgtttttgctgctaaacccggcgattacattattaaagtggatggttatggatttcaaccaatcgaagaagagatcaccgtcaatggtggccccgaagaaattaccaaaaattttactgtcatcttgtcgaagtaa

SEQ ID NO: 3432 - protein, 211 aa, Unknown
  Obtained from environmental sample
  DOMAIN (19)...(57): WD40-like Beta Propeller Repeat
  misc_feature (1)..(211): Xaa is any amino acid
MVYHKAKVPVNGVLPQSIGNVINTKYDERSPNISLDGQTLYFASKGHNTMGGYDIFFSTYDSASSKWSNPVNIGYPLNTASDEISFARNGTGQFGYMGAVRPEGLGDRDIYKVTFEESKAQPFYTVISGTVAASNPGKVELRNVSLIRKSDKKIIAVYSPYYLSNKYVFAAKPGDYIIKVDGYGFQPIEEEITVNGGPEEITKNFTVILSK

SEQ ID NO: 3433 - DNA, 528 bp, Unknown
  Obtained from environmental sample
  misc_feature (1)..(528): n is a, c, g, or t
atgcaggttttatggtcaaaggttttagcaggtgaggcaaattcgccaggaacatactccaaaagaacagttaatttcttgggttcattagataagtctgacgcatttctctttcaatcattatgtggctttgcttgggcaatgggaaatgttgttccattaatatatgacgtcaatgcagagatttacgctaaacaccatatcgatttcggcgcactcaaacatcttgacgaaattggtttgttgagctttgacaatttgagtggctataaacgtatccacttgcccaaaaaaattagggttgcttattacggcagggcgatagacattgaattcgacaaagaaaaagaaaacgaccttgaaatcggacatatcatattgtcaaaagttggacaagaacttgcacctatttgtgactcaaagccaattccagagttttttgatttcataattgaagactggacacaaaaaaagggattgaatgtttcctctccaattcaggttatccccaaaggcaacccaacatag

SEQ ID NO: 3434 - protein, 175 aa, Unknown
  Obtained from environmental sample
  misc_feature (1)..(175): Xaa is any amino acid
MQVLWSKVLAGEANSPGTYSKRTVNFLGSLDKSDAFLFQSLCGFAWAMGNVVPLIYDVNAEIYAKHHIDFGALKHLDEIGLLSFDNLSGYKRIHLPKKIRVAYYGRAIDIEFDKEKENDLEIGHIILSKVGQELAPICDSKPIPEFFDFIIEDWTQKKGLNVSSPIQVIPKGNPT

SEQ ID NO: 3435 - DNA, 558 bp, Unknown
  Obtained from environmental sample
  misc_feature (1)..(558): n is a, c, g, or t
atgaagattaaagaaatcatttcacaccttgaaaatatagctccacctcaataccaggagcattatgacaatgcgggtttgataacaggtcagtcattttgggattgtaaaggtgtattgatttgcctggatgtaactgaagaggttattttagaagcaaatcaaaaaaactgcaacctggttatagctcatcatccaatcatttttaagggattaaaaaagatcaatgggaataactatgttgaaaggatcattatcaacgccattaaaaacgatatagctatatatgctattcatactaaccttgataatataagatcgggggtaagtggaaaaatggccagtttattgaatttacaagatcagcatgttttatctccaaaagaaaatatgctgaaaaagcttttgacttttattccaaaagaccatgtaattgatgtgaggcaagctttatttgatgcaggggcaggtcatattggcaattattcggattgtagctttaattcaccgggatttggcacatttaaagccggtttgggtgcaatccatttaaggtga

SEQ ID NO: 3436 - protein, 185 aa, Unknown
  Obtained from environmental sample
  DOMAIN (10)...(185): NIF3 (NGG1p interacting factor 3)
  misc_feature (1)..(185): Xaa is any amino acid
MKIKEIISHLENIAPPQYQEHYDNAGLITGQSFWDCKGVLICLDVTEEVILEANQKNCNLVIAHHPIIFKGLKKINGNNYVERIIINAIKNDIAIYAIHTNLDNIRSGVSGKMASLLNLQDQHVLSPKENMLKKLLTFIPKDHVIDVRQALFDAGAGHIGNYSDCSFNSPGFGTFKAGLGAIHLR

SEQ ID NO: 3437 - DNA, 471 bp, Unknown
  Obtained from environmental sample
  misc_feature (1)..(471): n is a, c, g, or t
atggaaataaaagacaaactaattatcgctttagacttttcctcttttgatgaagtcaaaagctttctcaaccactttgacctaaaagaccctaattcactgagtttcgttaaagttggcatggagcttttttataaagaaggcgataaggttattgagtatttaaagcaacttaatttgaaaattttcttagatctaaaattactggatattcctaatactgttcataggtctcttaaaattctggcgcaatatgaacctgaaattattaatgtacatgctttaggtggcatagaaatgatgatgaaagcaagagaagctgtaaaagaaactagtcctaatactaaacttattgcagtgacttatttaactagcgtcacccaaagcattctcaataatgaactaggaattccagatgatataaatgctgcagtcctgagacttgctaaaatgcttccttacaggacttga

SEQ ID NO: 3438 - protein, 156 aa, Unknown
  Obtained from environmental sample
  DOMAIN (5)...(154): Orotidine 5'-phosphate decarboxylase / HUMPS family
  misc_feature (1)..(156): Xaa is any amino acid
MEIKDKLIIALDFSSFDEVKSFLNHFDLKDPNSLSFVKVGMELFYKEGDKVIEYLKQLNLKIFLDLKLLDIPNTVHRSLKILAQYEPEIINVHALGGIEMMMKAREAVKETSPNTKLIAVTYLTSVTQSILNNELGIPDDINAAVLRLAKMLPYRT

SEQ ID NO: 3439 - DNA, 711 bp, Unknown
  Obtained from environmental sample
  misc_feature (1)..(711): n is a, c, g, or t
atggaaatgcctagcgtaagaaaaacccccggcaaaacaagcaaggccgggatgaaattagaaaccgacctcaaagctgcactaaaggaacacttcggcttcactgattttaaaggacaacaggaagagatcatcaggaccctcctgagtggaaaggatactttcgtaatcatgcccaccggaggcggtaaaagtctttgttaccagttgcctgccatgatccttccgggagtggccatcattgttagtcccctgatcgcgctcatgaaaaaccaggttgacctggtgaggggttataacagcaatgatgatgtagcccattttctcaattcaacactgaccaagaaagaaataaaagtagtgcacgatgacctgaagtccggaagaaccaggatgctctatgtggcacccgagaccctgaccaagcaggacaacctggattttttcagtgacctgaaaatttccttcttcgcggtggacgaggcgcattgtatttcggagtgggggcatgatttccgtcccgaataccgccgcctganggatatgatggaccagatcagccccgatgttccggntattgcgttaaccgctaccgctacccccaaagtgcaaagtgatattgtaaagaacctggaactgcgcaagcctgagatctttatttcgtccttaaacgctcccatctctactacgagatccagccaaaatcattag

SEQ ID NO: 3440 - protein, 236 aa, Unknown
  Obtained from environmental sample
  DOMAIN (35)...(203): Type III restriction enzyme, res subunit
  misc_feature (1)..(236): Xaa is any amino acid
MEMPSVRKTPGKTSKAGMKLETDLKAALKEHFGFTDFKGQQEEIIRTLLSGKDTFVIMPTGGGKSLCYQLPAMILPGVAIIVSPLIALMKNQVDLVRGYNSNDDVAHFLNSTLTKKEIKVVHDDLKSGRTRMLYVAPETLTKQDNLDFFSDLKISFFAVDEAHCISEWGHDFRPEYRRLXDMMDQISPDVPXIALTATATPKVQSDIVKNLELRKPEIFISSLNAPISTTRSSQNH

SEQ ID NO: 3441 - DNA, 870 bp, Unknown
  Obtained from environmental sample
  misc_feature (1)..(870): n is a, c, g, or t
atggggtcacaaatcgccatgcactttgccaacattggtgtagaagttttattgctcgacatcgttcccttcgaactgactgaagaggaaaaagccaaaggcttaggtatggataacaaactggttagaaacagaattgttactaccgcttttaacggagcgcttaaattaaatcccaatccattatatcataaaagctttgccaacagagtttctcttggcaactttgatgatgacatggcaaaaatagccaatgtagattggattattgaagtagtagttgaaaggctcgatattaaacagcaggttttcgaaaaaatcgaaaaatatcgtaagccgggaacttttattacttcgaatacctcaggtattcctatggagttgttgataaaaggaagaagtgaagattttcagtcgtatttctgcgggactcacttttttaatcctcccaggtatttaaaattattggaagtaattccatcttcaaaaaccaataaagaggtgatcagcttctttatgaattatggggagaagtttttaggaaagaccaccgtattgtgcaaagatactccggcattcatagcgaatcgtattggagtatttagcattatggctttattccatatggtggatgaattaggtttaactcctgaagaaattgataaattaacaggtccggtaattggtggggcaaagtctgctactttccgtacagctgatgtggttggtttggatacgctggtaaatgtggcccaaggtgctaaagaaaatttaccgacgacgaacagaaggacaaattcgattggcttccttccntggaaagagatggagaataatggttgggacaaaaacaaaacaaggatcctttaa

SEQ ID NO: 3442 - protein, 289 aa, Unknown
  Obtained from environmental sample
  DOMAIN (193)...(273): 3-hydroxyacyl-CoA dehydrogenase, C-terminal domain
  misc_feature (1)..(289): Xaa is any amino acid
MGSQIAMHFANIGVEVLLLDIVPFELTEEEKAKGLGMDNKLVRNRIVTTAFNGALKLNPNPLYHKSFANRVSLGNFDDDMAKIANVDWIIEVVVERLDIKQQVFEKIEKYRKPGTFITSNTSGIPMELLIKGRSEDFQSYFCGTHFFNPPRYLKLLEVIPSSKTNKEVISFFMNYGEKFLGKTTVLCKDTPAFIANRIGVFSIMALFHMVDELGLTPEEIDKLTGPVIGGAKSATFRTADVVGLDTLVNVAQGAKENLPTTNRRTNSIGFLPWKEMENNGWDKNKTRIL

SEQ ID NO: 3443 - DNA, 339 bp, Unknown; identical to SEQ ID NO: 355
  Obtained from environmental sample
  misc_feature (1)..(339): n is a, c, g, or t

SEQ ID NO: 3444 - protein, 112 aa, Unknown; identical to SEQ ID NO: 356
  Obtained from environmental sample
  misc_feature (1)..(112): Xaa is any amino acid

SEQ ID NO: 3445 - DNA, 570 bp, Unknown
  Obtained from environmental sample
  misc_feature (1)..(570): n is a, c, g, or t
ttgttaagccggttccgttgggggttaagtgccgatctgcaggtgcctgactatgaaacccgcatcgagatcctggagaaaaagatgaaaaatgatgggcttgaaatgccaaaagaagtagttaagtacctggcttataatatcaatagtaatgtacgggaattagaaggggcgctgatttcattattggcacaatcttcgcttaacaagcgggaaatagacctagacttggcaaaaagagtcctccgtaatttcgtgaaaactagcagcaaggaaatcaccatcgaaaccatccagaaaatggtatgtgaatatttcgatgtgccttacgacaaactgctacagaaaacccgcaaacgagaaatcgtgcaggcccggcagattactatgtacctggctaaagcgtttaccaaaaattcattaaagaccatcggcgaacatttcggtgggcgcgaccacactaccgttatccactcctgccaaacggtgaaggatcttatggataccgatagcacgttccgcgaaagtgttatggagttgcaacagaaagtgcagctggccgccatgtag

SEQ ID NO: 3446 - protein, 189 aa, Unknown
  Obtained from environmental sample
  DOMAIN (1)...(163): Bacterial  dnaA  protein
  misc_feature (1)..(189): Xaa is any amino acid
MLSRFRWGLSADLQVPDYETRIEILEKKMKNDGLEMPKEVVKYLAYNINSNVRELEGALISLLAQSSLNKREIDLDLAKRVLRNFVKTSSKEITIETIQKMVCEYFDVPYDKLLQKTRKREIVQARQITMYLAKAFTKNSLKTIGEHFGGRDHTTVIHSCQTVKDLMDTDSTFRESVMELQQKVQLAAM

SEQ ID NO: 3447 - DNA, 792 bp, Unknown
  Obtained from environmental sample
  misc_feature (1)..(792): n is a, c, g, or t
atgaaagcgaatgacaaatatgcatctacggaagatattactaaaaaagaccgttccgttatttcacgaaaaactctcgaaggaataaaaaaaagttctgacaatgtatggcattctaacaaggaacaaaaaagtaaaagtctcccggccaaaaaaagggcaccggtaaaaacatctaaaaagaaagccccgcaaaaaaagccgggaaaagcagcaaggtttagcctgaacatgcaacccatgctggccacactggtcgacaaaccatttgatgaaccgggctggttatttgaaataaaatgggacggctaccgttcactggcattcgtaaataaaggaaaagtggaattgcggtcccgcaatgacaaatcctttaacgataaattttatccgcttgtgcaggaattaaaaacgtggaaacagaacgttattttggatggggaagtcgttgtggccaacccgcaggggatctccgacttcggcgcacttcaaaactggagaagcgaagccgatggcgacctcatctattatctcttcgatattttatggagtgaaggccgtgatctcacgtcgcttccgttggttgaacgaagaaaaattttaatggaaacgatcacaccaaccgacactatccggatcagcgaanatttcggggaatcggccacccagttttttgaggtagctcaaaagatgggactggaaggcatcattgccaaaaagcaaatagcgaatattatcccgggcgcaggtcaaagagtggttaaaaataaagcgaataacgtcaggaagtag

SEQ ID NO: 3448 - protein, 263 aa, Unknown
  Obtained from environmental sample
  DOMAIN (77)...(257): ATP dependent DNA ligase domain
  misc_feature (1)..(263): Xaa is any amino acid
MKANDKYASTEDITKKDRSVISRKTLEGIKKSSDNVWHSNKEQKSKSLPAKKRAPVKTSKKKAPQKKPGKAARFSLNMQPMLATLVDKPFDEPGWLFEIKWDGYRSLAFVNKGKVELRSRNDKSFNDKFYPLVQELKTWKQNVILDGEVVVANPQGISDFGALQNWRSEADGDLIYYLFDILWSEGRDLTSLPLVERRKILMETITPTDTIRISEXFGESATQFFEVAQKMGLEGIIAKKQIANIIPGAGQRVVKNKANNVRK

SEQ ID NO: 3449 - DNA, 438 bp, Unknown
  Obtained from environmental sample
  misc_feature (1)..(438): n is a, c, g, or t
atganctggggagtgaaaataataatcctatacctgggctttgtcgctcttatcattacaatggtaagcatggcgatgaatcagaaagtggaactcgttgccacagactattatgcccaggaattaaaataccaggaaaaaatagacggacaagccaattacaaacaattaaatatgccaatagagtttaaggtgacaggccgatcaatagaagtgattttcccaaaagagttattggaaagaaatattgccggaaatattcttgtctatcgtccgtccgactcttctttggacattaaaaccatgattcaattaaacaccgagggagtacaaacgatctcttcccaaaatctcaaaagaggcttgtataaaattcagatagagtggggaatggaaggaaagcagtatttcatggagaaaaatatatttattaactga

SEQ ID NO: 3450 - protein, 145 aa, Unknown
  Obtained from environmental sample
  misc_feature (1)..(145): Xaa is any amino acid
MXWGVKIIILYLGFVALIITMVSMAMNQKVELVATDYYAQELKYQEKIDGQANYKQLNMPIEFKVTGRSIEVIFPKELLERNIAGNILVYRPSDSSLDIKTMIQLNTEGVQTISSQNLKRGLYKIQIEWGMEGKQYFMEKNIFIN

SEQ ID NO: 3451 - DNA, 738 bp, Unknown
  Obtained from environmental sample
  misc_feature (1)..(738): n is a, c, g, or t
gtgggcaaagaaacagtcaagttcaagtttgatacacgtcaccccgcatcctatattctaagtattaccctcctgcttgcgcttaaaaaaaatgtaagtaaaaaaaccccaattcatattttgggattgggatccccaattcttattttattggctggttatatgtttaaggattttaaatccattactgtagatgcgactagctcatatgatgatgatttaagagcagataaaatatttggaattagcaaaatggatttattcaagttcatttcatatcaaatcgttgacaagaaaccttattatggaatatctccctattttaaagtcttcgaagaaaaatataattcggattggccaaaattattttctcattttaaagaggatttagccaataaaaatctcagcactgatgagatgaaaaggggaattgttctggataaattaaaaataaattcacgaatattagaaacttgtgtgccattctttgtgccgttggttagaggtaagcgtcttaaagcactaggcaaggtatttaaaagagaattgattgttgcaagagcatttgagaactactgggcaattaaatctttgtgtaacgatttaagttcatttaattcaaaaaaggaacttgacaaatacattgattcgaaaattaaagaatattcgcgctctgccgatggcaactatcttaatgctgtttacgagtgtaaatatataatcgataccttcaaatag

SEQ ID NO: 3452 - protein, 245 aa, Unknown
  Obtained from environmental sample
  misc_feature (1)..(245): Xaa is any amino acid
MGKETVKFKFDTRHPASYILSITLLLALKKNVSKKTPIHILGLGSPILILLAGYMFKDFKSITVDATSSYDDDLRADKIFGISKMDLFKFISYQIVDKKPYYGISPYFKVFEEKYNSDWPKLFSHFKEDLANKNLSTDEMKRGIVLDKLKINSRILETCVPFFVPLVRGKRLKALGKVFKRELIVARAFENYWAIKSLCNDLSSFNSKKELDKYIDSKIKEYSRSADGNYLNAVYECKYIIDTFK

SEQ ID NO: 3453 - DNA, 435 bp, Unknown
  Obtained from environmental sample
  misc_feature (1)..(435): n is a, c, g, or t
gtgacattaaaatttataatttcgtttgacgtttcacatttgacgtctgacattcaaggagaaaaaatgatttcaagaagaaatttcttaaagattacgggattatcatccgttgcattaggcgccggttttaccgctggtaaactagttggaaataaaaaatcagtttactttgctgtgcatggattcattcctgccgatgaacaggtaattggaaatcttgttacagcttttaaaaataaagtaaagagtaattctgaacctgttgtaatcgctgattcaaagatcggagaaaatataaatcgatttgatttgaaatcgggaaaagaaaatttctcaaacagcggaacaatcacttacagattaaaaagattaatcgagcaagttgattctgatatcattgtaagcgatgcccagaattctgtttatccttaa

SEQ ID NO: 3454 - protein, 144 aa, Unknown
  Obtained from environmental sample
  misc_feature (1)..(144): Xaa is any amino acid
MTLKFIISFDVSHLTSDIQGEKMISRRNFLKITGLSSVALGAGFTAGKLVGNKKSVYFAVHGFIPADEQVIGNLVTAFKNKVKSNSEPVVIADSKIGENINRFDLKSGKENFSNSGTITYRLKRLIEQVDSDIIVSDAQNSVYP

SEQ ID NO: 3455 - DNA, 768 bp, Unknown
  Obtained from environmental sample
  misc_feature (1)..(768): n is a, c, g, or t
atgctcgtcagcttcgtcggatccctgcccctgggtaccctgaatatcgcggcgatgcaaatatcggtatcagaaggggtcgctgctgccatgttgtttcttctgggttctttgctgatcgaaattgtctatgtacgactctcactggttgccattgactggatccgtaagcaggaaaaacttttgaaaatcctggaatatgttactttattgatcgtgaccgccctcgccgcttccagtttctatgcagccctccatcctgatgtaaaggaaaatatcgtgctgagcagttcaatgccgaagttcctgctgggtatgctgatgtgtgctgtaaatcccgtccagatccctttctggttcgggtggagcactgtacttttcaccaaaaagatcctgcttcccaggccgaatcattataattcttatatcgtcggcatcgggatcgggacattcattggtaatgccctttttattttcggcggcctcctgatcgccaattcaatcagcaataaccagcatattctgaattggatcatcggcggcattttcgccattacagcgctgatccagctttggcgtattatcaaacataaagatgcaatccatgatcttgaacaccccgaagaaatgaccgggaggtttgaggagaaaatggataaaatggaagaaagaatggaaaaactggaagaaggtttcgaaaaaatgacccacaaagatgaagaagatgataataaggagaagaaagataaaaagctgaagaaagactaa

SEQ ID NO: 3456 - protein, 255 aa, Unknown
  Obtained from environmental sample
  DOMAIN (5)...(191): LysE type translocator
  misc_feature (1)..(255): Xaa is any amino acid
MLVSFVGSLPLGTLNIAAMQISVSEGVAAAMLFLLGSLLIEIVYVRLSLVAIDWIRKQEKLLKILEYVTLLIVTALAASSFYAALHPDVKENIVLSSSMPKFLLGMLMCAVNPVQIPFWFGWSTVLFTKKILLPRPNHYNSYIVGIGIGTFIGNALFIFGGLLIANSISNNQHILNWIIGGIFAITALIQLWRIIKHKDAIHDLEHPEEMTGRFEEKMDKMEERMEKLEEGFEKMTHKDEEDDNKEKKDKKLKKD

SEQ ID NO: 3457 - DNA, 696 bp, Unknown
  Obtained from environmental sample
  misc_feature (1)..(696): n is a, c, g, or t
atgacgattgaggatttaagagatagaggattaattatacttgagagtattagtggcagcaaagcatacggattagacacacagacttctgatactgacataaaaggtgtatttcttcttccgaaaaaggaatattatggcttgaattatattcctcagataaataataaaacaaacgatagtgtgttttatgagtttggacgatttatggagttgctttcactaaacaatccaaatattttagaattactcaacgcacctgccacaacaataatctataagcatccttatttgtctgagattaagccggaatggattttgtccaaactttgcaataatactttcggaaaatttgcaatatcacagattaagaaagcaaaaggattaaaaaagaaatttgtaaatcctgtagcgaacgaacgaaaaagtgtattgtcattttgttttgtgaattacgaccagggagcggttccattggtaaaatatatggaaattaaaggttggagacaggaaaaatgtggattggtgaatattccatatatgaaagatgtttacggattatattattctgaaagtcttggattcagtggaataattagaggaaaagaactcaatgatgtttgtttaaagttcataccaaaaggaactaagcaagaatctctgttgtatttttcatccggaacgctatttcactaa

SEQ ID NO: 3458 - protein, 231 aa, Unknown
  Obtained from environmental sample
  misc_feature (1)..(231): Xaa is any amino acid
MTIEDLRDRGLIILESISGSKAYGLDTQTSDTDIKGVFLLPKKEYYGLNYIPQINNKTNDSVFYEFGRFMELLSLNNPNILELLNAPATTIIYKHPYLSEIKPEWILSKLCNNTFGKFAISQIKKAKGLKKKFVNPVANERKSVLSFCFVNYDQGAVPLVKYMEIKGWRQEKCGLVNIPYMKDVYGLYYSESLGFSGIIRGKELNDVCLKFIPKGTKQESLLYFSSGTLFH

SEQ ID NO: 3459 - DNA, 981 bp, Unknown
  Obtained from environmental sample
  misc_feature (1)..(981): n is a, c, g, or t
atgggaatagatccacagtttttagcgggagccgcaagcgtaacaactgcatggctttggaaagaatttggcaaagacctcatccaaaaagctgctaataatctatggatgcgtttcaaatttaatgacgccaaacaaaagtatcaaaatagtataaaaaaactccactcaactattcgagtattggacaaacttgaaactgtacctctgatcgataattatgtagaccttttcattcttgaagaaccggaggcatatcgaagatatggagttgaccatctggagtcgaactttgacgacacaaccggtttttataatcgaggcaaacgatcagatgccttactaattgcaactgaatatgatcacttgtttgtcttgggaaaacctggagcaggaaaaacgacttttttaaaatatttagcatccctggcagctgaagaaaaaatcaacaaaaccccaatatttatctcatttaacagttgggcgtatagcaaaaagaacttgcttgattttatgattgaacagtttgagatatgtagttttccagatgcaaaaatatttatagaattattattagaaaaaggaaatgccttaattcttcttgatgggcttgatgaagtaagtgaagagggaaaccaacggggacaaatgattcatgaactagagaatctggtcaaacgatatcaagacaacaaattcattattacctgtcgaaatgcagccaatgattataagtttgatgggtttacttatgtcgaaattgcagatttaacaattactncagttagtgtttttgtcanaaatggtttaacatcaactcgaacaaggcaacagaaattcttacgcagcttgataaagaagacatcaaagtctgaaagagctatcgcacaaccctctctttgctggaatgttatgtttagtattttgagaaacatcccatttnccatcaaagagagggatggtatacaaagaaacgattga

SEQ ID NO: 3460 - protein, 326 aa, Unknown
  Obtained from environmental sample
  DOMAIN (121)...(273): NACHT domain
  misc_feature (1)..(326): Xaa is any amino acid
MGIDPQFLAGAASVTTAWLWKEFGKDLIQKAANNLWMRFKFNDAKQKYQNSIKKLHSTIRVLDKLETVPLIDNYVDLFILEEPEAYRRYGVDHLESNFDDTTGFYNRGKRSDALLIATEYDHLFVLGKPGAGKTTFLKYLASLAAEEKINKTPIFISFNSWAYSKKNLLDFMIEQFEICSFPDAKIFIELLLEKGNALILLDGLDEVSEEGNQRGQMIHELENLVKRYQDNKFIITCRNAANDYKFDGFTYVEIADLTITXVSVFVXNGLTSTRTRQQKFLRSLIKKTSKSERAIAQPSLCWNVMFSILRNIPFXIKERDGIQRND

SEQ ID NO: 3461 - DNA, 360 bp, Unknown
  Obtained from environmental sample
  misc_feature (1)..(360): n is a, c, g, or t
atgacatattcaatttcaggttttgaaaccacagtcgtccgagtgcatttgctgttctttctaaaacctgctgctcgtaaaatccactcttacaagcaaattgaaaatatccactgctcagtttggaacggagcatcatacctcgcacaaaatgcgatctggaaaacgaatgaaaagggaaggactcgctgcaaaaataaggaaaacggtttaaacgaaccgtttacaaacagaatccacggttgtttaagccaaaactttgcccttaaaaaaggccctttgacaatccccaattgcccccggaaagaaaattccggggcctggttggagcctccccaaattgaacgtactcgaaaactt

SEQ ID NO: 3462 - protein, 120 aa, Unknown
  Obtained from environmental sample
  misc_feature (1)..(120): Xaa is any amino acid
MTYSISGFETTVVRVHLLFFLKPAARKIHSYKQIENIHCSVWNGASYLAQNAIWKTNEKGRTRCKNKENGLNEPFTNRIHGCLSQNFALKKGPLTIPNCPRKENSGAWLEPPQIERTRKL

SEQ ID NO: 3463 - DNA, 522 bp, Unknown
  Obtained from environmental sample
  misc_feature (1)..(522): n is a, c, g, or t
atgccagctttgttgaggcattccattttcaaatcgtcaaatgcctcatattgccagcccaggatttngaaagttatttctttcttcttttcacttccaaaacttttcaggaacaattttttgattatcttanccaagaagctgctcgtcaagatctcaagtttcttcatgaaaacaaaccaaaaattntatctgtcattctctttccggacacaagtactttttanaagatattcttcagttcgttctgattntgaaaggcacgctctcaaagagattctaagtgatccttcaatagcctccaaacttgctgacaccaaagcttctggcgaagttgcaatattaaatgaattctatgagatgctaaagaatgaacccgatcgtgccttttatgggattaaacatgttgaagctgcaaatgaacgacttgctattcaagttcttctagtgaccgatgaactctttcggtacatcaaattccatttctatttttttttgttttccaaaatctcacgaaattag

SEQ ID NO: 3464 - protein, 173 aa, Unknown
  Obtained from environmental sample
  DOMAIN (108)...(171): eRF1 domain 3
  misc_feature (1)..(173): Xaa is any amino acid
MPALLRHSIFKSSNASYCQPRIXKVISFFFSLPKLFRNNFLIILXKKLLVKISSFFMKTNQKXYLSFSFRTQVLFXRYSSVRSDXERHALKEILSDPSIASKLADTKASGEVAILNEFYEMLKNEPDRAFYGIKHVEAANERLAIQVLLVTDELFRYIKFHFYFFLFSKISRN

SEQ ID NO: 3465 - DNA, 666 bp, Unknown
  Obtained from environmental sample
  misc_feature (1)..(666): n is a, c, g, or t
atgtctaaacgaaaaaaagaccctttgctcgaagcgctaaaggaaggcaagtcctatacctggacaattcctgatggcggtaatttagcttccatgcgtgaggcgatcaagcatgggcaaacgctaacaatgtcgcccattgtaaatcccaacgaaattcaagtcggtgatttcgttctcgtcaagtggcatcaaagcgatatttttcatgtagtcggagagatacaaggggatcaatttcttatcataaacagtgtaggcaaagtcaatggttgggtaagcgcaaaagaaattcttggcagaataacaaaaatcatcgaacctgaaccacgcccaagtgtagaaattatgttggaacaattagagagggcttatcaagcattaataactcttgaacaagccgctgatagtgaagcacaacaactgtctgcaattgtcaatgatttgcgttggtatgctgatagaatcggcaaggagcgtttggataaaatgcctcgctccaataaatggagtttccaacaaaatctctggcgactcacaaaacaagcgaaaaagacgatagcccctgtttcaaatcgtgtcatttattttattgactgcggcaaacaatgcgtaggattagccagtgaaatatttgctctctttgagtacagcgactcagattaa

SEQ ID NO: 3466 - protein, 221 aa, Unknown
  Obtained from environmental sample
  misc_feature (1)..(221): Xaa is any amino acid
MSKRKKDPLLEALKEGKSYTWTIPDGGNLASMREAIKHGQTLTMSPIVNPNEIQVGDFVLVKWHQSDIFHVVGEIQGDQFLIINSVGKVNGWVSAKEILGRITKIIEPEPRPSVEIMLEQLERAYQALITLEQAADSEAQQLSAIVNDLRWYADRIGKERLDKMPRSNKWSFQQNLWRLTKQAKKTIAPVSNRVIYFIDCGKQCVGLASEIFALFEYSDSD

SEQ ID NO: 3467 - DNA, 300 bp, Unknown
  Obtained from environmental sample
  misc_feature (1)..(300): n is a, c, g, or t
ttgcaagtgagtttggataaacacatggaagataagtggtctggtgctgaaaaaatatcagttaccttacgggattatttcgaaaatcatcacggggataaaaaggttctaagattaaaatttttgtcatcccacaggaaccgggggaaaacaagggtgaatcccaacctttcaaagataaccttgggctatgtttctacccaagcctcggccaagttaaaccggaaaattagctataaaaacattaatttggggggggaacccttaatttgtgccatctctcttttggccccctcgaaa

SEQ ID NO: 3468 - protein, 100 aa, Unknown
  Obtained from environmental sample
  misc_feature (1)..(100): Xaa is any amino acid
MQVSLDKHMEDKWSGAEKISVTLRDYFENHHGDKKVLRLKFLSSHRNRGKTRVNPNLSKITLGYVSTQASAKLNRKISYKNINLGGEPLICAISLLAPSK

SEQ ID NO: 3469 - DNA, 747 bp, Unknown
  Obtained from environmental sample
  misc_feature (1)..(747): n is a, c, g, or t
ttggaaaaattggaactcgaaaaatatatacctattgaaagtctgacaggtgacgcttaccccgtaacagatatctcaagaaagctgtatgttgaaacttacggctgccagatgaattttgctgataccgaaattgtaaacggtatcatgggtaaaaacggttatgatattactgataatattgacgactccgcaataatacttatcaacacatgcagtatccgtgaaatggctgaagcccgtgtactgcaaaggctcacagaaatcaaaaagtacaagaaaaagaatccaaagctgattgtcggcataattggctgtatggctgaaaggcttaaacgtgaccttgtgacaaaaaagggagttgttgaccttgtccttggacccgatgaatacaggaaactgccctcattaattgataatttaattgatactggcgaaaagggcattgctgtaaagctttcacgtgttgaaacttacgatgatatacttccaatacgcaaagagggtttaagcgcatggctttctataatgcgcggctgcgataagttctgcagcttctgtgttgtgccatatacccgcggcagggaaagaagcagaccgcttgaaggtgttatccgtgaagtgaaacaactgcgtgatgaaggttttaaggatgtaactctgcttgggcagaatgttaattcatacgtaagtgaaaaatatgattttgccgacctgctggaagcctgtgcaaaagcntgtacctga

SEQ ID NO: 3470 - protein, 248 aa, Unknown
  Obtained from environmental sample
  DOMAIN (28)...(127): Uncharacterized protein family UPF0004
  misc_feature (1)..(248): Xaa is any amino acid
MEKLELEKYIPIESLTGDAYPVTDISRKLYVETYGCQMNFADTEIVNGIMGKNGYDITDNIDDSAIILINTCSIREMAEARVLQRLTEIKKYKKKNPKLIVGIIGCMAERLKRDLVTKKGVVDLVLGPDEYRKLPSLIDNLIDTGEKGIAVKLSRVETYDDILPIRKEGLSAWLSIMRGCDKFCSFCVVPYTRGRERSRPLEGVIREVKQLRDEGFKDVTLLGQNVNSYVSEKYDFADLLEACAKACT

SEQ ID NO: 3471 - DNA, 810 bp, Unknown
  Obtained from environmental sample
  misc_feature (1)..(810): n is a, c, g, or t
atgaaaaggatattttttgctttctcaattctatttattagcgtttgtggttttgcacagcacgaggcattaataaaagcctttaaaaagttcgagcatgatccgcaactaaaagctgctattagttcactatatattatcgatgcgaaaacagggaaaataattttcgataaaaattctttaatcggccttgctcccgcctctacgcaaaaattaattacgggtgcagcagcatacgaattattaggaaaagactttcgatataaaaccgaatttggcattacgaaaaaaggtgaggagaccagtttatttattaaaccttcaggtgatcctactttaggaagctggcgttgggagtcaacaaaagaaaaaaatgttttgcctcgaatcgtcaatgcttataaaaaaaatagtaccggtttttcaaaagtttttgtgcaagatgaagggtggaattatgaaggtattccgggagggtggacctgggaggatatcggcaatttttatggcgcaggagcaggtgttttaaactggagagaaaatcaatttgatgttatattaaagtcaggaaaaaatataggcgatgaggtgaaaattgttggcaccgatccttcactctattattataagcttttttccgtagctactgctgcaagagatacaaatgataatacctatatctattacttattaggtaaagatgaaggtataatcaggggcacaattccagtaaataaaacccggtttgtaatttccggtgcaatgccagatccgcaacggcagtttattgaaacattatcggattcataa

SEQ ID NO: 3472 - protein, 269 aa, Unknown
  Obtained from environmental sample
  SIGNAL (1)...(19)
  misc_feature (1)..(269): Xaa is any amino acid
MKRIFFAFSILFISVCGFAQHEALIKAFKKFEHDPQLKAAISSLYIIDAKTGKIIFDKNSLIGLAPASTQKLITGAAAYELLGKDFRYKTEFGITKKGEETSLFIKPSGDPTLGSWRWESTKEKNVLPRIVNAYKKNSTGFSKVFVQDEGWNYEGIPGGWTWEDIGNFYGAGAGVLNWRENQFDVILKSGKNIGDEVKIVGTDPSLYYYKLFSVATAARDTNDNTYIYYLLGKDEGIIRGTIPVNKTRFVISGAMPDPQRQFIETLSDS

SEQ ID NO: 3473 - DNA, 417 bp, Unknown
  Obtained from environmental sample
  misc_feature (1)..(417): n is a, c, g, or t
atgaggatcttgcttgatactaatattttgctggacattttgactaaacggcagcttcactttgatgactcggcaaaagtttggactgttgttcattccgaattagtagaaggatatctttctgcaatttctgtaaataacctttactatattgttcgcaagctacaagatcgcaaaacagcagaagcatttgttgatgacattttaaaagattttgaaattgccagccttacaaagagcattttgaagcaagcgggaactgtggccaataaagatttcgaagattcaattcaatatttctcagcaatccaggaagggtgtgaagtcttgatcaccagaaacaaaaaagattttcccgcagttggattacaagttttgactccgctagagtttcttgaacaattacaaaaagagtaa

SEQ ID NO: 3474 - protein, 138 aa, Unknown
  Obtained from environmental sample
  DOMAIN (3)...(128): PIN domain
  misc_feature (1)..(138): Xaa is any amino acid
MRILLDTNILLDILTKRQLHFDDSAKVWTVVHSELVEGYLSAISVNNLYYIVRKLQDRKTAEAFVDDILKDFEIASLTKSILKQAGTVANKDFEDSIQYFSAIQEGCEVLITRNKKDFPAVGLQVLTPLEFLEQLQKE

SEQ ID NO: 3475 - DNA, 753 bp, Unknown
  Obtained from environmental sample
  misc_feature (1)..(753): n is a, c, g, or t
ttggtgttggagccaaggcagtcacttgaagataaaaatcatcataattcgtacaacataattcgtaaaactgcaaagtctgttcctgtacttggtaatattggcgcagctcaattagtccaatcaaaaaatcttactgatattttatcattgattgatatgcttgaagcagatgcttttgtagtgcacttgaatcctcttcaagaattattgcaaattgaaggagaacctaatttttttggactattaaaaaaaattgaaagattaatatcgaaagcggaagttccaattattgtaaaagaagtcggttcaggaataagcaaaactgctgcaaaaaaattattaaaaattggagtaagtggaattgatgtggccggcgcaggaggaaccagttgggctggtgtagagattatcagaagtaaatcagaaaataatttttgggattggggattaccaacttcatattgtttaaaagaaatttatcctttaaagaaaaaatttaaatttactctcattggttcaggtggaattaattctgtacacgatcttgcaatggccttcgcttttggtgccgatcttgttgcatcagccaggattattttacaaacattgatgaaacaaaatgatgaagccgtatttgaattaatattaaactggtttgattacgttaaaaaagttatgtttcttaccggatcaaaaactcttaacgaactgaaaaataataagctaattaaaaaggaagaattatattga

SEQ ID NO: 3476 - protein, 250 aa, Unknown
  Obtained from environmental sample
  misc_feature (1)..(250): Xaa is any amino acid
MVLEPRQSLEDKNHHNSYNIIRKTAKSVPVLGNIGAAQLVQSKNLTDILSLIDMLEADAFVVHLNPLQELLQIEGEPNFFGLLKKIERLISKAEVPIIVKEVGSGISKTAAKKLLKIGVSGIDVAGAGGTSWAGVEIIRSKSENNFWDWGLPTSYCLKEIYPLKKKFKFTLIGSGGINSVHDLAMAFAFGADLVASARIILQTLMKQNDEAVFELILNWFDYVKKVMFLTGSKTLNELKNNKLIKKEELY

SEQ ID NO: 3477 - DNA, 702 bp, Unknown
  Obtained from environmental sample
  misc_feature (1)..(702): n is a, c, g, or t
atgagcgggatcttccttaaagcgagatgggaaaaccttgtccttataacatatgcagttgagcccggattgcttgatgacctattgcctgatggtgtaacagcggatactattgaaggcaaagcatttgtaagccttgtagcttttgattttcttgatacaaaggtgaaaggaataaaattcccgctgcatacaaattttcccgagatcaacctgcggtactacgtgagatacaaagagaaaaggggagtaatgttcgtaagggagtttgttccgccctcattcattcccttttttgcaaacctgttctataacgaaaaatacaaaggtattaaaatgaaaagcagtatttcgaaaaacggaaagatactgctgaatcactcaataaagatcagggaacataactacgaaataagcctggaagcacagaataaaccttacatgccgcctgcggagtctatcgaacattatttcaaagaacacgagtggggattcggaacctcaagagcagggaagacattaatatacagagtagagcatccgttctggaatgtttacccggttgtgaagtttgaccataattttgattttggagctatttatggcgaanaatggcgcactttgaatgaaaaaacaccgtataatgtgatttttgctgaaggctcaccggttacaatattcagctctgaaaaaattttgtaa

SEQ ID NO: 3478 - protein, 233 aa, Unknown
  Obtained from environmental sample
  misc_feature (1)..(233): Xaa is any amino acid
MSGIFLKARWENLVLITYAVEPGLLDDLLPDGVTADTIEGKAFVSLVAFDFLDTKVKGIKFPLHTNFPEINLRYYVRYKEKRGVMFVREFVPPSFIPFFANLFYNEKYKGIKMKSSISKNGKILLNHSIKIREHNYEISLEAQNKPYMPPAESIEHYFKEHEWGFGTSRAGKTLIYRVEHPFWNVYPVVKFDHNFDFGAIYGEXWRTLNEKTPYNVIFAEGSPVTIFSSEKIL

SEQ ID NO: 3479 - DNA, 687 bp, Unknown
  Obtained from environmental sample
  misc_feature (1)..(687): n is a, c, g, or t
atgatcttctcaaaaagcgcagttgaggaaatgatccaaaaagaaccggctaagatcagtccaaatgttgtgttgcgaccaatgtaccagcaacacattttacctaatgtggcttatgtaggtggtccggctgaactaaattattggcttgagtacaaaactgcatttgacgctatgggaattcaatttccaattctccaaccacgcgcacatgtaatgatcattgacaagaatcaggatcagaaatggaataaactaggcttaaaagcccttgatctatttaagaatgagaaggaactggtagacgccatcatttcttcaaaaggagaaacaattactttggaggaagaaaagaaaaaagcggaaagcttgttcaacgatcttcaaaagaaaagtacagagatcgataagacaatggagaatttggtaaaggccgaactccaaaaaacattaaatagcatctccgccattgaaggcaaattgaataagtctctcaaacaacgttcggaaacggagatcaaccagatcaaaaacattaaaagcaagttattccccgaaaatataccgcaggagcgttatgataactttagcatgtattattccaaatacggaaaaggatttattgaggctatcaagaaaagtagtgagggaaatgagttgaagtttattgttctaacggaagcctaa

SEQ ID NO: 3480 - protein, 228 aa, Unknown
  Obtained from environmental sample
  misc_feature (1)..(228): Xaa is any amino acid
MIFSKSAVEEMIQKEPAKISPNVVLRPMYQQHILPNVAYVGGPAELNYWLEYKTAFDAMGIQFPILQPRAHVMIIDKNQDQKWNKLGLKALDLFKNEKELVDAIISSKGETITLEEEKKKAESLFNDLQKKSTEIDKTMENLVKAELQKTLNSISAIEGKLNKSLKQRSETEINQIKNIKSKLFPENIPQERYDNFSMYYSKYGKGFIEAIKKSSEGNELKFIVLTEA

SEQ ID NO: 3481 - DNA, 450 bp, Unknown
  Obtained from environmental sample
  misc_feature (1)..(450): n is a, c, g, or t
atggttatttactttagccgaatgaaaaaattattgcttgttctgctattccttattggatatttcgcattctctcaaaataactctacctactacgagaaattctataaaaataaacccataattattttaatgttcgatggatttggtgagacctatctcaagagcacaagccttcctaatatcgaaaaattctccaaaaatggttttatgaagatcgtggatgctctaatgcctacggtaacaaattgtaataacgctagtatttgctgtggagaatttcctgataaagttgggataacgggtaattcttttcttgatacgcagggccatgaggaatatatggagtcaaaagatctggtgatggcgccgaccatttttgagaaattaagcaaatatggagtgaaatcggcaatgatctcaagcaagaaaaaagtgttgngcttttag

SEQ ID NO: 3482 - protein, 149 aa, Unknown
  Obtained from environmental sample
  misc_feature (1)..(149): Xaa is any amino acid
MVIYFSRMKKLLLVLLFLIGYFAFSQNNSTYYEKFYKNKPIIILMFDGFGETYLKSTSLPNIEKFSKNGFMKIVDALMPTVTNCNNASICCGEFPDKVGITGNSFLDTQGHEEYMESKDLVMAPTIFEKLSKYGVKSAMISSKKKVLXF

SEQ ID NO: 3483 - DNA, 930 bp, Unknown
  Obtained from environmental sample
  misc_feature (1)..(930): n is a, c, g, or t
gtgggcaatctatcaactggcggcactggcaaatcaccaatggttgaatacctggtgctgcatttaaagaacctgtacaaggtggctactttaagccggggttataaacggaaaacaacaggatatgccctggcgtctgatcaaactaccgctattgatataggcgatgaacctatgcagtttcaccgcaaatttcccgatgtgccggtggcagtaggcgaacaaagagtgcaggctattcctcaactattgcatgataaacctaatatagaagtgatcattcttgatgatgccttccagcatcgtgctattaaagcgggttttaatattttacttactgaatatggtaatttatttacccgtgatttttatttgccaaccggggatctgagggattccatgagcagttataaaagagccgatattattgtagttaccaaatgtcctcctgatatatcggaggaagaacggcaggaaattataaaggagatcaatcctttgcctcatcagcaggtttttttcgcttctatttcttatggaaccgtttatcatatcatccgaaatacatttggttctattgatgaagaaacagaagtacttttaataacgggtattgccaatccaaaacccttaaaaacatacctcgaagagcacatcaatacttattacctgatgcattataacgatcatcatatcttttctattgatgactggaaggatataaagaagcggtttgaaagtatgcaggaggagaaaaaggtcttgctgacaactgaaaaagacgcaatgcggttacaaaagttcgcccatgaaatagatggcatgcctttttacgtgatgcctattgaacataagtttttatttcatgacggagagagatttacaaatagaataattgaggttatagaaaattttaaaaaaccatattag

SEQ ID NO: 3484 - protein, 309 aa, Unknown
  Obtained from environmental sample
  DOMAIN (1)...(307): Tetraacyldisaccharide-1-P 4'-kinase
  misc_feature (1)..(309): Xaa is any amino acid
MGNLSTGGTGKSPMVEYLVLHLKNLYKVATLSRGYKRKTTGYALASDQTTAIDIGDEPMQFHRKFPDVPVAVGEQRVQAIPQLLHDKPNIEVIILDDAFQHRAIKAGFNILLTEYGNLFTRDFYLPTGDLRDSMSSYKRADIIVVTKCPPDISEEERQEIIKEINPLPHQQVFFASISYGTVYHIIRNTFGSIDEETEVLLITGIANPKPLKTYLEEHINTYYLMHYNDHHIFSIDDWKDIKKRFESMQEEKKVLLTTEKDAMRLQKFAHEIDGMPFYVMPIEHKFLFHDGERFTNRIIEVIENFKKPY

SEQ ID NO: 3485 - DNA, 471 bp, Unknown
  Obtained from environmental sample
  misc_feature (1)..(471): n is a, c, g, or t
atgattaggctttctatattaattccctcgataccttctcgatttgaaagggctatgtctttatataataagattgaaaccatgtgtatagggttagacgtggaaatacttctttttatggacaataaaaaaagaaccataggagaaaagagggaagcactgaaaaacctatcaaaaggaaaatattttatgtttgttgacgacgacgatagtttactgagtgtaaaagaaatttacgaggccactgaaaaagatgtggacgttatcactttttggcaggtatgtttgaatagcaatggttcagaatatttcattgactttggccttnaaaacccaattgaacataatacagacgagaacggtaattatgttaattgccttcgccctccgttcattgttgcgcctggtcgtcatggtttaaaaaataaataccctgcgatcattacggtgaagatggtgtttgggttttga

SEQ ID NO: 3486 - protein, 156 aa, Unknown
  Obtained from environmental sample
  misc_feature (1)..(156): Xaa is any amino acid
MIRLSILIPSIPSRFERAMSLYNKIETMCIGLDVEILLFMDNKKRTIGEKREALKNLSKGKYFMFVDDDDSLLSVKEIYEATEKDVDVITFWQVCLNSNGSEYFIDFGLXNPIEHNTDENGNYVNCLRPPFIVAPGRHGLKNKYPAIITVKMVFGF

SEQ ID NO: 3487 - DNA, 1116 bp, Unknown
  Obtained from environmental sample
  misc_feature (1)..(1116): n is a, c, g, or t
ttgatgccgattttgggtttttcnggtaaattattatattttttttatatttcaagcttatttacaattatggcccggaaactaatcttctattgcattttatttttttcattatcagcaaaaagtcaaaatataaatatttctttttttgatgagaaaggtaaactgacttatgaagaaaccgcttattattaccggcaaagtaccgatacattaaactatttcagatcattttattcaaagaataaaaacaaatactttgaaggtaaaatcataaatgccgtagatacatcggatttcaataataaatatgcgggattatgcagatggtattatctaaatggaaacattaaagtgcaaagtgaatataatgaaacaggacagcttcatggagtaaagaaagaatttagtgatcagggtaatcttattaaagaaacgatatatgagaatggaaaggttaaaaataagacgcataaggagtttagtaattcaggtggcgaaattaatgtgttagaagaagatttttcagaaaattctttggattggaaaattgtttcaacagaagaattaaattcaaaaataaggattggaggattagaaataataagtaagaaaacagagcagttcattaatttattgaataatcagattgattcggtaaatttcagtattgaaacaaaagtgaatacatataaacttaatattctaaatgaatgtgtaagtggaattgtatatggttttaaggattatagtaactataattatttttacatttcanaacaaaaatttcatatcgggtttgtaagagataatgtctttacaaagcanatagacggttattattctgttgatttgaaagtaaataatcataataaattgaagattttatgttcaaatgacagcctttatttttatttaaataacattttacatgntattctcataatgaaggtttcattgaaaatagatgggatttgcgtaaataacggatattatttttttgattatttagtagttaagcaattttgcaaaaatcatctgagtcnnnnnnnnnnnnnnnnnnnnnnnnnnnnnnnnnnnnnnnnnnnnnnnnnnnnnnnnaatggaggtaattga

SEQ ID NO: 3488 - protein, 371 aa, Unknown
  Obtained from environmental sample
  misc_feature (1)..(371): Xaa is any amino acid
MMPILGFSGKLLYFFYISSLFTIMARKLIFYCILFFSLSAKSQNINISFFDEKGKLTYEETAYYYRQSTDTLNYFRSFYSKNKNKYFEGKIINAVDTSDFNNKYAGLCRWYYLNGNIKVQSEYNETGQLHGVKKEFSDQGNLIKETIYENGKVKNKTHKEFSNSGGEINVLEEDFSENSLDWKIVSTEELNSKIRIGGLEIISKKTEQFINLLNNQIDSVNFSIETKVNTYKLNILNECVSGIVYGFKDYSNYNYFYISXQKFHIGFVRDNVFTKXIDGYYSVDLKVNNHNKLKILCSNDSLYFYLNNILHXILIMKVSLKIDGICVNNGYYFFDYLVVKQFCKNHLSXXXXXXXXXXXXXXXXXXXNGGN

SEQ ID NO: 3489 - DNA, 630 bp, Unknown
  Obtained from environmental sample
  misc_feature (1)..(630): n is a, c, g, or t
ttgcaatccccagatatcatatttaaatactcccctgatcttacgagttcacaaaaagatcaattcaccaaactttatcttttgtattctgaatggaatgagaaaatcaatgttatttcccgtaaagacattgagaacctctacattaaccacgtgttgcactcgcttggtatcgctaaaataatttcctttaaacctgggacacgtgttttagatgtaggaactggcggaggttttccgggaataccgttggccattctttttcctgaaactcaatttcacctggtggactctattggtaagaaaattactgtcgtgaaaaatgttgctgaagctcttggacttaaaaatattaaggctgaacaaataagggctgagcaaataaaaggtgaatatgattttattgtgagccgcgcggtcacacggcttaaagaattctatggatggatcaacaaaaaaataaaaaagacgtcatcccatcaactctttaatggcattctttatctcaaaggtggtgatcttgaagaagagttggatgaactgaaaaaaccacatcaattaatttcgctttctgatttcttcaaggaagaatttttcgaaactaaaaaggtggtttatattcctctgtaa

SEQ ID NO: 3490 - protein, 209 aa, Unknown
  Obtained from environmental sample
  DOMAIN (18)...(205): Glucose inhibited division protein
  misc_feature (1)..(209): Xaa is any amino acid
MQSPDIIFKYSPDLTSSQKDQFTKLYLLYSEWNEKINVISRKDIENLYINHVLHSLGIAKIISFKPGTRVLDVGTGGGFPGIPLAILFPETQFHLVDSIGKKITVVKNVAEALGLKNIKAEQIRAEQIKGEYDFIVSRAVTRLKEFYGWINKKIKKTSSHQLFNGILYLKGGDLEEELDELKKPHQLISLSDFFKEEFFETKKVVYIPL

SEQ ID NO: 3491 - DNA, 387 bp, Unknown
  Obtained from environmental sample
  misc_feature (1)..(387): n is a, c, g, or t
atgaattatgttatcgatactgtaacgataactcggcacttttctggggtcggtaaacttggttcaaaagcgaataaaatactcaaagaggccgaagaaggtaaacatctacttttcatatccgtagtaagtctttttgaaattttatacttggcagaaaaaaacaggattaaaatctctcttaagaatactatttcaacaattcagaaaaaaccatgttatatcattgttgatcttaatacggagatcattttaccagctgaatccattcaattttatgagttgcatgacagactcattttaggaaccgttaaatatctgggtctatctattatttcaagtgatgaaagatttgatgagttatcagacataaatcgtatttggtaa

SEQ ID NO: 3492 - protein, 128 aa, Unknown
  Obtained from environmental sample
  DOMAIN (3)...(127): PIN domain
  misc_feature (1)..(128): Xaa is any amino acid
MNYVIDTVTITRHFSGVGKLGSKANKILKEAEEGKHLLFISVVSLFEILYLAEKNRIKISLKNTISTIQKKPCYIIVDLNTEIILPAESIQFYELHDRLILGTVKYLGLSIISSDERFDELSDINRIW

SEQ ID NO: 3493 - DNA, 318 bp, Unknown
  Obtained from environmental sample
  misc_feature (1)..(318): n is a, c, g, or t
ttgcaatccccagatatcatatttaaatacttccctgatcttacgagttcacaaaaagatcaattcaccaaactttatcttttgtattctgaatggaatgagaaaatcaatgttatttcccgtaaagacattgagaacctctacattaaccacgtgttgcactcgcttggtatcgctaaaataatttcctttaaacctgggacacgtgttttagatgtaggaactggcggaggttttccgggaataccgttggccatttcttttcctgaaactcaatttcacctggtggactctattggaaaaaaattactgtcgtga

SEQ ID NO: 3494 - protein, 105 aa, Unknown
  Obtained from environmental sample
  misc_feature (1)..(105): Xaa is any amino acid
MQSPDIIFKYFPDLTSSQKDQFTKLYLLYSEWNEKINVISRKDIENLYINHVLHSLGIAKIISFKPGTRVLDVGTGGGFPGIPLAISFPETQFHLVDSIGKKLLS

SEQ ID NO: 3495 - DNA, 705 bp, Unknown
  Obtained from environmental sample
  misc_feature (1)..(705): n is a, c, g, or t
ttgctcgcagacatttcacatcctgcgggcctgattgcgcgcggattgttgagtgacccgatggagtattgccacattgttactaccacgacgcataaaacactgcggggtccccgtggcggtatgattctagtgggtaagaattttgataatccctggggtttaaaaacacctaagggtgagattaggaagatgacttcgatccttgattctggagtctttccaggtacgcaaggaggcccattggaacatgttatcgctgccaaggccgtgtcctttcaggaagcgctgtcggatgattacatggagtacatagtccaggtcgctaaaaatgctaaggtcatggcgcaggcttttctggacaaagggtataaaataatttcggggggcacagataatcatttgatgttaatagacctccgatcaaaaaatttaacagggaagcaggcagaggaaggcttaatccaagcggacattaccatcaataagaatatggttccttttgatactcaatcgccaatggtaacatcgggaatgagaatcggtacacccgccattaccacccgcggattaaaagaaaaggatgttcttaagattgtcgatcttatggacgaagcccttcaaaaaccaggcgatgctaaacaccttaagtccgtcaagaaaaaagtaaatcgattcatgcaaaaatttccactttatttataa

SEQ ID NO: 3496 - protein, 234 aa, Unknown
  Obtained from environmental sample
  DOMAIN (1)...(203): Serine hydroxymethyltransferase
  misc_feature (1)..(234): Xaa is any amino acid
MLADISHPAGLIARGLLSDPMEYCHIVTTTTHKTLRGPRGGMILVGKNFDNPWGLKTPKGEIRKMTSILDSGVFPGTQGGPLEHVIAAKAVSFQEALSDDYMEYIVQVAKNAKVMAQAFLDKGYKIISGGTDNHLMLIDLRSKNLTGKQAEEGLIQADITINKNMVPFDTQSPMVTSGMRIGTPAITTRGLKEKDVLKIVDLMDEALQKPGDAKHLKSVKKKVNRFMQKFPLYL

SEQ ID NO: 3497 - DNA, 594 bp, Unknown
  Obtained from environmental sample
  misc_feature (1)..(594): n is a, c, g, or t
gtggaaatggaacattatatggatgttttcaaccaacttaaagctcctatgggcgttttttctacacttggaaatcatgactatggagattatgaacaatgggaaaacaaggaagaaaaagcagcaaacctggaacgtttaaaacagattcatggagagttgggatggaaattgctgatgaatgaacatgttgtttttgaacgcaatggcgataagatagcactattggggatagagaattggagcgcaaaagccaggtttcctaaatatggcaaaatgaatgaagcctatgcaggtactgaagatattccttttaaaattctaatgagccacgacccttcacactgggatgcggaagtaataccgaaatacactgatattgacctgatgctggcagggcatacccatggcatgcagtttggtatagaattaccttggtttaaatggagcccggttcaatatgtttataagcaatgggccggactatacgaagagggaaaacaaaaattatatgtaaaccgtggttttggatttataggatatcctggcagggtgggtattttaccggaaataactttgattgaattaatctag

SEQ ID NO: 3498 - protein, 197 aa, Unknown
  Obtained from environmental sample
  misc_feature (1)..(197): Xaa is any amino acid
MEMEHYMDVFNQLKAPMGVFSTLGNHDYGDYEQWENKEEKAANLERLKQIHGELGWKLLMNEHVVFERNGDKIALLGIENWSAKARFPKYGKMNEAYAGTEDIPFKILMSHDPSHWDAEVIPKYTDIDLMLAGHTHGMQFGIELPWFKWSPVQYVYKQWAGLYEEGKQKLYVNRGFGFIGYPGRVGILPEITLIELI

SEQ ID NO: 3499 - DNA, 999 bp, Unknown
  Obtained from environmental sample
  misc_feature (1)..(999): n is a, c, g, or t
ttgcaattccgaaaagcaatggctttccattcctttcataccacttgttttggtccatacggtgtaccgaatgaagtgcaaatttgtactgaagaaatgcttaaaatggctgagaatggcattgccgcgcattggctttataagacgagaaaaaaagtatttcatgatgctcagtcacgcgcgcgcgaatggctaaaaggcattttagaaatggataaaagttccagaaattctttggaatttattgaaaatgtaaaaattgatctgtttcccgatgaagtctatgtgttcactcccaaaggacaaattattgagttacccgcaggcgcaacaccagttgattatgcttactcgattcattctgatattggtaatacctgcgtcgcagcacgattagataaacgattattgccattaagtacaccactcaccagtggtcagcaagttgaaattatcactgcgcctggagcaagacccaatgcggcttggcttaactttgtcgtcactggaaaagcgcgcagtaaaattaaacattatttgaaaaaacagcaacgcgaagaatccatggatttaggtcgacgtttagttgaaaaggcattgcaccattacaatttacatttagatacaacgacggaaaaaacgttattgtctgttgttaaaacatcctcgttagaatcattgaatcatctttttgaagaagttggaattggtaatcgacccgcgctattagttgcaaaacaaattgcaaaagcactcggtgatacttcgcagaaagagtccattacgcaaacgatccatccacttgttattaaaggcacagaaggattagtcctgcgatttgctaaatgttgtcgccctattcctggagatcatattggtggattaattcgaattggttttgggattgaagtgcatttgttaagctgtcccgtattagaaaaatatcatcatcatgcagataaattcgtaccactgtctgggaagaacaaatcgaagtga

SEQ ID NO: 3500 - protein, 332 aa, Unknown
  Obtained from environmental sample
  DOMAIN (90)...(153): TGS domain
  misc_feature (1)..(332): Xaa is any amino acid
MQFRKAMAFHSFHTTCFGPYGVPNEVQICTEEMLKMAENGIAAHWLYKTRKKVFHDAQSRAREWLKGILEMDKSSRNSLEFIENVKIDLFPDEVYVFTPKGQIIELPAGATPVDYAYSIHSDIGNTCVAARLDKRLLPLSTPLTSGQQVEIITAPGARPNAAWLNFVVTGKARSKIKHYLKKQQREESMDLGRRLVEKALHHYNLHLDTTTEKTLLSVVKTSSLESLNHLFEEVGIGNRPALLVAKQIAKALGDTSQKESITQTIHPLVIKGTEGLVLRFAKCCRPIPGDHIGGLIRIGFGIEVHLLSCPVLEKYHHHADKFVPLSGKNKSK

SEQ ID NO: 3501 - DNA, 588 bp, Unknown
  Obtained from environmental sample
  misc_feature (1)..(588): n is a, c, g, or t
atgaaaattctcttaggtgtttttattgcattggtcactttttccttaccgctttattccgaaacaaaaacgaatctcaccgttgaaacgccagcgaaatcctccccattaaataatgtaaaagaaaatgtagatgattccgcaaaagaacaggcgattagcgatgaagacattaatcgttttaccaataccatcgtcttaataaaagatttttatgtgcaacccactaaagacaaaaatttattagatgacgcgatacgcggcatggtcggtggactcgatcctcattccgaatacttagataagcaagcttacaaaacattgcttatgaccaccagtggcgcattcggtggtgtcggcataaaagtcactcctgaatttggcatattaaaaattgtgtctcctattgatgatacacctgcgtccaaagcaggcattcaagctggagattatattgttgcaattgatgccaagttagtcagtgaaatgagtttacaaaagccgtcaataaaatgcgcggccaaacaggaatcctcgttattctcacagaactttctaaaaggtgagaaaatacccctccacatataa

SEQ ID NO: 3502 - protein, 195 aa, Unknown
  Obtained from environmental sample
  misc_feature (1)..(195): Xaa is any amino acid
MKILLGVFIALVTFSLPLYSETKTNLTVETPAKSSPLNNVKENVDDSAKEQAISDEDINRFTNTIVLIKDFYVQPTKDKNLLDDAIRGMVGGLDPHSEYLDKQAYKTLLMTTSGAFGGVGIKVTPEFGILKIVSPIDDTPASKAGIQAGDYIVAIDAKLVSEMSLQKPSIKCAAKQESSLFSQNFLKGEKIPLHI

SEQ ID NO: 3503 - DNA, 822 bp, Unknown
  Obtained from environmental sample
  misc_feature (1)..(822): n is a, c, g, or t
ttgccattttttttattacctcgtgttttaccactgctaaaaacttatgcccgttttaccatgcctctttactgcactaaaattgttgtaaacaaaaaagacatattgaaaataaaaggcccggtactttttgcggctaatcatcctaattcatttcttgatggcgtaatattgagcacattattaactcaaaatttatactcactcacccgcggagatgtttttaaaaataaaattgcaaggaaaattttatcatggttaaagctattgcccgtttatcgtacaagtgaaggcacccataatcttgcaaataactataccacttttgatgcatgccatgaaaaatttaaagaaaaacagatcgttctcatttttagtgaagctagttctataaacgaatggcttcttcggcctttacgcaaaggcgctgcacgagtggcttttaacagctggcagcagggtattgatgtaaaaataattccccttgctttcaattatagctcatttaaaaaatttggaaagcaagtacatctcaattttggtgaagtaataaaaaaagattcttttaatgcagatactaacgggaagcaactggccgattttacacagcaattacaactacaattacaatcactggtatatgtagcaaatgacgaatacgcagcgcaaaaatatttcccgctcgcaaaaagtaaattcaaaacaactttgcttttgattccggggcttattggctggcttttgcacgcacctttgtttcatatatgcaggattattactgaagtccgttttaaaaaagcgatcattatgattcagtattaa

SEQ ID NO: 3504 - protein, 273 aa, Unknown
  Obtained from environmental sample
  DOMAIN (29)...(165): Acyltransferase
  misc_feature (1)..(273): Xaa is any amino acid
MPFFLLPRVLPLLKTYARFTMPLYCTKIVVNKKDILKIKGPVLFAANHPNSFLDGVILSTLLTQNLYSLTRGDVFKNKIARKILSWLKLLPVYRTSEGTHNLANNYTTFDACHEKFKEKQIVLIFSEASSINEWLLRPLRKGAARVAFNSWQQGIDVKIIPLAFNYSSFKKFGKQVHLNFGEVIKKDSFNADTNGKQLADFTQQLQLQLQSLVYVANDEYAAQKYFPLAKSKFKTTLLLIPGLIGWLLHAPLFHICRIITEVRFKKAIIMIQY

SEQ ID NO: 3505 - DNA, 684 bp, Unknown
  Obtained from environmental sample
  misc_feature (1)..(684): n is a, c, g, or t
ttgagtgatataggaatccataccgttgctcgcttaatcggagcgcctccggggtatgtagggtacgaagaaggcggacagttaaccgaagccgttagacgtcatccatattcggtggttctttttgacgaaatggaaaaagctcatccttccgtatttaatatattcttacagatattggatgagggtcgcttaaccgacagtaaaggtgttacagttgactttaaaaacaccattattattttgacaagtaatctaggaagcgatgttattcgtgaatatgcgggcaaaaaccaggagaaaatgcaatctgcaatctgggagatacttaatcatgcttttaaaccagaatttttaaaccgattagatggtgtagttttttttaaaccattaactcaagacttaatgactaatatttccaaaattcaattaaatgctgctgcaaatatactgcaaagccagggaattaaacttgagtttaatgacaaagctgtaaattactttgccgataaaggttttgatcctgtttttggtgcacgacccctaaaacggttgatcgaacaggagctgatggatgagatcgctttgcaaattttggagggaaaaatcaaaccgggtgatacaattaaaaccgatataatcaaaggaaagcctgaaattattaacctttatggaaaacattaa

SEQ ID NO: 3506 - protein, 227 aa, Unknown
  Obtained from environmental sample
  misc_feature (1)..(227): Xaa is any amino acid
MSDIGIHTVARLIGAPPGYVGYEEGGQLTEAVRRHPYSVVLFDEMEKAHPSVFNIFLQILDEGRLTDSKGVTVDFKNTIIILTSNLGSDVIREYAGKNQEKMQSAIWEILNHAFKPEFLNRLDGVVFFKPLTQDLMTNISKIQLNAAANILQSQGIKLEFNDKAVNYFADKGFDPVFGARPLKRLIEQELMDEIALQILEGKIKPGDTIKTDIIKGKPEIINLYGKH

SEQ ID NO: 3507 - DNA, 717 bp, Unknown
  Obtained from environmental sample
  misc_feature (1)..(717): n is a, c, g, or t
ttgaccagttttccttttcaacagggaaattcaaatttgaaaccacagtttagccacattatgaaattcagtcacaactacaaggggataatcaccaccacgctcaattacaccaataccaccgatattattcaacaggtaatagagcagaatgaagagaagaatgagacctatgttaaagccgcaaacattgcgaagcagcgccagtatggcatttcagtaaatacaaccttgcccattacgaaatggtggagaagcaatgtatttgtcaatgcattcaacaataaatttgacggcattgtcaatgatacaatgatatctgtaaaagcaacgaccctgcagttaaacggctcacagcaatttaattttgccaaaacatggtccgctgagatcagtgggtttttcaggagtggtggagttgaaggtgtgatacagggaagatcaatgggaatgttgtcagcaggcataggcaaagagatatttaaaaagaaggcttcactacgtttgaacattcgtgatatattttacacccaggcattcaggggtattgccaaatacggcaacgtagacgcgaaaattggtgaatcccgtgacagccgggttgtgaatttgggtttcacctaccggtttagtaaaggaaaaataaatggcgggccaaaaagaagagcaagtagtgcaagcgatgaacaaaaccgtatcgggggaggaaatcaataa

SEQ ID NO: 3508 - protein, 238 aa, Unknown
  Obtained from environmental sample
  misc_feature (1)..(238): Xaa is any amino acid
MTSFPFQQGNSNLKPQFSHIMKFSHNYKGIITTTLNYTNTTDIIQQVIEQNEEKNETYVKAANIAKQRQYGISVNTTLPITKWWRSNVFVNAFNNKFDGIVNDTMISVKATTLQLNGSQQFNFAKTWSAEISGFFRSGGVEGVIQGRSMGMLSAGIGKEIFKKKASLRLNIRDIFYTQAFRGIAKYGNVDAKIGESRDSRVVNLGFTYRFSKGKINGGPKRRASSASDEQNRIGGGNQ

SEQ ID NO: 3509 - DNA, 789 bp, Unknown
  Obtained from environmental sample
  misc_feature (1)..(789): n is a, c, g, or t
atggcggaagttatcaatgttttcttagatcaatttgaggaacagcttgccgcaaaatgtttggatatttccttaccaataaaatcattctgtttaaccaatttcggaattaaaccatatcaagttggcaaagaaatacctccacaaacaaaggattctgtaacaaataggatatttgacagcaaaatactaaaaagcaatgaatacaaacaatatttacgtggaaaggatataaataaatatataatttcacctctgnaagaaagatatataaaattcggtccgtggttagcagagccaagaccagccattgattttaatagtcctgaaaagcttttgttgcgacaaactggtgacagtcttatagcaactcttgatacaagttgttatctttgcctaaacaatctccatgtgataattatcaaagaaaaatcatataatattcgatatttactcggaatcatcaactcgaggttacttaattggtattatcacacaatgaaccctgaagttggtgaagcgttagcagaagttaaaaagactaatgtagaaaacctccccatccgccccatcgacttctccagtcctacagacaaagccctccacgaccgtatggtgcagcttgtcgaacagatgcttgcccttcgcaaacaactcccgaactccaagaccggccacgaacagacccatgtccagcgacagatcgacgccactgatcggcagattgacaagttggtgtatgagctgtacgggctgaccgaggaggagattgcggttgttgaaggctga

SEQ ID NO: 3510 - protein, 262 aa, Unknown
  Obtained from environmental sample
  misc_feature (1)..(262): Xaa is any amino acid
MAEVINVFLDQFEEQLAAKCLDISLPIKSFCLTNFGIKPYQVGKEIPPQTKDSVTNRIFDSKILKSNEYKQYLRGKDINKYIISPLXERYIKFGPWLAEPRPAIDFNSPEKLLLRQTGDSLIATLDTSCYLCLNNLHVIIIKEKSYNIRYLLGIINSRLLNWYYHTMNPEVGEALAEVKKTNVENLPIRPIDFSSPTDKALHDRMVQLVEQMLALRKQLPNSKTGHEQTHVQRQIDATDRQIDKLVYELYGLTEEEIAVVEG

SEQ ID NO: 3511 - DNA, 402 bp, Unknown
  Obtained from environmental sample
  misc_feature (1)..(402): n is a, c, g, or t
atggccaataacgatagtcccatctcccccgaagaggataaaaaaatcagggaagagctttacaagcaaaacctcgagctagccaggctatataaggaagttgacactcttaatagaagcctggaaaccgcgaacaataatctaaagacccttataaagcagagggagaatttggtgcatctcatcacccacaaggtcaaaggctcttttacgcgaactaaattcatttttgccgggcttctggacggtacattcgggcctatatcagaggaggtgcacaaaatagcggaacaaggactcgagttcgacaacggcggcatagaaaccgtggacttggttttgaacgtggcaaatatggagaacgggatcatcaaatacgacatgaaggaaacagacctttaa

SEQ ID NO: 3512 - protein, 133 aa, Unknown
  Obtained from environmental sample
  misc_feature (1)..(133): Xaa is any amino acid
MANNDSPISPEEDKKIREELYKQNLELARLYKEVDTLNRSLETANNNLKTLIKQRENLVHLITHKVKGSFTRTKFIFAGLLDGTFGPISEEVHKIAEQGLEFDNGGIETVDLVLNVANMENGIIKYDMKETDL

SEQ ID NO: 3513 - DNA, 516 bp, Unknown
  Obtained from environmental sample
  misc_feature (1)..(516): n is a, c, g, or t
atgagagaagataacgatactcaacaagtataccaagataaaatatccattataagtaaagaaggaaagagaagatggatttacccccgaaaacctaagggcaaattatataatttacgtacatggttcagtttccttttactggcaattctctttggcacaccgtttattaatgtaaacgggcatccttttatgctatttaattttattgaaagaaaatttattctcttcggcttatcatttgttccgcaggatttttatctattcggacttgcaatgatatctataattgttttcgtaattctatttactgctactttcggcaggttgttctgcggatgggcatgtccgcaaactatttttctggaaatggtttttagaaaaatagaatattggattgaaggcgatgcaagcagccagagaaaacttgcagtaagtccatggacaccaggtaagactataaagaaattttccaaatggattgttttttatttaatatcttttcttaatagctaa

SEQ ID NO: 3514 - protein, 171 aa, Unknown
  Obtained from environmental sample
  misc_feature (1)..(171): Xaa is any amino acid
MREDNDTQQVYQDKISIISKEGKRRWIYPRKPKGKLYNLRTWFSFLLLAILFGTPFINVNGHPFMLFNFIERKFILFGLSFVPQDFYLFGLAMISIIVFVILFTATFGRLFCGWACPQTIFLEMVFRKIEYWIEGDASSQRKLAVSPWTPGKTIKKFSKWIVFYLISFLNS

SEQ ID NO: 3515 - DNA, 414 bp, Unknown
  Obtained from environmental sample
  misc_feature (1)..(414): n is a, c, g, or t
ttggcttttatattctttgcattagtgataggtacaatggtgggcatttccatgacaaaaaattccgaccttgtttcagaaaattactatgaaaaagaattaaagtatcaggataaaattaatatgattaacagggcaaatgctctgcccgagaaaataaaaattgaagtcgcacaaacatttttaaaagtaacatatcctgaagtcttttctaaagaaaaaatcacgggaaaaataaatttctaccgtgcaatggataagaagaaagatttttcaacagatattaataatgacaagaattcttcccaagagattaacattaaggaaatggataagggaagctggaaaattcaaatttactggaacgtaaagggtgaagaatattttactgaatcagatttatttattaactaa

SEQ ID NO: 3516 - protein, 137 aa, Unknown
  Obtained from environmental sample
  SIGNAL (1)...(19)
  misc_feature (1)..(137): Xaa is any amino acid
MAFIFFALVIGTMVGISMTKNSDLVSENYYEKELKYQDKINMINRANALPEKIKIEVAQTFLKVTYPEVFSKEKITGKINFYRAMDKKKDFSTDINNDKNSSQEINIKEMDKGSWKIQIYWNVKGEEYFTESDLFIN

SEQ ID NO: 3517 - DNA, 690 bp, Unknown
  Obtained from environmental sample
  misc_feature (1)..(690): n is a, c, g, or t
ttgcgcattttacacgtcgatcagcgaatccatcatcctttaacctgcgataaaaataccataatggaacgaatagaagccctgatcagtaagttaaaagaacagtttgaacaaaaaaccgatcccaacgtgatgctaggtactgttcagttgctccagttcgaactcaccaaactcaggtccggcgctgcccaaagcctgggaaccgcaaaagtatcggtgatccttccatcaaccaatgtagtttcagcccaatatgaaaaatacgcccccaaacccatcgaagtgccggtggagaaaaaggagccggtagaggaaatgaaggaaacactgctggtggataacgggtccctttccgtagttcagaaaaatgggcagctcgatatggtttttgaccccatgacggaaattcctacgctctcccaccagtccaggggtaaagaaataaacgatcatgccggtgaaggggaatccctgaacgataaactccgccaggggaaaactgaattagtagagatattgaaagaagcccccgtaaaagatctccggaaagccatcggcatcaacgaccggttcctgtttatcaatgaccttttccggggcgatgagaccatgtatgagcggagcattaaaaccatcaatagttttaatatctatcccgaagcggagtactggatcaaccgtgagtaa

SEQ ID NO: 3518 - protein, 229 aa, Unknown
  Obtained from environmental sample
  misc_feature (1)..(229): Xaa is any amino acid
MRILHVDQRIHHPLTCDKNTIMERIEALISKLKEQFEQKTDPNVMLGTVQLLQFELTKLRSGAAQSLGTAKVSVILPSTNVVSAQYEKYAPKPIEVPVEKKEPVEEMKETLLVDNGSLSVVQKNGQLDMVFDPMTEIPTLSHQSRGKEINDHAGEGESLNDKLRQGKTELVEILKEAPVKDLRKAIGINDRFLFINDLFRGDETMYERSIKTINSFNIYPEAEYWINRE

SEQ ID NO: 3519 - DNA, 318 bp, Unknown
  Obtained from environmental sample
  misc_feature (1)..(318): n is a, c, g, or t
atgagtacgaacggaaagggaatttgggtttcttatgattttggtttaaaaggagactacacggggctctatacatggcttgacaatcacaatgcagtagaatgtggaaatgggctagcatattgtagctatgacacaacgaagcttgaaatcatgaattctgagaatcttgtaaaacatattactaaagacttaagagagcatataaaactttctaagactgacagaatgtacattatatggatggacggtgagtccaaaagggttagaggtgaattcatctctggattcagaaagcagtcaccagggaaggtatga

SEQ ID NO: 3520 - protein, 105 aa, Unknown
  Obtained from environmental sample
  misc_feature (1)..(105): Xaa is any amino acid
MSTNGKGIWVSYDFGLKGDYTGLYTWLDNHNAVECGNGLAYCSYDTTKLEIMNSENLVKHITKDLREHIKLSKTDRMYIIWMDGESKRVRGEFISGFRKQSPGKV

SEQ ID NO: 3521 - DNA, 1044 bp, Unknown
  Obtained from environmental sample
  misc_feature (1)..(1044): n is a, c, g, or t
ttgggaaaaaagaatttggaaaggttactttcccatttaacgtttttatggaaccaacgggcgggatgcattctcttaccggaattaaataaaaattggattttgggaaaggcgagttttcaatcgtcaacaggcggggcgagaccaagcaatttttttcataccgtaaaatttgtttataacgatgctggcancaagattggttatttagctgtgggacgggacatcacggagaaaaaaattgcagatgagaaactaaaagatagtgagctgttttaccgcactctcattgccgattctttggacggcatgcttctgttagataaggatggcacaataaattttgtatctccatctgtaaaaaatattttgggttatgatgaacatgaactgattggaacgaatggatttgcatatgttcatactgaggatattacatgggcggttgaatctttccagagagaagtatctgaaaaccctgaaataaaattcattaccattcgtctccgggaaaaaaatggtgaatggctttggtgcaatgttcgtgggcataatcttttgagcaatcctcatgttaaccggattgttgtttacttccacgacgatacattaagaaaagaggccaaagacgccttgcaggaaagcgaacaaaaattccgttcacttgttacccatatacaggttggcgtttttctttccgatggagcaggaaatattatcatgtgcaataaagcactttgcgccatgctttccataccccaatccatggttattggaaaaaatgtttacgatatcatgtcgatggatatgatcaatgaaaacaatgagtttgtgccggtatcacaaaggccacttacacttactcttcaatccaaacaaaccgtaaaggatgctgtgattggtgtgatacatcccatcacaaaagaaagatcgtggatactggttaactcggatccaattcttgatgaagatggaaatatcaagcatgttgtttgttcggtaatgaatataaccgaaagaaaaaagctggagcaaaaattatag

SEQ ID NO: 3522 - protein, 347 aa, Unknown
  Obtained from environmental sample
  DOMAIN (298)...(340): PAC motif
  misc_feature (1)..(347): Xaa is any amino acid
MGKKNLERLLSHLTFLWNQRAGCILLPELNKNWILGKASFQSSTGGARPSNFFHTVKFVYNDAGXKIGYLAVGRDITEKKIADEKLKDSELFYRTLIADSLDGMLLLDKDGTINFVSPSVKNILGYDEHELIGTNGFAYVHTEDITWAVESFQREVSENPEIKFITIRLREKNGEWLWCNVRGHNLLSNPHVNRIVVYFHDDTLRKEAKDALQESEQKFRSLVTHIQVGVFLSDGAGNIIMCNKALCAMLSIPQSMVIGKNVYDIMSMDMINENNEFVPVSQRPLTLTLQSKQTVKDAVIGVIHPITKERSWILVNSDPILDEDGNIKHVVCSVMNITERKKLEQKL

SEQ ID NO: 3523 - DNA, 699 bp, Unknown
  Obtained from environmental sample
  misc_feature (1)..(699): n is a, c, g, or t
gtgctggaaggatatggttgtacagaaacgtcacccgtaattgcggtcaatacccttgaacctaacggtatgcgtatcggaaccgtaggaaaatctattaagaatgttaaagttaaaattgctgatgacggagaaattttatgtaaaggtccaaatgtaatgctgggttattataaacattctgatctgacaaaggaagctattgatcctgatggatggtatcacaccggagatattggtgaaatggttgaagcagaatacctgaaaataactgacaggaaaaaggaaatcttcaaaacatcaggcggaaaatatattgcaccccagatgatcgaaaataaaatgaaagaatcccgtttcattgaacaggcaatggtgataggagaaaatcagaaatttgctgccgcgcttatcgtcccggcatttgcatttatacgcgactgggcaacggaggaaggcctcagttgcagaaccaatgaagaaataatcaatactcccgaagtaaaggcgcgcatcatgaaagaggttgaaaaaatgaattcggggcttgccagttatgaatccattaaaaagattgaattacttccgagagaattctccattgaaatgggtgagatgacaccaaagctaagcctgaaaagaaaaattataattgaaacttataaaaatctggtgaatatgatttatggacttaactaa

SEQ ID NO: 3524 - protein, 232 aa, Unknown
  Obtained from environmental sample
  misc_feature (1)..(232): Xaa is any amino acid
MLEGYGCTETSPVIAVNTLEPNGMRIGTVGKSIKNVKVKIADDGEILCKGPNVMLGYYKHSDLTKEAIDPDGWYHTGDIGEMVEAEYLKITDRKKEIFKTSGGKYIAPQMIENKMKESRFIEQAMVIGENQKFAAALIVPAFAFIRDWATEEGLSCRTNEEIINTPEVKARIMKEVEKMNSGLASYESIKKIELLPREFSIEMGEMTPKLSLKRKIIIETYKNLVNMIYGLN

SEQ ID NO: 3525 - DNA, 696 bp, Unknown
  Obtained from environmental sample
  misc_feature (1)..(696): n is a, c, g, or t
atgaaaaggaaaatatttttttacaccctgatgagtattcttttggcgggaatatttgcgccaggatattcgcaaaccaacaagattgactatgcgaactccaaggagtatatcatccgcaaattaagtgttgaatcaccttctaccacattggataaacaagtgctggttagaatgatgaaagactggggctattccgaaggccagaaaataaagattcccggagaagatatcactaatctggtagatcgtttatgggatgaagaagttttcaccaatatcaaagtttaccatactgctatcgaaaaagattttattgatctggtagtttatgttgaggaaaaaccaagggtaagcagattttctttacgtgggcctgccaacggacccgctttgaaaaaaacagaagccgacgaattatacgaacatattaaacctatcataggatttcaaaaaccatatactgattatctccaaaagaatgtagaacattatatcaaagactattttgctgataagaactttttcgataccaaagttgaatttgatgtaagtgtagataccatgaaaggngttatgccaggatctcttttagtaaggatcatggttgacaaaaaaaacaaggtaaaagttggccggctaaccgtggaaggcaatgagcatgtaagactaacaaaaatacgccgggcattttaa

SEQ ID NO: 3526 - protein, 231 aa, Unknown
  Obtained from environmental sample
  SIGNAL (1)...(20)
  misc_feature (1)..(231): Xaa is any amino acid
MKRKIFFYTLMSILLAGIFAPGYSQTNKIDYANSKEYIIRKLSVESPSTTLDKQVLVRMMKDWGYSEGQKIKIPGEDITNLVDRLWDEEVFTNIKVYHTAIEKDFIDLVVYVEEKPRVSRFSLRGPANGPALKKTEADELYEHIKPIIGFQKPYTDYLQKNVEHYIKDYFADKNFFDTKVEFDVSVDTMKGVMPGSLLVRIMVDKKNKVKVGRLTVEGNEHVRLTKIRRAF

SEQ ID NO: 3527 - DNA, 357 bp, Unknown
  Obtained from environmental sample
  misc_feature (1)..(357): n is a, c, g, or t
gtgtcagtagtaatagtggtggtggagttgcaggtaaaaaaaataaggtcatcgggatcgtgggtggcatcgcgacctgaagcgcatagcaagaatgatataccagggatttctgttggcgaagaaaaaaatttactcaaaaaaacacccttgggatttacctggcaagggcgctattctagtattcagaaggtaccggacaaagaacatcaaatgaacacaaaaactaatatggaaaaaaataaccctgtcattaaaacagggtcttttttatgccgcccgataaaattcttatttctgcaaaacaatttccccgacgttcaacggttgatcttgttttacttcgagattctctaa

SEQ ID NO: 3528 - protein, 118 aa, Unknown
  Obtained from environmental sample
  misc_feature (1)..(118): Xaa is any amino acid
MSVVIVVVELQVKKIRSSGSWVASRPEAHSKNDIPGISVGEEKNLLKKTPLGFTWQGRYSSIQKVPDKEHQMNTKTNMEKNNPVIKTGSFLCRPIKFLFLQNNFPDVQRLILFYFEIL

SEQ ID NO: 3529 - DNA, 579 bp, Unknown
  Obtained from environmental sample
  misc_feature (1)..(579): n is a, c, g, or t
ttgcgactcaaaccaaatgaaactatgtggcaggctttaggcgaggctattttaaaatataaaatatttttgttgttgcttttgttaagtgcaaccgcttttatgggttggcatgcgagcaaagtaaaattgagttacgatttttcaagagccatccctacagataatccaaaatataaagcttaccaggaattccggagtaaatatggcgaagacggcaacctgttggtgatcggtattcaatcaaaaaatatttttcaggaacctgtttttaatgactatttaaaactgcacgaagacttaaaaaaaacagcgggtgttgaagacgttatatctatgccggcagcagttaaccttattaaagatagcgccacagaaaaattagaagcgaaacagatttttaatggcgtagcattatctcaatcacaaattgacagcagtaagactatcttttattcacttcctttttaccgtaaccttttatacaatccgcagacaaatgcctggttgatgggtgtccgcatcaacaacgatattttaaattcagaaaaaagaaccggcgtcgtgaagaaattctaa

SEQ ID NO: 3530 - protein, 192 aa, Unknown
  Obtained from environmental sample
  misc_feature (1)..(192): Xaa is any amino acid
MRLKPNETMWQALGEAILKYKIFLLLLLLSATAFMGWHASKVKLSYDFSRAIPTDNPKYKAYQEFRSKYGEDGNLLVIGIQSKNIFQEPVFNDYLKLHEDLKKTAGVEDVISMPAAVNLIKDSATEKLEAKQIFNGVALSQSQIDSSKTIFYSLPFYRNLLYNPQTNAWLMGVRINNDILNSEKRTGVVKKF

SEQ ID NO: 3531 - DNA, 453 bp, Unknown
  Obtained from environmental sample
  misc_feature (1)..(453): n is a, c, g, or t
gtgattaatgaaaacgtcgaaactgaacttgattggtttaaagcatctcaacttgcgtataaaaagacttatgcttttgaatggcagggtgataatttgctccttgcacgtgaagcaatgctcactacgtttatagagaactacaaacaaaagtttaacaaagagcctttgctaaagaacatcaaatctattgcacatattatttcatggaatgtttggcaaatggatggattgaagggcgttattccaagtagttgtcatgatgtaattaaagtgtctcaagatttgtttggaaacaaatcagaacatgtccaagaatgtaatggttgtaagacaaataacattttctcccacaacggtatttattgtataattatggattgggagaaaaaagataaagaaacaaaatctactggtaagaaaatcaggttcattgacctgcttaacaaataa

SEQ ID NO: 3532 - protein, 150 aa, Unknown
  Obtained from environmental sample
  misc_feature (1)..(150): Xaa is any amino acid
MINENVETELDWFKASQLAYKKTYAFEWQGDNLLLAREAMLTTFIENYKQKFNKEPLLKNIKSIAHIISWNVWQMDGLKGVIPSSCHDVIKVSQDLFGNKSEHVQECNGCKTNNIFSHNGIYCIIMDWEKKDKETKSTGKKIRFIDLLNK

SEQ ID NO: 3533 - DNA, 618 bp, Unknown
  Obtained from environmental sample
  misc_feature (1)..(618): n is a, c, g, or t
atgtgccgacatatagtttgcgttttgccttatcgtgcatcttgtgatgcactagaagctttaatcaaaggtcacaagtttaaacaccttagcagctacgaaataataaatatctctggtgtagaaagcgataagatttataaagacacagaatcgattaaagcgaaaatcaaaaagcttgaagcggagaacaagaaaacaatcacgttaactgtaaaccgaatgcttacgggaagtactgttcatgaatgggacactatgctttttctcaaagacactgcttcacctcaagaatatgaccaagctatttttaggctgcaaaatcagtatataagggtattcaaagaaccgaatggtgatgtggttaagtacaatatgaaaccacagaccttgcttgttgactttaacccaaacagaatgttccagatgcaggaacataaatcgcagatttacaatgtgaataccgataaaaacggcaatagcaaactggaagaaagaatccaaaaggaacttgaaatatccccaatcgttgtactaaataaaaataagattgtacaaatcgagccttccgatattcttgatgctgtccgtaaatattcaagcagcaggaggtactga

SEQ ID NO: 3534 - protein, 205 aa, Unknown
  Obtained from environmental sample
  misc_feature (1)..(205): Xaa is any amino acid
MCRHIVCVLPYRASCDALEALIKGHKFKHLSSYEIINISGVESDKIYKDTESIKAKIKKLEAENKKTITLTVNRMLTGSTVHEWDTMLFLKDTASPQEYDQAIFRLQNQYIRVFKEPNGDVVKYNMKPQTLLVDFNPNRMFQMQEHKSQIYNVNTDKNGNSKLEERIQKELEISPIVVLNKNKIVQIEPSDILDAVRKYSSSRRY

SEQ ID NO: 3535 - DNA, 354 bp, Unknown
  Obtained from environmental sample
  misc_feature (1)..(354): n is a, c, g, or t
ttgttatttggtgcttttttaaaaaaaacagaaaccatgttcaagaattatctaaagatcgcctggagaaatctgtttcgaaacaaaggattcagtatcacaaatattctcggattgattatcggcatcacctgtacgatgctgatccttttttgggtgcaggacgaaattacctacgataaatttcacaagaactacgacaacatataccaggtaatcgccaaccgtgatttcaagaatgagatctttacggaccgcaatatggtgttcccgctctccaaagagctggagacaggatttccgcatataaaaaatgcagtgggtcataaccctatcgcaaaacccatgtgctga

SEQ ID NO: 3536 - protein, 117 aa, Unknown
  Obtained from environmental sample
  misc_feature (1)..(117): Xaa is any amino acid
MLFGAFLKKTETMFKNYLKIAWRNLFRNKGFSITNILGLIIGITCTMLILFWVQDEITYDKFHKNYDNIYQVIANRDFKNEIFTDRNMVFPLSKELETGFPHIKNAVGHNPIAKPMC

SEQ ID NO: 3537 - DNA, 978 bp, Unknown
  Obtained from environmental sample
  misc_feature (1)..(978): n is a, c, g, or t
atggtttttgtcgtcgccatttttttacttctcttcgttatctatttttttatttcgggaagtttaagcaagagggctattccttctcatcattatttagataaaattgtaaaagaaattgatactataagccagctaatttattggatagaagaaaagaagctctccgctggtttacttaatcggttacaagcctctgtgcaaataaacaatgaaaaagcgcatatccagataaaggaattaaaggacattttaaaccgttttgatcttcgggaaagaagtcccatcatttttattttcgcaaacagttttttactatgggatgcgtggcaaatgatttctctaaatacatggaaaagaaaaaataaacagaaattatcactgtggtatcaactcattgccgaatttgaagttttgaacagtttatctacggcgcattttaattatcctgaatggacaattccaacttttgaaaaagaacatttcacgttagcggttgaaagattagggcatccgctgatacatcctgcccaaagggtaagcagcgattttgatttgaaaggccagtcaaagattgcattaattacaggctccaatatggcaggcaaaagcacgtttttacgaagccttggtgttaatattattcttgcgcagtcaggctcaccggtttgtgccagcacatttgtcttatctcgcaataaattaatgagcagtatgcgcattgcagataacctggcggagaatacttctacattttatgcggagttaaaaaaattaaagtccataattgaagccgtaaatcataacgaacctgtatttattttattggatgaaattttacggggcaccaattcattggacaaacacaccggctccgaagcattgatacggcaaatgataaaacaaaaagctgtagctgtattggccactcatgatgtaacgctcggaaaattgaaaatgaatttcccgatttcataa

SEQ ID NO: 3538 - protein, 325 aa, Unknown
  Obtained from environmental sample
  DOMAIN (152)...(325): MutS domain V
  misc_feature (1)..(325): Xaa is any amino acid
MVFVVAIFLLLFVIYFFISGSLSKRAIPSHHYLDKIVKEIDTISQLIYWIEEKKLSAGLLNRLQASVQINNEKAHIQIKELKDILNRFDLRERSPIIFIFANSFLLWDAWQMISLNTWKRKNKQKLSLWYQLIAEFEVLNSLSTAHFNYPEWTIPTFEKEHFTLAVERLGHPLIHPAQRVSSDFDLKGQSKIALITGSNMAGKSTFLRSLGVNIILAQSGSPVCASTFVLSRNKLMSSMRIADNLAENTSTFYAELKKLKSIIEAVNHNEPVFILLDEILRGTNSLDKHTGSEALIRQMIKQKAVAVLATHDVTLGKLKMNFPIS

SEQ ID NO: 3539 - DNA, 648 bp, Unknown
  Obtained from environmental sample
  misc_feature (1)..(648): n is a, c, g, or t
ttgaaaccgttgttttacggaatggcttgggctgataatatttataaacatgcaggtgttatacccgtagtttttattgatagttatgtgcttccatccctttacaaatattatcatccggatgtgcagaccaccggatttaatactattaattatcgcagaaatcattttacaatttccgatgatgaaataagattgaataataagagggtttatgtagaagttggaaaaaagatagacatttcggatttttctattgaaggtctttacaccaatacctatttgcatttggttgattcttttaaagcggtaaatgcacttaagataaaatgggctaatgtagtaaagcatggtaagccgggagaagaaattcaggcatttttgacattacgcaacacagctaaagaaataattacggatccagcccttgcaataagctatactttttacagaaccaggaaagataaaataacatctcctccagcctttataaatgaaaaagaatttatgccgggtggggaaatagaaagaggtattcctttaaggctgcctttgaaaaggggtaaataccggcttgttttttctgtaaactattatccctttgagggaacgctggcaagcgattattataatgttattgttgactag

SEQ ID NO: 3540 - protein, 215 aa, Unknown
  Obtained from environmental sample
  misc_feature (1)..(215): Xaa is any amino acid
MKPLFYGMAWADNIYKHAGVIPVVFIDSYVLPSLYKYYHPDVQTTGFNTINYRRNHFTISDDEIRLNNKRVYVEVGKKIDISDFSIEGLYTNTYLHLVDSFKAVNALKIKWANVVKHGKPGEEIQAFLTLRNTAKEIITDPALAISYTFYRTRKDKITSPPAFINEKEFMPGGEIERGIPLRLPLKRGKYRLVFSVNYYPFEGTLASDYYNVIVD

SEQ ID NO: 3541 - DNA, 792 bp, Unknown
  Obtained from environmental sample
  misc_feature (1)..(792): n is a, c, g, or t
atgaataacaacaaacgcagctgggccgagccatataaaatgaaaatggtagagctgttgaaaatgacaactcctgcgcaacgcaaagtagcattgaaagaggcggggtacaatacatttttactcagatcggaggatgtatacattgatctgctgacagacagcggcacttccgccatgagtgacaggcagtgggccggaatgatgatgggcgatgaagcgtatgcaggcagcagaaatttttatcacctggaagaagtggttaaatccgtgtacggctataaatatctcataccgacacatcagggccgcggcgcagagaacatcctctccaggatccttatcaaaaaaggcgatatcattcccggcaatatgtatttcactaccacaagattacaccaggaattggcaggtggaaaatttgaagacatcatcatcgatgaagcgcatgatccagaaagcgaatttccgttcaaaggcaatgtcgacctggacaagcttcagaaacttattgacaaacatggcgccaaaaagattccttatgtcagcattgcaacgagtgtgaatatggcaggcggccagccgatcagcatgaaaaatcttaaagaacttagagcactcacgcggaaacatggcatccgcatcattcatgacatgacaagggttgctgaaaatgcttatttcatttcacaacgtgaaagcggatatcatgataaacctatcaaggacatcgtaaaacaaatctgtaatctgacggatgaagccactatgagcgcaagaaagatgcgttag

SEQ ID NO: 3542 - protein, 263 aa, Unknown
  Obtained from environmental sample
  DOMAIN (6)...(263): Beta-eliminating lyase
  misc_feature (1)..(263): Xaa is any amino acid
MNNNKRSWAEPYKMKMVELLKMTTPAQRKVALKEAGYNTFLLRSEDVYIDLLTDSGTSAMSDRQWAGMMMGDEAYAGSRNFYHLEEVVKSVYGYKYLIPTHQGRGAENILSRILIKKGDIIPGNMYFTTTRLHQELAGGKFEDIIIDEAHDPESEFPFKGNVDLDKLQKLIDKHGAKKIPYVSIATSVNMAGGQPISMKNLKELRALTRKHGIRIIHDMTRVAENAYFISQRESGYHDKPIKDIVKQICNLTDEATMSARKMR

SEQ ID NO: 3543 - DNA, 966 bp, Unknown
  Obtained from environmental sample
  misc_feature (1)..(966): n is a, c, g, or t
atgaattttttctcaccaagcactaagtgctgtacatattatccgaaattatctaattatcttgttggaggaatactttctgatgaatcaaatataccaggtaaggaaaaaattcgcgcaattataaaaaaaaggaaaggcgtacatccgcatggcgtttaccctcccaaagtgacagactatttttttaataatttgaataaacctgaagcatttggtcggactgagggattgttgtgtccatactatgacaacggtaaatgtgatgtatgggcgtttagagaaaccatgtgcagcactttcttttgcaagccggttaatggctttgcaggttggaggttttgggaatcgatgaaattctacttcagtaacgttcaaaaggctctagaaatttattgtctccttgaaacagagtttccattaggttacgaagacggaagactcaaaaattacgatattgacaatattcctgttccggatgaggactatgagaaaatttggggcgattggatgaataaggaagaggaatactatataaaatgttataacttggtgaagaacttaagtaaacaagattttgaatctattattggtattaatgaacgatatttacttgaacaggcaattaagaattttaagagcatgaacaggattccgttgcgcgtatatntgaaaaataaagaggctatcgaaattctccagaatggccattccagaatactttttagtcagtttgatgtagtgattacttgtccttttaatctactcgactatgtgggaactgtcccgatagattacaaagtacttttaagcaaaattgacaaaatcatcctggatttgaaagtccggaatatcaaattctctaatcatgagattctgcggagcgtaaagaatatactagtcatactgtcagtgtctttcaaccgattgcatctcccaccagtaccgaaagacgatgtctgctga

SEQ ID NO: 3544 - protein, 321 aa, Unknown
  Obtained from environmental sample
  misc_feature (1)..(321): Xaa is any amino acid
MNFFSPSTKCCTYYPKLSNYLVGGILSDESNIPGKEKIRAIIKKRKGVHPHGVYPPKVTDYFFNNLNKPEAFGRTEGLLCPYYDNGKCDVWAFRETMCSTFFCKPVNGFAGWRFWESMKFYFSNVQKALEIYCLLETEFPLGYEDGRLKNYDIDNIPVPDEDYEKIWGDWMNKEEEYYIKCYNLVKNLSKQDFESIIGINERYLLEQAIKNFKSMNRIPLRVYXKNKEAIEILQNGHSRILFSQFDVVITCPFNLLDYVGTVPIDYKVLLSKIDKIILDLKVRNIKFSNHEILRSVKNILVILSVSFNRLHLPPVPKDDVC

SEQ ID NO: 3545 - DNA, 600 bp, Unknown
  Obtained from environmental sample
  misc_feature (1)..(600): n is a, c, g, or t
atgatcattgtaatgccaaatgcagattcaagctggtacatcaactcctatgatggtaaggaaaaatatgaagacttttttattaaagaatttattccggccatagagaaggcgtatcatataaaggcggaaaaaaaatatagagccgtggcgggtctttctatgggagggtatggctcattgatctattctttaaaatatcccgatctgtttgtggcggttgcaccgcttagtgctgcagtgtggagtgatagccaaatggttagtacgcctgataatatatatgatattacctatggccctttatatggaaaaggattgaaaggcaatgaccggttaaataatgcatggtatgctaactccattttgaaattagttgaatctaaacctgtgaatgaattgagaaaagtgagatattggattgattgcggggatgatgattttttaactgttggaaattctttattgcatattgcattgacagaaaaaaaagtgccgcatgaatttcgtatgcgtgatggtgttcatagctggacctattggcgaaccggtattattgatgcattgcagtttatcggtgatagctttcatcagaagtaa

SEQ ID NO: 3546 - protein, 199 aa, Unknown
  Obtained from environmental sample
  DOMAIN (1)...(192): Putative esterase
  misc_feature (1)..(199): Xaa is any amino acid
MIIVMPNADSSWYINSYDGKEKYEDFFIKEFIPAIEKAYHIKAEKKYRAVAGLSMGGYGSLIYSLKYPDLFVAVAPLSAAVWSDSQMVSTPDNIYDITYGPLYGKGLKGNDRLNNAWYANSILKLVESKPVNELRKVRYWIDCGDDDFLTVGNSLLHIALTEKKVPHEFRMRDGVHSWTYWRTGIIDALQFIGDSFHQK

SEQ ID NO: 3547 - DNA, 354 bp, Unknown
  Obtained from environmental sample
  misc_feature (1)..(354): n is a, c, g, or t
atgaagtacaattttaatgaaattgagaaaaaatggcaggatttttgggaaactaataaaacctttgccgcaagtattgatcattccaaaccaaagtattacgtgctggatttcttcccgtatccttccagtgatggattgcatgtaggtcaccctgagggttacaccgcgacagatataattgcgcggtataaaaggatgaagggctttaacgtactgcacccgatgggctgggatgcattcggtctgcctgcagaacagtttgcaattaaaaccggcattcacccaaggataacaacgcaaaagagcatagataattttaagcgtcagctaaatcaatctgatcaatggtaa

SEQ ID NO: 3548 - protein, 117 aa, Unknown
  Obtained from environmental sample
  misc_feature (1)..(117): Xaa is any amino acid
MKYNFNEIEKKWQDFWETNKTFAASIDHSKPKYYVLDFFPYPSSDGLHVGHPEGYTATDIIARYKRMKGFNVLHPMGWDAFGLPAEQFAIKTGIHPRITTQKSIDNFKRQLNQSDQW

SEQ ID NO: 3549 - DNA, 465 bp, Unknown
  Obtained from environmental sample
  misc_feature (1)..(465): n is a, c, g, or t
ttgacccacaggcttaaggacataagattaatagtcatagatattgacggcacgctggttgaccagcacggaaatgttggagaaaaaacactgcagcttgccaaagagctgaaaaaacagaatattttctgcacgttgtcttctgcaaggtctttccattattccgctcacattgctgatgatctggaaattgatattccgtttgtgacgcttgacggcgcgctcatcaaaggcagaaaaggcgaagcagtctacaggggtacgcttaaagatcatttgtgcataaagctattgcgctggctgaaagcaattacggtaaaattacaatgtgcgatgaattcagcttatttgttacccccaacaatgccggttgtaaagaatacacaaagctttccgcccccaattaaagaagtacccgaattttacgggcctgaaagatattctgaaaatactgatatactgtga

SEQ ID NO: 3550 - protein, 154 aa, Unknown
  Obtained from environmental sample
  misc_feature (1)..(154): Xaa is any amino acid
MTHRLKDIRLIVIDIDGTLVDQHGNVGEKTLQLAKELKKQNIFCTLSSARSFHYSAHIADDLEIDIPFVTLDGALIKGRKGEAVYRGTLKDHLCIKLLRWLKAITVKLQCAMNSAYLLPPTMPVVKNTQSFPPPIKEVPEFYGPERYSENTDIL

SEQ ID NO: 3551 - DNA, 1059 bp, Unknown
  Obtained from environmental sample
  misc_feature (1)..(1059): n is a, c, g, or t
ttgataccatcacactttacagtaaccttcaaagaaagagagtatgatgaaagtgaatttgcttccatcatagcaaaaaagtataaaacaaatcataccgaaattccggtacatcccgaagaacttgtacatcagatcccgggcattttatccaggatggatagtcccagtggtgacggcataaacagttacattatctccgaagcaattaaaaaagccggacttaaagtggccatctccgggttaggcggagatgagctgtttgcgggatatgcttactcaaaatggtataagcgaatcgcagggcaaaatggattttggtctaattcgggttttcttcgaaacactgcagcatcaatactggatttgaaaggctccgtacgaacaaaaaaattttcgaacctgctaaagatttctgatccggcattgtataacatttaccctgttcttcgagccgtcttctcgcctaatgagatttctatgttgctgccaaccgcttctcaaccaacctcactggaaacggaattacaaaacaaaaaacaagagattgccaggtttccattctattcccaatttggcataggggatattctcggatacacggaaggtgtcctgttaaaagacagcgaccaaatgagcatggctaattctattgaattacgtgttcctttttttgatgtggatctcgtggaatatgtcctttccataccggatcattttaaaaagccgacgactcctaaaaaacttcttgttgattcaatgggttccatgatcccggaagcaatttggaataagaaaaagatggggtttgttttgccatgggacagatggcttcgcaaagaattacattcctactgcacactagctattcaaaacctgatgagcagaaatatttttcagaaagagattcttaacaatttttggcagcaattcaatcttggtgacaaatcggtatcatgggcaaaatctggacactggttgtgcctgaaaagtggatggaaaatggtattgatcaagagatcaccagtaccgtatgaatccccaaaacccaggctgtga

SEQ ID NO: 3552 - protein, 352 aa, Unknown
  Obtained from environmental sample
  DOMAIN (4)...(267): Asparagine synthase
  misc_feature (1)..(352): Xaa is any amino acid
MIPSHFTVTFKEREYDESEFASIIAKKYKTNHTEIPVHPEELVHQIPGILSRMDSPSGDGINSYIISEAIKKAGLKVAISGLGGDELFAGYAYSKWYKRIAGQNGFWSNSGFLRNTAASILDLKGSVRTKKFSNLLKISDPALYNIYPVLRAVFSPNEISMLLPTASQPTSLETELQNKKQEIARFPFYSQFGIGDILGYTEGVLLKDSDQMSMANSIELRVPFFDVDLVEYVLSIPDHFKKPTTPKKLLVDSMGSMIPEAIWNKKKMGFVLPWDRWLRKELHSYCTLAIQNLMSRNIFQKEILNNFWQQFNLGDKSVSWAKSGHWLCLKSGWKMVLIKRSPVPYESPKPRL

SEQ ID NO: 3553 - DNA, 303 bp, Unknown; identical to SEQ ID NO: 2551
  Obtained from environmental sample
  misc_feature (1)..(303): n is a, c, g, or t

SEQ ID NO: 3554 - protein, 100 aa, Unknown; identical to SEQ ID NO: 2552
  Obtained from environmental sample
  DOMAIN (1)...(90): IPP transferase
  misc_feature (1)..(100): Xaa is any amino acid

SEQ ID NO: 3555 - DNA, 447 bp, Unknown
  Obtained from environmental sample
  misc_feature (1)..(447): n is a, c, g, or t
ttgggcgaagaaatgaaatacgttcgtaaactggtggaattacatttgcgaccaattagtttaaccaatgaaaatattacggattctgccattcgacgtttattgtttgatgccggccaggatattgacgacctgatgatcctttgtgaaagtgacatcacctccaaaaacaaactaaaggttaagcgttacctggccaattttgaaatggtacgtgaaagatgcaaagaagtggaagaaaaagaccacatccgtaactggcaaccgcccatcaccggaaatatcatcatggaagtatttggaattcctccttcaaagcccgttggcattatcaaggacgcaatcaaggatgcaattttggatggaatcattaccaacgactacgaaacggcgtatcaatatatgctggaaaaaggtaaggaatgcggcctaaagcctgttcactga

SEQ ID NO: 3556 - protein, 148 aa, Unknown
  Obtained from environmental sample
  misc_feature (1)..(148): Xaa is any amino acid
MGEEMKYVRKLVELHLRPISLTNENITDSAIRRLLFDAGQDIDDLMILCESDITSKNKLKVKRYLANFEMVRERCKEVEEKDHIRNWQPPITGNIIMEVFGIPPSKPVGIIKDAIKDAILDGIITNDYETAYQYMLEKGKECGLKPVH

SEQ ID NO: 3557 - DNA, 507 bp, Unknown
  Obtained from environmental sample
  misc_feature (1)..(507): n is a, c, g, or t
gtggcaagtgcaatgaaacctttcgttattatactgcttatcgttttgggacactcttcctacggacaaaaatcttccgacacatgtctgactgaaaggcaatttcacgacttaaagtatcgaatataccttttggtagacaataatagaagtcaacaatttcaaattcgcctattgactgatttgaatcgaattgacacagttcataactctgccgactcattagtcgttaaatacttcgacaaaacagagaaacttataaggacacagaaaaagtatcttaaaaacggctgcacaaaagactcgttggtggttcattacaacaaagacgaacttgtagcatatattgaaaattggagttcaagtctatgtgacgcagacacaaccgacaaagagaacaggtattttgtttacaagaactcttactcaagatatgagtatgactcagcgaaaagggtgacaaaatatgtatttcatatatctacacccatgacaagacgaatttaa

SEQ ID NO: 3558 - protein, 168 aa, Unknown
  Obtained from environmental sample
  misc_feature (1)..(168): Xaa is any amino acid
MASAMKPFVIILLIVLGHSSYGQKSSDTCLTERQFHDLKYRIYLLVDNNRSQQFQIRLLTDLNRIDTVHNSADSLVVKYFDKTEKLIRTQKKYLKNGCTKDSLVVHYNKDELVAYIENWSSSLCDADTTDKENRYFVYKNSYSRYEYDSAKRVTKYVFHISTPMTRRI

SEQ ID NO: 3559 - DNA, 447 bp, Unknown; identical to SEQ ID NO: 883
  Obtained from environmental sample
  misc_feature (1)..(447): n is a, c, g, or t

SEQ ID NO: 3560 - protein, 148 aa, Unknown; identical to SEQ ID NO: 884
  Obtained from environmental sample
  misc_feature (1)..(148): Xaa is any amino acid

SEQ ID NO: 3561 - DNA, 705 bp, Unknown
  Obtained from environmental sample
  misc_feature (1)..(705): n is a, c, g, or t
ttgnaaagggttgttataagctatactggaggaaatactttaactgctggtgatatcgggaaattcgtttccggataccaggtgttgaatccggatcttgctatctgtagccttgatgagaaagttaaattcaatatggaattaacaatcgagaaaggtcgcggataccgtccggctgaggagaacaaaagagcaggtactgatattggagtaattgctatcgattctatcttcaccccgatcgtaaacgttcgttataatattgagaacttccgggttgagcaaaaaacggattatgaaaaattaatcatggaagttcagtctgatggatctattgctccaaaagaagcattgaaggaggcggctaaaattcttatccaccactttatgttattctctgatgagagaattactttggatactgaagagaaatctcaaacagaggaatttgacgaagagtcattacatatgagacagttgttgaagacaaaactggtagacatggatctttcagttcgtgctttaaactgcttgaaagcggctgatgtagaaactcttggtgatttggtatcattcaataaaaacgatcttttaaaattccgcaacttcggaaaaaaatctcttgttgagttggaagacttagttagagcaaaaggattacattttggaatgaaccttgctaaatataaattagagaaagactaa

SEQ ID NO: 3562 - protein, 234 aa, Unknown
  Obtained from environmental sample
  DOMAIN (4)...(79): RNA polymerase Rpb3/RpoA insert domain
  misc_feature (1)..(234): Xaa is any amino acid
MXRVVISYTGGNTLTAGDIGKFVSGYQVLNPDLAICSLDEKVKFNMELTIEKGRGYRPAEENKRAGTDIGVIAIDSIFTPIVNVRYNIENFRVEQKTDYEKLIMEVQSDGSIAPKEALKEAAKILIHHFMLFSDERITLDTEEKSQTEEFDEESLHMRQLLKTKLVDMDLSVRALNCLKAADVETLGDLVSFNKNDLLKFRNFGKKSLVELEDLVRAKGLHFGMNLAKYKLEKD

SEQ ID NO: 3563 - DNA, 357 bp, Unknown
  Obtained from environmental sample
  misc_feature (1)..(357): n is a, c, g, or t
atgagcccaaaagaagttctattgaaatggttagagtactttaatagtgctgacgcagaaaatatttcaagcctgtatgctgaaaatgcaattaaccatcaagttgcaaacgagcctgttgtaggacaaaaagcaatacgtgaaatgtttagccgggaatttggcaacgcaaaaatggtttgtataccagaaaatatttttgaagataaagattgggtcatcttagagtggaaagaccctaaagaaatgagaggctgcggtttctttcaaattcaaaatgataagattgtattccaacgtggctattgggataaactttcatttcacaaaatttataatattccattgaacctttaa

SEQ ID NO: 3564 - protein, 118 aa, Unknown
  Obtained from environmental sample
  misc_feature (1)..(118): Xaa is any amino acid
MSPKEVLLKWLEYFNSADAENISSLYAENAINHQVANEPVVGQKAIREMFSREFGNAKMVCIPENIFEDKDWVILEWKDPKEMRGCGFFQIQNDKIVFQRGYWDKLSFHKIYNIPLNL

SEQ ID NO: 3565 - DNA, 354 bp, Unknown
  Obtained from environmental sample
  misc_feature (1)..(354): n is a, c, g, or t
atgaagcgattcagttatttatttctactcattttattgattaatcaatgtcggaataaagaggagaatattcctacacaattttccggaaaacccgaagttcctgcttctatcaaaaatgaacatcaatatctccttgataaaattcataaaataactttatatcaagacagtacaggccgtacggcagtaaaactcaatgagttgatgcaacatcattttaaggaagaagaagattgggtattacccccattgggactattgcaaaccctggcaagtggaaaaatacctgatcaaggcaaagaaataatacaattaacagaaaaaattaaattgcagtcgtcacatatatag

SEQ ID NO: 3566 - protein, 117 aa, Unknown
  Obtained from environmental sample
  SIGNAL (1)...(19)
  misc_feature (1)..(117): Xaa is any amino acid
MKRFSYLFLLILLINQCRNKEENIPTQFSGKPEVPASIKNEHQYLLDKIHKITLYQDSTGRTAVKLNELMQHHFKEEEDWVLPPLGLLQTLASGKIPDQGKEIIQLTEKIKLQSSHI

SEQ ID NO: 3567 - DNA, 711 bp, Unknown
  Obtained from environmental sample
  misc_feature (1)..(711): n is a, c, g, or t
atgaaaaagataatttatagatctgaagacaggggaaaggcaaattatggctggctggatacaaaatacagtttcagttttgcaaattattataatccgaaaatgatgaactttgggatgctgcgtgttcttaatgatgatactgttgttcccgcaatgggatttggaactcatccgcacgataatatggaaataattactttggttttagaaggtgcgcttgagcataaagacagtatgggcacaggttctgttatttataaagatgaagttcaggttatgtcggccggatcaggaattacacactctgagtttaatccatctgataaagatggggtaaagctttttcagatctggattttcccaaaagaaaaaaacataaaaccaaggtatgatcaaaaatcatttcctatttctgagcgaaagaataaacttattccagcagtttccggattaagtaaagaaggctcattatacatccatcaggatgcagaaatttatcttgggaattttgagaagggtaaaaaagtaaattatcagataagcaatcctgcaaacggcgcttacattttggttgtagatggaagtttaaaagttggtgatgaggaattatttaaacgtgatgcaattggaatttctgaagtaaataattttgagatagaaatgattgaggattcaaactttttgattattgatgttccgatgggttga

SEQ ID NO: 3568 - protein, 236 aa, Unknown
  Obtained from environmental sample
  DOMAIN (4)...(120): Pirin
  misc_feature (1)..(236): Xaa is any amino acid
MKKIIYRSEDRGKANYGWLDTKYSFSFANYYNPKMMNFGMLRVLNDDTVVPAMGFGTHPHDNMEIITLVLEGALEHKDSMGTGSVIYKDEVQVMSAGSGITHSEFNPSDKDGVKLFQIWIFPKEKNIKPRYDQKSFPISERKNKLIPAVSGLSKEGSLYIHQDAEIYLGNFEKGKKVNYQISNPANGAYILVVDGSLKVGDEELFKRDAIGISEVNNFEIEMIEDSNFLIIDVPMG

SEQ ID NO: 3569 - DNA, 339 bp, Unknown
  Obtained from environmental sample
  misc_feature (1)..(339): n is a, c, g, or t
ttgttcaggtatctcaacattaagccgccaaaaaccatagcgcctaaacacataacgcagcatttctttagtaatctcttcacgccctttggctcgacgatcaaagaaagaataatggacatgtgcctctgtttgtgtcattctattcatgtaatagacgccgacaaaatcatcgagcacccaacacaatccgtgagctctcggtatatcaccatcactagaaataaacagctcacaaaaatgcttgaaatctttaacgtctattccaaatatctgcggatacttctttgcacgataccaaacttctggctgttctcaggaaagaatggcatcggataa

SEQ ID NO: 3570 - protein, 112 aa, Unknown
  Obtained from environmental sample
  misc_feature (1)..(112): Xaa is any amino acid
MFRYLNIKPPKTIAPKHITQHFFSNLFTPFGSTIKERIMDMCLCLCHSIHVIDADKIIEHPTQSVSSRYITITRNKQLTKMLEIFNVYSKYLRILLCTIPNFWLFSGKNGIG

SEQ ID NO: 3571 - DNA, 468 bp, Unknown
  Obtained from environmental sample
  misc_feature (1)..(468): n is a, c, g, or t
gtgtcttattgttttgcattttaccncgaagcgtttggattttacagcgaccagtttttatataaaacagttcgcaaaacatatcatgcgatttgtgaaggccgatgcatggaagatgaagggctgatcgacaaaccattattcacgacagaactgggcaaagtcatcattgccaaaaaaggaaaggaaagccaaaccgaatggaaagtcatcgaccgctttaaatttcacacactgtttgaactgcatccgctgacaggtcgtacgcatcagatccgtgtacatctcgcatcgattggtcatccgattgttggtgatattacctatggttcttcgggaccgcttttcttctctacgttgaaaggcaagaaatacaaactgagtgcagagctcgaaacggagcggcccttacttgcacgcgtagcgctacatgcaggtgcgatcgaattgcttgatttcgatannntn

SEQ ID NO: 3572 - protein, 156 aa, Unknown
  Obtained from environmental sample
  DOMAIN (4)...(98): RNA pseudouridylate synthase
  misc_feature (1)..(156): Xaa is any amino acid
MSYCFAFYXEAFGFYSDQFLYKTVRKTYHAICEGRCMEDEGLIDKPLFTTELGKVIIAKKGKESQTEWKVIDRFKFHTLFELHPLTGRTHQIRVHLASIGHPIVGDITYGSSGPLFFSTLKGKKYKLSAELETERPLLARVALHAGAIELLDFDXX

SEQ ID NO: 3573 - DNA, 360 bp, Unknown
  Obtained from environmental sample
  misc_feature (1)..(360): n is a, c, g, or t
ttgacttgtcgtccacttttacaggtggccggcaacttatcagacaatatgtacattgtgcaagacaagaatagtaaatggggagcgtacaatgacaaaggactattaattgttgaatgcaaatttgatgagatatggcactttaatgaaggacttgcaaaatttaaactgaatggcaaatggggattcgtggacaagaaaggaaaaataattattgaaccaacatttgaatacgcaagtcagtttacgaatggacttgcatatgcggagataaacggaaaatcgggctttataaataaaaaggggaaatttgtaattgcacccaaatttgaaattaataaaggaagtagatttgaataa

SEQ ID NO: 3574 - protein, 119 aa, Unknown
  Obtained from environmental sample
  DOMAIN (94)...(110): KWG Leptospira
  misc_feature (1)..(119): Xaa is any amino acid
MTCRPLLQVAGNLSDNMYIVQDKNSKWGAYNDKGLLIVECKFDEIWHFNEGLAKFKLNGKWGFVDKKGKIIIEPTFEYASQFTNGLAYAEINGKSGFINKKGKFVIAPKFEINKGSRFE

SEQ ID NO: 3575 - DNA, 669 bp, Unknown
  Obtained from environmental sample
  misc_feature (1)..(669): n is a, c, g, or t
ttgctggcttttgtcgttgctgtattgctggcgcagcttacgttgccgtttagcaatgatatggtgcagaagaaattgttcattgattatggatcaggacaattctggatgctttcgctgggattggttcttgtcacgggcgttgtttcaggaagttatccggcattttatctctcttcattccagccggtaaaagttttaaaaggaaaaccaacgattggaaaaggagcgagcacgccgcgcaaaattctggtgacattacaatttggattctcaattttccttatcatcggaacgatcgtgatctatcgtcagattcaaatggtgaaaaatcgtgagcttggttaccagcaggagaatctcatgaacgtatcttactccaatgaagtcgccaagaactacaaggccattaaattagatctactgggaagcggagttgtagacgcagttacaaaagcaaacagttcaattacagatatcaattcgaacaacttcctgggctggccgggaaaaccagaagacctgcgtgtcatttttactacgatcgccacagagtatgactacacaaaaacgatgggaattaagttattggaaggacgtgacttttcagaagacttcaagagtgatacagcagctattctggtgacaaagccggtctcgacctcatga

SEQ ID NO: 3576 - protein, 222 aa, Unknown
  Obtained from environmental sample
  misc_feature (1)..(222): Xaa is any amino acid
MLAFVVAVLLAQLTLPFSNDMVQKKLFIDYGSGQFWMLSLGLVLVTGVVSGSYPAFYLSSFQPVKVLKGKPTIGKGASTPRKILVTLQFGFSIFLIIGTIVIYRQIQMVKNRELGYQQENLMNVSYSNEVAKNYKAIKLDLLGSGVVDAVTKANSSITDINSNNFLGWPGKPEDLRVIFTTIATEYDYTKTMGIKLLEGRDFSEDFKSDTAAILVTKPVSTS

SEQ ID NO: 3577 - DNA, 585 bp, Unknown
  Obtained from environmental sample
  misc_feature (1)..(585): n is a, c, g, or t
atgcgacaagtatgtaatttaacttttcaatactgcacagattttaaggaaaatgatgtaatgcagaattataaaaaacgtccaattcctattcctgataaccagaaagagtatttattgctttatacaacagctactcaaaatacctttcttgctgaatatataacacagttagaaatacattatattaatgaagagttatctgattttaatgaagaagaatttgaattaggtatcaattacagccgtgaagattcaacagcaagaatagaacaaaaacaaaaattagtgaaagttcgtaaattggataaatcaatttgcgataatttaaaagaattatatgattttcgctgtcaaataacaggtgttaatttttcacaaagccatgctattagtgttgtagaagcacatcacatagactattttacaaaatcttttaacaataattcagataacatattaataataagcccaaattaccatcgtctaattcataaactaaatcctgttttcgacaaacaaaatttatcttttgtttttccaaacggtttaactgaaaaaataaagattaatttgcacttatga

SEQ ID NO: 3578 - protein, 194 aa, Unknown
  Obtained from environmental sample
  misc_feature (1)..(194): Xaa is any amino acid
MRQVCNLTFQYCTDFKENDVMQNYKKRPIPIPDNQKEYLLLYTTATQNTFLAEYITQLEIHYINEELSDFNEEEFELGINYSREDSTARIEQKQKLVKVRKLDKSICDNLKELYDFRCQITGVNFSQSHAISVVEAHHIDYFTKSFNNNSDNILIISPNYHRLIHKLNPVFDKQNLSFVFPNGLTEKIKINLHL

SEQ ID NO: 3579 - DNA, 381 bp, Unknown
  Obtained from environmental sample
  misc_feature (1)..(381): n is a, c, g, or t
gtgcgggcgtctattcacccggaattgttgataccagaaattgtgattgatgcggaaatttcgttgatggaaattaagcaatcgttttacgatatcatatgccagatggaaccgtttggacctgataatttaaggcctgtttttgttgccaaaaaggtttataatacaggctggagcaaagtggtgaaagaaaaccatatccgctttgttttacagcaaggtaccgcaaagattacaggcattggatttaatatggctgagaaaatgcccctgcttgaagcaggtaaggcagtggatgttgtttttaaactggatgaaaacgaatggaacggtgaaaaaagccttcagctaaaggtgattgatgtaaggatcaccgaataa

SEQ ID NO: 3580 - protein, 126 aa, Unknown
  Obtained from environmental sample
  misc_feature (1)..(126): Xaa is any amino acid
MRASIHPELLIPEIVIDAEISLMEIKQSFYDIICQMEPFGPDNLRPVFVAKKVYNTGWSKVVKENHIRFVLQQGTAKITGIGFNMAEKMPLLEAGKAVDVVFKLDENEWNGEKSLQLKVIDVRITE

SEQ ID NO: 3581 - DNA, 477 bp, Unknown
  Obtained from environmental sample
  misc_feature (1)..(477): n is a, c, g, or t
ttggatggttccaattattacagaaaaaagaaatctgagtggatattaagtactatgcgttactatttgcctggggatatagaagttcctgaaaacagaaaagaagtcatttcattaacaacagatcatattggttttatcatttctcaatccaactacaaacagtttttaactcctgcttatgttgaagagagaataacaaaatccattagtgcggcgataatgaaaaaagataaacttattgcgtggggtttaacccacgatgatggcgcgcttggttctcttcacgtacttgatgaatacagaaagaaaggctatggaaaagaaatcctgatttcacttattcatcaaaacaaaaaacttggtaaaatttcttttgcgcagattgaggaaaaaaatacaaaagcatcaaatcttgcagaacaattgggatttgtgaaagacagaagagttagctggattaaattaaaggaataa

SEQ ID NO: 3582 - protein, 158 aa, Unknown
  Obtained from environmental sample
  DOMAIN (72)...(146): Acetyltransferase (GNAT) family
  misc_feature (1)..(158): Xaa is any amino acid
MDGSNYYRKKKSEWILSTMRYYLPGDIEVPENRKEVISLTTDHIGFIISQSNYKQFLTPAYVEERITKSISAAIMKKDKLIAWGLTHDDGALGSLHVLDEYRKKGYGKEILISLIHQNKKLGKISFAQIEEKNTKASNLAEQLGFVKDRRVSWIKLKE

SEQ ID NO: 3583 - DNA, 675 bp, Unknown
  Obtained from environmental sample
  misc_feature (1)..(675): n is a, c, g, or t
ttgacttctttggatcaaggacttttgaaagaaattgttgcgttcaaagacaagtatccgttccgtttgatggtggacgatgcgcatggtttcggtacgatgggaaaaacgggagcgggaaccggcgaagcgcagggttgccaggacggtattgacatttacttcagcacgtttgcaaaatcaatggcttcgattggtggctttatgagtgccgacgaacaggtgattgaatatttgcgttacaacaaccgctcgcagatttttgcgaagtcgttgccgatgccgtttgtaattggtaacctgaagcgtttggagctgctgcgttccaagcccgagctgaaagacaagctgtgggacaatgtgaagaaattacaagccggacttcgcgaacgcggattcaacattggtaaaacaaatacaccggtaacacctgtttacttaagcggtacgacgaacgaagcagcaaatcttatcatggacatacgcgagaactacaacattttcctaagcatcgtgttgtatcctgtggtgccgaaaggtgtgatgatgctgcgtttgattcctactgctgtgcataccgatgaagacatcagtttgacgttgcaatgtttttctgaaataggagagaagctgcagaaaggtgtttaccaatcgcagaaactggtgacggtgtaa

SEQ ID NO: 3584 - protein, 224 aa, Unknown
  Obtained from environmental sample
  misc_feature (1)..(224): Xaa is any amino acid
MTSLDQGLLKEIVAFKDKYPFRLMVDDAHGFGTMGKTGAGTGEAQGCQDGIDIYFSTFAKSMASIGGFMSADEQVIEYLRYNNRSQIFAKSLPMPFVIGNLKRLELLRSKPELKDKLWDNVKKLQAGLRERGFNIGKTNTPVTPVYLSGTTNEAANLIMDIRENYNIFLSIVLYPVVPKGVMMLRLIPTAVHTDEDISLTLQCFSEIGEKLQKGVYQSQKLVTV

SEQ ID NO: 3585 - DNA, 675 bp, Unknown
  Obtained from environmental sample
  misc_feature (1)..(675): n is a, c, g, or t
ttgaaattgcgtttgttgctgcagtacctatgtaagaatttagataaggaacgaaaaatgtacaaactaatagcggtaggtttgttaattgcaataggtttggcaacgacacagcatagttttgcccaaactaaatcggcagagatggagcgaataattaacgagtaccttaccaataaacaatttatgggtacagtattggttgcagaagcagaccacataattctcaataggggctatgggtacgctaatttggagtggaatattcccaacacgcccgaaacaaaatttagaattgcctctcttacaaaacaatttactgctgcgagcattttattgctggaggaaaaaggtaaattgaaaacaacagatacaattacaaaatactttcctgacgcgccggagtcctggaaaaagatcacgattttcaatcttctcaatcatagctctggcatttcggatttcacagcctttccggaaatcaaatcgtttcagttatcacctactacccccactaacacaatagacttatttaaaaacaagccattgaacttccaacctggcgaaaaagtaagttattcaagctcgggttatattttacttggcgcactgatcgaaaaaatcactgggaaaagttacggatcatttgtaatagataatatattttaccgctaa

SEQ ID NO: 3586 - protein, 224 aa, Unknown
  Obtained from environmental sample
  DOMAIN (49)...(224): Beta-lactamase
  misc_feature (1)..(224): Xaa is any amino acid
MKLRLLLQYLCKNLDKERKMYKLIAVGLLIAIGLATTQHSFAQTKSAEMERIINEYLTNKQFMGTVLVAEADHIILNRGYGYANLEWNIPNTPETKFRIASLTKQFTAASILLLEEKGKLKTTDTITKYFPDAPESWKKITIFNLLNHSSGISDFTAFPEIKSFQLSPTTPTNTIDLFKNKPLNFQPGEKVSYSSSGYILLGALIEKITGKSYGSFVIDNIFYR

SEQ ID NO: 3587 - DNA, 849 bp, Unknown
  Obtained from environmental sample
  misc_feature (1)..(849): n is a, c, g, or t
atgagatatattactcattatcaaccctttgaaatagacaagagttatttattaaatcgacatatattattatgttctattgataatattgtttattctggtattatgatagatattgttgataatatgaatataaaaataagaacaccaaaattggaagtaaaaacaattcaaataagtgatatattagatattagttcattttatttatattataaagaatatttttatgatgacttctttattaaagaattatataataatatatatcttacagatgccctttttcaaaagttgaataaatttaacactaatttatcatttatattagcacaatacaataatatatctgtagtatgtttcaaaagaggtgaaaatgtcgatatttatgattattcttctaatattattgaattaaatataccaaaagataatatcaaccaaatcactgaaataactcaacgtatcgttcaatttccagtagaatataaaaaattaatagataatgaaaaaaaattaagagaaaatataaatgaacactatgaaaatgataattctaatttatatggcacggtaaattattctgacataactcttgatttagtccaaacgcgtcaaatacctgggaaaatagagttattgaaaatgaaaaaaaaagaatatagtttcatattctttataatacataaatataaagataatgatataatttatgtccttactgatctaataataagagatgatgaaataatagcatataaagcatataattcacttataaaagaggaagaaaatattaacaatattaaaatttataattatggtgaatttaaaacattggttacaaat

SEQ ID NO: 3588 - protein, 283 aa, Unknown
  Obtained from environmental sample
  misc_feature (1)..(283): Xaa is any amino acid
MRYITHYQPFEIDKSYLLNRHILLCSIDNIVYSGIMIDIVDNMNIKIRTPKLEVKTIQISDILDISSFYLYYKEYFYDDFFIKELYNNIYLTDALFQKLNKFNTNLSFILAQYNNISVVCFKRGENVDIYDYSSNIIELNIPKDNINQITEITQRIVQFPVEYKKLIDNEKKLRENINEHYENDNSNLYGTVNYSDITLDLVQTRQIPGKIELLKMKKKEYSFIFFIIHKYKDNDIIYVLTDLIIRDDEIIAYKAYNSLIKEEENINNIKIYNYGEFKTLVTN

SEQ ID NO: 3589 - DNA, 621 bp, Unknown
  Obtained from environmental sample
  misc_feature (1)..(621): n is a, c, g, or t
atggatgtgtttcgttcaggtaaggagctgcgctttaatttttctaaaaaagttatactgggcattcacctcatgctgaccggcgacttacatttctttgaagaatcaaatgagcggaaatcgaccattgtagagttgcggtttaaagatggcaccggcctggcgcttactgaccgtatgaaaaatgctaacgttaaattgaatcctgttgacaaagcgggcattgatgcacttgacatcaattataaaacgctcaaagaaattttaaaccgaaaagcggtcatcaaaaatgttcttttggaccaggatatcatacaaggcatcggcaattcttattccgacgagattttgtggcaaacaagaatttcaccattctcaaaagcgaatgccatacctgatgaaaaaatcaaggaattggctaccactataaagaaagttttaaaagcggccactgaaaaaatttacaaaaatcatcctggcaagattaatagcgaggtgaaagactacctgcaaattcacaccaagaagaaagcagaaagccccaccggcaaaccaatactcactgcagagcgaggcatgcttttgacttactatacggatgagcagattttgtatgagtga

SEQ ID NO: 3590 - protein, 206 aa, Unknown
  Obtained from environmental sample
  DOMAIN (73)...(170): Formamidopyrimidine-DNA glycosylase H2TH domain
  misc_feature (1)..(206): Xaa is any amino acid
MDVFRSGKELRFNFSKKVILGIHLMLTGDLHFFEESNERKSTIVELRFKDGTGLALTDRMKNANVKLNPVDKAGIDALDINYKTLKEILNRKAVIKNVLLDQDIIQGIGNSYSDEILWQTRISPFSKANAIPDEKIKELATTIKKVLKAATEKIYKNHPGKINSEVKDYLQIHTKKKAESPTGKPILTAERGMLLTYYTDEQILYE

SEQ ID NO: 3591 - DNA, 747 bp, Unknown
  Obtained from environmental sample
  misc_feature (1)..(747): n is a, c, g, or t
atgacgatctctattgagcctaccactgcatgcaatcttcgatgtcctgaatgtccgagcggattacgttcgttttcacgtgatacgggaaatttgaaagaagattttttccgcaaactcatcgacgacatgcatcggcaactgatgtatttaatattttactttcaaggggaaccttatatcaatccaaatttcctcaatatggtaaaatatgcccacgaccggggcatttacaccattacttctacaaacggccattttttacatcccgaaaatgctcgcaaaactgttgaatcaggtcttgatcgaatattgatctctatcgatggttcgacgcaggaagtgtatgagcaatatcgcaaggaaggaaaactggaaactgtattgcagggagcgagaaacttggtggcagctaaacgggatacgggatctgcaacgccccatatcatttttcagatgttgatcgtcaggccaaacgaacatcaaatcgaggatgtcaaaaaactggcaaaagaaattggtgtcaacgaagtcaaattgaaaaccgctcaggtgtataattacgaaaaaggtaatgagctgattcctacactggataaatacagtcgctataagcaacatgctcccggtcaatggaaagtgaaaaacactttactgaaccaatgctggaaactatggcacgcatgcgtcattacatgggatggtattgtggtcccctgctgttttgataaggatgctatctattaa

SEQ ID NO: 3592 - protein, 248 aa, Unknown
  Obtained from environmental sample
  DOMAIN (5)...(170): Radical SAM superfamily
  misc_feature (1)..(248): Xaa is any amino acid
MTISIEPTTACNLRCPECPSGLRSFSRDTGNLKEDFFRKLIDDMHRQLMYLIFYFQGEPYINPNFLNMVKYAHDRGIYTITSTNGHFLHPENARKTVESGLDRILISIDGSTQEVYEQYRKEGKLETVLQGARNLVAAKRDTGSATPHIIFQMLIVRPNEHQIEDVKKLAKEIGVNEVKLKTAQVYNYEKGNELIPTLDKYSRYKQHAPGQWKVKNTLLNQCWKLWHACVITWDGIVVPCCFDKDAIY

SEQ ID NO: 3593 - DNA, 357 bp, Unknown
  Obtained from environmental sample
  misc_feature (1)..(357): n is a, c, g, or t
ttggtaaagagaggactcagcaaagccgagcataccgagttgaatgaaaaatataagttcggcgacaatgaagtcaactttgtcacttttgatgttaccggaaaagacaaaaataaaatccgccttacaaaaaaagaaattctgttgttgaaacttctgatcgacaggaaaaatgaggttgtatcgcgcgagcaaatattggaaaccgtgtggggatacgacatctatccatcaacgcgtacagtagacaatttcatacttgctttcaggaaatatttcgaacccgatcccaagaatccaaaatattttttttccatcaggggtgtgggatataagtttgtgagtgacgaggcataa

SEQ ID NO: 3594 - protein, 118 aa, Unknown
  Obtained from environmental sample
  DOMAIN (36)...(113): Transcriptional regulatory protein, C terminal
  misc_feature (1)..(118): Xaa is any amino acid
MVKRGLSKAEHTELNEKYKFGDNEVNFVTFDVTGKDKNKIRLTKKEILLLKLLIDRKNEVVSREQILETVWGYDIYPSTRTVDNFILAFRKYFEPDPKNPKYFFSIRGVGYKFVSDEA

SEQ ID NO: 3595 - DNA, 687 bp, Unknown
  Obtained from environmental sample
  misc_feature (1)..(687): n is a, c, g, or t
ttgtcggttcaagtccgacgggcggctccatttatttgggaatatatgaaaattattaaaaataataagatttttatacataaaaacatagctccgctggtaaatccaaacgtacccacccaaaagaaatccagaaaatcatatctcataaaaaggataatagttacaaacggattaagtttaataattgtcgttcttacttatctgtggatggtctttctgctttccagcgtcagttctttctgggacttattccgaggaaaagatatttatgttgacgaagataaaactcctcctattccgccatttttgaaaactatccccgaagctactcaaagttccagtatagatatagtcggtcaatccgaatcaggtgtgaaagttgaactgtttgttgacggaagcaaggtagcagaaactgtaagtgactcaaacggaggatttgtattcgctgccattcctgtgggggtatttaaacaggaaatattcgcaaaagcgatagatgacacagggaatgacagcaatatgtcgaatatttatgctatacagcaggacacaactgcgcccgaagtcgaaattacatcagctaaatccagctctatcggaacaagcagtacaggacataccttagaaattgcgggaaaattgaaccaggttcaacggctatgtacaaggcagttgcagtaa

SEQ ID NO: 3596 - protein, 228 aa, Unknown
  Obtained from environmental sample
  misc_feature (1)..(228): Xaa is any amino acid
MSVQVRRAAPFIWEYMKIIKNNKIFIHKNIAPLVNPNVPTQKKSRKSYLIKRIIVTNGLSLIIVVLTYLWMVFLLSSVSSFWDLFRGKDIYVDEDKTPPIPPFLKTIPEATQSSSIDIVGQSESGVKVELFVDGSKVAETVSDSNGGFVFAAIPVGVFKQEIFAKAIDDTGNDSNMSNIYAIQQDTTAPEVEITSAKSSSIGTSSTGHTLEIAGKLNQVQRLCTRQLQ

SEQ ID NO: 3597 - DNA, 684 bp, Unknown
  Obtained from environmental sample
  misc_feature (1)..(684): n is a, c, g, or t
gtgttcatgctccttgccgcattcgtaatctacagcacgtgtgtttctattagctttgtaccgcctatatttatggatcattattttaccattgataagcctgccgtggctgaatttaaagatcgtggaagtaaatttattgcttatgcttatcacataaaaacaatagatgattttaagcaacgcttaaaagaattaaaaaatcaacatccaaaagcgacacattattgctttgcctacaggcttggtttgaatgaaattaattttagagttaatgatgatggtgagccatcaggtacagccggcaaaccgatactggcacaaatagatagcaaaagccttacgaatatcctggtaatagttgtgcgttatttcggcggaactttattaggcgtttccgggttgatcaatgcttatagaacagccacggcgctggttttacagttgacgccgataaaacaaaagccggtagaaaaaatctattcacttcattttgattatacacaaatcaacggggtaatgacaataataaagcaatttaactgtacaattatagagcaggaaatgcagttatttagcaggctgatcattggcgttcctgtaaaacatttagctgaagtattgagcatgtttaacgaattaaagggagttgaaataaccgaaaagaattctctgcatcaatga

SEQ ID NO: 3598 - protein, 227 aa, Unknown
  Obtained from environmental sample
  DOMAIN (41)...(148): Uncharacterized protein family UPF0029
  misc_feature (1)..(227): Xaa is any amino acid
MFMLLAAFVIYSTCVSISFVPPIFMDHYFTIDKPAVAEFKDRGSKFIAYAYHIKTIDDFKQRLKELKNQHPKATHYCFAYRLGLNEINFRVNDDGEPSGTAGKPILAQIDSKSLTNILVIVVRYFGGTLLGVSGLINAYRTATALVLQLTPIKQKPVEKIYSLHFDYTQINGVMTIIKQFNCTIIEQEMQLFSRLIIGVPVKHLAEVLSMFNELKGVEITEKNSLHQ

SEQ ID NO: 3599 - DNA, 354 bp, Unknown
  Obtained from environmental sample
  misc_feature (1)..(354): n is a, c, g, or t
atgacgatcggcttactggccggtattatgctcaccggctctgagatcaagtctatccgaaatgggaaggtgagctttaatgacagctactgttacttccataagggtgaggtctggattaaaagccttcatattgcggaatatgtaaatgctggttatgcaggacatgacccgatacgtgagcgtaagctgctcctaaacaagaaggaaatgaggaagtgggagcagaagatgaaggagaaagggtatacgatcgttccccttgctgtgttcataaatgaagagggctatgccaaggtagagataggcctcggtaagggtaagaagaccctacgacaagcgcgagagtattaa

SEQ ID NO: 3600 - protein, 117 aa, Unknown
  Obtained from environmental sample
  DOMAIN (1)...(54): SmpB protein
  misc_feature (1)..(117): Xaa is any amino acid
MTIGLLAGIMLTGSEIKSIRNGKVSFNDSYCYFHKGEVWIKSLHIAEYVNAGYAGHDPIRERKLLLNKKEMRKWEQKMKEKGYTIVPLAVFINEEGYAKVEIGLGKGKKTLRQAREY

SEQ ID NO: 3601 - DNA, 375 bp, Unknown
  Obtained from environmental sample
  misc_feature (1)..(375): n is a, c, g, or t
ttggatttaatgataaacgaattaacgatctntgtcagcaggtttgctctcatggaagcagaagctataccaccagcgaaatttttttcactgagaatatggttaacaaagctgctcgtacataaatgtatttttaaaataagcagtgagctatttagtcaaggtaattcttctaaaaccttaggacattactatggttacggtgattcgcataagttgaaccagaagcacatgcctcttagctttagagctgtttttattctaaaaaatattgttggctttgatgagaatgagattgccgaaattttaaacacaacgccgctgagcgtaaagcaaaggcttaataaggctcgtgcatatgtcaataatcactga

SEQ ID NO: 3602 - protein, 124 aa, Unknown
  Obtained from environmental sample
  misc_feature (1)..(124): Xaa is any amino acid
MDLMINELTIXVSRFALMEAEAIPPAKFFSLRIWLTKLLVHKCIFKISSELFSQGNSSKTLGHYYGYGDSHKLNQKHMPLSFRAVFILKNIVGFDENEIAEILNTTPLSVKQRLNKARAYVNNH

SEQ ID NO: 3603 - DNA, 828 bp, Unknown
  Obtained from environmental sample
  misc_feature (1)..(828): n is a, c, g, or t
ttgatgttgcgcatatttatttttcgactgcaaaagaaaagttacattattgccgatactccgggtcacgtagaatatacaagaaacatggttacaggagcttcgacttctcaggtttctatcattttgatcgatgccagaaaaggtgtaatcgagcaaacttaccgtcactttttcatcaataatttattgagagtaaaagaagtaatcgttgccatcaacaaaatggatttggtggattattctgaagaagttttcaataaaatcaaagctgattttgaggctttaaatgcaaaaagtactttcaaagaacaaaacgtaagctacattccgttaagtgcaatcaacggcggaaacgttgtggacaaatcggagaatatgccttggtacgaaggacaaacggttttagagcatttagaaggattacatgcttctgatgtatacgaagcaggaaaagcacgtttcccagttcagacggttattcgtccaaaaacagaagaatatcacgattttagaggttacgctggaaaattatacggaaactcaatcaaagttggagatgctgtaacagttcttccttctttaacagagtcaaaagttactaaaattcactttttcgataaaacatttgacgaagctacagcaggttcttcaatcacaatcgaattagaaaatgatatcaatgtaacgagaggtgatatgattgtaaaatcaagcgaacttccaaaaattgaaaaagacattaccacaacagtttgctggatggacagtaaaaaactggttgcgggaactaaatatttggtacaacacaataccacagagttttag

SEQ ID NO: 3604 - protein, 275 aa, Unknown
  Obtained from environmental sample
  DOMAIN (171)...(236): Elongation factor Tu domain 2
  misc_feature (1)..(275): Xaa is any amino acid
MMLRIFIFRLQKKSYIIADTPGHVEYTRNMVTGASTSQVSIILIDARKGVIEQTYRHFFINNLLRVKEVIVAINKMDLVDYSEEVFNKIKADFEALNAKSTFKEQNVSYIPLSAINGGNVVDKSENMPWYEGQTVLEHLEGLHASDVYEAGKARFPVQTVIRPKTEEYHDFRGYAGKLYGNSIKVGDAVTVLPSLTESKVTKIHFFDKTFDEATAGSSITIELENDINVTRGDMIVKSSELPKIEKDITTTVCWMDSKKLVAGTKYLVQHNTTEF

SEQ ID NO: 3605 - DNA, 903 bp, Unknown
  Obtained from environmental sample
  misc_feature (1)..(903): n is a, c, g, or t
atggacgttttaaaaatagcaacagcaggaagtgtagatgacggaaaaagtactttgatcggaagattattgtatgatacaaaatcgttgacaactgataaaatagaagcaatcgaaaaaagcagtaaacaaaaaggatacgattaccttgatttttctttggcaactgacggattggtggcagaaagagagcaaggaatcacgattgatgttgcgcatatttatttttcgactgcaaagaaaagttacattattgccgatactccgggtcacgtagaatatacaagaaacatggttacaggagcttcgacttctcaggtttctatcattttgatcgatgccagaaaaggtgtaatcgagcaaacttaccgtcactttttcatcaataatttattgagagtaaaagaagtaatcgttgccatcaacaaaatggatttggtggattattctgaagaagttttcaataaaatcaaagctgattttgaggctttaaatgcaaaaagtactttcaaagaacaaaacgtaagctacattccgttaagtgcaatcaacggcggaaacgttgtggacaaatcggagaatatgccttggtacgaaggacaaacggttttagagcatttagaaggattacatgcttctgatgtatacgaagcaggaaaagcacgtttcccagttcagacggttattcgtccaaaaacagaagaatatcacgattttagaggttacgctggaaaattatacggaaactcaaccaaagttggagatgctgtaccagttcttccttctttaacagagtcaaaagttactaaaattcacttttcgataaaccatttgacgaagcacaacagttcttcatccacatcgattcgaacatggttcacgtacgagaggtgccgatcgtaa

SEQ ID NO: 3606 - protein, 300 aa, Unknown
  Obtained from environmental sample
  DOMAIN (1)...(214): Elongation factor Tu GTP binding domain
  misc_feature (1)..(300): Xaa is any amino acid
MDVLKIATAGSVDDGKSTLIGRLLYDTKSLTTDKIEAIEKSSKQKGYDYLDFSLATDGLVAEREQGITIDVAHIYFSTAKKSYIIADTPGHVEYTRNMVTGASTSQVSIILIDARKGVIEQTYRHFFINNLLRVKEVIVAINKMDLVDYSEEVFNKIKADFEALNAKSTFKEQNVSYIPLSAINGGNVVDKSENMPWYEGQTVLEHLEGLHASDVYEAGKARFPVQTVIRPKTEEYHDFRGYAGKLYGNSTKVGDAVPVLPSLTESKVTKIHFSINHLTKHNSSSSTSIRTWFTYERCRS

SEQ ID NO: 3607 - DNA, 498 bp, Unknown
  Obtained from environmental sample
  misc_feature (1)..(498): n is a, c, g, or t
ttgctggaagtaaaccccgcgcacaagaaagtaaatgaagctattaccaagatagctgaggagttcacgtgtgataatggaaaaggcgataaagaattccttgcagagataactttgcttaatgcggacattatgagtttgaaatactcggactcctggtactgtgagggcatggcgaatactcagggccgtacagggtccgcaatttttaatttggccaacgggaatgagataaaagttgataatgaattatcagaagatcgttcgaaactggagatacgaattcgtgatgattttatccaatcgataaaaaataaaggggttgattgtccagaacctagaccagctttttcttatctagcaaaaaatgaaatggtgtttgttaattacagtgatgacgaggattcagttcaatgcgaggttgaagccaggattccttctactgagtttagaaagtttgtgaagaccggctctgagttatccaagctcaccaattag

SEQ ID NO: 3608 - protein, 165 aa, Unknown
  Obtained from environmental sample
  misc_feature (1)..(165): Xaa is any amino acid
MLEVNPAHKKVNEAITKIAEEFTCDNGKGDKEFLAEITLLNADIMSLKYSDSWYCEGMANTQGRTGSAIFNLANGNEIKVDNELSEDRSKLEIRIRDDFIQSIKNKGVDCPEPRPAFSYLAKNEMVFVNYSDDEDSVQCEVEARIPSTEFRKFVKTGSELSKLTN

SEQ ID NO: 3609 - DNA, 621 bp, Unknown
  Obtained from environmental sample
  misc_feature (1)..(621): n is a, c, g, or t
ttggcggnntattggtnnancttggtnaattctggatgttcgccattgttcatagcattggttattgctttcgtttacaactggaaaacaacgccggtttatagtgcctccagcacagtgttggtgaaaacaaaagatcagggcgatgtgatggacattctgaactttaccgatttgaataatgacaggaacattcagaatcaaatcgcgatcctaaagtcaaggactttattaaataagacacttcagtcgctcgacttcggagtttcttattttgtgatgaaaaatttccggacgaaagaattatataagaacagtccaatggaaataaccattgactcggctagttatgctgcttacacagttccgattaatatcaaaatattaagtccggcggagttcgagatctcttttgagaatcaaaagaagaaatataatgagaagcatcggttcggcgagtcattcaaaaccacgcttggcatgatcacacttaataagaaggagaacttcgatagatcggttagagagaatattgttaatcagacgcctgattatttaattacgctgaattctccgaatgctttgctggcgaagtacgcagcgaatttgacattgctttaa

SEQ ID NO: 3610 - protein, 206 aa, Unknown
  Obtained from environmental sample
  misc_feature (1)..(206): Xaa is any amino acid
MAXYWXXLVNSGCSPLFIALVIAFVYNWKTTPVYSASSTVLVKTKDQGDVMDILNFTDLNNDRNIQNQIAILKSRTLLNKTLQSLDFGVSYFVMKNFRTKELYKNSPMEITIDSASYAAYTVPINIKILSPAEFEISFENQKKKYNEKHRFGESFKTTLGMITLNKKENFDRSVRENIVNQTPDYLITLNSPNALLAKYAANLTLL

SEQ ID NO: 3611 - DNA, 468 bp, Unknown
  Obtained from environmental sample
  misc_feature (1)..(468): n is a, c, g, or t
gtgcttgaacaccttcagaatccgtcagaagccctgaggaatctgaaaaaaattctgaagcccggaggcacgataactgtaattgaaggagatcacggctcatgctatttttatccagaaggagaggaagctcttgcggcctggaactgtcttatcagggtacaggcatatatgagaggaaattcccttatcgggcgccagctttatcctctattgaaggattcaggtttcagagaagtaaaggtagatcccagaatggtatatgtagattccagcaaacctgaacttgtaaacggttttattctgaagacaataatccccatggtacaaggtgtaaaagaacaggctctggaaatgcaaatgatagaggaagaaacctggaataaaggaatagaagaacttcataagactgccagacctacaggcacattttgctataccttttttaaaggtaggggaataaagtaa

SEQ ID NO: 3612 - protein, 155 aa, Unknown
  Obtained from environmental sample
  misc_feature (1)..(155): Xaa is any amino acid
MLEHLQNPSEALRNLKKILKPGGTITVIEGDHGSCYFYPEGEEALAAWNCLIRVQAYMRGNSLIGRQLYPLLKDSGFREVKVDPRMVYVDSSKPELVNGFILKTIIPMVQGVKEQALEMQMIEEETWNKGIEELHKTARPTGTFCYTFFKGRGIK

SEQ ID NO: 3613 - DNA, 366 bp, Unknown
  Obtained from environmental sample
  misc_feature (1)..(366): n is a, c, g, or t
atgctattgtatccagaagaagaggaagctcttgcgccctggaactgtctaatcaggttacagcaatatttgagaggaaattcccttatcgggcgccagctttatcctctantgaaggattcaggtttcagagaagtaaaggtagatcccagaatggtatatgtagattccagcaaacctgaacttgtaaacggttttattctgaagacaataatccccatggtacaaggtgtaaaagaacaggctctggaaatgcaaatgatagaggaagaaacctggaataaaggaatagaagaacttcataagactgccagacctacaggcacattttgctataccttttttaaaggtaggggaataaagtaa

SEQ ID NO: 3614 - protein, 121 aa, Unknown
  Obtained from environmental sample
  misc_feature (1)..(121): Xaa is any amino acid
MLLYPEEEEALAPWNCLIRLQQYLRGNSLIGRQLYPLXKDSGFREVKVDPRMVYVDSSKPELVNGFILKTIIPMVQGVKEQALEMQMIEEETWNKGIEELHKTARPTGTFCYTFFKGRGIK

SEQ ID NO: 3615 - DNA, 792 bp, Unknown
  Obtained from environmental sample
  misc_feature (1)..(792): n is a, c, g, or t
atgctggaattgattaccgaaaaatgcacggacctattgttacagacaaattcaccggtatcgcaacattttgaaattgattacaccaaagacagtcaaacactttatcagaaatttgtctttataaaatcaataatcggaactgacgattttgctgaagcaatacaccgtatccttactgctcctgttactaaatggatagagacaacagaaggaaaagacattcgcaactcaaggcgattttctaacggtaatattaaagaaattctaaaaggcggtaaacgaagcagattacctgagacgcattattttagaagttatggcattgatacattgccggaacgaatatcttccataataaaaaccgattcggtagatacaccggaaaaccgttttataaaacatgtacttgaaaactttctgaagttctgtctggatattaacagcaaggcaaaaaagttcgcacataagaaaatggaaaacgaatcagaactcctgattcgtgaattggaaagtcagctacaccattccgtttttaaagacatctcaagaccaacaactttaaaactaaacagcccggttttacagcgaaaggaaggctatcgcgaagtgcttcgggtatggctaatgtttgaccttgcagcaaaacttatctggaaaggcggagacgatatatacagtggaggaaaaaagatattgccaccttatatgaatattggttattcttcaagttgctcgacttgcttcattccatattggaaattgagccctaagactttcagatttatataa

SEQ ID NO: 3616 - protein, 263 aa, Unknown
  Obtained from environmental sample
  misc_feature (1)..(263): Xaa is any amino acid
MLELITEKCTDLLLQTNSPVSQHFEIDYTKDSQTLYQKFVFIKSIIGTDDFAEAIHRILTAPVTKWIETTEGKDIRNSRRFSNGNIKEILKGGKRSRLPETHYFRSYGIDTLPERISSIIKTDSVDTPENRFIKHVLENFLKFCLDINSKAKKFAHKKMENESELLIRELESQLHHSVFKDISRPTTLKLNSPVLQRKEGYREVLRVWLMFDLAAKLIWKGGDDIYSGGKKILPPYMNIGYSSSCSTCFIPYWKLSPKTFRFI

SEQ ID NO: 3617 - DNA, 540 bp, Unknown
  Obtained from environmental sample
  misc_feature (1)..(540): n is a, c, g, or t
atgactttggaaaatcacttatcacataccagacacaggaatcttaccctgggtttgtttggcttcggatgcgtcggacagggcctgtatcatgtgctggatgaaacacaaggcatcaaggcagaaataaagaagatctgcgttaagcatcggaacaaaccacggacgcttcctgagaatttattcacgtttgataaagatgaaattttgaacgatccatctattgacgtagtagtggagctgattgatgatgcagatgcagcgtttgaaattgtcaaggctgcgttgcagaacgggaaagcagtcgttacggcaaataagaaaatgctggcagaacacctcgaggaaatttatggattgcagcaacaatatggcaagccggtattatatgagggctcagtctgcggcagtattccgatcatccgtaacctagaagaatattacgataacgatctgctgaccgggatcgaggggatttttaacggttccaccaactacatcctgacaaaggtattcgaagaaaaaaaagaattatgctga

SEQ ID NO: 3618 - protein, 179 aa, Unknown
  Obtained from environmental sample
  DOMAIN (14)...(137): Homoserine dehydrogenase, NAD binding domain
  misc_feature (1)..(179): Xaa is any amino acid
MTLENHLSHTRHRNLTLGLFGFGCVGQGLYHVLDETQGIKAEIKKICVKHRNKPRTLPENLFTFDKDEILNDPSIDVVVELIDDADAAFEIVKAALQNGKAVVTANKKMLAEHLEEIYGLQQQYGKPVLYEGSVCGSIPIIRNLEEYYDNDLLTGIEGIFNGSTNYILTKVFEEKKELC

SEQ ID NO: 3619 - DNA, 420 bp, Unknown
  Obtained from environmental sample
  misc_feature (1)..(420): n is a, c, g, or t
atgcaacttcaaatggctaagacaaacaaaaaattaaaacaaatcttgtttgcacatagtggtggtgaacaaggaagtcagggaaaaggcagttttgatttagtatctgccctcaaagcagaattatcaaatgaatataaaattcattgccccataattgacgacccggaagctccgacgtatgaaaagtggaaaattttgtttagcagagaattcaataaaatcgaagagccgattattctagttggtcattcgttaggtagctcaatgttacttaagtatttatctgaagaaaacccaaatacttcaatttcgggtttgtttttagttgctacgccactttggggaaagagcggttgggatgttgatgattttgtattgcaaaaaaactttgaagccacatttatacatatgttctaa

SEQ ID NO: 3620 - protein, 139 aa, Unknown
  Obtained from environmental sample
  misc_feature (1)..(139): Xaa is any amino acid
MQLQMAKTNKKLKQILFAHSGGEQGSQGKGSFDLVSALKAELSNEYKIHCPIIDDPEAPTYEKWKILFSREFNKIEEPIILVGHSLGSSMLLKYLSEENPNTSISGLFLVATPLWGKSGWDVDDFVLQKNFEATFIHMF

SEQ ID NO: 3621 - DNA, 375 bp, Unknown
  Obtained from environmental sample
  misc_feature (1)..(375): n is a, c, g, or t
gtgaatgaagaatggaaaccctaccttaaaagtctgcaagcgaaaacttacggattttatcgtatgggttgggttgcggataatccagacgcggatacctttattaatttatttatcaccggcggcggtaataaccacacgcaatggggaaataaacaatacgacgaatacattcgtcagggttccatggaatcagaccccgagaaaagaaaagaaatttattataaagcgcaaagaatcatcaacgaagatgaagtcccaatcattccgctttattactacgcagatgaatacatgattaacaaacgtgtaaagaacttgccgacgaatgtgatgcataagttttacttgagtgacacttcgatctctgaataa

SEQ ID NO: 3622 - protein, 124 aa, Unknown
  Obtained from environmental sample
  misc_feature (1)..(124): Xaa is any amino acid
MNEEWKPYLKSLQAKTYGFYRMGWVADNPDADTFINLFITGGGNNHTQWGNKQYDEYIRQGSMESDPEKRKEIYYKAQRIINEDEVPIIPLYYYADEYMINKRVKNLPTNVMHKFYLSDTSISE

SEQ ID NO: 3623 - DNA, 612 bp, Unknown
  Obtained from environmental sample
  misc_feature (1)..(612): n is a, c, g, or t
atgaaccgatttcaaaagcattatgtagtaacaggagggggcggttttattggcagccaggtaataaaagaattattaaaagatgatacgataaagatcacctgcattgataattttgatccattttataagcggcagctaaaactgttgaaccttgctggttttgaaaaaacccataatttttttcttttagatattgatctttccagagtttccataaagcaactacatgacgctgttagccaaccggtagatgtaatcatccatcttgctgccaaagctggagtaaggcccagcattgccaatccagttgcttatgtagaaacaaatattttgggcacgcaaacactattggattttgccgttcagaaaaaagtaaaaaagtttgtttttgcttcttccagtagtgtatatggcataaatgaaaattttccgtggaaagaagatgaattgctgatgccgatcagcccttatgccatgaccaaactttcgggtgaaatggctggacatgtttacaataaattatacccagcttccattatcgccttgcgttttttnacggtctatggggcggggcaagaccagaccttgctatccatcggtttacannnc

SEQ ID NO: 3624 - protein, 204 aa, Unknown
  Obtained from environmental sample
  DOMAIN (8)...(203): NAD dependent epimerase/dehydratase family
  misc_feature (1)..(204): Xaa is any amino acid
MNRFQKHYVVTGGGGFIGSQVIKELLKDDTIKITCIDNFDPFYKRQLKLLNLAGFEKTHNFFLLDIDLSRVSIKQLHDAVSQPVDVIIHLAAKAGVRPSIANPVAYVETNILGTQTLLDFAVQKKVKKFVFASSSSVYGINENFPWKEDELLMPISPYAMTKLSGEMAGHVYNKLYPASIIALRFXTVYGAGQDQTLLSIGLXX

SEQ ID NO: 3625 - DNA, 429 bp, Unknown
  Obtained from environmental sample
  misc_feature (1)..(429): n is a, c, g, or t
atgcaatcggggaaattatcatcaggcaacaacagggatggctattgtgcatccttaacattaataaatagtttctttatggaatattctatcaacaaaaagatcaacaagaattttaatgatgcggttgaaagtgtaacggcagaattaaagaaagaaggatttggcatcattacagaaattgatctgaaagacaaattcaaagaaaaattggacatcgattttcgcaactacaaaattctgggtgcctgcaatcccgcaatggcccacaaagcaattttggaagaagataaaataggcgtgatgcttccctgtaatgttttagtacacgaaaaggagaatggtgaagtagaaatagcagggatccatcctcttaattctattggtactattgggaatgaacatttgaaatccatagcggagggataa

SEQ ID NO: 3626 - protein, 142 aa, Unknown
  Obtained from environmental sample
  DOMAIN (30)...(142): Domain of unknown function DUF302
  misc_feature (1)..(142): Xaa is any amino acid
MQSGKLSSGNNRDGYCASLTLINSFFMEYSINKKINKNFNDAVESVTAELKKEGFGIITEIDLKDKFKEKLDIDFRNYKILGACNPAMAHKAILEEDKIGVMLPCNVLVHEKENGEVEIAGIHPLNSIGTIGNEHLKSIAEG

SEQ ID NO: 3627 - DNA, 405 bp, Unknown
  Obtained from environmental sample
  misc_feature (1)..(405): n is a, c, g, or t
ttgaccatgtatgatgaccaggaaatgatcaccaaaatgatggaaatggggtcaaatgcctacctcaccaaaactacagatccagaggaaatctaccaggcaatccttacatgtgtcaacgatgatttttattttaatgacctcgttaacaaagcagttcttttaaaacttcagcataaaaaaacagtgagacaattttatcctaatcctgtaaaattttcagaaaaagaattacgtattttaaaacatattgcagaggataaaaccacggaagaaatttcaaaagaagtttttttaagcccgcgtactattgaaacaattcgccaaaaaatgaaagaaaaggtaggagcaaaaaccatagctggcctggttatgtatgctatgcgcaacaggcttctggaataa

SEQ ID NO: 3628 - protein, 134 aa, Unknown
  Obtained from environmental sample
  DOMAIN (70)...(127): Bacterial regulatory proteins, luxR family
  misc_feature (1)..(134): Xaa is any amino acid
MTMYDDQEMITKMMEMGSNAYLTKTTDPEEIYQAILTCVNDDFYFNDLVNKAVLLKLQHKKTVRQFYPNPVKFSEKELRILKHIAEDKTTEEISKEVFLSPRTIETIRQKMKEKVGAKTIAGLVMYAMRNRLLE

SEQ ID NO: 3629 - DNA, 540 bp, Unknown
  Obtained from environmental sample
  misc_feature (1)..(540): n is a, c, g, or t
gtgtgttacaccattcctgataacggtgattgggcagtaaaagatgcagttcttaagtatggagataaagaaagaagattaacaggtggtagtttaattgaacttgttcattggccagttgatggcaagcagaaaatttatgactttcgaaaaaccaacccagatgagatcgtaaaggatgtagatgccagtcctgaaaatattccccatcgctgtgataccatctactttgaaaatattagtggggaaaccgatctttcaaacgttactttgacgatttccactttatacgctcaccctagagaaactgattactgcgatacgaaataccttgataaggttcacaaagcactcgaagcgaaaaagatgaaaataaaggtgaagtgcaaacctgaagagagcatagttgggttggatattgtcgagaaaccagctgaactgagtgatgcagaggcatataattttattgctagtgatgattttctaattgatcttaacggcatcagaggtccgtggattttcgaaacgaatataccttag

SEQ ID NO: 3630 - protein, 179 aa, Unknown
  Obtained from environmental sample
  misc_feature (1)..(179): Xaa is any amino acid
MCYTIPDNGDWAVKDAVLKYGDKERRLTGGSLIELVHWPVDGKQKIYDFRKTNPDEIVKDVDASPENIPHRCDTIYFENISGETDLSNVTLTISTLYAHPRETDYCDTKYLDKVHKALEAKKMKIKVKCKPEESIVGLDIVEKPAELSDAEAYNFIASDDFLIDLNGIRGPWIFETNIP

SEQ ID NO: 3631 - DNA, 354 bp, Unknown
  Obtained from environmental sample
  misc_feature (1)..(354): n is a, c, g, or t
gtgattacaatagcgttattagacagaaaaaaagaaaagtattatgtacctgccagggtgaagtattattctaatctctattactataaccgcatctggaattacaataccatacaggcagatatgggattgattagtggaggctatgaggaggtccccagttttttatgggaaagtattttcttcgatcttgaaaccttgtctcctatatattcggtaaaaacaaaaacttttgatcctgttagtttgaatgccatgtcgcatgaatatggcaagttaattattaaggatatgctcaaaaagaaaatgcttctacccgaggcccccaaaacggaacaactcaaagtattttga

SEQ ID NO: 3632 - protein, 117 aa, Unknown
  Obtained from environmental sample
  misc_feature (1)..(117): Xaa is any amino acid
MITIALLDRKKEKYYVPARVKYYSNLYYYNRIWNYNTIQADMGLISGGYEEVPSFLWESIFFDLETLSPIYSVKTKTFDPVSLNAMSHEYGKLIIKDMLKKKMLLPEAPKTEQLKVF

SEQ ID NO: 3633 - DNA, 378 bp, Unknown
  Obtained from environmental sample
  misc_feature (1)..(378): n is a, c, g, or t
gtgccaatgagctatgcgtacgaagaaggatatatttatgctcatgcatatgaaggaatgaagattgatatgatgcggcaaaatccaaaagtttgttttgaagtggatgttatgaaagacatgtctaactggaaaaccgtgatcgcctggggagattttgaagaattgactggcgaggatagaaatcatgctttaaaaatcttagttaacaggaagctccctttcctgtcaagcattaccgcaaaattttctaaagactggccttttttctccgcagattataaagaaattgagggtattgttttcagaatttttttaattgaaaaaacaggacgttttgaattaaatactgctactactttttcctacactatgtaa

SEQ ID NO: 3634 - protein, 125 aa, Unknown
  Obtained from environmental sample
  misc_feature (1)..(125): Xaa is any amino acid
MPMSYAYEEGYIYAHAYEGMKIDMMRQNPKVCFEVDVMKDMSNWKTVIAWGDFEELTGEDRNHALKILVNRKLPFLSSITAKFSKDWPFFSADYKEIEGIVFRIFLIEKTGRFELNTATTFSYTM

SEQ ID NO: 3635 - DNA, 462 bp, Unknown
  Obtained from environmental sample
  misc_feature (1)..(462): n is a, c, g, or t
atgcaatccggaaaatcgaaaatgatacggagaaattcagtttcaatacaggggtccagcagtttcatgattgccaccaatgaattgactgatttgaaatgccataaacgttccgtcctcgaacctttgttgatcctgctggcaccttatgccccgcatattgccgaggaattatatgcgaaactacaggagtattttccgaaactatataaaggaggagcttccatcctggatgccgcctatcccgttttcgaagaaaaatatgtaaaggaaaccagtaaggaatacccggtctcggtaaatggaaaaacaaggaccacgattgatatttcactcgaagcggcccagcccgaagtcgagcagatcgtcctgaataatgaggtggtccagaaatggctggaagggcgtcaacctaaaaagatcatatttgtgaagggaaaaatggtgaatgtggtggtttga

SEQ ID NO: 3636 - protein, 153 aa, Unknown
  Obtained from environmental sample
  misc_feature (1)..(153): Xaa is any amino acid
MQSGKSKMIRRNSVSIQGSSSFMIATNELTDLKCHKRSVLEPLLILLAPYAPHIAEELYAKLQEYFPKLYKGGASILDAAYPVFEEKYVKETSKEYPVSVNGKTRTTIDISLEAAQPEVEQIVLNNEVVQKWLEGRQPKKIIFVKGKMVNVVV

SEQ ID NO: 3637 - DNA, 411 bp, Unknown
  Obtained from environmental sample
  misc_feature (1)..(411): n is a, c, g, or t
atgtggagcctgggatggagacagtttgttcctttcatgattaccattattgtaatactgcttaccgatttgctcattggtgttagtattggactgttgatctcaacttattttattatcaggaataactttaaagcagaatataaaattcaaaaaacaaaacagcacgaaacagaagtgtttttcatcaagctcaacacaagtgttacatttctaaataaggtaaaactcaaagatgctttagatcaaattcccgaatattccatacttaccattgacggcagtgactgcaattttattgactacgatattcttgagatcatttccgagtatagcaacaaagcacacgataaacatgttgaattgcatttgaaaggaattgaaaaagtaaatgtaacggccatacattaa

SEQ ID NO: 3638 - protein, 136 aa, Unknown
  Obtained from environmental sample
  misc_feature (1)..(136): Xaa is any amino acid
MWSLGWRQFVPFMITIIVILLTDLLIGVSIGLLISTYFIIRNNFKAEYKIQKTKQHETEVFFIKLNTSVTFLNKVKLKDALDQIPEYSILTIDGSDCNFIDYDILEIISEYSNKAHDKHVELHLKGIEKVNVTAIH

SEQ ID NO: 3639 - DNA, 324 bp, Unknown
  Obtained from environmental sample
  misc_feature (1)..(324): n is a, c, g, or t
ttgcagcaaacaaacttgcaccaaaacttaatttgcgggcagccaggaaatttcaaattttttaaaaaaccaatttgggaaaagctctggcaaacaacaacattgaagacaataaaatgcatttgcattttttcaatcttgtacaacaataattcctgtaatttttttataaagaaggaggagggtttaaaaaattctcatcaccattatttcaaatgctcttttatggcaatagccaatgcaattttaaactggttgataaagcgtttaataacttgttcgcgttggctgcttttgcggaaatgggctttggtatcatggtag

SEQ ID NO: 3640 - protein, 107 aa, Unknown
  Obtained from environmental sample
  misc_feature (1)..(107): Xaa is any amino acid
MQQTNLHQNLICGQPGNFKFFKKPIWEKLWQTTTLKTIKCICIFSILYNNNSCNFFIKKEEGLKNSHHHYFKCSFMAIANAILNWLIKRLITCSRWLLLRKWALVSW

SEQ ID NO: 3641 - DNA, 750 bp, Unknown
  Obtained from environmental sample
  misc_feature (1)..(750): n is a, c, g, or t
atgaatatcggaataattggtacagggtttgggaaaacgattggcttaaattttaaagctgttgatccgtctgtaaaaatatatttttggggaagaagtaaagataagcttcaaaaggcgattgccgaagttggagcggatagtggttatgaatcatggcgggatttagttaaagatccaaaaatagacctcgttgttatcgcaaatcacagcgccggacacaaagaagtttttgaattagcagcaaaatataataaaaatattcttgtagaaaaacccgcagcacttcattcttctgaaatttccgaaatggtaaagttatttaaatctaaaaataaaatagcagtggtgaatcatgaaggaagattacatccggttataacttatattaaagaattaattgacacacaaaagctgggagatattatgacggtaagaataggtgcttatttaaattggtatagtaatccggaatataaagaaaactggaataatgataaatctcttggcgggggacaaatatgttctgttggtagccatcaaattgatatggcaagatatttattaggtttccctaaaataattaacgggtccgttcaggattttgtatataaagactcaagatttgtaacagaaccgacagcagatagccagtttgctgcacactataaaaccgagaaaggaacatcaattcaattatttaatgacacttattgttttgtacaaagatttacaatcttgatccaatag

SEQ ID NO: 3642 - protein, 249 aa, Unknown
  Obtained from environmental sample
  DOMAIN (131)...(243): Oxidoreductase family, C-terminal alpha/beta domain
  misc_feature (1)..(249): Xaa is any amino acid
MNIGIIGTGFGKTIGLNFKAVDPSVKIYFWGRSKDKLQKAIAEVGADSGYESWRDLVKDPKIDLVVIANHSAGHKEVFELAAKYNKNILVEKPAALHSSEISEMVKLFKSKNKIAVVNHEGRLHPVITYIKELIDTQKLGDIMTVRIGAYLNWYSNPEYKENWNNDKSLGGGQICSVGSHQIDMARYLLGFPKIINGSVQDFVYKDSRFVTEPTADSQFAAHYKTEKGTSIQLFNDTYCFVQRFTILIQ

SEQ ID NO: 3643 - DNA, 375 bp, Unknown
  Obtained from environmental sample
  misc_feature (1)..(375): n is a, c, g, or t
ttgaaaaagaaacggctgtgccaaatcttgaactatctgtcgaactctcggatattgttgtcacctcccttcttaaggacaaagtggatgaacctattcttaacagggtccgagatccggttaatcttgaatttcatcattgtaaagagactggagaactgtctgaaccagggattgcggacatttttgtcagatttaggtttcctatcctttaaaggttttctccttctctcagaatttttcaactacagattaaaggttcgaggctttgccaagaaaacaaaacaggtaataaaaatctggttctctgaatactccgaaacctacgggaaacctggcttgaccattgtctccgattgtcctggttcgcaatga

SEQ ID NO: 3644 - protein, 124 aa, Unknown
  Obtained from environmental sample
  misc_feature (1)..(124): Xaa is any amino acid
MKKKRLCQILNYLSNSRILLSPPFLRTKWMNLFLTGSEIRLILNFIIVKRLENCLNQGLRTFLSDLGFLSFKGFLLLSEFFNYRLKVRGFAKKTKQVIKIWFSEYSETYGKPGLTIVSDCPGSQ

SEQ ID NO: 3645 - DNA, 738 bp, Unknown
  Obtained from environmental sample
  misc_feature (1)..(738): n is a, c, g, or t
ttgtggacacattacggccatcatagggttttagcctaccagtaccaacaacggagaggcaacagagtaattgttaaggtcatctcccaaacgccacaaatcaagttttcggattccatcaaacggaagctggaaattatctacaacggcaaaaatgttaaaaatctagtgctgactcagcttgtgatttacaaccaaggaacaaaaatcatcaagccgctgaagttgaccggtaatgtaaagccagatgaaaaattcttacccattggaaagtctataagcatgcattcttattttatggaacttaacgtcactgatctccaggaaataactgcatcaagaatggagaacacgactggaacttttgagattgaacgtccttacctaaaccccaaatcgaagtataaagaagaagaaattaaagtatctgttttctcagatgtgccgcttgatttatctgttagtggaggtggagaggattgggcctccaaacttgtctacttagaagaagagcaaaaaacgatgattagaaatgttcgtattggcgcatttgtcctcggatctactatgattattattggtatatatatgtctatcactaccccagtgtcattattggataaaccagttccaaacggtgcatttctaataatgggtgtaggtataggtttacttgtaaatgtattttcaggattcttaaaagtcgaccgtacagaaagactttcccggttagattaa

SEQ ID NO: 3646 - protein, 245 aa, Unknown
  Obtained from environmental sample
  misc_feature (1)..(245): Xaa is any amino acid
MWTHYGHHRVLAYQYQQRRGNRVIVKVISQTPQIKFSDSIKRKLEIIYNGKNVKNLVLTQLVIYNQGTKIIKPLKLTGNVKPDEKFLPIGKSISMHSYFMELNVTDLQEITASRMENTTGTFEIERPYLNPKSKYKEEEIKVSVFSDVPLDLSVSGGGEDWASKLVYLEEEQKTMIRNVRIGAFVLGSTMIIIGIYMSITTPVSLLDKPVPNGAFLIMGVGIGLLVNVFSGFLKVDRTERLSRLD

SEQ ID NO: 3647 - DNA, 381 bp, Unknown; identical to SEQ ID NO: 1795
  Obtained from environmental sample
  misc_feature (1)..(381): n is a, c, g, or t

SEQ ID NO: 3648 - protein, 126 aa, Unknown; identical to SEQ ID NO: 1796
  Obtained from environmental sample
  misc_feature (1)..(126): Xaa is any amino acid

SEQ ID NO: 3649 - DNA, 660 bp, Unknown
  Obtained from environmental sample
  misc_feature (1)..(660): n is a, c, g, or t
gtgatagcattattagaactagatagagaggttcttaaatgggctacgccattttcttctgtagttgcatttatttcattatttgcagcttatctattcggattcggtgaagtcgccttgtccaacgaaagaagttccggtgaagaaaacacaacttatcttggcaaaaagataaatcatcaatacagtaaaacttttgaatttgaaaataatctaagaagctatttaaaaagttaccttacggatataaattattttagtttcttaagacctttttatgaaatccaaattgccaaaatattttcccgaatgccacaatattttagtgagttcagaagttgtaatattggtcaaaaaacaaatacctggtgtgccaattgctccaaatgtttatcaacttacctattgcttaaaccatttttaaaagaagtcgatcttgtaaaaatttttggagaaaatttgttgaataaaccaagtttaaaagaaacacttatcgatttaactgataataaacgagtaaaaccgtttgaatgcgttggtaccagggaagagcttaaagcagctttagaaaataatttaactatgatagatgattggaataaagaaaataatttaaccgacaaatatgaaagaatacttagaaaccaaattcaaaaataa

SEQ ID NO: 3650 - protein, 219 aa, Unknown
  Obtained from environmental sample
  misc_feature (1)..(219): Xaa is any amino acid
MIALLELDREVLKWATPFSSVVAFISLFAAYLFGFGEVALSNERSSGEENTTYLGKKINHQYSKTFEFENNLRSYLKSYLTDINYFSFLRPFYEIQIAKIFSRMPQYFSEFRSCNIGQKTNTWCANCSKCLSTYLLLKPFLKEVDLVKIFGENLLNKPSLKETLIDLTDNKRVKPFECVGTREELKAALENNLTMIDDWNKENNLTDKYERILRNQIQK

SEQ ID NO: 3651 - DNA, 519 bp, Unknown
  Obtained from environmental sample
  misc_feature (1)..(519): n is a, c, g, or t
ttgcatgatggtttaataaaacattttaatgagatatattatccgcctgtccttgtcctattccttgtttataaaaaagaaaacattagacgtccattagatggatttggttttcttataccttctaaagaaagaaaatctttccttggtgcaatctggagttcagtaatattcccaaacagatctgatgatgacacggcttcatttactttgtttgtcggcggtgcaagaaaccccgaaataggaagtattgataaagaaatattaatcggcaaagttaaaaaagagtttgaagatttaatgaaaatttcaggaactcctgaacttcaaacatacaaatactggagtaaagcaattcctcaatacaatattggctatgttgaacacgaaaaatattttgatgaatttgaaagaaaaaatcccggaataattttaagcggcaactaccgcggtggaatttctgtcggggattgcataaagaatgcagcaatagttgcagataaagtaacaaagttttaa

SEQ ID NO: 3652 - protein, 172 aa, Unknown
  Obtained from environmental sample
  misc_feature (1)..(172): Xaa is any amino acid
MHDGLIKHFNEIYYPPVLVLFLVYKKENIRRPLDGFGFLIPSKERKSFLGAIWSSVIFPNRSDDDTASFTLFVGGARNPEIGSIDKEILIGKVKKEFEDLMKISGTPELQTYKYWSKAIPQYNIGYVEHEKYFDEFERKNPGIILSGNYRGGISVGDCIKNAAIVADKVTKF

SEQ ID NO: 3653 - DNA, 444 bp, Unknown; identical to SEQ ID NO: 2221
  Obtained from environmental sample
  misc_feature (1)..(444): n is a, c, g, or t

SEQ ID NO: 3654 - protein, 147 aa, Unknown; identical to SEQ ID NO: 2222
  Obtained from environmental sample
  misc_feature (1)..(147): Xaa is any amino acid

SEQ ID NO: 3655 - DNA, 495 bp, Unknown
  Obtained from environmental sample
  misc_feature (1)..(495): n is a, c, g, or t
atgttttcgaaagctgggcggcctatattatccaaaaattcctggatcacattctcgtcatcagcggatagctcaggagcttttttttcaaaaccctggctttttaaaagctcatcaatattatgtctccaatctggcatggtagtgtttattatcgattttattaaacagttagattggcgaacgtggctaaaacaaggcgtaatttattgttcttttggcaaatgcttccggaattttcttaataacaaggcttgtcgctttaaaaaaactattcacctttgttactggcaacttccgattaggagaataaaaaattttttgattaaactatttttaattttcattctccaagcttntgttatgaacatcttcgatttttaccggttaaatgaacagcagcaattagacacactgcaagagtcaggtgtcttcattgggaaattgatggccttatcatatatcaactatcccggtaacatggttctaagttga

SEQ ID NO: 3656 - protein, 164 aa, Unknown
  Obtained from environmental sample
  misc_feature (1)..(164): Xaa is any amino acid
MFSKAGRPILSKNSWITFSSSADSSGAFFSKPWLFKSSSILCLQSGMVVFIIDFIKQLDWRTWLKQGVIYCSFGKCFRNFLNNKACRFKKTIHLCYWQLPIRRIKNFLIKLFLIFILQAXVMNIFDFYRLNEQQQLDTLQESGVFIGKLMALSYINYPGNMVLS

SEQ ID NO: 3657 - DNA, 534 bp, Unknown
  Obtained from environmental sample
  misc_feature (1)..(534): n is a, c, g, or t
atgttttcgaaagctgggcggcctatattatccaaaaattcctggatcacattctcgtcatcagcggatagctcaggagcttttttttcaaaaccctggctttttaaaagctcatcaatattatgtctccaatctggcatggtagtgtttattatcgattttattaaacagttagattggcgaacgtggctaaaacaaggcgtaatttattgttcttttggcaaatgcttccggaattttcttaataacaaggcttgtcgctttaaaaaaactattcacctttgttactggcaacttccgattaggagaataaaaaattttttgattaaactatttttaattttcattctccaagcttttgttatgaacatcttcgatttttaccggttaaatgaaaagcagcaattagacacactggaagagtcaggtgtctttattgcagaaatgaatggcccttattataatatcaaactataccaggtaaatggtttttatgttgaactctattttcatacccacttcaatgtggtgtaa

SEQ ID NO: 3658 - protein, 177 aa, Unknown
  Obtained from environmental sample
  misc_feature (1)..(177): Xaa is any amino acid
MFSKAGRPILSKNSWITFSSSADSSGAFFSKPWLFKSSSILCLQSGMVVFIIDFIKQLDWRTWLKQGVIYCSFGKCFRNFLNNKACRFKKTIHLCYWQLPIRRIKNFLIKLFLIFILQAFVMNIFDFYRLNEKQQLDTLEESGVFIAEMNGPYYNIKLYQVNGFYVELYFHTHFNVV

SEQ ID NO: 3659 - DNA, 444 bp, Unknown
  Obtained from environmental sample
  misc_feature (1)..(444): n is a, c, g, or t
atgccagattggagacataatattgatgagcttttaaaaagccagggttttgaaaaaaaagctcctgagctatccgctgatgacgagaatgtgatccaggaatttttggataatataggccgcccagctttcgaaaacatttgcgaccagataaattcgtttcaaaacatcagggctgaaataagtctctcaaaaaaaaatgcccactcatccattgaaccattcgagctgtctatttataaaatgagccaaccaaaattatcttaccgcctcgctttcttaaaaaaagaaaacggaatcaatataagtggagaatacagtacacccaatatttacggagaaaataccggttaccaaagtagtggattaaacctggcaatagccggaactacggaggacgatattgcaagtgatttttttggcattatgaagtctaaattttag

SEQ ID NO: 3660 - protein, 147 aa, Unknown
  Obtained from environmental sample
  misc_feature (1)..(147): Xaa is any amino acid
MPDWRHNIDELLKSQGFEKKAPELSADDENVIQEFLDNIGRPAFENICDQINSFQNIRAEISLSKKNAHSSIEPFELSIYKMSQPKLSYRLAFLKKENGINISGEYSTPNIYGENTGYQSSGLNLAIAGTTEDDIASDFFGIMKSKF

SEQ ID NO: 3661 - DNA, 351 bp, Unknown
  Obtained from environmental sample
  misc_feature (1)..(351): n is a, c, g, or t
atgttgaaagatgataaagacataattcaaattctttctgaaaatcttttccctgttgttggggtaggtgcttctgcaggcggattggaggcatttaaagaacttgtaaaggccatacctgaagattccggaatggcctatattttcattcagcacctatcaccgaagtacgaaagtatattgacggaaatacttcaaaaaggaaccaatcttccagtgttggaaatcgctgataatatgaaggtgaggccaaatcatatttatgttattccttccaataaatacttcacgcgcaatgatggtgtgctgcaggtgcttccacgcatcaaggcgaaaaagcaacactattga

SEQ ID NO: 3662 - protein, 116 aa, Unknown
  Obtained from environmental sample
  misc_feature (1)..(116): Xaa is any amino acid
MLKDDKDIIQILSENLFPVVGVGASAGGLEAFKELVKAIPEDSGMAYIFIQHLSPKYESILTEILQKGTNLPVLEIADNMKVRPNHIYVIPSNKYFTRNDGVLQVLPRIKAKKQHY

SEQ ID NO: 3663 - DNA, 501 bp, Unknown
  Obtained from environmental sample
  misc_feature (1)..(501): n is a, c, g, or t
ttgtctgtaaaattccaaccagatgaaaccacaaaattggtattggacagatttaaattattatgggtaattgaaaatggtgaccttccagaaataccagttggaatcaacttacaaaaatcagaagtgtgttattttaaatgtcatgctgattggtatgaacacagaagtgtgaccaccagaattaactatggtgggccaactgccagaattaaaatcatgaagggtgtttattattctgctggtagcataagtgtccagtcagttaaatcagaagaattaaaacagattgattccggtgaactgtatttaacaaataagagaataattttcactggtgataggaaatccaccaatatcaaactggacaaaattctggaagtgaatccttatactgatgcagtggaaattgtcaaggacaccggtaaaccaccaacactgtcaatgggaaaatcagaagcagaaatcttctatatgatgctgggcaggttgattgattaa

SEQ ID NO: 3664 - protein, 166 aa, Unknown
  Obtained from environmental sample
  misc_feature (1)..(166): Xaa is any amino acid
MSVKFQPDETTKLVLDRFKLLWVIENGDLPEIPVGINLQKSEVCYFKCHADWYEHRSVTTRINYGGPTARIKIMKGVYYSAGSISVQSVKSEELKQIDSGELYLTNKRIIFTGDRKSTNIKLDKILEVNPYTDAVEIVKDTGKPPTLSMGKSEAEIFYMMLGRLID

SEQ ID NO: 3665 - DNA, 501 bp, Unknown
  Obtained from environmental sample
  misc_feature (1)..(501): n is a, c, g, or t
ttgtctgtaaaattccaaccagatgaaaccacaaaattggtattggacagatttaaattattatgggtaattgaaaatggtgaccttccagaaataccagttggaatcaacttacaaaaatcagaagtgtgttattttaaatgtcatgctgattggtatgaacacagaagtgtgaccaccagaattaactatggtgggccaactgccagaattaaaatcatgaagggtgtttattattctgctggtagcataagtgtccagtcagttaaatcagaagaattaaaacagattgattccggtgaactgtatttaacaaataagagaataattttcactggtgataggaaatccaccaatatcaaactggacaaaattctggaagtgaatccttatactgatgcagtggaaattgtcaaggacaccggtaaaccaacaacactgtcaatgggaaaatcagaagcagaattcttctatatgatgctgggcaggttgattgattaa

SEQ ID NO: 3666 - protein, 166 aa, Unknown
  Obtained from environmental sample
  misc_feature (1)..(166): Xaa is any amino acid
MSVKFQPDETTKLVLDRFKLLWVIENGDLPEIPVGINLQKSEVCYFKCHADWYEHRSVTTRINYGGPTARIKIMKGVYYSAGSISVQSVKSEELKQIDSGELYLTNKRIIFTGDRKSTNIKLDKILEVNPYTDAVEIVKDTGKPTTLSMGKSEAEFFYMMLGRLID

SEQ ID NO: 3667 - DNA, 624 bp, Unknown
  Obtained from environmental sample
  misc_feature (1)..(624): n is a, c, g, or t
ttgtatgatttaaaaaatagtcttgaaaacatttgcactttgttaaccaaattgctgaataatggtaaaataaaatcaaatgaagaagcgtttgaatggataaattttttagagaaccaaattaccgattggattcaggagattaaaatattaagcccatggacaaaaaataattcaattcctgaaaaattcagaggtttaaaaatatttcaaaagataccatcgttaaaagaagttgcacgaatgaatattgaatttcatgaagagttagcatctttccacaacaacgataaaaccaacgaagagcaacaatggctttataatttggaactttcaattaatgaagcaagcacattagcaaaggaacgtatttcaataattcatgacctggctggccaatgttcagacttttcaaacatggagtataatgttctttatgataaaacgcagcatttacttgcaatcggttataacgctgatgagcttcatccggataacggcaactacgatttgcttgcttctgaaagcacgcttaggttactcgttgctattccgcagggaaaacttcccacgaaagttggtttccctggcaagcggttactgtacggatataccccgttttaa

SEQ ID NO: 3668 - protein, 207 aa, Unknown
  Obtained from environmental sample
  misc_feature (1)..(207): Xaa is any amino acid
MYDLKNSLENICTLLTKLLNNGKIKSNEEAFEWINFLENQITDWIQEIKILSPWTKNNSIPEKFRGLKIFQKIPSLKEVARMNIEFHEELASFHNNDKTNEEQQWLYNLELSINEASTLAKERISIIHDLAGQCSDFSNMEYNVLYDKTQHLLAIGYNADELHPDNGNYDLLASESTLRLLVAIPQGKLPTKVGFPGKRLLYGYTPF

SEQ ID NO: 3669 - DNA, 717 bp, Unknown
  Obtained from environmental sample
  misc_feature (1)..(717): n is a, c, g, or t
atggttcgtgataagcagggtagaaaaatgagcaaaagcctgggaaactctcccgatcttttggaactgattgagcgctttggagcagatgcagttcggtttgggattttaattgctgccccggctggtaacgatcttttgtttgatgacagcagttgtgaccagggaaggagttttaataacaaaatatggaatgcgttgaaactggtaaaaatgtgggaagagaagcagtcatcaatcagtaatcaacaatcagcagattttgccgtgctatggtttgaaaacaggttgaatgaagtgaagcaacaggttgaagaattgtatatacaattccggttgagcgaggcattgaaaattatttattcactcatatgggatgatttctgtagctggtatctcgaatggatgaaaccaccaatggaaggaaaaatcagcatgcaggattatgaaagaacaattgaattttttgaagaattgctacagttacttcatccatttatgccttttgttacggaagaaatttaccaccagttaaaagacagaagcgaaggcgatgatatttgtatcaaacaatttaaaccaatcaccgatagcaacgggctgattttaaaacatgcttctttgttaaaagagatgataaccgcaatcagggaagtgcgggttaaaaataatattaaacaaagggaaggcattgtgctccatattgaaaccagatga

SEQ ID NO: 3670 - protein, 238 aa, Unknown
  Obtained from environmental sample
  misc_feature (1)..(238): Xaa is any amino acid
MVRDKQGRKMSKSLGNSPDLLELIERFGADAVRFGILIAAPAGNDLLFDDSSCDQGRSFNNKIWNALKLVKMWEEKQSSISNQQSADFAVLWFENRLNEVKQQVEELYIQFRLSEALKIIYSLIWDDFCSWYLEWMKPPMEGKISMQDYERTIEFFEELLQLLHPFMPFVTEEIYHQLKDRSEGDDICIKQFKPITDSNGLILKHASLLKEMITAIREVRVKNNIKQREGIVLHIETR

SEQ ID NO: 3671 - DNA, 612 bp, Unknown
  Obtained from environmental sample
  misc_feature (1)..(612): n is a, c, g, or t
ttgagaattaaaaaaaagagatgttctcccaaaagattaatctttaacaaaaaagagaaaatttgtactggttgtggttcaagtcttcaaacaacagatgaattaaaacctggttatatttcagtcaagaaaaattggcaaaattcagattcatctctagaaaaaagtttgagtttcaaaagtaagaatgattttttatttctattccctgaagagttgaaacaggtcgaagaaatcaacgccaaattagttacgaatcccgacttagcaaaagaatttgaagtggaaagcgggattttgaaagcggaaacaaaaaaaaatcgggcaattttgtgtaaaagatgttggtacttgaaaaattataatcaagttcttcctgtttctattaaatatgaagacttgtcaaagaaattggaaattattaaagaaaaatcgaagcatcgaacttcagttttgaaaattgtggatatttttgactttgatgcgagtctcattcctgactttcgatctctggtaggcgacaaaactatgctttatttagtcgccaataagttggatttgttgcctaaaagagtttcctttcgtagagttcgtcagtggctgcaattataa

SEQ ID NO: 3672 - protein, 203 aa, Unknown
  Obtained from environmental sample
  misc_feature (1)..(203): Xaa is any amino acid
MRIKKKRCSPKRLIFNKKEKICTGCGSSLQTTDELKPGYISVKKNWQNSDSSLEKSLSFKSKNDFLFLFPEELKQVEEINAKLVTNPDLAKEFEVESGILKAETKKNRAILCKRCWYLKNYNQVLPVSIKYEDLSKKLEIIKEKSKHRTSVLKIVDIFDFDASLIPDFRSLVGDKTMLYLVANKLDLLPKRVSFRRVRQWLQL

SEQ ID NO: 3673 - DNA, 825 bp, Unknown
  Obtained from environmental sample
  misc_feature (1)..(825): n is a, c, g, or t
atgatatttagaatcaacaatcctattttcgtttgtgtgatatcatatactgaaacaagtgaaattccggggattactatagctggagcgaataaggatttaattaaatatacatcttcagcggatgcagagtttctttattatggtagatgtaaatgtataaatggcgttcctgcaactccggatggaaaaccaactccagctataataacaaaaacaatgttaaatattggtaacattccttttattgtagtagattcaggagtaaaaattaaacctgatatccccttattttcatttaatcttaggtcggggaaaaatatctcggataacattgcaatggaatcagaggaggtagaaaaagcctatagatatggattaatactaggtaaacaactatcaaaaagtcatgatcttgtaattcttggagaaagcattcctggtggaactactactgcacttggggttatgctttctttaggtatagacgcagaaaataaaatgagtagtagtatgccaaaaaatccacataatttaaaaaataatttaataaggaaaagcatgaaaaaaaataatatagattttggatcattgaaaaataaaccgtttgatgctatctccttgtttggggatcctatgatcccttcagtgacaggtattgctcaagggattattgagaatggtgggacagtaatgctggcaggtggaactcaaatgtgttgtattttatcaattttaaaaagtctaaaggttaaaacggataaagtctttataggtactacaaaatatatttttaatgatcatagtgcagatttacaaacctag

SEQ ID NO: 3674 - protein, 274 aa, Unknown
  Obtained from environmental sample
  DOMAIN (34)...(256): Phosphoribosyltransferase
  misc_feature (1)..(274): Xaa is any amino acid
MIFRINNPIFVCVISYTETSEIPGITIAGANKDLIKYTSSADAEFLYYGRCKCINGVPATPDGKPTPAIITKTMLNIGNIPFIVVDSGVKIKPDIPLFSFNLRSGKNISDNIAMESEEVEKAYRYGLILGKQLSKSHDLVILGESIPGGTTTALGVMLSLGIDAENKMSSSMPKNPHNLKNNLIRKSMKKNNIDFGSLKNKPFDAISLFGDPMIPSVTGIAQGIIENGGTVMLAGGTQMCCILSILKSLKVKTDKVFIGTTKYIFNDHSADLQT

SEQ ID NO: 3675 - DNA, 426 bp, Unknown
  Obtained from environmental sample
  misc_feature (1)..(426): n is a, c, g, or t
atgtttacaggcattattgaaacaataggcaaagtggatgaaataaccggaaatggaaataataaaactttttggattacttcttctctatttcctgaacttaaaatagatcaaagcctttctcacaatggtgtttgccttactatcgaagatctaaaagatgggttgcacaaagtaactgcggtaaaagaaacattggataaaaccgatctgaatcaatggaagccaggtactcaggttaacctagaaagaagcctgttaccttccagtcgcttagatgggcattttgttcaggggcatgtagatactattggaatatgtaaaaaaataaatgacgaaaaaggaagttgggagctggaattcgaatttgcaaaaaaatttggcccattgattattgacacaggtcaatctgtattaatggtataa

SEQ ID NO: 3676 - protein, 141 aa, Unknown
  Obtained from environmental sample
  DOMAIN (3)...(85): Lumazine binding domain
  misc_feature (1)..(141): Xaa is any amino acid
MFTGIIETIGKVDEITGNGNNKTFWITSSLFPELKIDQSLSHNGVCLTIEDLKDGLHKVTAVKETLDKTDLNQWKPGTQVNLERSLLPSSRLDGHFVQGHVDTIGICKKINDEKGSWELEFEFAKKFGPLIIDTGQSVLMV

SEQ ID NO: 3677 - DNA, 375 bp, Unknown
  Obtained from environmental sample
  misc_feature (1)..(375): n is a, c, g, or t
atgaccctcacagaccgacatgaaattgcgacatcatttcctgacaagcttgaccaaacaacacttgacattgaaattttaccttcagagttcaaaatatttgaggatggaatctttgcaacagatatggacagcaaatggaatgtttttgtattggacaagatcctctatttagcacgcagttggacaaacttttgtatttacaaagtcttcgcacaacagcaagacaagaaagtgattttatccaattttcaggttaaccgagatgataatcagtataaaagtttggatattgaaacaaatatccaactgcgtaaacacctgtacgttgtgcgcaattggacaacccctaaaacttatggaaaaagcatttaa

SEQ ID NO: 3678 - protein, 124 aa, Unknown
  Obtained from environmental sample
  misc_feature (1)..(124): Xaa is any amino acid
MTLTDRHEIATSFPDKLDQTTLDIEILPSEFKIFEDGIFATDMDSKWNVFVLDKILYLARSWTNFCIYKVFAQQQDKKVILSNFQVNRDDNQYKSLDIETNIQLRKHLYVVRNWTTPKTYGKSI

SEQ ID NO: 3679 - DNA, 315 bp, Unknown
  Obtained from environmental sample
  misc_feature (1)..(315): n is a, c, g, or t
atgataatcagtataaaagtttggatattgaaacaaatatccaactgcgtaaacacctgtacgttgtgcgcaattggacaacccctaaaacttatggaaaaagcatttaactatataaccttagttctcataatctgtttattgacagcctgcaatccattttcaaagccatgggacaaaatttatgaagatcaacaaaaacttttcaaaaataaccgacagacatttgaattagctgcaactcttttagaacattcctctggttcggacacaattcttcgattacggacaattcttttaactgctgacacttaa

SEQ ID NO: 3680 - protein, 104 aa, Unknown
  Obtained from environmental sample
  misc_feature (1)..(104): Xaa is any amino acid
MIISIKVWILKQISNCVNTCTLCAIGQPLKLMEKAFNYITLVLIICLLTACNPFSKPWDKIYEDQQKLFKNNRQTFELAATLLEHSSGSDTILRLRTILLTADT

SEQ ID NO: 3681 - DNA, 540 bp, Unknown
  Obtained from environmental sample
  misc_feature (1)..(540): n is a, c, g, or t
ttgaactcactttataaaattggcaatgtaggtatgacgttagaaacacttgaaaatgaaattaaggaagcaattccaaggctattcgagatggcaagaagtcttacaaggaataagatttccgaaaattataaactcattttgacagaaatcaaagacagtagcgaaaactttcacgaacaaagaaaaataaataagctggtcaatgatgaaaaagttccaatgttgcttactgaactcattcctatgctaaaaaatctttacaataatttttatgacattaacctgcatatttacaaagcgacaaggaacatcactataattgatttccgttattacccaaagtcatcccttggcgaagattttagggtaaaggtttcagacaacccaccaatgcttcattgcaaggttaattatccaccgtggttatctgacaaaaatgaaaagtttgatattaattgggaacattacgaaggattaaataagctaagacttttatggctaaaactcaaattaagaactcgaatgcggctaacatga

SEQ ID NO: 3682 - protein, 179 aa, Unknown
  Obtained from environmental sample
  misc_feature (1)..(179): Xaa is any amino acid
MNSLYKIGNVGMTLETLENEIKEAIPRLFEMARSLTRNKISENYKLILTEIKDSSENFHEQRKINKLVNDEKVPMLLTELIPMLKNLYNNFYDINLHIYKATRNITIIDFRYYPKSSLGEDFRVKVSDNPPMLHCKVNYPPWLSDKNEKFDINWEHYEGLNKLRLLWLKLKLRTRMRLT

SEQ ID NO: 3683 - DNA, 387 bp, Unknown
  Obtained from environmental sample
  misc_feature (1)..(387): n is a, c, g, or t
ttgtttttttatctgatgtctgacaaatgttttatataccatttacgaaatgaatgcaaagtcgttgtaatattgttgataaaaattgaaagaatatatgataatcctaatggaaaggataatgatggaaacggtggtttccgaatcttagtggacaggctttggcctcgcggtctaagtaaaaaggaggtgcatattgacttgtggataaaagatgttgcaccaagtactgcgttgagaaaatggtttagtcatgacgaaaaaaaatgggatgaatttaaatcaagatattttaaggaacttgagaaatgcaatgaatcgatagatgtaattttagataagatagaaaaaggctctgtagtattactgtatggagcaaaagactga

SEQ ID NO: 3684 - protein, 128 aa, Unknown
  Obtained from environmental sample
  DOMAIN (26)...(128): Protein of unknown function, DUF488
  misc_feature (1)..(128): Xaa is any amino acid
MFFYLMSDKCFIYHLRNECKVVVILLIKIERIYDNPNGKDNDGNGGFRILVDRLWPRGLSKKEVHIDLWIKDVAPSTALRKWFSHDEKKWDEFKSRYFKELEKCNESIDVILDKIEKGSVVLLYGAKD

SEQ ID NO: 3685 - DNA, 600 bp, Unknown
  Obtained from environmental sample
  misc_feature (1)..(600): n is a, c, g, or t
gtgatggttatacaagatcacgggcatgatcataaaggcgttgacagaggtgccgacctgcatccatttcttggttataattttcgtatttctgaattgcattccgctgtaggcctggcacaaataaaaagagtacacgaatttttagctattcaaaaaagaaatcaaacggctttaaaaagaattttagaacaaattccgggcatacaatttcgaaggctaccagatcccggtggcgatagctgtacatttttaagttggtttctaccaactgaagagatcacgattaaattggtagaagcattgaaagcagaaggaatccttgcaggcaatttttattggtataacaataactggcattacatccgtaaatgggagcacctcaaaaattccatctcgttgaaccgtttgtcagaggcacaggaacttgcattgcacaaattaaaggatcaggatttttcagtaagcgataagataatgtctcgatgtatttccactttaatgagtcttacatggacagaagaacaggttaaagaaaagggagaaaaaatattgagtgttgcactaaaagtattgtcttcttccggcgtttcaatataa

SEQ ID NO: 3686 - protein, 199 aa, Unknown
  Obtained from environmental sample
  misc_feature (1)..(199): Xaa is any amino acid
MMVIQDHGHDHKGVDRGADLHPFLGYNFRISELHSAVGLAQIKRVHEFLAIQKRNQTALKRILEQIPGIQFRRLPDPGGDSCTFLSWFLPTEEITIKLVEALKAEGILAGNFYWYNNNWHYIRKWEHLKNSISLNRLSEAQELALHKLKDQDFSVSDKIMSRCISTLMSLTWTEEQVKEKGEKILSVALKVLSSSGVSI

SEQ ID NO: 3687 - DNA, 954 bp, Unknown
  Obtained from environmental sample
  misc_feature (1)..(954): n is a, c, g, or t
atggnctccaacaacaagatcagccgaagaaaatttgtgagctcagccgccgtcgcctctctgggatttaccatcgtaccgcgccatgtgatgggtggtagcggcttcgttgcgccgagtgacaagcttaccatcgcttatataggttgcggaacgcagggactgcgagaaatgactgagctcattacgaatcccaaggttcagatcgtctctgtttgcgaccctaacaagagaagcacaaactatatcgattggtccccgtatggcatccgcaacagcatccgcaaagtgatcggcgacccgaactggggcgaaggagtggaaggtattcagggcggcagagatgtgggccaggaactcgtggaaaaatattacgccaggacccagggaaaggagaagtataaagggtgtacttcctatgaggactttcgcgagcttctggaaaaggagaaggacgtcgatgcccttaagatcatgacgccggatcaccttcatgcgactatctcgatagcggggatgaagaagggaaaacacgtcgtcattcataaacccatcgccaaccgcatgtacgagagccgcctggtcattgatactgcgaggaagaccggcgtgagcacgcacttgctcgcatggagcaaacgcccgggcaacgacattgtgaaaaagtggattgccgacggtgcgatcggcaccctcaaagaggttcataactggtcataccggccggtgtggccccagtgggtacaaattcccgctgacacgccgccggtcccaaaggatttcaactggcaattgtggctcggaccggtgccggacaggacgtaccatccggagtacacaaactgcgtgttccggggatggtatgacttcggcggtggcaagtattgcggacctggggacactacagcctctgggccgatgttctcacgctgggtgtcaagacaccgcccttaa

SEQ ID NO: 3688 - protein, 317 aa, Unknown
  Obtained from environmental sample
  DOMAIN (43)...(207): Oxidoreductase family, NAD-binding Rossmann fold
  misc_feature (1)..(317): Xaa is any amino acid
MXSNNKISRRKFVSSAAVASLGFTIVPRHVMGGSGFVAPSDKLTIAYIGCGTQGLREMTELITNPKVQIVSVCDPNKRSTNYIDWSPYGIRNSIRKVIGDPNWGEGVEGIQGGRDVGQELVEKYYARTQGKEKYKGCTSYEDFRELLEKEKDVDALKIMTPDHLHATISIAGMKKGKHVVIHKPIANRMYESRLVIDTARKTGVSTHLLAWSKRPGNDIVKKWIADGAIGTLKEVHNWSYRPVWPQWVQIPADTPPVPKDFNWQLWLGPVPDRTYHPEYTNCVFRGWYDFGGGKYCGPGDTTASGPMFSRWVSRHRP

SEQ ID NO: 3689 - DNA, 312 bp, Unknown
  Obtained from environmental sample
  misc_feature (1)..(312): n is a, c, g, or t
atgttttcgattttccggccaaccatcgtggtaactaactggtttcttcgtgatatctgtgacttcctcggtcaggatctgctttccatctcgcatcaccgtcacccggtcagccaccagataaacctcttccagccgctgggcaatatagatgatggtgatatgcttttccttcaaccgctggatgatctcgaacagcagatccagctctttatctgtgagcgtagcggaaggctcgtccataataatgagctgagcgttccggctgagcgctttgcagatctcgacaatctgcttttgggcaacacttaa

SEQ ID NO: 3690 - protein, 103 aa, Unknown
  Obtained from environmental sample
  misc_feature (1)..(103): Xaa is any amino acid
MFSIFRPTIVVTNWFLRDICDFLGQDLLSISHHRHPVSHQINLFQPLGNIDDGDMLFLQPLDDLEQQIQLFICERSGRLVHNNELSVPAERFADLDNLLLGNT

SEQ ID NO: 3691 - DNA, 681 bp, Unknown
  Obtained from environmental sample
  misc_feature (1)..(681): n is a, c, g, or t
ttgagaacgagaacggctttaatggagagtataacgttaaaaaacgaggtgcacctgcagttggataaaaatacctacgtatatgtgcaatcatttgataaattctctaaaacgggctaccagtttgtattggaaaagtttaacggcgacaacttaaaggagcgtattgtagccaattctgtggtatttgattctgttaaacgggtatggtcaatgcgcgagtactccgtgcgccatgtaaatggtttgcgcgaaagcattcagcaaaatttaaccaaagatactgtgctgaatatgcagccttcagattttgaaatagtggctaacacctattcggctatgtcattaaaagagctgaacaggcgcattaaacaagaagaaatacgcggttcgggcgatttgaaagacatgctttttgaaaaataccgccgttttgtttatccttttgcagcttacgtgttaactataataggtgtgtcaatctcctcgcgtaaggtgaggggtggggttggcttaccccttggtataggcttgtttttatgcttcgcctatatagtggttgataaattttcgttggtatttgccattaaaggcggcctgtcgccatttgttgcaacaattatacccaacgccttattcgggtttatagggctttatttgctttataaagcgccaaaataa

SEQ ID NO: 3692 - protein, 226 aa, Unknown
  Obtained from environmental sample
  misc_feature (1)..(226): Xaa is any amino acid
MRTRTALMESITLKNEVHLQLDKNTYVYVQSFDKFSKTGYQFVLEKFNGDNLKERIVANSVVFDSVKRVWSMREYSVRHVNGLRESIQQNLTKDTVLNMQPSDFEIVANTYSAMSLKELNRRIKQEEIRGSGDLKDMLFEKYRRFVYPFAAYVLTIIGVSISSRKVRGGVGLPLGIGLFLCFAYIVVDKFSLVFAIKGGLSPFVATIIPNALFGFIGLYLLYKAPK

SEQ ID NO: 3693 - DNA, 438 bp, Unknown
  Obtained from environmental sample
  misc_feature (1)..(438): n is a, c, g, or t
ttgatacaaatatataccttaattgccattgagcggattttatggaacaaaattagaccggataaggcgcctgtttgtataaacgggaacacattcgttaataaaaattacgatatgatgaaaaggttatttttaagcgtattaatacttagcggtttcgttggttattcacaacctggctggaaagattcaaccattgccgggaacaaggttttggatgcttttgagcttaatgatatggtttattttaaaaccaaaagcggttggggcgtttatttgcctgctaaatctcaattagtgctcaaaccggcctatcagtttatattgggtacaaaaagtaaggacaaaagtttgttttatgcggtaaagaaaaataaacttcagataattgatgncgtgggaaaaacggtaattcaaaaaacatattgtcattcttga

SEQ ID NO: 3694 - protein, 145 aa, Unknown
  Obtained from environmental sample
  misc_feature (1)..(145): Xaa is any amino acid
MIQIYTLIAIERILWNKIRPDKAPVCINGNTFVNKNYDMMKRLFLSVLILSGFVGYSQPGWKDSTIAGNKVLDAFELNDMVYFKTKSGWGVYLPAKSQLVLKPAYQFILGTKSKDKSLFYAVKKNKLQIIDXVGKTVIQKTYCHS

SEQ ID NO: 3695 - DNA, 597 bp, Unknown
  Obtained from environmental sample
  misc_feature (1)..(597): n is a, c, g, or t
atgcgttggtgttacgggccaataatcttaaaagttgtttatctgaagaataatgggggcggaaagtttgagttaattccacttcctgtaatggcacagctggccccgctcaatggaatggtcacagacgacttcaataatgatggtaatcttgatgtggcaataactggcaacgattacggaaatgaagtaaataatggaaagtatgatgccatgaacggacttattttactgggcgatggcaatggaaatttttctgcacaatcaatattgcgatctggtttttttgttccaggcgatgccaaagctcttattaaactcaggcgcgttaatgatggatacgccctggttgcctcacaaaacggcgggccattgaaaatgttcattcataaaaggcaacatcaaaaagaaattccgctgcaaccgttcgatatgttcgcctggatcacgtataaaaatggaaaaagacaaaaatgtgacataagctatggatcttcctttctatctcagtccagccgctttttaaaggctgacagtaatatggtttcaatagagattaaaaattcaagacaacaggtccgtaagataaatttgtaa

SEQ ID NO: 3696 - protein, 198 aa, Unknown
  Obtained from environmental sample
  misc_feature (1)..(198): Xaa is any amino acid
MRWCYGPIILKVVYLKNNGGGKFELIPLPVMAQLAPLNGMVTDDFNNDGNLDVAITGNDYGNEVNNGKYDAMNGLILLGDGNGNFSAQSILRSGFFVPGDAKALIKLRRVNDGYALVASQNGGPLKMFIHKRQHQKEIPLQPFDMFAWITYKNGKRQKCDISYGSSFLSQSSRFLKADSNMVSIEIKNSRQQVRKINL

SEQ ID NO: 3697 - DNA, 363 bp, Unknown
  Obtained from environmental sample
  misc_feature (1)..(363): n is a, c, g, or t
gtgagtttcaagattaagaatttttccacgattcgcatcagctcaacgaatgtatccaaaagcagagattggtataaaaaattatttggagccgatccggtcgaagatattgagaattttgtttcatttaagattaacggcgtttgtttcgatattagtcttgcggactcaaagtcaccttcatcaactggaggatcggtaggatactggctggttgatgacctagaccaggcaattacacaggccatggaactaggtggagaaatttaccgaggacctctcaaagtggataagactcaaagcacaatcgttcagattaaagatccctgtagaaatataattggatttgaagcgctcttttga

SEQ ID NO: 3698 - protein, 120 aa, Unknown
  Obtained from environmental sample
  DOMAIN (7)...(116): Glyoxalase/Bleomycin resistance protein/Dioxygenase superfamily
  misc_feature (1)..(120): Xaa is any amino acid
MSFKIKNFSTIRISSTNVSKSRDWYKKLFGADPVEDIENFVSFKINGVCFDISLADSKSPSSTGGSVGYWLVDDLDQAITQAMELGGEIYRGPLKVDKTQSTIVQIKDPCRNIIGFEALF

SEQ ID NO: 3699 - DNA, 444 bp, Unknown
  Obtained from environmental sample
  misc_feature (1)..(444): n is a, c, g, or t
atgattgaaatgaaaaaattaaataagaataaaacttatatcaaaaacgaaagcaggaaaaaggaagaggaaaaacgtaaagagttttctaaagatcatagtattcaaaagtactatcacggtactaaagctgatctaaagattggtgatcatataaaaccaggttttatttcaaactacggcaaaaggaagaagtctaattttatatatttaactgcctctctggaggctgccatctggggtgcagaacttgctttgggtaaaggatgtgaaagaatttatatagtagcgcctgaaggaccgattgaggatgatcctaatttaactgacaaaaaatatccgggcaatccgacaaaatcctatcgttcacgatatccgcttcgggttattggtgagattaccagaatggcagggaccttcctcttgaacagctcagtactatga

SEQ ID NO: 3700 - protein, 147 aa, Unknown
  Obtained from environmental sample
  misc_feature (1)..(147): Xaa is any amino acid
MIEMKKLNKNKTYIKNESRKKEEEKRKEFSKDHSIQKYYHGTKADLKIGDHIKPGFISNYGKRKKSNFIYLTASLEAAIWGAELALGKGCERIYIVAPEGPIEDDPNLTDKKYPGNPTKSYRSRYPLRVIGEITRMAGTFLLNSSVL

SEQ ID NO: 3701 - DNA, 582 bp, Unknown
  Obtained from environmental sample
  misc_feature (1)..(582): n is a, c, g, or t
ttgtttatgtcatctgtacaaagtcctcctaaaacctgtcaggttattattcaagatgggtttccnaaaggattcgttgagggaatagtatccaatgaatttatctgggctccatggtcggattggttaaaaaacatgaaagcattaaattccaaatattttaatatgaaggtttctgataccagatatcccaataccgatagtcttcaggtgcatttacccgattcattttttcataattttaagtaccatctgcctgaaattaacaagttaaatagaaaaatcaggacagttacacccattacaattactaatatgggaaatactccattgttttcaggtagaggccgtgatggaattatgttatcatatacctggtataatgtatctgagcagaaaaacttagaacgtcaaagcaatattaaatcagtaatattagcagatataattaaatcgttggatcagcatataaatatagaaactccaaagaagagcgggaaatacatttttcaattaatggtgtcttttgataatcaaagaaatactgccattggagaaccattggaagtagagtatgattaa

SEQ ID NO: 3702 - protein, 193 aa, Unknown
  Obtained from environmental sample
  misc_feature (1)..(193): Xaa is any amino acid
MFMSSVQSPPKTCQVIIQDGFPKGFVEGIVSNEFIWAPWSDWLKNMKALNSKYFNMKVSDTRYPNTDSLQVHLPDSFFHNFKYHLPEINKLNRKIRTVTPITITNMGNTPLFSGRGRDGIMLSYTWYNVSEQKNLERQSNIKSVILADIIKSLDQHINIETPKKSGKYIFQLMVSFDNQRNTAIGEPLEVEYD

SEQ ID NO: 3703 - DNA, 576 bp, Unknown; identical to SEQ ID NO: 3065
  Obtained from environmental sample
  misc_feature (1)..(576): n is a, c, g, or t

SEQ ID NO: 3704 - protein, 191 aa, Unknown; identical to SEQ ID NO: 3066
  Obtained from environmental sample
  misc_feature (1)..(191): Xaa is any amino acid

SEQ ID NO: 3705 - DNA, 642 bp, Unknown
  Obtained from environmental sample
  misc_feature (1)..(642): n is a, c, g, or t
atgaaacctacattattgataatggctgctggcatggcatcgcgatatggaagtatgaagcaggtgcaacaatttggccctggtggcgaaacaattatggactattctatttatgatgctattgaagccgggtttaaaaaagttgtttttatcattcgcgaagattttgctgaagattttaaaaacatttttgagccaaagcttaaaggcaaaatagaaactgaatatgtgtaccaggaactaggcgcttttttagagaattttaaaatacccgaaggaagaacaaagccatggggaacatcgcatgctattttatgtgcaaaaaattcggttcaggaaccatttgcagtgatcaatgctgatgatttttatggcaaagatgcatttggaaaagcaaggaattttttatcaaatgaatgcgatgaaaagacctttgctcttttgggatacgaattaggcaataccttatctgaaaatggatccgtgagccgtggtgtctgtgaggttgatcataataataatctcgttcagattgtagaacgattaaaagtttatgaagaaggcggagaaattgtttacgaagaaggagatggcggtaagcatgagattccggagaattttaaagcatcaatgaatttctnn

SEQ ID NO: 3706 - protein, 214 aa, Unknown
  Obtained from environmental sample
  SIGNAL (1)...(19)
  misc_feature (1)..(214): Xaa is any amino acid
MKPTLLIMAAGMASRYGSMKQVQQFGPGGETIMDYSIYDAIEAGFKKVVFIIREDFAEDFKNIFEPKLKGKIETEYVYQELGAFLENFKIPEGRTKPWGTSHAILCAKNSVQEPFAVINADDFYGKDAFGKARNFLSNECDEKTFALLGYELGNTLSENGSVSRGVCEVDHNNNLVQIVERLKVYEEGGEIVYEEGDGGKHEIPENFKASMNFX

SEQ ID NO: 3707 - DNA, 666 bp, Unknown
  Obtained from environmental sample
  misc_feature (1)..(666): n is a, c, g, or t
atgaatttgacacggnttatgtttttgtcggacggttatattgccaatggcgcagagccgtggcaattcccaaaagctgccgatttacctaagattgaagttaaattcaccacggagaaaaatggggataagtttcttccttataaaagagatgaaaagctttcacggccctgggctattccgggaaccaaaggattggaacaccgcatcggcggactggagaaacaacatgaaacaggaaatatttcatacgattccgaaaatcatgaattcatggtgagattgcgcgagagtaaagtggaaaaaattgccgactatattccactgcagacccttgataacggaactgagaaaggaaaacttcttattgtaggatggggctcaacttacggggctatcaaaactgccgttattgaagccagggaaaaaggactcgatgtttcacatgcgcatatccgttatataaaaccattccctaaaaaccttggtgaaatcttatataattatgataagatccttattcctgaaatgaattcagggcagcttgtaagaattatcagggataaatttatggttcctgcaattacctttagtaaagttcagggaatgccatttaacaccagtgaaattcttgaaaaaatagaaagtgttctgaataataattaa

SEQ ID NO: 3708 - protein, 221 aa, Unknown
  Obtained from environmental sample
  misc_feature (1)..(221): Xaa is any amino acid
MNLTRXMFLSDGYIANGAEPWQFPKAADLPKIEVKFTTEKNGDKFLPYKRDEKLSRPWAIPGTKGLEHRIGGLEKQHETGNISYDSENHEFMVRLRESKVEKIADYIPLQTLDNGTEKGKLLIVGWGSTYGAIKTAVIEAREKGLDVSHAHIRYIKPFPKNLGEILYNYDKILIPEMNSGQLVRIIRDKFMVPAITFSKVQGMPFNTSEILEKIESVLNNN

SEQ ID NO: 3709 - DNA, 615 bp, Unknown
  Obtained from environmental sample
  misc_feature (1)..(615): n is a, c, g, or t
ttgttgaagattatcagtaaaactaaaaagcgatttacagattgggtttcgaaaatctatattccaagccccgttgaagtagaaggacaaagactcaatctcagcagagatgccaggtacttatcattcaactacacgccgactctttcgatgatttatgagatttcaaaagataacattctttatattcatggtgaagtcggaaactccgatcgagagatagtacttggtcatgcatggaaacccacctttaaaccaatacccaatcttcccgatccggatgaagatcctgatgatccaagaactattgaaggaaacgaaataaccaacaagtattttgagaatacattcaagaatgtacaaagcatcataaatgaaaatcaatcgttcttcgcaagccttcaccaagttgcaaacatttatgttctcggtcattcgttatcggctgttgatattgattacttcaaagaaatacttaagaagatcaatacagataaagtatgctggagaatcagtttcttcggagaaaaggaacttgatagacaccaagcaacaatcaacaagcttggcataagtggtaacaatgtatcgttttgtgagatacaaaggttttaa

SEQ ID NO: 3710 - protein, 204 aa, Unknown
  Obtained from environmental sample
  misc_feature (1)..(204): Xaa is any amino acid
MLKIISKTKKRFTDWVSKIYIPSPVEVEGQRLNLSRDARYLSFNYTPTLSMIYEISKDNILYIHGEVGNSDREIVLGHAWKPTFKPIPNLPDPDEDPDDPRTIEGNEITNKYFENTFKNVQSIINENQSFFASLHQVANIYVLGHSLSAVDIDYFKEILKKINTDKVCWRISFFGEKELDRHQATINKLGISGNNVSFCEIQRF

SEQ ID NO: 3711 - DNA, 450 bp, Unknown
  Obtained from environmental sample
  misc_feature (1)..(450): n is a, c, g, or t
atgaaaaaaatagtaagcatacttgtatttgttctcttagcaaacctgtcacaagctacctatattttgattccaatggacctaaaccaaaagaatcatttaaaagcatatggtgttgcctattgggtattgaaacaagatgtggaagtgcattggctactgaattaccgtggaggcagttttatggtgaaaggtgcaaaagaaattgaaagtgaatgtacgatacgaggcgtttcatttgaagtaattccagatgcgaagtcgagcgctattttaacagagatctccaatcctgaagtgaacatggaggatttgacattagaaaaagtcctactgttgctgttattcaccaaaaacaaaacatcttgcgattatgccgtacattgtaccacctatgcggaataccctagagttattacgatgacgattttaaaggcaatgttactatga

SEQ ID NO: 3712 - protein, 149 aa, Unknown
  Obtained from environmental sample
  SIGNAL (1)...(19)
  misc_feature (1)..(149): Xaa is any amino acid
MKKIVSILVFVLLANLSQATYILIPMDLNQKNHLKAYGVAYWVLKQDVEVHWLLNYRGGSFMVKGAKEIESECTIRGVSFEVIPDAKSSAILTEISNPEVNMEDLTLEKVLLLLLFTKNKTSCDYAVHCTTYAEYPRVITMTILKAMLL

SEQ ID NO: 3713 - DNA, 591 bp, Unknown
  Obtained from environmental sample
  misc_feature (1)..(591): n is a, c, g, or t
ttgccgctggcagttcccggcacctgggcaattaaaaacccgattcatggagaatatcaggtgacatccgtgaacgattgtcagccatccttcacaatcattgatttgaatgcagatttatatcagtactcttctgcaggtcattataacgatatggacatgctgcaagttgggagaggtatgagttacgatgaagacaaaacgcatttctccatgtggtgcatgctgaattctccgcttcttgccggtaatgatctgcgcaacatgacgaagcaaacaatagaaatactgaccaacaaagagatcattgcgttgaaccaggatgaaggatttattcaggcaaaaagactgttccgtgaaaacaatgtggaagtttgggtgaaacctttaggaaacggaaagtcaaaggcaatagcttttttgaatcgtggagatcaggatactttgtttacattgactcctgaaaaaataaatatcagaaagaaaagcaggttaagagatctgtggcttcataagaagttgggaaaaatgagaaagagtaaatcattctctattcctaaacatggcatcgtagttcttaaacagtattga

SEQ ID NO: 3714 - protein, 196 aa, Unknown
  Obtained from environmental sample
  misc_feature (1)..(196): Xaa is any amino acid
MPLAVPGTWAIKNPIHGEYQVTSVNDCQPSFTIIDLNADLYQYSSAGHYNDMDMLQVGRGMSYDEDKTHFSMWCMLNSPLLAGNDLRNMTKQTIEILTNKEIIALNQDEGFIQAKRLFRENNVEVWVKPLGNGKSKAIAFLNRGDQDTLFTLTPEKINIRKKSRLRDLWLHKKLGKMRKSKSFSIPKHGIVVLKQY

SEQ ID NO: 3715 - DNA, 372 bp, Unknown
  Obtained from environmental sample
  misc_feature (1)..(372): n is a, c, g, or t
ttgcaaatcatcaagcttgactcaacccgaaaccaaaaaatagcccggctaacgtttagtcgcgactaccttgaaagagaaaaggcgctcgcccggatttccgattccaatcctatcattcaaattactacctggttcctcatcttgtttttcattttcgtagatattcttcctgtaacatggaaagccttgacaaagaaaggtccgtatgatgataaattaaacctcgcggaaaaaataattagcaacgaaaccaggaaaaaagaaattgattctgacaccagtttaaatatacatactcataacaaggattgggaatccaggaattataaacgtgaaggaatagaaaaagaagaaagcgttgttatataa

SEQ ID NO: 3716 - protein, 123 aa, Unknown
  Obtained from environmental sample
  misc_feature (1)..(123): Xaa is any amino acid
MQIIKLDSTRNQKIARLTFSRDYLEREKALARISDSNPIIQITTWFLILFFIFVDILPVTWKALTKKGPYDDKLNLAEKIISNETRKKEIDSDTSLNIHTHNKDWESRNYKREGIEKEESVVI

SEQ ID NO: 3717 - DNA, 870 bp, Unknown
  Obtained from environmental sample
  misc_feature (1)..(870): n is a, c, g, or t
atggagcgattcaaggaagatttcgaaaaaatgataaaggtaggacaatccttgaagggaagatttggcaaaaccaggaaaccttctgataaattcacgattgattttggtgccttgggtatcaaacagtcatctgcacaaatcaccagttttaatcaatctgcagaattggtgggacagcagtttgttgccgttgtcaattttcctccaaaacagatctcagattttttcagtgaatgccttgttctcggtatttatgatgaaaataaagatgtagttttattacagccaaaggcattccgtatccaatggattaaaaattggataatgaacctatacaccgcatattactcttcacctataggatcactcaaattgcaatgctcagataagtatatcaaaacgattaatttttgtgatgccgaaggtgagatacaaaatgatgaacataaattgctgaatgcctgcagtaaacaattagatgaatactttacaggaaaacgtaagcaatttaccgtgccgttaaaccaggacgggacagaatttcagacaaaaatttgggaccttctttataaaattccctatggcagaaccattagctataatgaattagccaaacaatatggcgatctgaaagctattcgtgctgtagcatctgccagtggcaaaaacaatattgcgatcgttgttccctgtcatcgtgttattggaagtgatcaatccctggttggttatggaggtggcttgtggagaaagaaatggttactggatcatgaagcaaaatttcatcttggcgttcaggaattcgattttgaagcctctgtgaatttaactgagaaaggtgattcggaaatacttggtcattcctga

SEQ ID NO: 3718 - protein, 289 aa, Unknown
  Obtained from environmental sample
  DOMAIN (111)...(177): 6-O-methylguanine DNA methyltransferase, ribonuclease-like domain
  misc_feature (1)..(289): Xaa is any amino acid
MERFKEDFEKMIKVGQSLKGRFGKTRKPSDKFTIDFGALGIKQSSAQITSFNQSAELVGQQFVAVVNFPPKQISDFFSECLVLGIYDENKDVVLLQPKAFRIQWIKNWIMNLYTAYYSSPIGSLKLQCSDKYIKTINFCDAEGEIQNDEHKLLNACSKQLDEYFTGKRKQFTVPLNQDGTEFQTKIWDLLYKIPYGRTISYNELAKQYGDLKAIRAVASASGKNNIAIVVPCHRVIGSDQSLVGYGGGLWRKKWLLDHEAKFHLGVQEFDFEASVNLTEKGDSEILGHS

SEQ ID NO: 3719 - DNA, 543 bp, Unknown
  Obtained from environmental sample
  misc_feature (1)..(543): n is a, c, g, or t
gtgaaagcaatttattacgaaaatgaatggatcccttacggcgaaatgcttacggtgtatataaccaatggttcttacgataaaattgcgaagttgcttcaggagtacaatcgcctccgtaatgcagtgtatgtaacctatccttatgctattacagcaggctatgttatcaatgatgtaaatatgcatttacagggtttgcctaaatccgaaagaaaaaaatatatcaagtccagagagaaagatttaaaaaagcaattctctgatccgctttccaatctttcggtttaccagggtagagttttgatgaagctgatcaatcggcaaaccaaaaataattgctacgatatcattaaagattatcggggcggcttaagtgccagaatgtaccagacagttgccttcttttttggtagcagtttgagacaggattatgatattgctcatgataaaaccgatcggcagattgagaatattgtgaaggagattgatggctcctggtattttaatccttacaggccgggaattgctccgcagagataa

SEQ ID NO: 3720 - protein, 180 aa, Unknown
  Obtained from environmental sample
  misc_feature (1)..(180): Xaa is any amino acid
MKAIYYENEWIPYGEMLTVYITNGSYDKIAKLLQEYNRLRNAVYVTYPYAITAGYVINDVNMHLQGLPKSERKKYIKSREKDLKKQFSDPLSNLSVYQGRVLMKLINRQTKNNCYDIIKDYRGGLSARMYQTVAFFFGSSLRQDYDIAHDKTDRQIENIVKEIDGSWYFNPYRPGIAPQR

SEQ ID NO: 3721 - DNA, 879 bp, Unknown
  Obtained from environmental sample
  misc_feature (1)..(879): n is a, c, g, or t
ttgtttagaatgtacggccggttgaccttcaaccaaaaagtctcggaagaaagtttgatcaaggcctcacatgcagtcatcacaaatgtaagagaagatcatttagaaattatgggaccagaaaagaaggacgtagcattggcctttagcggttctattcctaaatccaaagtattatttacttcagaaaaagaatttttccctttttttcaaaaaatttgtaaaagcaaaaatactgaaattatcggaactcatcttggaaaatattcagatctaaactatatgcaaggtttcgcatattatgaacattcggagaatgtgatcttggcattagaagtatgcgaggccttgggggtaaaaccagaaattgctataaaaggtatgtggtctcattctcccgatttgggagctagtttctttaatgaatattattttggtaagaagaagatagtttttgcaaatgctttcgccgcaaacgatccaagatccgctacaagtatttgggaaaatacggtcttacagtttcctgaatatggttataaagtagctattgtaaattgtaggaaggacagacccgaaagatcggaacaaatggcaaaggaaatcctttcctggaaaaagaatgcgccagatctaattttgatagtaggagaggaaactggagtattcaaaaagacatgcctaaaactaggttgcgggaattctaaattagtagatctgaaaggcattgatgcaaaaaggatcttggaattctttgaaaattctcttccgtccgaaacactggtagtcggacttgggaatataggaggactaggtttagaacttctgggagattttaaaacacagggaaattctaaacggttaatatggacttattga

SEQ ID NO: 3722 - protein, 292 aa, Unknown
  Obtained from environmental sample
  misc_feature (1)..(292): Xaa is any amino acid
MFRMYGRLTFNQKVSEESLIKASHAVITNVREDHLEIMGPEKKDVALAFSGSIPKSKVLFTSEKEFFPFFQKICKSKNTEIIGTHLGKYSDLNYMQGFAYYEHSENVILALEVCEALGVKPEIAIKGMWSHSPDLGASFFNEYYFGKKKIVFANAFAANDPRSATSIWENTVLQFPEYGYKVAIVNCRKDRPERSEQMAKEILSWKKNAPDLILIVGEETGVFKKTCLKLGCGNSKLVDLKGIDAKRILEFFENSLPSETLVVGLGNIGGLGLELLGDFKTQGNSKRLIWTY

SEQ ID NO: 3723 - DNA, 780 bp, Unknown
  Obtained from environmental sample
  misc_feature (1)..(780): n is a, c, g, or t
ttgcgcggaagaggaaattctgataaacctaaagaagaatatactgcaagagttcatgcgcaggacctaaaagagctttcgacgatattaggatattctaaaatatcaatactctcccattcattaggagcctggatcactctcagatttgcggagaagtttgccggctttttagaaaaagcgatactgatagacggaggcggagaactttccatcaaacgtaaaatttccaatctgctcatgatccaaggatctttggctcgtttgggtagaagaatccctagtaaagaaatatatctgcaagaggctaaaaaatcttccttactttctgcctggaatacgaatattcaaaatttcttattatacgaattggagtctactggaacactttcccccgcattaatgccaggagatactttttacggaccagtgctttgttccattcctccatttgtgatcgattctgaattaaagaatatgggcggcgcaataaaacccatcgggatcatagcaaggctttttaaaaacccaaaagagtttatcaaaactctgaaagagaacaaggttatgccttattcagctttgcattgccctgttcttgtgatccgagctttaaaaccgaatttcaaacctggagacgaacttttgcctcctacagctattgagaagatgaaagaaaagatccaaaacctaaaagttatgaactctcagataaaaacattattgagtctgtatcatcagaagataaggaaagagatcaggacatattcaaatttctaa

SEQ ID NO: 3724 - protein, 259 aa, Unknown
  Obtained from environmental sample
  misc_feature (1)..(259): Xaa is any amino acid
MRGRGNSDKPKEEYTARVHAQDLKELSTILGYSKISILSHSLGAWITLRFAEKFAGFLEKAILIDGGGELSIKRKISNLLMIQGSLARLGRRIPSKEIYLQEAKKSSLLSAWNTNIQNFLLYELESTGTLSPALMPGDTFYGPVLCSIPPFVIDSELKNMGGAIKPIGIIARLFKNPKEFIKTLKENKVMPYSALHCPVLVIRALKPNFKPGDELLPPTAIEKMKEKIQNLKVMNSQIKTLLSLYHQKIRKEIRTYSNF

SEQ ID NO: 3725 - DNA, 900 bp, Unknown
  Obtained from environmental sample
  misc_feature (1)..(900): n is a, c, g, or t
atgtatagatacgctaatcatatcaagctgggttccggaaatttaggaggggagtctgaagctattataggaaactggataaagaaaagtgggaacagggataaggttgtaattgctaccaaggttggttgggatattgatgaaaagcgcacagggcttacaaggcagcagatattgcaggagtcagaaggctcactaaaaaggctgcagacagatcacatcgatctttaccagtcgcataaagactatcccgggacagaccagaaagaaactcttcaagtttattccgagcttgtttcgcagggtaaggtaagagctattggagcctcaaactattccgctgaaagattaaaagaggccttaagtataagcgaaaaaaataatttcccaagatatcagagccttcagccgcattataatctatatgaaagagccccttttgaaaacgaccttgagcagctttgcctgaaagagaacattggcgttattccatatttctccttagcccgtggtttcttaaccggtaaatacaggacagatgaggatataaataaaagcccgagaggtggttctgtaaagaactcttattataatgatagaggctttagaatattaaaggctcttgatgatgcatcagaaaaatataattctactcccggtcagatctctcttgcatggttaatggcaaggccttcaatacccgnccctatagcaagcgcaacaagtgtagagcagcttaaagatattatgaaagctgcagaaataaagcttgatcaggatacgaccaaagatcttgatgaggcttctaactattacataatatggaagaccatatattattcccgatcaaacgagggtcgggcatgtgcatttaacggttgccaaactgcagagggcaat

SEQ ID NO: 3726 - protein, 300 aa, Unknown
  Obtained from environmental sample
  DOMAIN (10)...(270): Aldo/keto reductase family
  misc_feature (1)..(300): Xaa is any amino acid
MYRYANHIKLGSGNLGGESEAIIGNWIKKSGNRDKVVIATKVGWDIDEKRTGLTRQQILQESEGSLKRLQTDHIDLYQSHKDYPGTDQKETLQVYSELVSQGKVRAIGASNYSAERLKEALSISEKNNFPRYQSLQPHYNLYERAPFENDLEQLCLKENIGVIPYFSLARGFLTGKYRTDEDINKSPRGGSVKNSYYNDRGFRILKALDDASEKYNSTPGQISLAWLMARPSIPXPIASATSVEQLKDIMKAAEIKLDQDTTKDLDEASNYYIIWKTIYYSRSNEGRACAFNGCQTAEGN

SEQ ID NO: 3727 - DNA, 726 bp, Unknown
  Obtained from environmental sample
  misc_feature (1)..(726): n is a, c, g, or t
ttgggtaaatatatttcatggcataattaccgtggcaaggcaaatgcgcaattcgaagggttcaaagataaaaaaacagatggccgcaatccaagcaatagttatataccacggtttagaaatgtgcgcaagcaggaaatggattttcaacgcggttatgctattggcattggtggcggaagaggaacttctataaaccaggatttgatcggcgatgaactaagagagaatttattgaatccaccattaggcaactggaacatcagtagttggatgatgggtgaatcggttcctcttgaaaagaatcatattcgtcttcataatgacatgaaagataaatacggtattcctcaaataattatttcctgcgagtggagtgagaatgatgacaagatggtggaagattatattgaacaatcaaaagaaatgtttgagaaggcagggttcattaacataaaggcggaagacacaaaatctccccctggctcagatatacacgagatgggtggcgtaagaatgggccacgatccaaaaacttctttgttgaataaatggaaccaactccatcattgcaaaaatgtttttgttactgatggcgcctgcatgacatccacaggatcccaaaatccaacattaacttatatggccatcaccgcaagagctgctcattatgcggtagaagaaattgaagaagagaaatctttagagaagataagatgcaagtga

SEQ ID NO: 3728 - protein, 241 aa, Unknown
  Obtained from environmental sample
  misc_feature (1)..(241): Xaa is any amino acid
MGKYISWHNYRGKANAQFEGFKDKKTDGRNPSNSYIPRFRNVRKQEMDFQRGYAIGIGGGRGTSINQDLIGDELRENLLNPPLGNWNISSWMMGESVPLEKNHIRLHNDMKDKYGIPQIIISCEWSENDDKMVEDYIEQSKEMFEKAGFINIKAEDTKSPPGSDIHEMGGVRMGHDPKTSLLNKWNQLHHCKNVFVTDGACMTSTGSQNPTLTYMAITARAAHYAVEEIEEEKSLEKIRCK

SEQ ID NO: 3729 - DNA, 807 bp, Unknown
  Obtained from environmental sample
  misc_feature (1)..(807): n is a, c, g, or t
atgattggggaaggtagagtcctctttccgaaaaggaaagaaggccgacccagggaaaaaaaatttctaaaggacttacaaaaagagcatactggattttcaacttggcttgaaagtaaaacggttggatttactacccacggaacacgagatcttacagaactgcttaaaggaaaattttttgattttcctaaaccagttactctgatcaaaacacttattgggcaggtaatgcagtccgaagacatagtatttgatttctttgcaggctcaggcactacagctgaagctataatggagctaaacaagcaagacaacggcaatagaaagttcattttagcacaacttccagaaccgaccgaagaggctagcgaagcatccaaagcaggttacaaaacaatagccgatatttccaaggagagaatcagaagagtcattaacaagatcaagaaagaaaatgtcagttctaaacaactcggcatcgatttgggaacagattcaattggacggggaattactggaactgatagagattctatcgattttggattcaaggtttttaagctctctccatccaacttcaaaatctggcgcagcgatgaaataacagaagaaaatcttgtcgagcagttggatgcctttacagatccggttaggggggaaagtgaggaaagcaacattctgtatgaactgatgctgaaagccggctattcgcttacggagaagatagaatcaaaggccggttattatccgatccaagacggggaactggtgattgtgttgaccggcatgaacaatctgtattga

SEQ ID NO: 3730 - protein, 268 aa, Unknown
  Obtained from environmental sample
  misc_feature (1)..(268): Xaa is any amino acid
MIGEGRVLFPKRKEGRPREKKFLKDLQKEHTGFSTWLESKTVGFTTHGTRDLTELLKGKFFDFPKPVTLIKTLIGQVMQSEDIVFDFFAGSGTTAEAIMELNKQDNGNRKFILAQLPEPTEEASEASKAGYKTIADISKERIRRVINKIKKENVSSKQLGIDLGTDSIGRGITGTDRDSIDFGFKVFKLSPSNFKIWRSDEITEENLVEQLDAFTDPVRGESEESNILYELMLKAGYSLTEKIESKAGYYPIQDGELVIVLTGMNNLY

SEQ ID NO: 3731 - DNA, 729 bp, Unknown
  Obtained from environmental sample
  misc_feature (1)..(729): n is a, c, g, or t
gtgttcgcgnnggcacactgnngaagnntacaaagnnagaagtttccctcgnngacagggagtgaagacgacagcnnaattctcgacgagcttcgaaaaaccgttgaaaaattactgctgcccctcgttgagaataataatgagaacgaggattcggaagactttattgaaactctaaagctcgacctatatccgaaggatgtctacacctttactcccatgggaaaggtaattcagttgccgcgcggtgcgacgccgatcgattttgcttatgcgatccactctgtggttggcgacacatgtaccggagcaaagataaacggtcggattgttccgcttcgcagcgaactgcaaaacggtgatgtagtcgagatcctgaccactcaaaattccaaaccgtctggggactggctcaatcacgctgttacctcacgagcccgtaatcgaatccgtcattttatttcgatcgagcagcggtcccagtcgatcgagatcggtcggaagctgttggaaaaggaaggtgataagttcaggatcagtcctaagaaatttgttgggaacgaagcggagatgaaacggatcgcgaatgaatacggactcagccggccggaagatctttttgcgtcagtgggttatgggaaaaccctgccgcgaaacgttgtcgctaagttcctgggagctgagaaattcagtgaattagatcccgattctaaacgtgaacacgcttaa

SEQ ID NO: 3732 - protein, 242 aa, Unknown
  Obtained from environmental sample
  DOMAIN (64)...(127): TGS domain
  misc_feature (1)..(242): Xaa is any amino acid
MFAXAHXXXXQXXKFPSXTGSEDDSXILDELRKTVEKLLLPLVENNNENEDSEDFIETLKLDLYPKDVYTFTPMGKVIQLPRGATPIDFAYAIHSVVGDTCTGAKINGRIVPLRSELQNGDVVEILTTQNSKPSGDWLNHAVTSRARNRIRHFISIEQRSQSIEIGRKLLEKEGDKFRISPKKFVGNEAEMKRIANEYGLSRPEDLFASVGYGKTLPRNVVAKFLGAEKFSELDPDSKREHA

SEQ ID NO: 3733 - DNA, 318 bp, Unknown
  Obtained from environmental sample
  misc_feature (1)..(318): n is a, c, g, or t
ttgntccaattctatnaacanctgnnnatgttgtggcatattcccatgcgctcgggtcgggaaggggaaagcaactgcccgttggtcngcgtcatggcggctatcncccaacgttcacctgttgtttncaccattttcatctacggatccgatgaactaaattntttccataggatattcggcgnaagccttcctttaagggcattacccataaattcgacccctcttattcggttattatacttccagaactattcganaatggtaaattataatcttcantcaaacacccagtcacggaacacgaccaccttanna

SEQ ID NO: 3734 - protein, 106 aa, Unknown
  Obtained from environmental sample
  misc_feature (1)..(106): Xaa is any amino acid
MXQFYXXLXMLWHIPMRSGREGESNCPLVXVMAAIXQRSPVVXTIFIYGSDELNXFHRIFGXSLPLRALPINSTPLIRLLYFQNYSXMVNYNLXSNTQSRNTTTLX

SEQ ID NO: 3735 - DNA, 423 bp, Unknown; identical to SEQ ID NO: 67
  Obtained from environmental sample
  misc_feature (1)..(423): n is a, c, g, or t

SEQ ID NO: 3736 - protein, 140 aa, Unknown; identical to SEQ ID NO: 68
  Obtained from environmental sample
  misc_feature (1)..(140): Xaa is any amino acid

SEQ ID NO: 3737 - DNA, 300 bp, Unknown
  Obtained from environmental sample
  misc_feature (1)..(300): n is a, c, g, or t
gtgcccaaactgctgctcctgcaatcgcgcaaggatgaagctgtgaattggatcattgttattcttagaaaactatcagatttattcttttggctttcagaagcatgcgatgccttgaaatggaaaatagaaatacgcaacaggccgaaatgctctaaatgcaattatccggcaagattgggtttgaccgtctgcgaatttcatgaatcagaggttgtgctaaaagattttatggaagaacaagtaaatttgcagctgcgggaattatcacaaccgattctggcgtacgcattccattag

SEQ ID NO: 3738 - protein, 99 aa, Unknown
  Obtained from environmental sample
  misc_feature (1)..(99): Xaa is any amino acid
MPKLLLLQSRKDEAVNWIIVILRKLSDLFFWLSEACDALKWKIEIRNRPKCSKCNYPARLGLTVCEFHESEVVLKDFMEEQVNLQLRELSQPILAYAFH

SEQ ID NO: 3739 - DNA, 819 bp, Unknown
  Obtained from environmental sample
  misc_feature (1)..(819): n is a, c, g, or t
atgacgacgaagaaaaccggcgaaaacgaagtcctncggtgctcgttntgcaacaaggatcagaacgacgtccggaagctcattncgggccctaccgtcttnatttgcgatgagtgcgtcgaggtctgcaacgacatcatcgcggacgacagcaagttcgatctcggcacccgctcggcgctgccgatgcctgtcgagatcaagaagtttctggacgagtacgtcatcggccaggagcagaccaagaagaagctggccgtcgcggtctacaaccactacaagcggctcgagatccagaagcagtcacgcggccgtcacgacgtcgagctcagcaagtcgaacatcctgctgatcggaccgaccggcagcggcaagacgctgctcgcacagacgctcgcccgcctgctgtcggtgccgttcaccatcgtcgacgccacgacgctcaccgaggccggttacgtcggcgaggatgtcgagaacatcatcctgaagctgctgcaggccgccggcggcgacatcgagaaggcgcagcagggcatcatctacatcgacgaggtcgacaagatctgccgcaaggacgagaacccgtcgatcacccgcgacgtgtcgggcgagggcgtgcagcaggcgctgctgaagatcctggaaggcacggtggccaacgtgccgccgcagggcggccgcaagcacccgcaccaggagttcttccaggtcgacacgacgaacatcctcttcatctgcggcggcgcctttgtcgggctcgacaagcagatccagcggcggctcggcaagaagaccatggcttccgcgaagacatga

SEQ ID NO: 3740 - protein, 272 aa, Unknown
  Obtained from environmental sample
  DOMAIN (114)...(271): ATPase family associated with various cellular activities (AAA)
  misc_feature (1)..(272): Xaa is any amino acid
MTTKKTGENEVLRCSXCNKDQNDVRKLIXGPTVXICDECVEVCNDIIADDSKFDLGTRSALPMPVEIKKFLDEYVIGQEQTKKKLAVAVYNHYKRLEIQKQSRGRHDVELSKSNILLIGPTGSGKTLLAQTLARLLSVPFTIVDATTLTEAGYVGEDVENIILKLLQAAGGDIEKAQQGIIYIDEVDKICRKDENPSITRDVSGEGVQQALLKILEGTVANVPPQGGRKHPHQEFFQVDTTNILFICGGAFVGLDKQIQRRLGKKTMASAKT

SEQ ID NO: 3741 - DNA, 690 bp, Unknown
  Obtained from environmental sample
  misc_feature (1)..(690): n is a, c, g, or t
atgttagaccttaaatttgtccgtgagaaccccgaattagttaaacaaggcatagaaaataagaatgaaaagagcaggataaatgagatcattactcttgatgaaaaaagaagagcattaattatagagacggaggaattaaaatcaagaagaaataaagtttcggcgcagataccgcagatgaaaaaaagcggacaggatgttacagaagtgcttgccgaaatgaaacaggtatcagataagattacaactctcgattctgaactcagaggcatagaatcggaagttgaaaatataatgttgtacatccccaaccttgctcactcttctgtacctgtaggaagatccgctgaggaaaatgttgaggtccgcagatggcttcccgaaggcttttcatttgaactgaatgaagcagttatggatcatgtgcagcttgggaaaaagctgaacatacttgattttgaaagaggagctaaaatatctggatcaggtttccctttatatactggtaaaggggcaactcttgagagagccttaataaattttatgcttgatttccatattcagaagcataattataaagagatacttcccccatttttggtaaaccgtgaatcaatgcgagggacaggccagcttccgaaaatggctgatgatatgtatcatatagaaaaggatgatctgttcccc

SEQ ID NO: 3742 - protein, 230 aa, Unknown
  Obtained from environmental sample
  DOMAIN (1)...(107): Seryl-tRNA synthetase N-terminal domain
  misc_feature (1)..(230): Xaa is any amino acid
MLDLKFVRENPELVKQGIENKNEKSRINEIITLDEKRRALIIETEELKSRRNKVSAQIPQMKKSGQDVTEVLAEMKQVSDKITTLDSELRGIESEVENIMLYIPNLAHSSVPVGRSAEENVEVRRWLPEGFSFELNEAVMDHVQLGKKLNILDFERGAKISGSGFPLYTGKGATLERALINFMLDFHIQKHNYKEILPPFLVNRESMRGTGQLPKMADDMYHIEKDDLFP

SEQ ID NO: 3743 - DNA, 912 bp, Unknown
  Obtained from environmental sample
  misc_feature (1)..(912): n is a, c, g, or t
atggtanaanaagctagagcattgattcaaatgtggganattgaaagagtatttacagatataacaacatctcaaacctataataaaataagagacgatttttggagggcccttggcaaacttccggtaggaaaaaattttacaaggcaaatggcatcaaagtttgaggcaagcttaaaagggatggtaagcaaaagcagtaatttatttgaagcattaagattgcgttatttcggtcccattgatggccacaatattactaaacttgtagatacactaaaagatctgaaagatatttccggacctaaattgcttcatattaaaactgtaaagggaaagggatatgatattgctgaaaaggaacaaacgaaatggcacgcaccgggcttgtttgacaaaattaccggtgagatttataaaaagagatttgacctgccacaacctcccaaataccaggatgtgttcggtcatactataattgagctggcagaacagaacaagaaaataatgggtgtgactcctgccatgccaagtggttgttcgttaaaatatatgatggaaaaaatgcccgaccgtgcatttgatgtcggcatttgcgaacaacatgcggtaacacttagtgccgggcttgcaactcagggtatgaaggtgttctgtaacatttactcaacttttatgcaaagggcctacgaccaggtgatacacgacgtagcaattcaaaatcttccagtggtattttgcctggatagagccgggcttgtcggggaagatggcccaactcatcatggcgcttatgatattgcttacatgagatgcatcccaaacatgattgttagcgcacctatgaacgaatcagagttaagaaatgtgatgtacacttcgcanattaacagcccaaaaaatctttcgtga

SEQ ID NO: 3744 - protein, 303 aa, Unknown
  Obtained from environmental sample
  DOMAIN (149)...(300): Transketolase, pyridine binding domain
  misc_feature (1)..(303): Xaa is any amino acid
MVXXARALIQMWXIERVFTDITTSQTYNKIRDDFWRALGKLPVGKNFTRQMASKFEASLKGMVSKSSNLFEALRLRYFGPIDGHNITKLVDTLKDLKDISGPKLLHIKTVKGKGYDIAEKEQTKWHAPGLFDKITGEIYKKRFDLPQPPKYQDVFGHTIIELAEQNKKIMGVTPAMPSGCSLKYMMEKMPDRAFDVGICEQHAVTLSAGLATQGMKVFCNIYSTFMQRAYDQVIHDVAIQNLPVVFCLDRAGLVGEDGPTHHGAYDIAYMRCIPNMIVSAPMNESELRNVMYTSXINSPKNLS

SEQ ID NO: 3745 - DNA, 387 bp, Unknown
  Obtained from environmental sample
  misc_feature (1)..(387): n is a, c, g, or t
gtgattaccttnatgaaaaaaaagttccaaataaaatattcattttacctgctttgccaaaaggtgtatcnaggaaaagttcagctcaatattttgagagaaaatttactgcaattacagcctgataaacaatcaaaaaacgggcaatatcttgaacaggttttaggcattgctgcggaggtattccaggtgcctgtttcaaagttatctattgctgatacttcaaatactgtgaacgggtgggattcactggctcatttaattttcatcacttctatggaggagcattttaatatctcttttagtactgcagaagtaataaccatgaatagtataaaaaaggcactggaacttatcaaacaaaaacatgtaccaaaagcagcctaa

SEQ ID NO: 3746 - protein, 128 aa, Unknown
  Obtained from environmental sample
  misc_feature (1)..(128): Xaa is any amino acid
MITXMKKKFQIKYSFYLLCQKVYXGKVQLNILRENLLQLQPDKQSKNGQYLEQVLGIAAEVFQVPVSKLSIADTSNTVNGWDSLAHLIFITSMEEHFNISFSTAEVITMNSIKKALELIKQKHVPKAA

SEQ ID NO: 3747 - DNA, 504 bp, Unknown
  Obtained from environmental sample
  misc_feature (1)..(504): n is a, c, g, or t
atgaaacggaaactttcagcagagtggaaaggacgttcggaaaatataatgattgtagacctggttcggaatgatctggcaaaagtgtgtacagaggggagtgtaaaagtggaggaattgatgggtatatatgctttcccgcaggtatatcaaatgatttctacagtaagcggggaagtagaaaacaacacgcgggtaacggatatattaaaagctacttttcccatggggagcatgaccggcgcccccaaaaaaagagtaatggaactaattgagcagtatgagcgaaccaaacgtggcttattttcgggggcggtgggttatatctctccccagcaagatatggattttaatgtggtgatcaggagcatattatataatgcctccggccggtatatttctttccccaccggttccgctattacttattacagcaaggcggaagatgaatacgaagagtgtctgttaaaggcaggagccataaaaaaagtgctgaacgggtaa

SEQ ID NO: 3748 - protein, 167 aa, Unknown
  Obtained from environmental sample
  DOMAIN (1)...(165): chorismate binding enzyme
  misc_feature (1)..(167): Xaa is any amino acid
MKRKLSAEWKGRSENIMIVDLVRNDLAKVCTEGSVKVEELMGIYAFPQVYQMISTVSGEVENNTRVTDILKATFPMGSMTGAPKKRVMELIEQYERTKRGLFSGAVGYISPQQDMDFNVVIRSILYNASGRYISFPTGSAITYYSKAEDEYEECLLKAGAIKKVLNG

SEQ ID NO: 3749 - DNA, 801 bp, Unknown
  Obtained from environmental sample
  misc_feature (1)..(801): n is a, c, g, or t
atggatgaagggcttaatacatttgtacaattccttaccgaacgggaatttgatgccaattatccttcccagcgtggtccggcatacaaaatggttgattacatgcgtttgccaaagaatcagctggaacctattatgagcaacagtgagaatataatacactttggtcccaatgcttacggaaaaccggccactgcgctgaatatccttcgcgaaactgttatgggccgggatctttttgatttcgctttcaaacaatactgcagccgttgggcttttaagcatcctgaaccggcggatttcttccgtaccatggaagatgcgagcgcgattgacctggattggttctggagaggatggttctatgacatcgaaccggtggatatttccgttgacaccgttaaggcttacacaatcgttaaaggcgaaaagttacctgtgaaaatggatacggtagtaagcgctcctaaaaagaaagaagttgaatttatcactactatcagaaatcgtgaaagcggaatcgttccccttgttgatcgtgacacaacattgcgtgacttttattatcgctacgcgggtcccgccgctgtgaccaaagagactaaaaacagatatgatggcctggaagaagcgtcagattcgcttatacacaaatacaagggccagtatgtatatgagatgaaattctctaataaaggagggctcgtttccccgcttatcatccagtttaattatagtgatggcagcagtgaaattgacagaatcagcgcgtacatctggagaaaaatgaaaaggaagtaa

SEQ ID NO: 3750 - protein, 266 aa, Unknown
  Obtained from environmental sample
  misc_feature (1)..(266): Xaa is any amino acid
MDEGLNTFVQFLTEREFDANYPSQRGPAYKMVDYMRLPKNQLEPIMSNSENIIHFGPNAYGKPATALNILRETVMGRDLFDFAFKQYCSRWAFKHPEPADFFRTMEDASAIDLDWFWRGWFYDIEPVDISVDTVKAYTIVKGEKLPVKMDTVVSAPKKKEVEFITTIRNRESGIVPLVDRDTTLRDFYYRYAGPAAVTKETKNRYDGLEEASDSLIHKYKGQYVYEMKFSNKGGLVSPLIIQFNYSDGSSEIDRISAYIWRKMKRK

SEQ ID NO: 3751 - DNA, 321 bp, Unknown
  Obtained from environmental sample
  misc_feature (1)..(321): n is a, c, g, or t
atgcaaccaagggagggttgnaccatgagaagaatcgtaacaagcctggcagttttggttctggtgatgtttagctgttcacaaatgattttggcgcaaacaacacaagatcaaaaatcaaatggaaaagttgtcaacatcaacactgcgaatcagagtgaattggaatcgcttcctggaattggaccatctttagcaaaaaagattattgattttagaacgaaaaatggtggattcaaaaatccaagcgatttaatggctgttcaaggaatcggtgaaaagaaattcgaacagctgaaaactttgatttcagtcaaataa

SEQ ID NO: 3752 - protein, 106 aa, Unknown
  Obtained from environmental sample
  DOMAIN (43)...(72): Helix-hairpin-helix motif
  misc_feature (1)..(106): Xaa is any amino acid
MQPREGXTMRRIVTSLAVLVLVMFSCSQMILAQTTQDQKSNGKVVNINTANQSELESLPGIGPSLAKKIIDFRTKNGGFKNPSDLMAVQGIGEKKFEQLKTLISVK

SEQ ID NO: 3753 - DNA, 333 bp, Unknown
  Obtained from environmental sample
  misc_feature (1)..(333): n is a, c, g, or t
atggataatgacagattaaaaacggctaaaacttatctaagctattgcttcattgctgaagtctctattcttatttttctttacttaaatttccagagcattcaaaagaaaattatattagacaaatgccggttagaaacaattgctttgttgtcactcacaaaaaatcatccgctatcaaaatacttatccatttcggatttaaagaagatacagaatgaatcttataaggatgtcgtggctaaagctttagatctgccagatatgattgccattcataactcttttagtgagacttttaaagtccgacctactgattattcgatgttctga

SEQ ID NO: 3754 - protein, 110 aa, Unknown
  Obtained from environmental sample
  misc_feature (1)..(110): Xaa is any amino acid
MDNDRLKTAKTYLSYCFIAEVSILIFLYLNFQSIQKKIILDKCRLETIALLSLTKNHPLSKYLSISDLKKIQNESYKDVVAKALDLPDMIAIHNSFSETFKVRPTDYSMF

SEQ ID NO: 3755 - DNA, 381 bp, Unknown
  Obtained from environmental sample
  misc_feature (1)..(381): n is a, c, g, or t
ttgaatactggaatcctgtcatttgaatttgaatggtatctgcgagattatttctttcgagtaaacaatagaaatggtgaggattttgagagcatatttgataataatgaaatctgcagttacatgaaagataactacctcaaatataagaattggaaattggaagaaataactaaattatttaatactgctatatatgatctccatgataggaatgttttgatcgtcaagaaagatattggtaaggtcatcctaaaatctaggtttgtacgaaaacaatgtacaaattgttattatattaattacctctcctcatcggagtcaatgaattgccacaggtgtaagtcagataacttgaaggactttccacctagaaagtag

SEQ ID NO: 3756 - protein, 126 aa, Unknown
  Obtained from environmental sample
  misc_feature (1)..(126): Xaa is any amino acid
MNTGILSFEFEWYLRDYFFRVNNRNGEDFESIFDNNEICSYMKDNYLKYKNWKLEEITKLFNTAIYDLHDRNVLIVKKDIGKVILKSRFVRKQCTNCYYINYLSSSESMNCHRCKSDNLKDFPPRK

SEQ ID NO: 3757 - DNA, 441 bp, Unknown
  Obtained from environmental sample
  misc_feature (1)..(441): n is a, c, g, or t
atgtcgaagatcaatatatccaataaaaaagcaactttcgagttcgagataattgataaatttacggcgggaattatgcgtaccggaacggaaataaaatccatccgcgagggaaaagcaaatatgagcgatgcgtattgttccttcaccagcggcgaattatttgtgcgaaacctgcatatttccgagtatgatatgggaacgcattataaccacgaacccaaacgcgcacgtaagctgctattgcaaaaaaaagaactcaaaaaactcaatacaaaagttaaagaaaaaggccttaccattgttcctttaaagatatttttaagcggaacaggatatgcgaaaatggatatcgcgttagcaaaaggaaagaaaacatttgataagcgcgaaagcataaaagagcgcgatgtaaaaagagatatggaaagaagctattaa

SEQ ID NO: 3758 - protein, 146 aa, Unknown
  Obtained from environmental sample
  DOMAIN (3)...(70): SmpB protein
  misc_feature (1)..(146): Xaa is any amino acid
MSKINISNKKATFEFEIIDKFTAGIMRTGTEIKSIREGKANMSDAYCSFTSGELFVRNLHISEYDMGTHYNHEPKRARKLLLQKKELKKLNTKVKEKGLTIVPLKIFLSGTGYAKMDIALAKGKKTFDKRESIKERDVKRDMERSY

SEQ ID NO: 3759 - DNA, 480 bp, Unknown
  Obtained from environmental sample
  misc_feature (1)..(480): n is a, c, g, or t
gtgaatgaccttgctttttctcaaaacattgatacaaccgtagaggaagttgaggagatcttatttaaggtccaggactttgatccggcaggaattgctgcgagggatttacaggaatgcctcatgctgcaactcgaaagaaaagaagatcttaacggtcacgtaaagctggcaagaattattgtagcagactatttcgacgaatttacaaagaaacattacgataagattcagaagaagctcaacatagaaagtgacgaggatctgaaggaaatcataaatataataaccaagctcaatcctaaaccaggaggtgcttcaggagatgtaaaagcgcaatatctgcttccagattttattctggtaaataataacggcaaactcgaactctctttgaattcgaaaaatggacctgagcttaaggtcagcagatcgtatgcagaaatgctttcagacctacgacaaaagtgtaaagcgtga

SEQ ID NO: 3760 - protein, 159 aa, Unknown
  Obtained from environmental sample
  DOMAIN (1)...(147): Sigma-54 factor, core binding domain
  misc_feature (1)..(159): Xaa is any amino acid
MNDLAFSQNIDTTVEEVEEILFKVQDFDPAGIAARDLQECLMLQLERKEDLNGHVKLARIIVADYFDEFTKKHYDKIQKKLNIESDEDLKEIINIITKLNPKPGGASGDVKAQYLLPDFILVNNNGKLELSLNSKNGPELKVSRSYAEMLSDLRQKCKA

SEQ ID NO: 3761 - DNA, 408 bp, Unknown
  Obtained from environmental sample
  misc_feature (1)..(408): n is a, c, g, or t
ttgtttgtacaaaatacaaaaaaaccgattatgcaaatcgttatacaccggtgtttaaaacggccaggattaattgatcgagccagaacttattatctggagctgaatgaaaaagggctctatattatttgtttgggcaatgctacccaggaggttccccgttccggggacctaatcgcccaggcattggctgctcaaaccattaagttcatcgccaaccaatacgaaaaaaagatcagggaaactgaaactcaacttcaggaaaaggggattaatgaagttgtaaaaggaaaacattcctattatttccaaaaatcagaaatagaaaatttcgaattcaaagttttagcgaacaatactgttcaaataaaaataaaagcggaaacaaagagatcaccctttttctga

SEQ ID NO: 3762 - protein, 135 aa, Unknown
  Obtained from environmental sample
  misc_feature (1)..(135): Xaa is any amino acid
MFVQNTKKPIMQIVIHRCLKRPGLIDRARTYYLELNEKGLYIICLGNATQEVPRSGDLIAQALAAQTIKFIANQYEKKIRETETQLQEKGINEVVKGKHSYYFQKSEIENFEFKVLANNTVQIKIKAETKRSPFF

SEQ ID NO: 3763 - DNA, 435 bp, Unknown
  Obtained from environmental sample
  misc_feature (1)..(435): n is a, c, g, or t
atggcgggttactatggacttaagtcaatatatagtgatgaaaagaaaaaggacactttccgaattctcataaccttatttaccgtcaatcacctgattcattttgtatttctcttccttcgtttcaaaagccatgcagccccgctcagcatcgtagagaatttacatggtttcattacttttattttcatcataacgattccattttttctatggaaatataataaactgaacaaactgctttatactgccgtcattctgcatttactcaacatcagttactttatcaatcaaacattctggggcaaagtaaaacctgagcatccggcttatcataatcagtttggtgttgttgtaatagctgtggcttgtctttatattctttatagagtttttctcgaaaacagctcccggaaaataccaggaaaatattga

SEQ ID NO: 3764 - protein, 144 aa, Unknown
  Obtained from environmental sample
  misc_feature (1)..(144): Xaa is any amino acid
MAGYYGLKSIYSDEKKKDTFRILITLFTVNHLIHFVFLFLRFKSHAAPLSIVENLHGFITFIFIITIPFFLWKYNKLNKLLYTAVILHLLNISYFINQTFWGKVKPEHPAYHNQFGVVVIAVACLYILYRVFLENSSRKIPGKY

SEQ ID NO: 3765 - DNA, 357 bp, Unknown; identical to SEQ ID NO: 3121
  Obtained from environmental sample
  misc_feature (1)..(357): n is a, c, g, or t

SEQ ID NO: 3766 - protein, 118 aa, Unknown; identical to SEQ ID NO: 3122
  Obtained from environmental sample
  misc_feature (1)..(118): Xaa is any amino acid

SEQ ID NO: 3767 - DNA, 777 bp, Unknown
  Obtained from environmental sample
  misc_feature (1)..(777): n is a, c, g, or t
atgctggtcatgtccaacaggaaggatggtgaaaagaagaatttgctcaagtatcaaagtacttttgatggtatcagcacttggattgattttcttaatgactatgaatacagtggttcccaagaattcagggctgctgagttgaagaaacttatcagggtgacttacacttcaagaactcctggtggccttaagtcctacattgacaccctacaggccaacctcaatgagctggctatcctcctgccttatttttattttaaaggtcaaacatggcatattttgttccagaatttgcaagatatgaccgctttgaattctctcatccaaacctgcaaggaccaagactatacatatatgcagtctgtccaatgccttagaacctatggtgcttctcatgaggattctaaccccagactaattcagcacactgagttagaacaagactcctcctttacccttgaacaggccagaaccattctacactctatggcaaaggaatcatctcttgtccaggtttttcatacattgaatacttctgccactttatgcaattcattgagtataccactccatatttggaagcttctgagtaaagaattccagactgagatacagcaaatcagaaaacagatcagtgagaaggaagatgcagccaagactctacctttccctaagccttccaaccagaaaattcccctgcagtatggcctcaccttggataagaaggccccagatgttaaggtagacaggcatgttaatgtcatagtcctataa

SEQ ID NO: 3768 - protein, 258 aa, Unknown
  Obtained from environmental sample
  misc_feature (1)..(258): Xaa is any amino acid
MLVMSNRKDGEKKNLLKYQSTFDGISTWIDFLNDYEYSGSQEFRAAELKKLIRVTYTSRTPGGLKSYIDTLQANLNELAILLPYFYFKGQTWHILFQNLQDMTALNSLIQTCKDQDYTYMQSVQCLRTYGASHEDSNPRLIQHTELEQDSSFTLEQARTILHSMAKESSLVQVFHTLNTSATLCNSLSIPLHIWKLLSKEFQTEIQQIRKQISEKEDAAKTLPFPKPSNQKIPLQYGLTLDKKAPDVKVDRHVNVIVL

SEQ ID NO: 3769 - DNA, 927 bp, Unknown
  Obtained from environmental sample
  misc_feature (1)..(927): n is a, c, g, or t
gtgcgtaattactcaggatctttacgacttagcacttgggatttgaagcgggatgccccaggacaggaaacagaaatgcttgcgctatatgtacctccccaaggacttgagtttcttggtatacctgtaaaggatacaaagaaaattgctcctaaacatctttttgcaggaaaaaatgtcgcaacaactaatccaatccgtgagcctgtactgatagatcgtgatacgtttgaaagcatcaagataaatgatttacaggaaattttcatgaaggctattactaatttaggtgacgagctgctacttgatctcattaatcaattcaaagaaacagattctcctgaagagcgctcccgtatacaaaaagaagtagatactcgtctttttaatatactccgctttgaatcagaacttcatttcaatggttcgcaaacaaaagtaaataaagattttaccgtttatcccgctacaaaacttaaagtaaattcccttcttcagctcatcaaagtaactaaaagtatgccaggacaacccgctcccaaaagatataaagagccgggtcacaaaagaggcacgaaacaacaacctctaaacacaagccctcatcgcaaacaagaaaccggcaataagtggaaacatacatcttcacaacaactaaaaacttatgatgatacacagccatttttgccaggcgatctcctaattcagaaattgactaacggtgaattggaacatattccccttaatacgaaattgtcaggtaatgaggagcatcttgatgaaattattgaatcaaatacgaagcttagacgcgctgagcttgcctacatactctatcggatgttattgcagagaagtcttgaggaactattacgtaataagattaagaccccgtcggaaattataaacaattctgtgatccactag

SEQ ID NO: 3770 - protein, 308 aa, Unknown
  Obtained from environmental sample
  misc_feature (1)..(308): Xaa is any amino acid
MRNYSGSLRLSTWDLKRDAPGQETEMLALYVPPQGLEFLGIPVKDTKKIAPKHLFAGKNVATTNPIREPVLIDRDTFESIKINDLQEIFMKAITNLGDELLLDLINQFKETDSPEERSRIQKEVDTRLFNILRFESELHFNGSQTKVNKDFTVYPATKLKVNSLLQLIKVTKSMPGQPAPKRYKEPGHKRGTKQQPLNTSPHRKQETGNKWKHTSSQQLKTYDDTQPFLPGDLLIQKLTNGELEHIPLNTKLSGNEEHLDEIIESNTKLRRAELAYILYRMLLQRSLEELLRNKIKTPSEIINNSVIH

SEQ ID NO: 3771 - DNA, 585 bp, Unknown
  Obtained from environmental sample
  misc_feature (1)..(585): n is a, c, g, or t
gtgcaaataaatagattaattgttttacttctgattatgatttcacataaaaatttcgctgaaaacaaactgctctatttgcagccaatgcaagatgcaaagtatgtgaatttaaaagacaacatcattattggatttgagaaaccgcttaatgctgataaacaggatgttcaaaaatgcattgaggttattggaacaaaaagcggaattcatactggcgaaataaagtttgcagtcagcagcattattatttttaatccgcatacttcctttgcttatgatgaagaaatatatataaaaatttcgggaattgtatgcagagaaatcggaacgaagtcatttcagtatagattcactacttcaaagagaaaagttaactatgattaccggaagaatggagaagcagaatttccaggcttaaccgatcaaccgtttcttccccctgtactgaatgttacagtaaataataatccctccccgggttattttttcattactccatatgcaggcaactctaacctgatcattgcaaataacaacgcaacagtatactggtacagaaagctttccgcttctcactggtga

SEQ ID NO: 3772 - protein, 194 aa, Unknown
  Obtained from environmental sample
  SIGNAL (1)...(20)
  misc_feature (1)..(194): Xaa is any amino acid
MQINRLIVLLLIMISHKNFAENKLLYLQPMQDAKYVNLKDNIIIGFEKPLNADKQDVQKCIEVIGTKSGIHTGEIKFAVSSIIIFNPHTSFAYDEEIYIKISGIVCREIGTKSFQYRFTTSKRKVNYDYRKNGEAEFPGLTDQPFLPPVLNVTVNNNPSPGYFFITPYAGNSNLIIANNNATVYWYRKLSASHW

SEQ ID NO: 3773 - DNA, 384 bp, Unknown
  Obtained from environmental sample
  misc_feature (1)..(384): n is a, c, g, or t
gtggatcaagaatgtggtaaattgaagaaatatggttatcggagagctaaaaaaggaattcttccattaataggtaatttttatgtattgagaaaagaaggtattataacctccgacgaatatgagaaaattgctaaattatatgaattattcagtaataatgataataaaatgatagatttaatagaagattttgttgaaggtttaaagacaagactagagacggttttgaattctcaaaataaacaggaagatgttgaagttcttaagaacgaacttgccaaaataactgacaaggctagaactgcatcgaatgaattgcaacaatcgggttataaattaacaaagttgtactatgatttaagaaaaactcgaacaggctga

SEQ ID NO: 3774 - protein, 127 aa, Unknown
  Obtained from environmental sample
  misc_feature (1)..(127): Xaa is any amino acid
MDQECGKLKKYGYRRAKKGILPLIGNFYVLRKEGIITSDEYEKIAKLYELFSNNDNKMIDLIEDFVEGLKTRLETVLNSQNKQEDVEVLKNELAKITDKARTASNELQQSGYKLTKLYYDLRKTRTG

SEQ ID NO: 3775 - DNA, 507 bp, Unknown
  Obtained from environmental sample
  misc_feature (1)..(507): n is a, c, g, or t
atgaaccgatttcaaaagcattatgtagtaacaggagggggcggttttattggcagtcaggtaataaaagaattattaaaagatgatacgataaagatcacctgcattgataattttgatccattttataaacggcagctaaaactgttgaaccttgctggttttgaaaaaacccataatttttttcttttagatattgatctttccagagtttccataaagcaactacatgacgctgttagccaaccggtagatgtaatcatccatcttgctgccaaagctggagtaaggcccagcattgccaatccagttgcttatgtagaaacaaatattttgggcacgcaaacactattggattttgccgttcagaaaaacgtaaaaaagtttgtttttgcttcttccagtagtgtatatggcataactgaaaattttccgtggaaagaagatgaattgctgatgccgatcagcccttatgccatgaccaaactttcgggtgaaatggcttga

SEQ ID NO: 3776 - protein, 168 aa, Unknown
  Obtained from environmental sample
  DOMAIN (8)...(168): NAD dependent epimerase/dehydratase family
  misc_feature (1)..(168): Xaa is any amino acid
MNRFQKHYVVTGGGGFIGSQVIKELLKDDTIKITCIDNFDPFYKRQLKLLNLAGFEKTHNFFLLDIDLSRVSIKQLHDAVSQPVDVIIHLAAKAGVRPSIANPVAYVETNILGTQTLLDFAVQKNVKKFVFASSSSVYGITENFPWKEDELLMPISPYAMTKLSGEMA

SEQ ID NO: 3777 - DNA, 663 bp, Unknown
  Obtained from environmental sample
  misc_feature (1)..(663): n is a, c, g, or t
atgttaaaaaattattttaaaatagcattgcgggttcttctgcgcaataaattctattcaataattaacatttttgggttggctgtcgggcttgcaagttttatattgattgccatttacatacaagatgaattaagttatgacaagcagcattctatgggcaaaaatatttaccgtgttatagaaaaaattgataatgctgaaggccagggagaaaactcgtcatcaaatccatttcctgttgggccttcattacaaaatgattatccgcatttaattgagcagcaagtacgtttcttcaatttccaggatgaaaaacatacgttgcaggttggcgataaaaaatacaatgaaaaatatactttttttgctgatagcaatgtattgaatttgtttgatttcccgctacaaagtggtgacagagaaaaagttctgtcaaacccaaactctatagttttaacaaaagagttagcacaaaagtattttggaaatgaagaccctataggaaaactgctgaagtttgatggcgttatagatctgcttgttacaggaatttttggcgatctgccacaacaaacgcatctaaaattttctgcgctcatttcattttcaactttaaggcaaatggttggcccggatctacagataaaaaattggatatga

SEQ ID NO: 3778 - protein, 220 aa, Unknown
  Obtained from environmental sample
  misc_feature (1)..(220): Xaa is any amino acid
MLKNYFKIALRVLLRNKFYSIINIFGLAVGLASFILIAIYIQDELSYDKQHSMGKNIYRVIEKIDNAEGQGENSSSNPFPVGPSLQNDYPHLIEQQVRFFNFQDEKHTLQVGDKKYNEKYTFFADSNVLNLFDFPLQSGDREKVLSNPNSIVLTKELAQKYFGNEDPIGKLLKFDGVIDLLVTGIFGDLPQQTHLKFSALISFSTLRQMVGPDLQIKNWI

SEQ ID NO: 3779 - DNA, 456 bp, Unknown
  Obtained from environmental sample
  misc_feature (1)..(456): n is a, c, g, or t
atgatgaagacttttggagaaaaggcatttcatttttttaagacattaaaacctgattttaaaactccaactggtatagatcttctgcttccttttacgaataacgaagctcgttcgattgcaaaaaaattttatgaaaagttttacgatgatataaatgataggacattcataatcggaataaacccgggaagattcggagcgggtattacagggatttcatttacagatccggtacgattgcaaaatgattgcggcatcgaaaacgattttccaaaaaaagctgagttgtcgagtatttttgtttatgaaataattaaagccttcggtggcgtaaaaacgttctatgataaattcttcatgactgccatttgtccaataggatttacatcaaatcagaagaacattaattattacgataacaaagaacttctggaaacagcagggagtacataa

SEQ ID NO: 3780 - protein, 151 aa, Unknown
  Obtained from environmental sample
  misc_feature (1)..(151): Xaa is any amino acid
MMKTFGEKAFHFFKTLKPDFKTPTGIDLLLPFTNNEARSIAKKFYEKFYDDINDRTFIIGINPGRFGAGITGISFTDPVRLQNDCGIENDFPKKAELSSIFVYEIIKAFGGVKTFYDKFFMTAICPIGFTSNQKNINYYDNKELLETAGST

SEQ ID NO: 3781 - DNA, 660 bp, Unknown
  Obtained from environmental sample
  misc_feature (1)..(660): n is a, c, g, or t
gtgataaccgtgtccccccgaaaaaattctgaagtggaggagccgcttcttaaggaaatggggataacacccgggcaattggttatattatttgtgggtacttataaaccaacagccggcgttgatgatcttatcatagcttttgatcgattgttcaatgactatacggactgcagcttttttttgataggaaccggaccttcgaaacatcaatgcaggaaattggcagatgggttgagatcaaacaatgtaattaaatttattgaccgggttccgtacaaggaactgttgacttatcaaagcctgaccaatgtgatagtttgtcccgataaggacaatccttactctcattacgttatccacgttaaatattttgatgccttgatctctggaaaattagtaatcaatggagcttttgagagtgtaaaagagatcaatccggatgattgtttatcactaacttttgagccttcaaatattgatagtctatataataaacttaaactgtgccggaaagaacagcattttcttgaaaagaagtacggacaaacaaaaaattatgttgcaaacaatcttacttatcactctttcatccacaaattgataaacagttttaaaacccttgatactaagcccgctgaagattcttctttactataa

SEQ ID NO: 3782 - protein, 219 aa, Unknown
  Obtained from environmental sample
  DOMAIN (13)...(187): Glycosyl transferases group 1
  misc_feature (1)..(219): Xaa is any amino acid
MITVSPRKNSEVEEPLLKEMGITPGQLVILFVGTYKPTAGVDDLIIAFDRLFNDYTDCSFFLIGTGPSKHQCRKLADGLRSNNVIKFIDRVPYKELLTYQSLTNVIVCPDKDNPYSHYVIHVKYFDALISGKLVINGAFESVKEINPDDCLSLTFEPSNIDSLYNKLKLCRKEQHFLEKKYGQTKNYVANNLTYHSFIHKLINSFKTLDTKPAEDSSLL

SEQ ID NO: 3783 - DNA, 450 bp, Unknown; identical to SEQ ID NO: 2751
  Obtained from environmental sample
  misc_feature (1)..(450): n is a, c, g, or t

SEQ ID NO: 3784 - protein, 149 aa, Unknown; identical to SEQ ID NO: 1214
  Obtained from environmental sample
  DOMAIN (49)...(128): Acetyltransferase (GNAT) family
  misc_feature (1)..(149): Xaa is any amino acid

SEQ ID NO: 3785 - DNA, 642 bp, Unknown
  Obtained from environmental sample
  misc_feature (1)..(642): n is a, c, g, or t
atgaccttagaaaatttaggatataatgatagccttaaaaaattcaggaatgagcatgaccttaaaggatttgagattggaagagtaatatcagaacataaagaaagatatattgtaaaaaccgcgaaaggagaatttgaagccgggataacagggaacttacgatttacttcaaaaaaccgcgaagattttccagccgttggcgattgggtggccataaccattcatgattcagacttttccattattcacagcatattcccgagatcctctgttatttccaggcaggcccctggtaaattcggagagaaacaaataatagctacaaatattgattatgcattattggtacaggccgcagaccgcgatttcaatattaacaggcttgagagatacctgaccatttgtaattcttcaaacgttacccccataataatactcaccaaggttgatttaattgatgcacatctgactttcgagatattggataaaataaaacgccgcattagtaatgtgcgggtaattgccataagtaatgcatcacaagaaggttacgacaatctaaaagcgattattgaaaagggtaaaacttattgtatgcttggttcttcaggcgtaggaaaaatccactttattaaataa

SEQ ID NO: 3786 - protein, 213 aa, Unknown
  Obtained from environmental sample
  misc_feature (1)..(213): Xaa is any amino acid
MTLENLGYNDSLKKFRNEHDLKGFEIGRVISEHKERYIVKTAKGEFEAGITGNLRFTSKNREDFPAVGDWVAITIHDSDFSIIHSIFPRSSVISRQAPGKFGEKQIIATNIDYALLVQAADRDFNINRLERYLTICNSSNVTPIIILTKVDLIDAHLTFEILDKIKRRISNVRVIAISNASQEGYDNLKAIIEKGKTYCMLGSSGVGKIHFIK

SEQ ID NO: 3787 - DNA, 705 bp, Unknown
  Obtained from environmental sample
  misc_feature (1)..(705): n is a, c, g, or t
atgaacgattcgacggatcatattttattcaacgaagaagaattccaacaaacttctgattttaacatcaaggagtttctgcataactatgtttggcggtattggtactggtatctgatttccattttcatagcattggttattgctttcgtttacaactggaaaacaacgccggtttatagtgcctccagcacagtgttggtgaaaacaaaagatcagggcgatgtgatggacattctgaactttaccgatttgaataatgacaggaacattcagaatcaaatcgcgatcctaaagtcaaggactttattaaataagacacttcagtcgctcgacttcggagtttcttattttgtgatgaaaaatttccggacgaaagaattatataagaacagtccaatggaaataaccattgactcggctagttatgctgcttacacagttccgattaatatcaaaatattaagtccggcggagttcgagatctcttttgagaatcaaaagaagaaatataatgagaagcatcggttcggcgagtcattcaaaaccacgcttggcatgatcacacttaataagaaggagaacttcgatagatcggttagagagaatattgttaatcagacgcctgattatttaattacgctgaattctccgaatgctttgctggcgaagtacgcagcgaatttgacattgcttaaccgataa

SEQ ID NO: 3788 - protein, 234 aa, Unknown
  Obtained from environmental sample
  DOMAIN (19)...(157): Chain length determinant protein
  misc_feature (1)..(234): Xaa is any amino acid
MNDSTDHILFNEEEFQQTSDFNIKEFLHNYVWRYWYWYLISIFIALVIAFVYNWKTTPVYSASSTVLVKTKDQGDVMDILNFTDLNNDRNIQNQIAILKSRTLLNKTLQSLDFGVSYFVMKNFRTKELYKNSPMEITIDSASYAAYTVPINIKILSPAEFEISFENQKKKYNEKHRFGESFKTTLGMITLNKKENFDRSVRENIVNQTPDYLITLNSPNALLAKYAANLTLLNR

SEQ ID NO: 3789 - DNA, 489 bp, Unknown
  Obtained from environmental sample
  misc_feature (1)..(489): n is a, c, g, or t
atgaatagaagcttttttcagtcattatatccagagggaatttttgttatccccgaatcaaatagtaatgggtccacagttgagacagtaaaggaaaaacaatttgaggtttcctttttcggcggtaataagcaaaagatactgatacttgtagaggatgtagaagcggagtttatcaacgaaaaagacaaagagtttttagggaaagtgttgggagcaataaagcttacttataacgacgtggctttggtcaacacatttaaaaaccaatccgtaagtttcggggattatctggataagattgatttttcaaaagcaataatattcgggaaagagccaaccgggctcacagagtcggggattttaaaatataagatctctacagtagaggcgatagagattttgcacgctgatattctatctgagattcaggacgataaaaacaaaaagattaagctctgggaggagcttaaaagaatgtttgcttga

SEQ ID NO: 3790 - protein, 162 aa, Unknown
  Obtained from environmental sample
  misc_feature (1)..(162): Xaa is any amino acid
MNRSFFQSLYPEGIFVIPESNSNGSTVETVKEKQFEVSFFGGNKQKILILVEDVEAEFINEKDKEFLGKVLGAIKLTYNDVALVNTFKNQSVSFGDYLDKIDFSKAIIFGKEPTGLTESGILKYKISTVEAIEILHADILSEIQDDKNKKIKLWEELKRMFA

SEQ ID NO: 3791 - DNA, 489 bp, Unknown; identical to SEQ ID NO: 3789
  Obtained from environmental sample
  misc_feature (1)..(489): n is a, c, g, or t

SEQ ID NO: 3792 - protein, 162 aa, Unknown; identical to SEQ ID NO: 3790
  Obtained from environmental sample
  misc_feature (1)..(162): Xaa is any amino acid

SEQ ID NO: 3793 - DNA, 417 bp, Unknown
  Obtained from environmental sample
  misc_feature (1)..(417): n is a, c, g, or t
atggaaaaatttctgatcgcaggtctgggaaacattggcgaagaataccaggatacccgacacaacattgggttcaatgttgccgatgcagttgctaaatctttgcggaaagaagatgacaaaactcctgtatcccggttatttacttccgaccgttatgccaatgttcaccaggcacgattcaaaggaaacaagcttaccatcatcaaacctacgacgtatatgaacctgagcggtaaagcagtgaacttctggcttcaggaagaaaaaattccttttacaaatttattgatcattaccgatgaccttgcacttcctttcggcacactcaggcttaaaaagaagggaagtgacggaggacacaatggtctcacagatatcattgcaancctgaacaacagtganattgcaggctga

SEQ ID NO: 3794 - protein, 138 aa, Unknown
  Obtained from environmental sample
  DOMAIN (5)...(137): Peptidyl-tRNA hydrolase
  misc_feature (1)..(138): Xaa is any amino acid
MEKFLIAGLGNIGEEYQDTRHNIGFNVADAVAKSLRKEDDKTPVSRLFTSDRYANVHQARFKGNKLTIIKPTTYMNLSGKAVNFWLQEEKIPFTNLLIITDDLALPFGTLRLKKKGSDGGHNGLTDIIAXLNNSXIAG

SEQ ID NO: 3795 - DNA, 396 bp, Unknown
  Obtained from environmental sample
  misc_feature (1)..(396): n is a, c, g, or t
atgcgcaacttattcctcctgatctggaaatattacttctttatcctttttatcatttttgaagttacctgcgtttatcttttagtaaaaaataacagctatcataattcaggtttcataaattcttccaataaagtagccgctgaaatgctcagtactgtaaacagtgcacgtgaattcattaacttaaaatctgaaaatgaacatctggncagagaaaatgtcgagattatgagcatggtggcggaaaagctatattcaatcgattctgattcaggtttagtaaagattcatgttcaaaaggcttacattatttccagacaagtcttaatcatccgttaccgagaaatatttttactctgtaagggaaattctgataaacggaaagggtattaa

SEQ ID NO: 3796 - protein, 131 aa, Unknown
  Obtained from environmental sample
  misc_feature (1)..(131): Xaa is any amino acid
MRNLFLLIWKYYFFILFIIFEVTCVYLLVKNNSYHNSGFINSSNKVAAEMLSTVNSAREFINLKSENEHLXRENVEIMSMVAEKLYSIDSDSGLVKIHVQKAYIISRQVLIIRYREIFLLCKGNSDKRKGY

SEQ ID NO: 3797 - DNA, 924 bp, Unknown
  Obtained from environmental sample
  misc_feature (1)..(924): n is a, c, g, or t
ttgatngcatataaaatacaataccgttacggacaggtatttttcgttgtccttaataatcccgatggaagcaaggttgagcataggatggagtacctggacgaggaatactggcatgtgaccttaaaaacaggagaactgggtataaaggatgaattttcctacagttacctgttgaaagaagaaggaaaagaagcgataaatgatctttgcaggcacaggataatccaattaaaaaagattaaggcaggcgaaataaatgtatttgacgagtggcaggtaacttcattatatgagcaagtttttttaagcaagccttttgaacaggtatttgacaaaaagaaaaaaagtaaaaaagataaggctaagaaatacacccatatcttcaaggtatttgttcctcacatcccggacgataaagtgatttgtatcagtggttctgcagaagagatgaatgaatggtcggcagaagatcctgttttactgcacaagtccaaagctgcatggacagttcacctaaacctgcacaaagaacatttccccatcagctataagttcgggctatacgatctgaagactaaaacgcttattcatttcgaaaaaggggataaccgggtcattgaaaatgctgaagggaaagacaaagttgcagtgtttcatgtttttcctgctttacaacaattcaaatggcagggcgccgggttgaacatccctgtttcttcgctcaaaactgaacacagctggggagttggtgattttacagacctgaacctgctagtggattgggcaaaggacagcggtataaagatgatccagctactacccgtaaatgatacaacggaaacccatagcatcaaggattcttacccttatgcttctatctcggactttgccctgcaaccgatgttacttgaacgttcataa

SEQ ID NO: 3798 - protein, 307 aa, Unknown
  Obtained from environmental sample
  misc_feature (1)..(307): Xaa is any amino acid
MXAYKIQYRYGQVFFVVLNNPDGSKVEHRMEYLDEEYWHVTLKTGELGIKDEFSYSYLLKEEGKEAINDLCRHRIIQLKKIKAGEINVFDEWQVTSLYEQVFLSKPFEQVFDKKKKSKKDKAKKYTHIFKVFVPHIPDDKVICISGSAEEMNEWSAEDPVLLHKSKAAWTVHLNLHKEHFPISYKFGLYDLKTKTLIHFEKGDNRVIENAEGKDKVAVFHVFPALQQFKWQGAGLNIPVSSLKTEHSWGVGDFTDLNLLVDWAKDSGIKMIQLLPVNDTTETHSIKDSYPYASISDFALQPMLLERS

SEQ ID NO: 3799 - DNA, 696 bp, Unknown
  Obtained from environmental sample
  misc_feature (1)..(696): n is a, c, g, or t
ttgcaggtatttactaaatggtatgaaattggagattgcgaattatgcttcaagtctaaaatagagcctcccctagtggaaaccgataaagcttccgtaacacctttattaatttttggcgacccagtaaaatatccagttgagttgaataaagattcggagtatttatttaaatatgactattatcactatggtcattttagaattgacaagaaagataatcttcattttattgagccgaccatttttttgcaaaagcatgaaagggaaatacagaattggttgaaaaaaaagaaagcggatcttggcccttatattacagaacgtaaagtatgcattatttcgcctgatgggaagtataattcaaaattcgtgcattatgttaatgagtatctattcagaaatacagctaatgtcattctatacaatgcggaaagcgattacatttcaaattttaaggaattctatggagatattctgaaaaatgcatccttagttgtatatgttgatgatcaaatttccacagcaaggacattctactctattgatcaatacattaaatcttgcggcaatgaaaaaagaacagatttaattatatgcatgctcagtcgaatcacgtcggttgtatatgatgaaattgagtctaccattgggaaaattagaaataggcgacaaaagtgctcctgctttctatag

SEQ ID NO: 3800 - protein, 231 aa, Unknown
  Obtained from environmental sample
  misc_feature (1)..(231): Xaa is any amino acid
MQVFTKWYEIGDCELCFKSKIEPPLVETDKASVTPLLIFGDPVKYPVELNKDSEYLFKYDYYHYGHFRIDKKDNLHFIEPTIFLQKHEREIQNWLKKKKADLGPYITERKVCIISPDGKYNSKFVHYVNEYLFRNTANVILYNAESDYISNFKEFYGDILKNASLVVYVDDQISTARTFYSIDQYIKSCGNEKRTDLIICMLSRITSVVYDEIESTIGKIRNRRQKCSCFL

SEQ ID NO: 3801 - DNA, 393 bp, Unknown
  Obtained from environmental sample
  misc_feature (1)..(393): n is a, c, g, or t
atgaaggatggatcttcatactttatcattgttattgcatttattattcttgcagctctagtaactgtaagctgtacaacaaatttttctaaatccaaaaacaagaatagcgccatcatcacagatagcaacaacaaaaattatccttcgaaaataatgttgaataatagacagtggatgacggcaaatcttaatgtcaatatacccgggtcttattgttatgatgatgcagaaacaactgtgacaagtatggccgtttatatacgtgggagacagcaaaaaaagggtgtgaaatacttggtgaaggatggagaaacctacagaagaaaatggcaacattcttggatccctagtgtcgactgcagcgcgcaactcagttttgttcctttatga

SEQ ID NO: 3802 - protein, 130 aa, Unknown
  Obtained from environmental sample
  misc_feature (1)..(130): Xaa is any amino acid
MKDGSSYFIIVIAFIILAALVTVSCTTNFSKSKNKNSAIITDSNNKNYPSKIMLNNRQWMTANLNVNIPGSYCYDDAETTVTSMAVYIRGRQQKKGVKYLVKDGETYRRKWQHSWIPSVDCSAQLSFVPL

SEQ ID NO: 3803 - DNA, 429 bp, Unknown
  Obtained from environmental sample
  misc_feature (1)..(429): n is a, c, g, or t
atgacaaccctgaattttaatataaaagaagctatagaagcagtaaaagcagatgcttacctcatgacaggtaatattcataattctgatatttactatgtaacgcattttcttgcttctgatgaatttacatatattcagacaaaaaaaggaaacgaaatacttttcatttcccagatggaaaaaggaagagctgaaatcgagtctagagtttctaatatcaaaaccacccaggatcttggatacagaaagaaaattaaggaaaaaaaaaatgtgtctcttgcctatgctgcctgtatatccgaattattgctagaggacggggcaaaaagaatttcagttccttatgattttccaatattttattcagaatttcttaaaaattcaggtttctccaatatacctataacaagtcctttcaaggaatga

SEQ ID NO: 3804 - protein, 142 aa, Unknown
  Obtained from environmental sample
  misc_feature (1)..(142): Xaa is any amino acid
MTTLNFNIKEAIEAVKADAYLMTGNIHNSDIYYVTHFLASDEFTYIQTKKGNEILFISQMEKGRAEIESRVSNIKTTQDLGYRKKIKEKKNVSLAYAACISELLLEDGAKRISVPYDFPIFYSEFLKNSGFSNIPITSPFKE

SEQ ID NO: 3805 - DNA, 783 bp, Unknown
  Obtained from environmental sample
  misc_feature (1)..(783): n is a, c, g, or t
ttgatacgtatctcaccaggtccgaaacagaatctgtcaatactttatatagacctgcttcggacacgcataagggagcagtcatatttaaatgaaaaaattaccaatacctctcccggcctcatttacctgtttgatattgccacgtttacgttcacatttatcaatgatgcaggtgtagaattctttggcctttccttttcagaactcaaaagccttggaaacaaagccatggaatatttaattcatcccgaggatcttccaaaaactattgccttgcttaaagaggttgctttgtcggaagaagatgatacatggggctacgagttccgtttgaaaaattataaagatgagtatttgtggatgaataatactatcagcatatttaaacgtgatgcggataatataccagtggagattattggcaatatgatcaatatccagaaagaaaaagaaactacggaaaaattaaaacaaagagaaacagatttaggaaaaagcgaagcgttatataagcaggctcaatcgctcagtcatatcggtcattattcacttgaccttgatacaaaagaaatatacctgaccgacgagctgaaacgtatatacgagttggacatggaaagggatatttttcaatacaccgaggtaactaccatgcggcaccccgaagatgcggaaatggtagctgcaaccatgcaacgtagttttgaaaactatgaacctttcgattttgattttcgccttattacaaaaaaaggaaaccaaaaagtgtacatgctatag

SEQ ID NO: 3806 - protein, 260 aa, Unknown
  Obtained from environmental sample
  misc_feature (1)..(260): Xaa is any amino acid
MIRISPGPKQNLSILYIDLLRTRIREQSYLNEKITNTSPGLIYLFDIATFTFTFINDAGVEFFGLSFSELKSLGNKAMEYLIHPEDLPKTIALLKEVALSEEDDTWGYEFRLKNYKDEYLWMNNTISIFKRDADNIPVEIIGNMINIQKEKETTEKLKQRETDLGKSEALYKQAQSLSHIGHYSLDLDTKEIYLTDELKRIYELDMERDIFQYTEVTTMRHPEDAEMVAATMQRSFENYEPFDFDFRLITKKGNQKVYML

SEQ ID NO: 3807 - DNA, 795 bp, Unknown
  Obtained from environmental sample
  misc_feature (1)..(795): n is a, c, g, or t
gtgacaccggcgcatgacatcaacgacttcaggcttggacaaaaacacaagctgccggtgatcgatgcgttgaccgaagatggcaagatcagtgaagcggcaggcgcgtatgttggcatggatcgttttgcatgcaggaaactcatcatcaaggatcttgaatcacaaggcctgcttgagaaggtagaagagatcaacaacaaagtcggatatagcgaaagaactgatgcggtgatagaaccgaaattatcaatgcaatggttcgtgaaaatggagcagctcagcaagcctgccctggaagaggtattaaccagcgatgtgaaattaattcctgaaaagtatgtgaatacttacaaacactggatggagaatgtgcacgactggtgcatcagccgacagctctggtggggtcagagaattccggcatggtacgataaaaatggaaataccgttgttgcaaaatcatcgggagaagcattggaaaaattaaaagctattgatgagaatgtaaagatcgaagatataaaacaggatgaggatgttctggatacctggttttcatcgtggttatggccgcttacagtatttgatccggatgtgatcaaaaatggatggaagaacgcaaacaccgatctgaaatattattatccaaccaacgaccttgtaaccgctcctgagatttcgtntttctgggtggcgcggatgatcattgcaggaaaagagtacacgggactgaaacctttttcgaatgttacctcaccggtattgtgcgtgataaacaaggaaggacactga

SEQ ID NO: 3808 - protein, 264 aa, Unknown
  Obtained from environmental sample
  DOMAIN (1)...(263): tRNA synthetases class I (I, L, M and V)
  misc_feature (1)..(264): Xaa is any amino acid
MTPAHDINDFRLGQKHKLPVIDALTEDGKISEAAGAYVGMDRFACRKLIIKDLESQGLLEKVEEINNKVGYSERTDAVIEPKLSMQWFVKMEQLSKPALEEVLTSDVKLIPEKYVNTYKHWMENVHDWCISRQLWWGQRIPAWYDKNGNTVVAKSSGEALEKLKAIDENVKIEDIKQDEDVLDTWFSSWLWPLTVFDPDVIKNGWKNANTDLKYYYPTNDLVTAPEISXFWVARMIIAGKEYTGLKPFSNVTSPVLCVINKEGH

SEQ ID NO: 3809 - DNA, 375 bp, Unknown
  Obtained from environmental sample
  misc_feature (1)..(375): n is a, c, g, or t
ttgttgatacgctgcactcacaagtcatactttagaaactatccaggtcctcttataaaatattttaatgaagagattggagcagagaagatgtgcaaattaatacaaagtnttgaagataaacgtgctagcgcaaaagtaatgattggactttttgatggggaagagttccagacttttataggtgaagttcccggagaaattgccgagaaaaaaggtgaggataatagtgtagggtttggatttgacttttactttattcccaaaggatatacaatgtgcagatcagcgatgaatcaggaggattacgacaatacttctcccagaaaaaaagctcttgataaactagccgagttcctctctactaagaggtag

SEQ ID NO: 3810 - protein, 124 aa, Unknown
  Obtained from environmental sample
  DOMAIN (1)...(120): Ham1 family
  misc_feature (1)..(124): Xaa is any amino acid
MLIRCTHKSYFRNYPGPLIKYFNEEIGAEKMCKLIQSXEDKRASAKVMIGLFDGEEFQTFIGEVPGEIAEKKGEDNSVGFGFDFYFIPKGYTMCRSAMNQEDYDNTSPRKKALDKLAEFLSTKR

SEQ ID NO: 3811 - DNA, 579 bp, Unknown
  Obtained from environmental sample
  misc_feature (1)..(579): n is a, c, g, or t
gtgccctatttcctagtggagcgtctgggtttggataagcggccgggggtagtaacttttgatgataaaaaaattgccaaggacatgcgcaagtttttgagtggtgcagaaagagtggggattttaggtccagcaccggcagtgcatttcagccgttctcatgctgatttggttttcctggatgatgaattatggccgattttgcaggaaaaaagtaaggaggaaattaatcagatcaaagaaacttcttacattttggctgatttactggaggaaattaaatgggcgattactcctgaggagagaatggatttattggccgaacatttagataaagagatattacggaagggtgatgatgtggctttcccatcattagtagaaagccgacatggcaataaaaacatactctacttactgggattgaaggctaaaataaagcaaaaagatctcatctacatcaatattggcgcgcagaaaaatggtttttttgctgatgccggacgtacttattttgtgaataatccagttttggaaaaaaaatatcgcaaatttgacaagctttttttacctttgtga

SEQ ID NO: 3812 - protein, 192 aa, Unknown
  Obtained from environmental sample
  misc_feature (1)..(192): Xaa is any amino acid
MPYFLVERLGLDKRPGVVTFDDKKIAKDMRKFLSGAERVGILGPAPAVHFSRSHADLVFLDDELWPILQEKSKEEINQIKETSYILADLLEEIKWAITPEERMDLLAEHLDKEILRKGDDVAFPSLVESRHGNKNILYLLGLKAKIKQKDLIYINIGAQKNGFFADAGRTYFVNNPVLEKKYRKFDKLFLPL

SEQ ID NO: 3813 - DNA, 360 bp, Unknown
  Obtained from environmental sample
  misc_feature (1)..(360): n is a, c, g, or t
atgaaaagcagaagctatttatatggggttaaatctgaaatattagtaaggaattattttgaaagtaaagagtttaaatgcttgggaaatagggttaagaccccttttggagaattagatttaatagtaaagaaagaaaatttaatagtttttgcagaagtaaaagcaagaaaaaacctcaaacacttcgagattataactaataggcaaataatccgtaattcagaggctgctaatttttatttaagtaacaatcagatctttgataaatatgatactaggttcgacctgatagtagtaataggcaatattattagggaacatatagaaaatgcttgggagtatactccaacaacttga

SEQ ID NO: 3814 - protein, 119 aa, Unknown
  Obtained from environmental sample
  DOMAIN (11)...(101): Uncharacterised protein family UPF0102
  misc_feature (1)..(119): Xaa is any amino acid
MKSRSYLYGVKSEILVRNYFESKEFKCLGNRVKTPFGELDLIVKKENLIVFAEVKARKNLKHFEIITNRQIIRNSEAANFYLSNNQIFDKYDTRFDLIVVIGNIIREHIENAWEYTPTT

SEQ ID NO: 3815 - DNA, 300 bp, Unknown; identical to SEQ ID NO: 73
  Obtained from environmental sample
  misc_feature (1)..(300): n is a, c, g, or t

SEQ ID NO: 3816 - protein, 99 aa, Unknown; identical to SEQ ID NO: 74
  Obtained from environmental sample
  misc_feature (1)..(99): Xaa is any amino acid

SEQ ID NO: 3817 - DNA, 759 bp, Unknown
  Obtained from environmental sample
  misc_feature (1)..(759): n is a, c, g, or t
gtgaaacttttaacacaactaatcgggttgttaacggggcaacttatcaactattcaagtaacttgcttaaaaataatccgggagaaccaccaggtggccgggttggccacaaaaagatagtaactcaaatgaaacgattcagtgcagtattattaggaagcattatggccataacagctcttgctcagaaaaacaatacagaaaacacacttctctggaagataagcggaaacgggctttcaaagccttcttatctttttggtactatccatatgctttgcaaagacgatgcggtactcagcgatagccttaaaagtatcattaaaaacgtaaaggaagtttactttgaagtggacctggacaatatgtttgaaatgctggctgtgatgggcaagatgaaaatgagggatgacacaaccctgcaggacctgctaagtgtcgctgattatgagaaagtgaaaacctatttcgaaacaaaaggatccatgcttcctttttccatgctggaaacttataagcctatgctcgcagcttctacactgcaacaaggtggtttgccgtgcgaaacgactgccatgatggaacaggtgatcatgcaggaagcaaaacaatacaataaatcaattaaagggctggaaagtatgggctaccaggcttcggtactggatagcattccatataaactacaagctgagcaactggtgagttacattgataatgctattaaggggggtgaaggacgacaaagaattaaatga

SEQ ID NO: 3818 - protein, 252 aa, Unknown
  Obtained from environmental sample
  misc_feature (1)..(252): Xaa is any amino acid
MKLLTQLIGLLTGQLINYSSNLLKNNPGEPPGGRVGHKKIVTQMKRFSAVLLGSIMAITALAQKNNTENTLLWKISGNGLSKPSYLFGTIHMLCKDDAVLSDSLKSIIKNVKEVYFEVDLDNMFEMLAVMGKMKMRDDTTLQDLLSVADYEKVKTYFETKGSMLPFSMLETYKPMLAASTLQQGGLPCETTAMMEQVIMQEAKQYNKSIKGLESMGYQASVLDSIPYKLQAEQLVSYIDNAIKGGEGRQRIK

SEQ ID NO: 3819 - DNA, 498 bp, Unknown
  Obtained from environmental sample
  misc_feature (1)..(498): n is a, c, g, or t
ttgtcggacactagtggatcaagattcaagaagtcatactgtatcggcgctataaaagtctcagaaatggtcgaagaaggagaactaaatgttttagtgaagcctgttaaaaatcccgaattatccgcgtttattacggaacttacgggaatacggcagatagacctcaacaaaaaaggagtctcgctaaaggaagcatcagagcgtttcctaaagtttgttgaggattatccagctttttgttggggaattgatactgagatacttgaacaaaatcacgaattgcaagggagtgacctggtgctgcctcgcgagcaatttgcaaatctgaagcccttgatcgtcccgcttctacagaaaatagggatcgatgaaagcaagtactcaagcgggaccttgatccaagcttttggaggcacaggagcgcacgcgcatgatgctgttaacgatatgcggaatttactggaagctatgagagaattgcaaaaacatgagtaa

SEQ ID NO: 3820 - protein, 165 aa, Unknown
  Obtained from environmental sample
  misc_feature (1)..(165): Xaa is any amino acid
MSDTSGSRFKKSYCIGAIKVSEMVEEGELNVLVKPVKNPELSAFITELTGIRQIDLNKKGVSLKEASERFLKFVEDYPAFCWGIDTEILEQNHELQGSDLVLPREQFANLKPLIVPLLQKIGIDESKYSSGTLIQAFGGTGAHAHDAVNDMRNLLEAMRELQKHE

SEQ ID NO: 3821 - DNA, 420 bp, Unknown
  Obtained from environmental sample
  misc_feature (1)..(420): n is a, c, g, or t
atgtattgcatcccgtaccggttcttgtataagaagatcactatcatacttgcttttattttacttgcgcttgttgccgacaggcttatcttcacaacaagtgatacagaagtagatatccagcctgcaatactaagagctgcccccaattcagaacttaagatcaatgtatataaatcaaatattttcgggtttaaagtaccattaagcaaagtggaagttcggtttgtgatagaggaaggagctaatttagtctcgcttgtaaatgaggatataaacggagaggtaacggttcgttcaaagggttttgagggagaggcaactgttgcgatctattcgctcaagtcaggctttcagataaagaaagttctaataaagatactgccccgcgatctggcggtgtacggagagttcatgtaa

SEQ ID NO: 3822 - protein, 139 aa, Unknown
  Obtained from environmental sample
  misc_feature (1)..(139): Xaa is any amino acid
MYCIPYRFLYKKITIILAFILLALVADRLIFTTSDTEVDIQPAILRAAPNSELKINVYKSNIFGFKVPLSKVEVRFVIEEGANLVSLVNEDINGEVTVRSKGFEGEATVAIYSLKSGFQIKKVLIKILPRDLAVYGEFM

SEQ ID NO: 3823 - DNA, 591 bp, Unknown
  Obtained from environmental sample
  misc_feature (1)..(591): n is a, c, g, or t
atgcaactcatcttcgcgaccaacaaccgcaataaagtagaagagatacgtaagatcatccggtcatttgatgttatcaccatgggtgaagccggaattgcagaagacattcccgagccttttgatacgctggaggaaaatgcttttgccaaatcaattttcatttataagcggacaggtaaagcctgtttcagtgaagataccggcctggaagtttatgcattgaatggagagccgggcgtaagaagtgcgcgctatgcaggagaaccttccaacccgggtaagaatacagagttgctgttgaataaattaaatggtatcacagaaagaaaagcacgtttcagaacagtggtttctttgatctataataaagtggaataccagtttgatggaatttgtgaaggaaagataattacagaaaaaacaggcgacaaaggatttggttacgacccggtttttattccggatggaagtgaaaaaacatttgcagagatgccggtggaagaaaagaatgtttttagtcacaggaagaaagcagttcaaaagctgattgatttcataaactcactggatgccgcgactactcattga

SEQ ID NO: 3824 - protein, 196 aa, Unknown
  Obtained from environmental sample
  DOMAIN (3)...(187): Ham1 family
  misc_feature (1)..(196): Xaa is any amino acid
MQLIFATNNRNKVEEIRKIIRSFDVITMGEAGIAEDIPEPFDTLEENAFAKSIFIYKRTGKACFSEDTGLEVYALNGEPGVRSARYAGEPSNPGKNTELLLNKLNGITERKARFRTVVSLIYNKVEYQFDGICEGKIITEKTGDKGFGYDPVFIPDGSEKTFAEMPVEEKNVFSHRKKAVQKLIDFINSLDAATTH

SEQ ID NO: 3825 - DNA, 831 bp, Unknown
  Obtained from environmental sample
  misc_feature (1)..(831): n is a, c, g, or t
atgactgagatggattcacaagtttcactactgagacaagatggagtgaagatacctgttgcagactcggcagctccagttagtgaccaagaaggtaatatcacgggatgcgtggtgatattccgcgacatgactagggagcggaaaattgataaggctaagacagaatttgtgtcactagcttcacaccaactgaggactccgttgtcgacgataaattggtattcagaaattatcttatcggaggagattggtaagttaaatacgaaacagaaacagtactcaaatgaggtgtaccacgcaagtcagcggatggtggctttggttaactcactgctgaatgtatcccggttggaactgggaacattctcagtggatccgaggccaatgaatatcgcaaaaattgcagagaccactattaaagaacttcaaccacaaattacacagaaaaatttaacaattaaaaaaaagtatggcaagcagtctgaggtgattaacgtagatcccaagctgatgggaatgatcctgcaaaatttaatatctaacagtgtcaaatatacgaagtcgggtggattaattacagtgagtttggtaaaaaaagataataacttagtgatagtggttgaagataatggaattggaatacctaaaagtcaacaaaaagaaatatttggcaaactatttagagcagataatgcgaaggttatagatccggatgggtcaggactaaggttatatatagttaaggagattatcgcttatacgggtggggctggttgggttgaatcaccagaaggtaaaggaacgaagttttatgcagcataccgttga

SEQ ID NO: 3826 - protein, 276 aa, Unknown
  Obtained from environmental sample
  DOMAIN (5)...(47): PAC motif
  misc_feature (1)..(276): Xaa is any amino acid
MTEMDSQVSLLRQDGVKIPVADSAAPVSDQEGNITGCVVIFRDMTRERKIDKAKTEFVSLASHQLRTPLSTINWYSEIILSEEIGKLNTKQKQYSNEVYHASQRMVALVNSLLNVSRLELGTFSVDPRPMNIAKIAETTIKELQPQITQKNLTIKKKYGKQSEVINVDPKLMGMILQNLISNSVKYTKSGGLITVSLVKKDNNLVIVVEDNGIGIPKSQQKEIFGKLFRADNAKVIDPDGSGLRLYIVKEIIAYTGGAGWVESPEGKGTKFYAAYR

SEQ ID NO: 3827 - DNA, 744 bp, Unknown
  Obtained from environmental sample
  misc_feature (1)..(744): n is a, c, g, or t
atgactagggaccggaaaattgataaggctaagacagaatttgtgtcactagcttcacaccaactgaggactccgttgtcgacgataaattggtattcagaaattatcttatcggaggagattggtaagttaaatacgaaacagaaacagtactcaaatgaggtgtaccacgcaagtcagcggatggtggctttggttaactcactgctgaatgtatcccggttggaactgggaacattctcagtggatccgaggccaatgaatatcgcaaaaattgcagagaccactattaaagaacttcaaccacaaattacacagaaaaatttaacaattaaaaaaaagtatggcaagcagtctgaggtgattaacgtagatcccaagctgatgggaatgatcctgcaaaatttaatatctaacagtgtcaaatatacgaagtcgggtggattaattacagtgagtttggtaaaaaaagataataacttagtgatagtggttgaagataatggaattggaatacctaaaagtcaacaaaaagaaatatttggcaaactatttagagcagataatgcgaaggttatagatccggatgggtcaggactaggtttatatatagttaaggagattatcgcttatacgggtggggctgtgtggtttgaatcaacagaaggtaaaggaacgaagttttatgccagcataccgcttgaagggatgaagaagaaagaaagcgttaagcaattaatttaa

SEQ ID NO: 3828 - protein, 247 aa, Unknown
  Obtained from environmental sample
  DOMAIN (10)...(78): His Kinase A (phosphoacceptor) domain
  misc_feature (1)..(247): Xaa is any amino acid
MTRDRKIDKAKTEFVSLASHQLRTPLSTINWYSEIILSEEIGKLNTKQKQYSNEVYHASQRMVALVNSLLNVSRLELGTFSVDPRPMNIAKIAETTIKELQPQITQKNLTIKKKYGKQSEVINVDPKLMGMILQNLISNSVKYTKSGGLITVSLVKKDNNLVIVVEDNGIGIPKSQQKEIFGKLFRADNAKVIDPDGSGLGLYIVKEIIAYTGGAVWFESTEGKGTKFYASIPLEGMKKKESVKQLI

SEQ ID NO: 3829 - DNA, 939 bp, Unknown
  Obtained from environmental sample
  misc_feature (1)..(939): n is a, c, g, or t
atgctgttttcgggtgatggttatgggaattcactcttttctatggctttaatacaaaaatacgaacctcagcttttgaatagtttaaacaactctacggctaaagacttggctcaggttttaagagatttaaaaaacaaacatacaaagtcaatagagctantagagttcttcttctcgattgagaataatagaaaagttcgagataataatattccaatttcatttgctaaagaactttctcatgatactgatatgaaagtagtctttctatttttctatggaagtataatttatcatttagctaatctaatgaaagttgaaggtttggagccaccaagatttataaactttagtggaacaggatctaagattctaaatatcactgatccaagcccaggaattaagaaattgatagactttacaaaaatcattttcgaagatgtatattctattggcttaacagagccattggacattaagcaatttgatgagcccaaagaaattacgtgcaagggcggtttattgtgtcctaattatgctgatgttgatgaaattgaattgaaaataaaaactgttttattaggcgatagggagaaaactttaattccaaagcaatcgataagatattcggaggtggaaaaaccagagttattgcaatctgtcaccaccgaagtcagtggtttcattaataaattttttgggtggagtgataaatacaatttcaataataagtttggcataaacccatcaatgtttgataaatacaaggattggcttaaggaagacatgagacaatatttgttagcgggacttaaggaaaaaatagacgaggttcaagacaacgctaacatcaatattgaagaaacattattcttctatccgctgattggaggactgaataagcttgctcataacattcaactgaataataattaa

SEQ ID NO: 3830 - protein, 312 aa, Unknown
  Obtained from environmental sample
  misc_feature (1)..(312): Xaa is any amino acid
MLFSGDGYGNSLFSMALIQKYEPQLLNSLNNSTAKDLAQVLRDLKNKHTKSIELXEFFFSIENNRKVRDNNIPISFAKELSHDTDMKVVFLFFYGSIIYHLANLMKVEGLEPPRFINFSGTGSKILNITDPSPGIKKLIDFTKIIFEDVYSIGLTEPLDIKQFDEPKEITCKGGLLCPNYADVDEIELKIKTVLLGDREKTLIPKQSIRYSEVEKPELLQSVTTEVSGFINKFFGWSDKYNFNNKFGINPSMFDKYKDWLKEDMRQYLLAGLKEKIDEVQDNANINIEETLFFYPLIGGLNKLAHNIQLNNN

SEQ ID NO: 3831 - DNA, 579 bp, Unknown; identical to SEQ ID NO: 1507
  Obtained from environmental sample
  misc_feature (1)..(579): n is a, c, g, or t

SEQ ID NO: 3832 - protein, 192 aa, Unknown; identical to SEQ ID NO: 1508
  Obtained from environmental sample
  misc_feature (1)..(192): Xaa is any amino acid

SEQ ID NO: 3833 - DNA, 708 bp, Unknown
  Obtained from environmental sample
  misc_feature (1)..(708): n is a, c, g, or t
atgtgggtattagtaaagaaaatgactaaacgtcaacattgcgctgtgctactctctattgaaggaattgatgctagcggcaagaccactttagtggacactatcctcaaacattatgaagacaaaggattaaaagtggctatttttcgatttcccacccgagacacccccataggcaagttgattgaccaagtcttgcgtaaagaagtgaccttgccaagcgaaacgttgcaatttttgttcagcgccaatcgttccgaaatgcaagaacaaattcacaaaacgtgtcatactcatgaccttgttctcttcgaccgctacttggattcggccgtggcctacgctgttgctcaaaatatgtctggggattggattcgcacactcgacaaatcgtgtattgctccagatggttgcatttttttacacattaacccagagaatgcaacctttcgccagaaagaacgtcaaaaatcgagtgccaacaaggcggaattgtatgataagaccaaatttcaaacgttggttcacaaggcctattgcaaatgttatcctctcgacacaactgcgtcgcatgtacaaagttgggcaaccccaaaaatttatccacacttactcgtccaacacattaatgcagaggagagtaaaaactcggtctttttgaatgccattgagtttttggaaaagcttctcaaagaaaaacagtcttaa

SEQ ID NO: 3834 - protein, 235 aa, Unknown
  Obtained from environmental sample
  DOMAIN (20)...(200): Thymidylate kinase
  misc_feature (1)..(235): Xaa is any amino acid
MWVLVKKMTKRQHCAVLLSIEGIDASGKTTLVDTILKHYEDKGLKVAIFRFPTRDTPIGKLIDQVLRKEVTLPSETLQFLFSANRSEMQEQIHKTCHTHDLVLFDRYLDSAVAYAVAQNMSGDWIRTLDKSCIAPDGCIFLHINPENATFRQKERQKSSANKAELYDKTKFQTLVHKAYCKCYPLDTTASHVQSWATPKIYPHLLVQHINAEESKNSVFLNAIEFLEKLLKEKQS

SEQ ID NO: 3835 - DNA, 804 bp, Unknown
  Obtained from environmental sample
  misc_feature (1)..(804): n is a, c, g, or t
atgtctatttttgaatattctgactatcgtaagcttatcaaggacaaattcgcgcaaatgcccaagaaaggttttgggcaaatgagtcgcttagcagaggcacttggagtgcatacaacacttgttagtcaggtgttatcgggacataagcaattttctgaagaacagataattttggccgcacaatttttcggatttaatgaacttgaatcagaatatgcggttggcctagtcgaacattctcgcgccggaaataccgcgctaaaatccctcaagttaaaaaaacttgaaagtctgcgagctcaagcaatgcaactctcaaatagggtaaaaaaagatattgttctaaaaccagaggacatggcgctattttattcaagctggatgtattcgtctgttcgccaaatagtcactttaaagggcatacgtactcctcacgatatttcgaataaacttaatataccgattaaacatgtacatcaaattgtctcttttttagtggatagtgggctcatgataaatactgcaaagggacttacagttggtccgcggagcacacatatcgattccaattcgccttgggttaagaatcatcatttgaactggaggcaaaagtctatccagaatctcgaaggccataatgaacggaaccttttttatacttctccgctcactatttccaaagcggatttcttaaaagttcgggagatcttaattgagacgatcaatcgtataaacttaattgtagactcatcacccangcgaagtttctgtggatttaatattgattggtttgaagtataa

SEQ ID NO: 3836 - protein, 267 aa, Unknown
  Obtained from environmental sample
  misc_feature (1)..(267): Xaa is any amino acid
MSIFEYSDYRKLIKDKFAQMPKKGFGQMSRLAEALGVHTTLVSQVLSGHKQFSEEQIILAAQFFGFNELESEYAVGLVEHSRAGNTALKSLKLKKLESLRAQAMQLSNRVKKDIVLKPEDMALFYSSWMYSSVRQIVTLKGIRTPHDISNKLNIPIKHVHQIVSFLVDSGLMINTAKGLTVGPRSTHIDSNSPWVKNHHLNWRQKSIQNLEGHNERNLFYTSPLTISKADFLKVREILIETINRINLIVDSSPXRSFCGFNIDWFEV

SEQ ID NO: 3837 - DNA, 897 bp, Unknown
  Obtained from environmental sample
  misc_feature (1)..(897): n is a, c, g, or t
atgtcaaactcaggtagctataataagccagtactgtttccgggcaatgaatattctagaatgttatctgaaaagtatcactacaaggaatggatgatctcgcgatttctaaactacatacctgatgcagaagatcttttgaaatatgtcgacaccaaatccaatctacatacctatataagggctaatactctcaaaattgatccaaattcactaaaggttcgcttacttgaaaaaggatttaaactcaaaaataccattgtagatgaggtctttgaggtaatcaaccacgggtcagatcaatttactaaaaaggtaacttcaggagtctcgactggtgttagtagtagtagcagcatggactcgctaattagaaatccgtccgcacgtatttcgtcaaatcaaattaaagaggagcagtccaattctaaagaacgaaaattacctagcctaggctcaacatttgaatatttgaaaggatattattatattcaagatctgagttcgggagttgcggtcagtgaaatggatatttatccatcagacgattttcatgtcttggacatggctgccgcaccaggcggaaagactactcatatagcgcaaaaattaaacaaccttggtaaaatagttgcttgcgaatctaaccctaatagattgccatccttagtgtttaacctgtctcgaatgggagtaaagaatactcttgtccttaagataaagtctgaagatataatgcagttgggatttagatttgatagagtattgcttgatgctccttgcacatgtgaagggatcatattaaaagatgaaatcagaaagaggagtcgaaccatccgtgatttaaatatctgtagtaataaggcaaaaaaaaatgatcccttgctggggttttaa

SEQ ID NO: 3838 - protein, 298 aa, Unknown
  Obtained from environmental sample
  DOMAIN (91)...(298): NOL1/NOP2/sun family
  misc_feature (1)..(298): Xaa is any amino acid
MSNSGSYNKPVLFPGNEYSRMLSEKYHYKEWMISRFLNYIPDAEDLLKYVDTKSNLHTYIRANTLKIDPNSLKVRLLEKGFKLKNTIVDEVFEVINHGSDQFTKKVTSGVSTGVSSSSSMDSLIRNPSARISSNQIKEEQSNSKERKLPSLGSTFEYLKGYYYIQDLSSGVAVSEMDIYPSDDFHVLDMAAAPGGKTTHIAQKLNNLGKIVACESNPNRLPSLVFNLSRMGVKNTLVLKIKSEDIMQLGFRFDRVLLDAPCTCEGIILKDEIRKRSRTIRDLNICSNKAKKNDPLLGF

SEQ ID NO: 3839 - DNA, 912 bp, Unknown
  Obtained from environmental sample
  misc_feature (1)..(912): n is a, c, g, or t
atgatggatggcaaaccaacatttctttcaccgactgatctggccaacatgttgaagaacatgccagcctcatctatcgatcagatcgagatcatgaccaacccttcggccaagtatgatgcctcgggtaattccggcgtaattaatattaaaacaaaaaaaggaagggcagccggattcaacggctccgtaatgataggcgtgacgaccagttattttgaaaatgagaagggagtattttacgttatccctaaaagccagaatagtctcaattggaattatcggaaaaataagatcaatttttttggaaattataatcccaacatgttccggggtcggagcatgctcgagatctcacgcaacgtccttgaccaggataaaaatatcattgcccataacgatgttaaaaccaatttcaaatttggaaatgataaccataccctgaaacttggtctcgacctgtttgctgataagaaaaacactttcggaatagtggtaagtggttttagtttctccggacatccatccccgaaaacagtgaccacttcatctaaccagttttatcagcctaaaaaccatatggtatctaataccaggaaccatatccggttcaggaatttcacgtcaaatctcaattaccgtcaccagtttgattccgccggcagggagttgacggccgatttcgattatatcatttacgataatgtatcggatatgaacctggaaaccgaattctattcaggcaattgggttaagaacggggacaaccttttattaaagggacatcttccttctaatatcaatatttactctttncaatcggaatatacacacccattgaagaatggcggaaggtttgaagcangtataaaaagcagtatcgtgaaaaatgacaaccctggtggagtatga

SEQ ID NO: 3840 - protein, 303 aa, Unknown
  Obtained from environmental sample
  misc_feature (1)..(303): Xaa is any amino acid
MMDGKPTFLSPTDLANMLKNMPASSIDQIEIMTNPSAKYDASGNSGVINIKTKKGRAAGFNGSVMIGVTTSYFENEKGVFYVIPKSQNSLNWNYRKNKINFFGNYNPNMFRGRSMLEISRNVLDQDKNIIAHNDVKTNFKFGNDNHTLKLGLDLFADKKNTFGIVVSGFSFSGHPSPKTVTTSSNQFYQPKNHMVSNTRNHIRFRNFTSNLNYRHQFDSAGRELTADFDYIIYDNVSDMNLETEFYSGNWVKNGDNLLLKGHLPSNINIYSXQSEYTHPLKNGGRFEAXIKSSIVKNDNPGGV

SEQ ID NO: 3841 - DNA, 438 bp, Unknown
  Obtained from environmental sample
  misc_feature (1)..(438): n is a, c, g, or t
ttggccgagaccgcgccgaagtggaatctgaaattatgggacgctatcagggtatggaataaaatggaagaatttgagataaaatttttagaagtagatgtgccggaattggaaaagaaactattatccatcggggcagagaaagccggagagtttgattacactcgaactatttttttcatgaatgaagatcatgtaggaggaagggatggttggataagggtgcgtactgacggaaaagaaactacgctaacattcaagaaaagcattaaagaaaaaggtgaagatggatctatgaaaaatgtgggtatgaatgagatagaggtagtggtggatgattatgaaaaaacctgcgaactcatcagagctatgggtctcttagtgaacaagacagaaaaaaataaaagaataagatatcaaaaggggacgtcgccttga

SEQ ID NO: 3842 - protein, 145 aa, Unknown
  Obtained from environmental sample
  misc_feature (1)..(145): Xaa is any amino acid
MAETAPKWNLKLWDAIRVWNKMEEFEIKFLEVDVPELEKKLLSIGAEKAGEFDYTRTIFFMNEDHVGGRDGWIRVRTDGKETTLTFKKSIKEKGEDGSMKNVGMNEIEVVVDDYEKTCELIRAMGLLVNKTEKNKRIRYQKGTSP

SEQ ID NO: 3843 - DNA, 483 bp, Unknown
  Obtained from environmental sample
  misc_feature (1)..(483): n is a, c, g, or t
atgaaatcatttatttttttcttattttttgttttggctttttcagttgccaatgcgcaggcctacaaaattactttgcatgctcctcaatataacagcgggcttgcctaccttacttattattacggaaagaatatgaatgtgcaggattctgccattgtcaattcaaaaggagttgcagtttttgaaggaaaaacaaaaattcttcccggtgtttattcagttgttctgcctggcaaaaccaaattgctcgactttttaatagcaaacaaacaaataattactatttctattccggacacttccaatattataaaatccacgagtgtaaccggcgcagaagaaaatgacctctttcanacttatcaaaaattcgtgaccgaaaaaggaaatcgcttcaaaggaantagaagctttatcagcatcagcccacaaagaagacagcgcccttcattgaaaaaaattataagcattaaacgatga

SEQ ID NO: 3844 - protein, 160 aa, Unknown
  Obtained from environmental sample
  SIGNAL (1)...(19)
  misc_feature (1)..(160): Xaa is any amino acid
MKSFIFFLFFVLAFSVANAQAYKITLHAPQYNSGLAYLTYYYGKNMNVQDSAIVNSKGVAVFEGKTKILPGVYSVVLPGKTKLLDFLIANKQIITISIPDTSNIIKSTSVTGAEENDLFXTYQKFVTEKGNRFKGXRSFISISPQRRQRPSLKKIISIKR

SEQ ID NO: 3845 - DNA, 873 bp, Unknown
  Obtained from environmental sample
  misc_feature (1)..(873): n is a, c, g, or t
atggaacacaatccttacattgacaagcttcacttattgcaacaggactgggaagctatgatcacctcattgaaggaggaaaaatttgattacattattgatctgcaccataacctcaggacgttaagaataaaaaaagcactgaaacttcccgccttttctttcaataagctgaatgtagaaaaattcatttttgttaaattgaaatggaatgtaatgcccaggggtgttcatatcatcgacaggtatatggctacagtggccccatttggagtttataatgatggggaggggatggattatttcattcccgcaaatgaagagatacaattaaaagatattccggcgtctcaccaccttggctttatttctattgtgatcggggcttcattttatactaaaaaacttccggtttataaactgcaggagctttgccaaaagatcaatttcccaattattcttctgggagcaaaagaggaatttaaagaaggagaggagatcagtaaagtggatccggtaaagatctacaatgcatgtggtaaattcagtctgaatgaaagcgcagacatcgtcaggaaatcaaaactggtggtcgcccatgatacgggacttatgcatattgctgcagcatttaaaaaacaggtaattgccatctggggtagtacaacgccttcttttggaatggtgccttattatggagaaaaatacatgatgacgcatcccanaccatatgatgacatacaggtactaaaactatggtgcaggccctgtacccaaatgggaagaaataaatgccccgcaggacatttcaaatgcatgaaaaagattgacctggatgcagttgtggaaaggaatatgttgagagtaagataa

SEQ ID NO: 3846 - protein, 290 aa, Unknown
  Obtained from environmental sample
  DOMAIN (17)...(254): Glycosyltransferase family 9 (heptosyltransferase)
  misc_feature (1)..(290): Xaa is any amino acid
MEHNPYIDKLHLLQQDWEAMITSLKEEKFDYIIDLHHNLRTLRIKKALKLPAFSFNKLNVEKFIFVKLKWNVMPRGVHIIDRYMATVAPFGVYNDGEGMDYFIPANEEIQLKDIPASHHLGFISIVIGASFYTKKLPVYKLQELCQKINFPIILLGAKEEFKEGEEISKVDPVKIYNACGKFSLNESADIVRKSKLVVAHDTGLMHIAAAFKKQVIAIWGSTTPSFGMVPYYGEKYMMTHPXPYDDIQVLKLWCRPCTQMGRNKCPAGHFKCMKKIDLDAVVERNMLRVR

SEQ ID NO: 3847 - DNA, 336 bp, Unknown
  Obtained from environmental sample
  misc_feature (1)..(336): n is a, c, g, or t
atgagatttaatatggaatcattaaaagaaaaaacattaccacaattagtacttttaaataaaaaagaacaacacaaagtttatcaggtcacaggtactgctggaacctctatgcccgaacacattagtacaaaagaagctgttgtaattatccaggaaggcgaggttgtcctcaacatccaaaatcaaaattataatttaaagaaaaacgatgtgttcataattcctgctgaggtcaagcattttttaagtataggaaaggattttaaggcggtagttataatggacattgattctcaaattgaaatttataaactaataaggagactaaaatga

SEQ ID NO: 3848 - protein, 111 aa, Unknown
  Obtained from environmental sample
  misc_feature (1)..(111): Xaa is any amino acid
MRFNMESLKEKTLPQLVLLNKKEQHKVYQVTGTAGTSMPEHISTKEAVVIIQEGEVVLNIQNQNYNLKKNDVFIIPAEVKHFLSIGKDFKAVVIMDIDSQIEIYKLIRRLK

SEQ ID NO: 3849 - DNA, 588 bp, Unknown
  Obtained from environmental sample
  misc_feature (1)..(588): n is a, c, g, or t
atgaaatacaaagttttgaaaatctggttaccagttttcgctgcatttattatcactggttgcggcgtacagtcgtatgttgaaaaagacccctcagtcaatcttaacagctataagacatatgcctggatcggcgaaaaaaacagcagtagaaaaaatgacaaaccttataaggatttccaggaaagttatttaacagacctgatttcccggcaacttgaaaagaacggatttgttaaagcaaaatcaaaccctgatgtacttgtcgattacgacatcatgattgaaaatgaagtgagagaaagatcaaacccggtgtattcaaggtcgtttgtccgttatttctataacccttacacaggacgtattaatacgctctactatccttcccgctatatgggacaggatgcttacgacgtgccttacaaatcaggaacagtcactatcaacatcgttgacaatgaatccaggaaactggtttggcagggatgggctgaaactgaggttaccaaaaaacgtattgataaggacgacatgaacaaaattgtaaaatcaattttcagaaagttggatctggcaaaaaactga

SEQ ID NO: 3850 - protein, 195 aa, Unknown
  Obtained from environmental sample
  misc_feature (1)..(195): Xaa is any amino acid
MKYKVLKIWLPVFAAFIITGCGVQSYVEKDPSVNLNSYKTYAWIGEKNSSRKNDKPYKDFQESYLTDLISRQLEKNGFVKAKSNPDVLVDYDIMIENEVRERSNPVYSRSFVRYFYNPYTGRINTLYYPSRYMGQDAYDVPYKSGTVTINIVDNESRKLVWQGWAETEVTKKRIDKDDMNKIVKSIFRKLDLAKN

SEQ ID NO: 3851 - DNA, 930 bp, Unknown
  Obtained from environmental sample
  misc_feature (1)..(930): n is a, c, g, or t
gtgttaacgaacttggcttttgaacaagctaatatagacagtgtaggaaatattattgccaccaaaggtgaagggtatccaagaatattactttgtggtcatatggatacagttccaaataaagttccagtaaggatagagaatggcttcatgtatggtagaggtgcatcagatgctaaagctccattaatatccatgcttttagcagcctctgaattccctaaacaaaatggtactataatatttgctggtgtagtcgatgaggaaggaaatgcaacaggtagtaagcatcttgtaaaaaataatttggaaatagattatgccatatttggtgaacccagtggtatagaaaatattacagtttcctataagggaagattagctcttaaattaatatgtgatgttttagacagtgcacatgcaagtgctccatggttagcaaaaaactctattgaagaaatctataatttttggaatgagattaaaaatgctttaaataagaattatgagaaagaaaaaagaagtaactctgtcagttgttgtcttacagaaattttaggtggatccagtcacaatgtcactcctcaaaaatgtaaaataacaatggatattagaatcccaaatgggactacttgccaacaagtttttgattctataaaaagtctcattgcaaaaacttcaaaagaaaatgggataaaaacaaattttataattgaagattttactgagccattcgaaactgatttttcctctccattagtgaggtctcttgttctctcaattcttgacatttgtaaaaaaagacttgcattattaagaaaaacangaacaggtgatatgaatattatttggaaatgccttttaaaatttcccagtaagttacctaacggcccctgggagattccacatttctttctccaaaatggttaa

SEQ ID NO: 3852 - protein, 309 aa, Unknown
  Obtained from environmental sample
  DOMAIN (121)...(231): Peptidase dimerisation domain
  misc_feature (1)..(309): Xaa is any amino acid
MLTNLAFEQANIDSVGNIIATKGEGYPRILLCGHMDTVPNKVPVRIENGFMYGRGASDAKAPLISMLLAASEFPKQNGTIIFAGVVDEEGNATGSKHLVKNNLEIDYAIFGEPSGIENITVSYKGRLALKLICDVLDSAHASAPWLAKNSIEEIYNFWNEIKNALNKNYEKEKRSNSVSCCLTEILGGSSHNVTPQKCKITMDIRIPNGTTCQQVFDSIKSLIAKTSKENGIKTNFIIEDFTEPFETDFSSPLVRSLVLSILDICKKRLALLRKTXTGDMNIIWKCLLKFPSKLPNGPWEIPHFFLQNG

SEQ ID NO: 3853 - DNA, 309 bp, Unknown; identical to SEQ ID NO: 909
  Obtained from environmental sample
  misc_feature (1)..(309): n is a, c, g, or t

SEQ ID NO: 3854 - protein, 102 aa, Unknown; identical to SEQ ID NO: 910
  Obtained from environmental sample
  misc_feature (1)..(102): Xaa is any amino acid

SEQ ID NO: 3855 - DNA, 984 bp, Unknown
  Obtained from environmental sample
  misc_feature (1)..(984): n is a, c, g, or t
atgaacaaaactatcaaaacatcgatttttcttttcctgtttttgttctcatcaaacattttttcacagatctattcaccaaaagatattgttaatatctacgatccgttcacaataactttcggagaacttatactgaacacaaatgatgatgaattcaaagaacataattttgtaataataattacaattactatcggacccgagaagatcatcaaatttttatataaagatgacctgctgataaataatgttaaaagctataatgatgaatactgggcaattaactttacagcaaggaagaacaacgttgttctgataccggcaatttataatatcgccaacaacggcggtatggtaaatattaagatggaaggctattcaaatatttccacaggcgatgaatcaatgatgagccagcttagtacaagttatgtttataccagctcaacaatgtacggctcaatggagcaggcatataaatatttagcaacaacacctgaggtcaataaaccgaattcaagcctgttaacaaccgctgaagttttgcagagaaatgtttcaaccaggccgggaatattttaccttggtaacccgacagatgtaagttacgcgatacctgaggacccgaaaaaagttataggaactaacttgcttatacagggtcagaaaaaagttgaatcaaaactttcgaacaaagcagcagatgtatggaacctgctaataactaaatatacagatgtaaaacttgttcagggtgaagcatactttaacaagataaaaggtgctttcagtgatattataaacatgcctaaaatagatgaaagtaaacgcgaaggtttattggcacgctgtaacgagattatcaacgaagatcttgttatgggacgcaaagccggaagttacatgaataacgagggtaataaaacagttcactttatcttatggaactttgttaaagccgggcatcagggcaaaatctga

SEQ ID NO: 3856 - protein, 327 aa, Unknown
  Obtained from environmental sample
  misc_feature (1)..(327): Xaa is any amino acid
MNKTIKTSIFLFLFLFSSNIFSQIYSPKDIVNIYDPFTITFGELILNTNDDEFKEHNFVIIITITIGPEKIIKFLYKDDLLINNVKSYNDEYWAINFTARKNNVVLIPAIYNIANNGGMVNIKMEGYSNISTGDESMMSQLSTSYVYTSSTMYGSMEQAYKYLATTPEVNKPNSSLLTTAEVLQRNVSTRPGIFYLGNPTDVSYAIPEDPKKVIGTNLLIQGQKKVESKLSNKAADVWNLLITKYTDVKLVQGEAYFNKIKGAFSDIINMPKIDESKREGLLARCNEIINEDLVMGRKAGSYMNNEGNKTVHFILWNFVKAGHQGKI

SEQ ID NO: 3857 - DNA, 369 bp, Unknown
  Obtained from environmental sample
  misc_feature (1)..(369): n is a, c, g, or t
atgctaaaattagatgaaagtaaacgcgaaggtttattggcacgctgtaacgagattatcaacgaagatcttgttatgggacgcaaagccggagtttacatgaataacgaggtaataaaacagttcacttatcttatgaactttgttaaagccggcatcagggcaaaatctgataccgcttcaacaactgaagagttcatgaaatcagatgaacgtgaagcattgaactatttcgaaacgaacctgaaggataatgattttaacctgaataaccagtacctgttcgatgattacattaattcatcagtcaacaggggcgctattcagaaagaaattgatatcataagaagatattaccagcttaaataa

SEQ ID NO: 3858 - protein, 122 aa, Unknown
  Obtained from environmental sample
  misc_feature (1)..(122): Xaa is any amino acid
MLKLDESKREGLLARCNEIINEDLVMGRKAGVYMNNEVIKQFTYLMNFVKAGIRAKSDTASTTEEFMKSDEREALNYFETNLKDNDFNLNNQYLFDDYINSSVNRGAIQKEIDIIRRYYQLK

SEQ ID NO: 3859 - DNA, 927 bp, Unknown
  Obtained from environmental sample
  misc_feature (1)..(927): n is a, c, g, or t
gtgaatgggctgatcgattcgttgcgactccttgcgtgggatactgcccaggctaacatgctcggcaagatgaaagatattttgaaagagcgcaacgaactgttcttttcctatctgaaagtaaaagccaatattcttgagaataaagatttcgctattcaactggatacactatccgctattttacaaaatcaggatctggcaatcgacagcagtattataaaaatgcatcgcaagacgatcactacctacttgccagataccagcgcgaacgtaaaacaagaacagcaatcatttcttcgaaaattattcagcagcaaaaagaaagaaaaaccgaaagcagacacagcaagaattaaagtcgatcaggaattcaattttgaagtagatacactcgccgttgctcgtcagaatgaagctttgcttgcagtagaaaaaatgatgcgcgaaatggataaggaccagcgacgtcagcgcaaaaaaatgcaggatcaggaactcgagcttattcatgcaaacagtctttttattaatcagcttctgaatattcttcacgatgttgaaaacgaagaattgaaacgcatgagcagcaataacgaacatgcagttactgtaatgaatcaaagcatcagccggtatagaattctcacgataacgtttatactgatgggatctgtgctggtatattttattgcgatggacgtgagcaagagcaatttttacaaagagcagctcgagaaggcgaagaataaggcggaggaacttagtcagatcaagcagcggtttcttgctaacatgagccatgagatcagaacaccacttcagtctatcatcggatttgctgaacagctcanacataaatcaatcaccgggaagaagctgttgatgcgatccactcttcttcagaacatttgctgcacattgtga

SEQ ID NO: 3860 - protein, 308 aa, Unknown
  Obtained from environmental sample
  misc_feature (1)..(308): Xaa is any amino acid
MNGLIDSLRLLAWDTAQANMLGKMKDILKERNELFFSYLKVKANILENKDFAIQLDTLSAILQNQDLAIDSSIIKMHRKTITTYLPDTSANVKQEQQSFLRKLFSSKKKEKPKADTARIKVDQEFNFEVDTLAVARQNEALLAVEKMMREMDKDQRRQRKKMQDQELELIHANSLFINQLLNILHDVENEELKRMSSNNEHAVTVMNQSISRYRILTITFILMGSVLVYFIAMDVSKSNFYKEQLEKAKNKAEELSQIKQRFLANMSHEIRTPLQSIIGFAEQLXHKSITGKKLLMRSTLLQNICCTL

SEQ ID NO: 3861 - DNA, 447 bp, Unknown
  Obtained from environmental sample
  misc_feature (1)..(447): n is a, c, g, or t
atggaactcactgctctcagcgctatttctgctatagatggccgttaccgtaaacaggtgcagcacctcgacgaatatttttccgaatacgctttgatgaaatacagggtattggttgaaatcgaatacctgttattcctggaaaaaaagaaattcttcaagctatccaataaaacgataaagcacctccataaactggttacggaattcggcctggaagatgcgcaggaaatcaaacaaatcgaatataccaccaaccacgatgtaaaggcagtggaatatttcctgaaaaatgaacttgaaaaatccggcggcaaatctgcccgtgaatgggtccatttcggactaacctcccaggatatcaataatacggccattccccttttctggaaacatgcgatcgaatacgaatacctgcccgggctgcgaacctcaaacccaatctga

SEQ ID NO: 3862 - protein, 148 aa, Unknown
  Obtained from environmental sample
  misc_feature (1)..(148): Xaa is any amino acid
MELTALSAISAIDGRYRKQVQHLDEYFSEYALMKYRVLVEIEYLLFLEKKKFFKLSNKTIKHLHKLVTEFGLEDAQEIKQIEYTTNHDVKAVEYFLKNELEKSGGKSAREWVHFGLTSQDINNTAIPLFWKHAIEYEYLPGLRTSNPI

SEQ ID NO: 3863 - DNA, 726 bp, Unknown
  Obtained from environmental sample
  misc_feature (1)..(726): n is a, c, g, or t
atgatcagcagaagaaatatccgggtaaaagtgatgcagacgctgtacaacataactacccttgaatctgatattaaaccaggagaaccccaaaagatcctccaaaaccattttgaccagacccgccagctttttgttcatcttaccttttttctaacagaagtgtcccggtatgctgaaaccgattctcatcaacgcgcaggcaaacatcttcccacttacgaagaccttcatgtaaataccaaattagccggcaacaagatactgtggaagataatggaggaggcgtcttttaaagaagccctggcaaaactgaagccacaacaaaccatcaataaggacatggtccggagagtttacctgaaacttgctgaaactccagaatacaggagttatatcaataaccaggcgagagaaagtaaagacgagaaggaaattcttgagtttatcctggacaagctgatgctggccgacgagatttttatctcctacattgaagaaacttttaccaactgggaagatgatggtgaaatggtgatacagttgttggtaaatcttttgcaaaagccgggtagcggcgatttcaaagagatgatcagcggggagaaaaaagattttgcggccaaccttttaaaaactgtaatcgataaaagcgaatatttacagtccctgatcgtttccaaacttaagaactgggatcctgaagaaatgcactgctcgacatga

SEQ ID NO: 3864 - protein, 241 aa, Unknown
  Obtained from environmental sample
  misc_feature (1)..(241): Xaa is any amino acid
MISRRNIRVKVMQTLYNITTLESDIKPGEPQKILQNHFDQTRQLFVHLTFFLTEVSRYAETDSHQRAGKHLPTYEDLHVNTKLAGNKILWKIMEEASFKEALAKLKPQQTINKDMVRRVYLKLAETPEYRSYINNQARESKDEKEILEFILDKLMLADEIFISYIEETFTNWEDDGEMVIQLLVNLLQKPGSGDFKEMISGEKKDFAANLLKTVIDKSEYLQSLIVSKLKNWDPEEMHCST

SEQ ID NO: 3865 - DNA, 321 bp, Unknown
  Obtained from environmental sample
  misc_feature (1)..(321): n is a, c, g, or t
gtgatttttttcgcggcggtgaatgaaagtggattncctgccctgtcagcctcaattctttttaagaaagatcttatcgctccgaaaaacttcattgatatattttgttatgaacatttttcactgtttaaaaatgccagcccattatcgcgatcagggtcacaaataataaatttcagcatgctgatggaaagcaggtatttccattccaggtttagtaactggtctatacgcagccgggggaaggtccacctgaaccacatgatcacgaaaatgagaaaaaatgttttcccgaagaaccaaaccgaggaagggatatag

SEQ ID NO: 3866 - protein, 106 aa, Unknown
  Obtained from environmental sample
  misc_feature (1)..(106): Xaa is any amino acid
MIFFAAVNESGXPALSASILFKKDLIAPKNFIDIFCYEHFSLFKNASPLSRSGSQIINFSMLMESRYFHSRFSNWSIRSRGKVHLNHMITKMRKNVFPKNQTEEGI

SEQ ID NO: 3867 - DNA, 882 bp, Unknown
  Obtained from environmental sample
  misc_feature (1)..(882): n is a, c, g, or t
ttgacggataagccgaagatcaacttcgtggtgccgtctgacccggtcgagggagagattccgacggatatggagaatgaagcctggcagaaggcctccaaacgttatgtggccatgggtggacagatcacgcacaagccacgcaatttcgtgaaccggatcgacgacatctgggttcgttcgctgtacaacgacaaatttatcgtttatctcctggagtgggatgaccgcaccaagagcgtcgccgagggcaagctgccctgggctccgacgcaagtgaatctggacatcaaggagcaggctccgaagaccggcgaggaagggtctatcgcgtcgaatcaaaataactacaaggtgtacaacgacgctatcgccatcgaaactcctgtgaaatggaaggaattgcccgctccgatcaagccgcggtatctgttcgggaccaacgagcagttcccggtcgacatcgtgaagtgggaagctgacggatccatccgggcgttcaaggggacgggatgggataaagattttgaagaacgtgacacctatgaagagaacctgaagatcctcaagggcgaatggaagaatggccgttggtatgtgatgattcaacgtccgctcggtaacaagaaagatcaggattacgacgaagatacctttttcgaagtcggacaatatgtgccgaccgtgttcttcgcctgggacgggcacaacggtgatgcaggacggaagatggccgtatcggccttctactacacgttcctgaatcccccaatcccgaaggagacctacatctatccggcgatcattgcccttcgggtggtattgctggagggatgggtgatgacccggcgcgcgaataagaagagggggaagacgctgtaa

SEQ ID NO: 3868 - protein, 293 aa, Unknown
  Obtained from environmental sample
  misc_feature (1)..(293): Xaa is any amino acid
MTDKPKINFVVPSDPVEGEIPTDMENEAWQKASKRYVAMGGQITHKPRNFVNRIDDIWVRSLYNDKFIVYLLEWDDRTKSVAEGKLPWAPTQVNLDIKEQAPKTGEEGSIASNQNNYKVYNDAIAIETPVKWKELPAPIKPRYLFGTNEQFPVDIVKWEADGSIRAFKGTGWDKDFEERDTYEENLKILKGEWKNGRWYVMIQRPLGNKKDQDYDEDTFFEVGQYVPTVFFAWDGHNGDAGRKMAVSAFYYTFLNPPIPKETYIYPAIIALRVVLLEGWVMTRRANKKRGKTL

SEQ ID NO: 3869 - DNA, 351 bp, Unknown
  Obtained from environmental sample
  misc_feature (1)..(351): n is a, c, g, or t
gtgttaaatttgttgcccaaaattgtttttaagcggattcccccgaacttgaaattttgtgggggagaaatttgccggcagagttttgaagaacggctttgcaaagcagcctattgggaaagtctttgcaaagatatgatgaaaacggaatggttaanctctgatgtgataaccggcctcttaaacggcattattatatttgcagcgcgcaacctcttcttggtatggcgagatgctccgaacagtgtcagcgaaacagatataatactaggcttcaatggtaaagtcagagaagcatttacagcgcataaaaaacagcaggacgaatcaaataggaaaaaatataattaa

SEQ ID NO: 3870 - protein, 116 aa, Unknown
  Obtained from environmental sample
  misc_feature (1)..(116): Xaa is any amino acid
MLNLLPKIVFKRIPPNLKFCGGEICRQSFEERLCKAAYWESLCKDMMKTEWLXSDVITGLLNGIIIFAARNLFLVWRDAPNSVSETDIILGFNGKVREAFTAHKKQQDESNRKKYN

SEQ ID NO: 3871 - DNA, 939 bp, Unknown
  Obtained from environmental sample
  misc_feature (1)..(939): n is a, c, g, or t
atgaataaaagtgttctggtagttggtgccgggctcggtggaatggcccttgccctcaggctggcgaaaaaaggttgcagggtcagaatcattgaaaagaatggtcaggccggcggtcgtatgaaccagttgaaagctgatggattcaccttcgatacgggcccgagctttttcagcatgtcatacgagtttacccggtttgccgacgactgtaatattaagctgccattcagctactattcacttgatccactttatactgtaagtttcaggcacaatccgaaaacatactttctctataaggacataaagaagctggcggagcagttcagtgaatcagatccggatttcgaacagaaaatggagagatatcttgcaaaagggaaaaggcttttcgaagacacaatggatgtggtgatcaggaataatcatgatactctgcttcaatacattttccacctgatgaaggtgaacccggttcattttccgataatattccgcaatttctggcaacaggttgcccattatttcagctcggaagaagcgaggcagatcatttcactggtctcattctttcttgggcgcacaccattcgatacttcttcagtgtacaccctcctttcatataccgaattcaggcatgacggatattttaatgtgaaaggaggaatgtacaaggtgatcgaagggatgctgagtgaactggaaaaggagaatgttgaactaatttacaatactgaaatagttgattttgcctcggctggaaaagaatctgagtactttattgacagtaatggaaagaaatggggaagccgatttatttgtaatcaatgcggatgcagcaatattcaggggacggatatttcagagaaaaaaatttctccaagaaaaatctcgacaggatggaatggaaaaatgggtcccctggaccatgttatt

SEQ ID NO: 3872 - protein, 313 aa, Unknown
  Obtained from environmental sample
  SIGNAL (1)...(18)
  misc_feature (1)..(313): Xaa is any amino acid
MNKSVLVVGAGLGGMALALRLAKKGCRVRIIEKNGQAGGRMNQLKADGFTFDTGPSFFSMSYEFTRFADDCNIKLPFSYYSLDPLYTVSFRHNPKTYFLYKDIKKLAEQFSESDPDFEQKMERYLAKGKRLFEDTMDVVIRNNHDTLLQYIFHLMKVNPVHFPIIFRNFWQQVAHYFSSEEARQIISLVSFFLGRTPFDTSSVYTLLSYTEFRHDGYFNVKGGMYKVIEGMLSELEKENVELIYNTEIVDFASAGKESEYFIDSNGKKWGSRFICNQCGCSNIQGTDISEKKISPRKISTGWNGKMGPLDHVI

SEQ ID NO: 3873 - DNA, 876 bp, Unknown
  Obtained from environmental sample
  misc_feature (1)..(876): n is a, c, g, or t
ttgttcaaggtccagtacagagtaatattaagccgctatcgtgaagggacgctttgtccggattgccacggttaccgtctgcgtaaagaagccttatacgtaaaaattcatggtaagaacattggagaattaagcgaaatgcccatcagggatttaaagcaatggttcaacaatgctgaaaaaaaatttgcggattatgaaaagcaggttgctaaaagaattttaatagaaattcatcaccgcattgacacgatgttgaatgttggtttagggtacctcacgttaaatcgtctggccaatactttaagtggaggcgaaagccagcgtatacaactaaccagaagtctgggaagcaatcttaccaattcactttatattttggatgaaccttccattggcctgcatccgagagatacctttaatctgatccgtgtgcttaaagagcttcgtgacttaggcaatactgttgtagtggtagaacacgatgaaatgatgatgcgtgaagccgatcatattattgatatgggcccgctggcttcgcatttgggtggtgaggtgattgccgaaggaaactatgatgcgatcatctccaaccccgaaagccttacaggaaaatatctgaaaggtcaactcactatcgagcccccaaaaaaattacgaaagtcaaaaaattcaatcacagttgaaggtgcacggcagcacaatctgaaagatattaccgttgaatttccattgaatgtcctttgcgtggtaaccggagtaagcggaagcggaaagacaaccctgatcaaacacattctttaccctgccttaaaaaaattgcagggcgaagctgcagataaagcaggattccatcgtgctagaaaggtgatatga

SEQ ID NO: 3874 - protein, 291 aa, Unknown
  Obtained from environmental sample
  DOMAIN (7)...(176): ABC transporter
  misc_feature (1)..(291): Xaa is any amino acid
MFKVQYRVILSRYREGTLCPDCHGYRLRKEALYVKIHGKNIGELSEMPIRDLKQWFNNAEKKFADYEKQVAKRILIEIHHRIDTMLNVGLGYLTLNRLANTLSGGESQRIQLTRSLGSNLTNSLYILDEPSIGLHPRDTFNLIRVLKELRDLGNTVVVVEHDEMMMREADHIIDMGPLASHLGGEVIAEGNYDAIISNPESLTGKYLKGQLTIEPPKKLRKSKNSITVEGARQHNLKDITVEFPLNVLCVVTGVSGSGKTTLIKHILYPALKKLQGEAADKAGFHRARKVI

SEQ ID NO: 3875 - DNA, 792 bp, Unknown
  Obtained from environmental sample
  misc_feature (1)..(792): n is a, c, g, or t
ttgtccctggcggagattactgctttgtctattatccccaaccgcccctcttccctggtaattggaaaaagcaatgatcttatcatgcaggaaagaaatcgctggttggaaaagtttgcagaagaaaaagtatttacctcaaaggaaattgaagatgcattaagcgaacctttgtcagcttatcgttctattgtaccccattttatcccgcatttatcttatcatttaaaaaaacaaaaaacagggaatgtcatcaaaaccaatattgttttaaataagcaacttaagacggaaaaactggtagaagattatgtgcggagcttgcgtttacaaaatattcataacgctgccgtagtgatcattgagaacaagacgcacaatgtgataacctatataggttcaggaaattttattgatacgattgacggcggacaagtaaatggtgctgcagcgacaaggcaaccgggaagcacattaaaacctttgctttatggcttgtgtattgacgatgggttactgacaccaaaagcaataattgaagacgtagcaattaattatagtgggtatgcacctgaaaattatgatcagaaatttaatggctatgtgactcttgaatatgcattagagcattcactaaacatacctgcggtaaagagtttgaagttgttaggaaaagatgagttggtagagaaattaaaggaggtaaattttactcaaataaaaaaagatcaaaacaaactttggcttatctgtggtattggccggttggtgaactacgctttgaagaactaa

SEQ ID NO: 3876 - protein, 263 aa, Unknown
  Obtained from environmental sample
  misc_feature (1)..(263): Xaa is any amino acid
MSLAEITALSIIPNRPSSLVIGKSNDLIMQERNRWLEKFAEEKVFTSKEIEDALSEPLSAYRSIVPHFIPHLSYHLKKQKTGNVIKTNIVLNKQLKTEKLVEDYVRSLRLQNIHNAAVVIIENKTHNVITYIGSGNFIDTIDGGQVNGAAATRQPGSTLKPLLYGLCIDDGLLTPKAIIEDVAINYSGYAPENYDQKFNGYVTLEYALEHSLNIPAVKSLKLLGKDELVEKLKEVNFTQIKKDQNKLWLICGIGRLVNYALKN

SEQ ID NO: 3877 - DNA, 765 bp, Unknown
  Obtained from environmental sample
  misc_feature (1)..(765): n is a, c, g, or t
gtggttttccacatacaaggattggtagcaccgtatgcagatgtatattttcctgctggcttttccaaaagagaggttttaaaaaagagcaacctggccgatatctttcgtggagttactttctatcatcgctatttagtaatgaagaaacggggcgaacgggaaatagaaatgataaaacaatggaaatattttaccggcagaaccgactgggacaggaattacgtaaaacttattaacccggcagctatctattttcatggtgaagaattgctgagggcagattttttttccgctcaatggcagcctttacagtcaccggcaaagggacagcagattgttattggcactacaatcaatcctaatatttacaaagggctggacctggtgtataaagtagtgaaccttttaaaagattacaacatctgctggaaaatttttggcattgccgctgataatccggtaaacaacattataaaaaaagtaatggatattaagaaggctggggcggctgtaaagttttatggccagttaagtgctcctcaattaatcgaagaattgaagacctgccacttttttgtacatccatcctatattgataacagccccaacagcgtttgcgaagcaatgctgcttggcatgccggtgctttcatcttcgccaggtggtgtaaagtctttaataacacataaagaaaacggctttcctgttcaattccttatgatcaataccaactggcagggtttgctgggctcacctttataa

SEQ ID NO: 3878 - protein, 254 aa, Unknown
  Obtained from environmental sample
  DOMAIN (99)...(248): Glycosyl transferases group 1
  misc_feature (1)..(254): Xaa is any amino acid
MVFHIQGLVAPYADVYFPAGFSKREVLKKSNLADIFRGVTFYHRYLVMKKRGEREIEMIKQWKYFTGRTDWDRNYVKLINPAAIYFHGEELLRADFFSAQWQPLQSPAKGQQIVIGTTINPNIYKGLDLVYKVVNLLKDYNICWKIFGIAADNPVNNIIKKVMDIKKAGAAVKFYGQLSAPQLIEELKTCHFFVHPSYIDNSPNSVCEAMLLGMPVLSSSPGGVKSLITHKENGFPVQFLMINTNWQGLLGSPL

SEQ ID NO: 3879 - DNA, 339 bp, Unknown
  Obtained from environmental sample
  misc_feature (1)..(339): n is a, c, g, or t
gtggaagcacttattcaggtgatggatgtaggcgtactctgcaccaacagtgaaatacatgagaagggtgtttccaattcaatcattgagtacatgagccttgaaaagcctgtaattgccaccaaaggcggcggcacaaacgaagtaattgaagatggtaaaaatggatttttaattggccacaaagaagtagataaattagtagagaagctgctttatctttatgataacccggctgcaggaaaacaaatgggtgcaaatgccctgcaaaccatttatgataaatttttgctggatagaatgacggatgagttcattgccatttataacaggaaatag

SEQ ID NO: 3880 - protein, 112 aa, Unknown
  Obtained from environmental sample
  misc_feature (1)..(112): Xaa is any amino acid
MEALIQVMDVGVLCTNSEIHEKGVSNSIIEYMSLEKPVIATKGGGTNEVIEDGKNGFLIGHKEVDKLVEKLLYLYDNPAAGKQMGANALQTIYDKFLLDRMTDEFIAIYNRK

SEQ ID NO: 3881 - DNA, 801 bp, Unknown
  Obtained from environmental sample
  misc_feature (1)..(801): n is a, c, g, or t
atgtctaaactattaaaccgtgcggtgcgcatctatttacagactgttcaacactcgttgaacaaggcggtcgcgtccccgattgaaacccaggaaaaagtatttgcaaaactcctggctaattttaaaaacacgaagtacggtaagttacacggaatcaaacatgtcaaagacgtaaagtcttttcaaaagactttaccggtagttggatatgaggaagttaagcctttcatcgaaagaatgatgctgggtgaaaatgatgtcctagtcggtggtagtgtcaaatttttctctaaatcttccggtacaactaacgataagagtaagttcattcctgtacccagggctaatttatacaaaaaccacatcaaaagcggatgggacagtcttgccctgttttatcaaaagagaccggatgctgagttgttccataaaaaatcactgcttatagccggttcaataaataaatatgagcaaaatccaaagacgataattggcgatatatcagcggtcatgaccaaaaatatgccaagtatcgcccgttcattttatacaccggaccttgaaacagccttgctctccgattgggaagaaaagatcagtaagatcaccaaaatcgcacacaaccaggatgtggtcatgtttggcggtgtacctacctggctgatcgtaatattcagggaaatattaaagtataccggaaaggacatttactggaagtctggccgaatctccagggtactttccacgagagtgggttttgatcatatatggaccagtcaaatcgctgataccttctaa

SEQ ID NO: 3882 - protein, 266 aa, Unknown
  Obtained from environmental sample
  misc_feature (1)..(266): Xaa is any amino acid
MSKLLNRAVRIYLQTVQHSLNKAVASPIETQEKVFAKLLANFKNTKYGKLHGIKHVKDVKSFQKTLPVVGYEEVKPFIERMMLGENDVLVGGSVKFFSKSSGTTNDKSKFIPVPRANLYKNHIKSGWDSLALFYQKRPDAELFHKKSLLIAGSINKYEQNPKTIIGDISAVMTKNMPSIARSFYTPDLETALLSDWEEKISKITKIAHNQDVVMFGGVPTWLIVIFREILKYTGKDIYWKSGRISRVLSTRVGFDHIWTSQIADTF

SEQ ID NO: 3883 - DNA, 765 bp, Unknown
  Obtained from environmental sample
  misc_feature (1)..(765): n is a, c, g, or t
atgaacatcgaagacagacatttgatagacaggtatctccaggaagacatttcagggatagagctcgaaaactttttacaacgattgaaaagtgatgatgaccttgcccggcaggtggaatttcaacgattgatttataacggcattcaaaaagccaacagggataaattgagagaagtaattatctcatcgatcaattacaggaagcctgttgtacccttcgccctgaagatgatcgtaacttttttggtcgttactgtgataggaatctcactttggttttatgtaggtaatgaaactgcaaacagagatcaatcaaactcatggtttgcatttttaaaaagcaagagtaaaacggaaagcgttaaagaagtggaggagaaaaccaaaacttccaccaggcaaaaaaattcttctcctgaagatacggttgctgaagtaaaaactcttgaaatttctgaaggtgatagtctggctgtagaagatcaaaaatcaattccctctgcggattcaatccccattaataccgaggatgcaaatattgttgtgaagcaggatcagttgcttatttcaacaactttaaatgtagaggataagacagacgccggcaattcttccgaagaatctctttcanaagatgcagttgagcatttaaaccccgctgcagacctgccggaaaaggagaaaaccacctcggcatttatagttgagttctgggtttcgccaattaactaccgtggttataaaatgtcaaaaaaaaactga

SEQ ID NO: 3884 - protein, 254 aa, Unknown
  Obtained from environmental sample
  misc_feature (1)..(254): Xaa is any amino acid
MNIEDRHLIDRYLQEDISGIELENFLQRLKSDDDLARQVEFQRLIYNGIQKANRDKLREVIISSINYRKPVVPFALKMIVTFLVVTVIGISLWFYVGNETANRDQSNSWFAFLKSKSKTESVKEVEEKTKTSTRQKNSSPEDTVAEVKTLEISEGDSLAVEDQKSIPSADSIPINTEDANIVVKQDQLLISTTLNVEDKTDAGNSSEESLSXDAVEHLNPAADLPEKEKTTSAFIVEFWVSPINYRGYKMSKKN

SEQ ID NO: 3885 - DNA, 1032 bp, Unknown
  Obtained from environmental sample
  misc_feature (1)..(1032): n is a, c, g, or t
gtgctcttttcagccgcctaccattactatattttcattcttttgtgtcatacaaaatttcacgccaaagtattaaacagaccgaacgacttatttataaaaatattgggtatcttatctatcgctgagggacagactaggggaatacgagagcttgccttgaacatactcgaacattcgaccgaaaagatgggaataattgcgggaaggttttataaaggagccgatttagctggcatacataaagatgaaaaggatgtaaatgaatattgtcagtcctaccatgataagaagaataaattcaccgaagaatatttttttgatctgtgtattattgacgaaagcaaaaaaggaattcttgatacaaataattttaacttcggctccttactggatattttcagccttacccgtgaaaataagggagttgagtttacacaatatctgaaagcaatggctaagatcggattggtctcgttcagacaaacgatcaagtcgttggacggattctacaaggtattatctccttataacttagacacttcaacgttttcacaatttgacaccaaagaaagcgcagacactgagacatattatagtagtgggactttgtattccattatcatacctcaagttgcaaacttaccccttgagaatatggtaattcgaagttttgacaaattagacccttcttctgttgaagatcttttgacttattattttatcccttataaagacaacgaanataggttttttcctctaaatagcaaattggttagcgaattcttatacagtaatatttcggccaaagacatgcctaagtatgaatatgagaaacaatttgctgaatcggcaatcaattattttaaaagaattgaaagggataataccagcccgcggataatactttttctcaccttaaggtacagactgtggcaaggatatggcttatctcaaaagatgcttgctaatttcattttggaaacggactacggtgacttcgtttttatggatgcagagcaaatattgtaa

SEQ ID NO: 3886 - protein, 343 aa, Unknown
  Obtained from environmental sample
  misc_feature (1)..(343): Xaa is any amino acid
MLFSAAYHYYIFILLCHTKFHAKVLNRPNDLFIKILGILSIAEGQTRGIRELALNILEHSTEKMGIIAGRFYKGADLAGIHKDEKDVNEYCQSYHDKKNKFTEEYFFDLCIIDESKKGILDTNNFNFGSLLDIFSLTRENKGVEFTQYLKAMAKIGLVSFRQTIKSLDGFYKVLSPYNLDTSTFSQFDTKESADTETYYSSGTLYSIIIPQVANLPLENMVIRSFDKLDPSSVEDLLTYYFIPYKDNEXRFFPLNSKLVSEFLYSNISAKDMPKYEYEKQFAESAINYFKRIERDNTSPRIILFLTLRYRLWQGYGLSQKMLANFILETDYGDFVFMDAEQIL

SEQ ID NO: 3887 - DNA, 612 bp, Unknown
  Obtained from environmental sample
  misc_feature (1)..(612): n is a, c, g, or t
atgaccagggctgaattagggaaattcatggatagtgcgaaaaaaaaaggcgggctccatttttccgggagtgatataaagagccggcgccagtatgattcactagtaaaggcggggaaaataaaacatggctggtttgaaaggcaaatggcattcaaggaaattgaaatgaatgaaaagtataagggtgaccaggaccagattctgaaagcttttgtaaacaaccttgtgcacagtttcccccaaatgctgttcatttcgcttcctttattcgccctggtgcttaaattactgtacatacggcggaaacagtattattatgtgagccatgcgattttcagcgtgcagtattacatttttgtttttataatgctgttcgtcctgctcttcctgcagaaaattaacaaccagctcgactggatgataataatatacctgcaggtactcacgttcatgattatcttcttttacctctataaggccatgcggaatttttacctgcaacggcgggcgaaaacgatactgaaatatatcctgctgaatatgacgatgttcgtaatcatatgcctattgtttgttgtgtttgtatttttttcattactgaaaacctaa

SEQ ID NO: 3888 - protein, 203 aa, Unknown
  Obtained from environmental sample
  misc_feature (1)..(203): Xaa is any amino acid
MTRAELGKFMDSAKKKGGLHFSGSDIKSRRQYDSLVKAGKIKHGWFERQMAFKEIEMNEKYKGDQDQILKAFVNNLVHSFPQMLFISLPLFALVLKLLYIRRKQYYYVSHAIFSVQYYIFVFIMLFVLLFLQKINNQLDWMIIIYLQVLTFMIIFFYLYKAMRNFYLQRRAKTILKYILLNMTMFVIICLLFVVFVFFSLLKT

SEQ ID NO: 3889 - DNA, 321 bp, Unknown
  Obtained from environmental sample
  misc_feature (1)..(321): n is a, c, g, or t
atgaataattatttagatattttagtaagaaattatccattagaaaatgcaaatagtgacaatgtatatagtgaaaataatgaatataatgaagataaatttgatttaatatcttcagaaatacataaaggaggagcaacaacagaagttgttggaaatgatatagcatctggtggatttccgcccatttatttatgtaatttaaatgaatctaatgaagataaatcagaattagaattgagaaaaaaagaaaaatttatagataaaaaaataatttctataaaagagataatggaggctcgcagaaaaaaacaaacctaa

SEQ ID NO: 3890 - protein, 106 aa, Unknown
  Obtained from environmental sample
  misc_feature (1)..(106): Xaa is any amino acid
MNNYLDILVRNYPLENANSDNVYSENNEYNEDKFDLISSEIHKGGATTEVVGNDIASGGFPPIYLCNLNESNEDKSELELRKKEKFIDKKIISIKEIMEARRKKQT

SEQ ID NO: 3891 - DNA, 348 bp, Unknown
  Obtained from environmental sample
  misc_feature (1)..(348): n is a, c, g, or t
atgaataatgatataattattgactctctaaattatcatgataaaaattttgagaaatattataagatattaaataaaataaaatattttaaagttaaaataaaggaaaatgatttggatcatagtgaaattactatgtatgacaaaaataaaaaggaattatttttatctaaatatgaaattgctgcaatgtatgtaaaagaacataatctttggttatgggcatgggcaatttcaaatttaaacaaaaatatgtccaacatatcaagaaaagttcttttttatggtcttgatttagataaaaataatattgttcttaanagtgaattagttacatcaaggatttaa

SEQ ID NO: 3892 - protein, 115 aa, Unknown
  Obtained from environmental sample
  misc_feature (1)..(115): Xaa is any amino acid
MNNDIIIDSLNYHDKNFEKYYKILNKIKYFKVKIKENDLDHSEITMYDKNKKELFLSKYEIAAMYVKEHNLWLWAWAISNLNKNMSNISRKVLFYGLDLDKNNIVLXSELVTSRI

SEQ ID NO: 3893 - DNA, 888 bp, Unknown
  Obtained from environmental sample
  misc_feature (1)..(888): n is a, c, g, or t
ttgttttcagatattgaaaaatttacttatattgtagaaattgaagaagataaaattatggataatataattcagcatctacaattgactcctgattctgttggttcaactgaaacatgttatgaagatgctgaattgaatttatatcaaatatgtcatgttttatataacaaagattatccacctgttaataaatttgcttctgtattagtttcatcagaagaaccgatttntagtacatgtatattaataaaatcaaagatattaccagatagttcatgtcaattgcaaagtttatctatgaatgaaattaataaaatatttttaaataggcatcaccatttaggaattttattaaaaagtaatgaaaatataaatgaatcaattccaacagtatatgaatataaattagatccaatggaatatttagatgatactgacctaattaaaaattatagatggtttgatattccattgttgggagcttatctaatagtttttattgaattgaaaccaaataaacatcaaattaataataaggcaacattattatgtaaaaaattaatatatggagatgttttttttgcattaaaatctgatggtaataaatatatggatcttactgatgatatatttgctaaaatattagcaatacttagtgataaatcaattaacactaaaaaaactaaggaagactataaaagtgaaagtgatagtaaaaaacagtgtattgtaaacttttactcactattaaacaaaagatttgaagaatttactaatctaaatccaaatattgcatataaaaatgtaattgataatacattgcttaattcaaaatcactaaatagtgtattacaagaacataatgaaaagacacaaaataaataa

SEQ ID NO: 3894 - protein, 295 aa, Unknown
  Obtained from environmental sample
  misc_feature (1)..(295): Xaa is any amino acid
MFSDIEKFTYIVEIEEDKIMDNIIQHLQLTPDSVGSTETCYEDAELNLYQICHVLYNKDYPPVNKFASVLVSSEEPIXSTCILIKSKILPDSSCQLQSLSMNEINKIFLNRHHHLGILLKSNENINESIPTVYEYKLDPMEYLDDTDLIKNYRWFDIPLLGAYLIVFIELKPNKHQINNKATLLCKKLIYGDVFFALKSDGNKYMDLTDDIFAKILAILSDKSINTKKTKEDYKSESDSKKQCIVNFYSLLNKRFEEFTNLNPNIAYKNVIDNTLLNSKSLNSVLQEHNEKTQNK

SEQ ID NO: 3895 - DNA, 372 bp, Unknown
  Obtained from environmental sample
  misc_feature (1)..(372): n is a, c, g, or t
atggaaaaagtcctgatagtaaagcaaccacaaacgactttgcagattgttttattgtgcgggttnccggagggggtaatgtgcggtagtaacaacagtgaattcgaagctgtcattcttaaaggatatgaattctaccggaatattggaatcacttctatgganatagtttcaaataaaattacagtgctggatgattttcattcaatggccagaataacctggagatcgaattatatagtaaagaactcagatggaaaaattgagtttgatgtaatttatcttgttcagaccaggaaagaggaaataaaaattttcgcctatataacaggtgatgagcaacaagcgctgaaggagaaagggctaatctga

SEQ ID NO: 3896 - protein, 123 aa, Unknown
  Obtained from environmental sample
  misc_feature (1)..(123): Xaa is any amino acid
MEKVLIVKQPQTTLQIVLLCGXPEGVMCGSNNSEFEAVILKGYEFYRNIGITSMXIVSNKITVLDDFHSMARITWRSNYIVKNSDGKIEFDVIYLVQTRKEEIKIFAYITGDEQQALKEKGLI

SEQ ID NO: 3897 - DNA, 660 bp, Unknown
  Obtained from environmental sample
  misc_feature (1)..(660): n is a, c, g, or t
atgctttattttccactcattttaacttcaatagctcttacaaaaatcagaataagttctccaaaattatatgggactttgcttgttatttatagcatgatgggtttgttattcattaagaatacaaacgtaaactcatactcatacgcttcctctgttatggcgtattattcaatgatggatacaattaaaaaagaccactcctcgcctgaaattgtatacctgggcgataatgccgttttacaggattggattaacggaaccaggataataatgaacaaaaaaggaataaataaggagttatactttgccactattgcgccctccattccctattggcaaaaaagttatgcaagtatgtcccctcaaaatgccttcagacacatgagcctggattctgttttttctcctaatggtaaatggattatattggtggagaatccttccaaaaatgggattgtgaatgataatatcattttttataaacgggctgattcaagttttgtgaagttaaacggaatagaaaaatacattttcggaaactatcattatttttcgtctccataccccgcgagggggcttaaggatctttttaccggcaattttaacgctataaaccgcctgggtttttacgcaataaagctatatgacaaaccataa

SEQ ID NO: 3898 - protein, 219 aa, Unknown
  Obtained from environmental sample
  misc_feature (1)..(219): Xaa is any amino acid
MLYFPLILTSIALTKIRISSPKLYGTLLVIYSMMGLLFIKNTNVNSYSYASSVMAYYSMMDTIKKDHSSPEIVYLGDNAVLQDWINGTRIIMNKKGINKELYFATIAPSIPYWQKSYASMSPQNAFRHMSLDSVFSPNGKWIILVENPSKNGIVNDNIIFYKRADSSFVKLNGIEKYIFGNYHYFSSPYPARGLKDLFTGNFNAINRLGFYAIKLYDKP

SEQ ID NO: 3899 - DNA, 927 bp, Unknown
  Obtained from environmental sample
  misc_feature (1)..(927): n is a, c, g, or t
ttgacattcattgaacgcataaggacaggggtatctattgctttgttaagatacaatccgttctggaaattcttagaaaagtataccgctgaaccttatcttaaaaaaagtatgggtgttaatgcgtacaaaaaaatctgggaacctcttttgaaaaataaactcggtaaatatgcagttgatgtatctcttgcatggttttgggcacgtgtctacaaaagaacaccaaaactcgcttatcccaaaggtggatttctcgaattctcgaaacacctagaaagcataataaaggagaacaacggatccttcatatatggggcacaagttgagaatatatcgaaagactcaaatccttctgtcacgtatacagtagaaggtgagagcactaagcaaacatttgatgctgttatagttaccgttccaatgtttgcatttgttaagattgcaccccacctgcctaaatcgtatattaaaaagtattctgtcctaaaagggattggagcagtcaacatagtcatgcgtctcaagaatcgtttttttaaagatggttcatattggttgagtatgtgcgatactaagtccccaattcttgcagttgttgaacataccaatttcatggataaaaaaaattatgacaacgagcaccttgtatatattggaaattatatggatattgcagacccacggttctcgatgtcatcaaaagaacttctaagagaatatgaaccctggcttaggaaaattaatcctgattttaaacaatcccttatcggttaccaattatttaaagcaccatttgcccaaccaataaatccaatttattactctcaacacattcctccaatagaaaccccactngaaaaatgtgtatcttggcaatattcaacaggttttatcatgggacagaggcacccactatgcagttga

SEQ ID NO: 3900 - protein, 308 aa, Unknown
  Obtained from environmental sample
  misc_feature (1)..(308): Xaa is any amino acid
MTFIERIRTGVSIALLRYNPFWKFLEKYTAEPYLKKSMGVNAYKKIWEPLLKNKLGKYAVDVSLAWFWARVYKRTPKLAYPKGGFLEFSKHLESIIKENNGSFIYGAQVENISKDSNPSVTYTVEGESTKQTFDAVIVTVPMFAFVKIAPHLPKSYIKKYSVLKGIGAVNIVMRLKNRFFKDGSYWLSMCDTKSPILAVVEHTNFMDKKNYDNEHLVYIGNYMDIADPRFSMSSKELLREYEPWLRKINPDFKQSLIGYQLFKAPFAQPINPIYYSQHIPPIETPLEKCVSWQYSTGFIMGQRHPLCS

SEQ ID NO: 3901 - DNA, 342 bp, Unknown
  Obtained from environmental sample
  misc_feature (1)..(342): n is a, c, g, or t
ttgaatattgatcgttcaggcattggttctggcttttcagtagtaatcaaaataatcccggaccatattgtatacaaaggtcatttcccaggacaccctgttacacccggagttatttttgttcaaatcgtacatgaattaacagaatcacaccttaaaagaaaaatccggttagttgaactgctcaattgtaagtttttgaaaatcgtaaatccaaacgaggaaaatatggcaactttctttgttgatattattttgaaagatggtttgctgtatgttaaagcttccggcaacaacaattcaggcagtttttttaaatttaatgctatatacgccggctag

SEQ ID NO: 3902 - protein, 113 aa, Unknown
  Obtained from environmental sample
  misc_feature (1)..(113): Xaa is any amino acid
MNIDRSGIGSGFSVVIKIIPDHIVYKGHFPGHPVTPGVIFVQIVHELTESHLKRKIRLVELLNCKFLKIVNPNEENMATFFVDIILKDGLLYVKASGNNNSGSFFKFNAIYAG

SEQ ID NO: 3903 - DNA, 336 bp, Unknown
  Obtained from environmental sample
  misc_feature (1)..(336): n is a, c, g, or t
ttgtccggctttgagacctcactgaatgccattcctacggttgaatttttccgaaaaaattatgagcctcaaaatctgtcagacttatattatcaggaattgatcaaaccagttgaattggaacgaaagttttttaaaggaaattttcaggcaaataaatctcttgacaaatgcaaaaacccaatccaggcctattcaaaaatcccaaccgtatccgttttgggcaagaaaacccggaaccttttcatttccgaatggaaaggctccaaaaacatattctctaaacagattttttatttaatgggaatttctaaagagaaattaaaatatccccaa

SEQ ID NO: 3904 - protein, 112 aa, Unknown
  Obtained from environmental sample
  misc_feature (1)..(112): Xaa is any amino acid
MSGFETSLNAIPTVEFFRKNYEPQNLSDLYYQELIKPVELERKFFKGNFQANKSLDKCKNPIQAYSKIPTVSVLGKKTRNLFISEWKGSKNIFSKQIFYLMGISKEKLKYPQ

SEQ ID NO: 3905 - DNA, 660 bp, Unknown
  Obtained from environmental sample
  misc_feature (1)..(660): n is a, c, g, or t
atgcttatgaaaaaacttaaggttccattgctaactgctatcaatatggcttcttcgatagaacaggtctcttcttctttagatcaattaagtaaagaattaattgacattgctgcctggccggaatataattataaaccgcaagtttcattcagtataggtcatggcggtgactgcatttttctcaaattttatgtaacagaagatgtggttaaagcatcttactacaaacccgatgatcctgtttataaggatagctgtgtagaattttttatttctattgatggtgaagaacaatattacaatctcgagtttaatacaataggaacctgcaaactaaactttggaaagaatagaaatgaaaggcagcgcattccagaaaagttgattaaaatgatcaggtttttagcgactattcaaaacaatacagtcagcaattcaaaaggaattaaatgggagcttgtattaatgattcccattgaagtgttttcaaaacataaaataaaatccttttcgggaataaaatgttccggcaacttttacaaatgtggagatgatttaccagtacctcattttttgtgctggaataatattcaatcggcggagcctgattttcatctgcaaaaatattttggtgaaataatatcctgtaaatgttga

SEQ ID NO: 3906 - protein, 219 aa, Unknown
  Obtained from environmental sample
  misc_feature (1)..(219): Xaa is any amino acid
MLMKKLKVPLLTAINMASSIEQVSSSLDQLSKELIDIAAWPEYNYKPQVSFSIGHGGDCIFLKFYVTEDVVKASYYKPDDPVYKDSCVEFFISIDGEEQYYNLEFNTIGTCKLNFGKNRNERQRIPEKLIKMIRFLATIQNNTVSNSKGIKWELVLMIPIEVFSKHKIKSFSGIKCSGNFYKCGDDLPVPHFLCWNNIQSAEPDFHLQKYFGEIISCKC

SEQ ID NO: 3907 - DNA, 1065 bp, Unknown
  Obtained from environmental sample
  misc_feature (1)..(1065): n is a, c, g, or t
atgaaaaaaaatggctgtgccactctaactttatggtggtggttatttacccccttacttgccaacagcccggaaggttatttttatttaacttataatccagcgaaatcttctctcagtatagacaaattccaacaaataaaaaaccacgctaaatctattgatatatnngctcctcaaatttatcagttggatgaaaacggaaccataggggganatatagactccaggcttcttgtcctcgcaaaagaaaataatatcaaagttatgccattaattattaattccaattttaaccaggaaaaatttcataattttttacataacgccccagctcaagaaaaagcgatttcagaaatgctctcgctctgtaaacaatatcatttttatggattgcaattcgactttgaaaatatcaatatcaatgataaaaatgaatttacccgatttttccaattaactgcgaatcgattacatcaaaatggttttacaattagtattgctgttgttcctcatatatcagatattttttatagtgattatgatcggtggtatttcgaaaattggtcaggcgtatacgactaccaaatcttaggacaaagcgccgactttattagcctcatgagttatgatcaacataccagcttaaccactcctggtccgatagcggctattgattgggtagaaaaaaccattcagaatttattgaaaaatgttcctgcaaaaaagatttctctcggtattcctgcttattcaggtttttggtccactggaaaaattgatccaggaaatattccaaaaatatatacctatcgctcaaaagaaactcaaattagctacgcgaaagtattaagtttattagcacaatttaatcaatcattgatttggcaaaatcaatggaaatcatcttatgttatgtacacgaataatgaaaaaaatgagtatctttttgtcgaagatgcaaagtcatttcaagcaaaattagaattagcaaaacgctatcagttgcacggaatatcagtttggaaattaggatcggaagatccggcgatatgggataaataa

SEQ ID NO: 3908 - protein, 354 aa, Unknown
  Obtained from environmental sample
  DOMAIN (24)...(347): Glycosyl hydrolases family 18
  misc_feature (1)..(354): Xaa is any amino acid
MKKNGCATLTLWWWLFTPLLANSPEGYFYLTYNPAKSSLSIDKFQQIKNHAKSIDIXAPQIYQLDENGTIGGXIDSRLLVLAKENNIKVMPLIINSNFNQEKFHNFLHNAPAQEKAISEMLSLCKQYHFYGLQFDFENININDKNEFTRFFQLTANRLHQNGFTISIAVVPHISDIFYSDYDRWYFENWSGVYDYQILGQSADFISLMSYDQHTSLTTPGPIAAIDWVEKTIQNLLKNVPAKKISLGIPAYSGFWSTGKIDPGNIPKIYTYRSKETQISYAKVLSLLAQFNQSLIWQNQWKSSYVMYTNNEKNEYLFVEDAKSFQAKLELAKRYQLHGISVWKLGSEDPAIWDK

SEQ ID NO: 3909 - DNA, 384 bp, Unknown
  Obtained from environmental sample
  misc_feature (1)..(384): n is a, c, g, or t
atgaaaacaaccaattggggaaacacaaatttctctgacaccaacactaccattcctgcggttaatattaaagaaactgcggaagcttatgaagttgaggtagctgcgcccgggatgactaaaaatgatttcaaagttgaattggatggaaactcactcatcatcagttccgaaagaacaaacagaagcccggacgatgaaggtgaacggtatgcccgtaaagaattcagttatcaatctttccagagaacttttactctgcagaaagacgtagtggatattgagaagattcaggcgaagtatgaaaatggtttgttgcgtcttctcatccctaaaaaagaggaagcgaagcaaaagccgccaaggcttattcaaatttcttaa

SEQ ID NO: 3910 - protein, 127 aa, Unknown
  Obtained from environmental sample
  DOMAIN (22)...(127): Hsp20/alpha crystallin family
  misc_feature (1)..(127): Xaa is any amino acid
MKTTNWGNTNFSDTNTTIPAVNIKETAEAYEVEVAAPGMTKNDFKVELDGNSLIISSERTNRSPDDEGERYARKEFSYQSFQRTFTLQKDVVDIEKIQAKYENGLLRLLIPKKEEAKQKPPRLIQIS

SEQ ID NO: 3911 - DNA, 426 bp, Unknown
  Obtained from environmental sample
  misc_feature (1)..(426): n is a, c, g, or t
atggattttcgagaaggtgacgacgaagagatagaagttcatacagaaacaacagtcaagatagaaagatcgttgtacaataaattaaaactcattgctaaaaagaagaataaagatcttaaaaacacaataaattgtgttgtaaaaaactatgtaaatagggaagaattatttgaacattacaaaccgtttcttttcattgtcaccgcaaaagatcaatctctgtatattaaagacgaaaaactgaataaattggtagaagtcagtctaaaatataaagatcaaaaaagtaatgagatcttgatctattgtcatgaatgcaatactgattattgtgttcatacctcttttgctctagcatctaacgaattgggagagatacaattccaaataaaaaagaccaccaccaatactagtgctaaataa

SEQ ID NO: 3912 - protein, 141 aa, Unknown
  Obtained from environmental sample
  misc_feature (1)..(141): Xaa is any amino acid
MDFREGDDEEIEVHTETTVKIERSLYNKLKLIAKKKNKDLKNTINCVVKNYVNREELFEHYKPFLFIVTAKDQSLYIKDEKLNKLVEVSLKYKDQKSNEILIYCHECNTDYCVHTSFALASNELGEIQFQIKKTTTNTSAK

SEQ ID NO: 3913 - DNA, 732 bp, Unknown
  Obtained from environmental sample
  misc_feature (1)..(732): n is a, c, g, or t
atgaaccgttttttgattttcatttttgtgatctgtttttgcggaacagctgtttctcagagttctgattctaaaaaaggagatgcgcttttgaaagcgatgagtaagaagctttcagaaacgcaatcgttcagtttcagcacgactgaatttcatgatcgcttaaaaccaaattacgaaagaacgaaaatcaatgtcacacgggatgtagtggtacggcgtccgaatggtttctggacaaaatataaaggtgatcgtgatttcgaattctggtatgacggtaaaatgctgaccgtaatttcaaatgcaaaaaagatttatgttcagcgcgaattgcctccaacgctggatgaagctctggatatgttagctcaacgcctgaacgttgatcttccaatgtcagacattatttacaattctccttacgatgccttcatggacaaccaaactcatggaggcttcgtagggcaagaaagtattgatggttcttcttgcagccacctggattatatgaatccggcagtagattggcagttgtggatcaatgacaagagttcacttccctgcaagttggaaatgaaatacaaaactgacaaaggaaattccatttacaaaattacattcagtaactggaatttgaagccggcattaaaatcagatttgtttgcggcaaaaattcctgaaggctacgtacgaattccaatcctggaaaaggtgacgattcagaagtga

SEQ ID NO: 3914 - protein, 243 aa, Unknown
  Obtained from environmental sample
  SIGNAL (1)...(19)
  misc_feature (1)..(243): Xaa is any amino acid
MNRFLIFIFVICFCGTAVSQSSDSKKGDALLKAMSKKLSETQSFSFSTTEFHDRLKPNYERTKINVTRDVVVRRPNGFWTKYKGDRDFEFWYDGKMLTVISNAKKIYVQRELPPTLDEALDMLAQRLNVDLPMSDIIYNSPYDAFMDNQTHGGFVGQESIDGSSCSHLDYMNPAVDWQLWINDKSSLPCKLEMKYKTDKGNSIYKITFSNWNLKPALKSDLFAAKIPEGYVRIPILEKVTIQK

SEQ ID NO: 3915 - DNA, 372 bp, Unknown
  Obtained from environmental sample
  misc_feature (1)..(372): n is a, c, g, or t
gtgaactacggcttcattccgcaaacacttggaaaagatggagacccgctggacattttagtgatgtgctccgaagccattcaacctctgtgttttgtagaagcattggtaatcggcaatatgcaaatgatagacaccaaccttattgacgataaaataattgcggtagccaccaaagatccgggcgtaaattatattacttcccttgatgaagtgcctcaacattttttttctgttcttaaaaactattttgaacagtacaaagttttagaaaataaagaagttaagataaatgatttccaggataaagaaagagcctttgaaatcattaatgaatccatagaattttacaaagaaacgtttcctaaataa

SEQ ID NO: 3916 - protein, 123 aa, Unknown
  Obtained from environmental sample
  DOMAIN (1)...(119): Inorganic pyrophosphatase
  misc_feature (1)..(123): Xaa is any amino acid
MNYGFIPQTLGKDGDPLDILVMCSEAIQPLCFVEALVIGNMQMIDTNLIDDKIIAVATKDPGVNYITSLDEVPQHFFSVLKNYFEQYKVLENKEVKINDFQDKERAFEIINESIEFYKETFPK

SEQ ID NO: 3917 - DNA, 837 bp, Unknown
  Obtained from environmental sample
  misc_feature (1)..(837): n is a, c, g, or t
ttgaagaaaaacagtgaggacgtcctgagatgctcgttctgcaacaagagccagaatgacgttcgaaagctgatcgctggccccacagttttcatctgcgacgaatgcgttgcggtttgccaggacatcatcgacgaagaccagaattacgagccatcgccccgcaatgtccacctgccaaaacccccggagatcaaaggttttctcgaccagtacgtcatcgggcaagataaatcgaaaaagaaactcgccgtcgccgtctacaaccattacaagcgcatcgagatgtcgcggaagaagtccgacatcgaactccagaaatcgaacatcctgttgatcgggccaaccggaacgggtaaaacactgctcgcgcagacgctggcccgtttgttgagcgtgccgttcgctattgtggacgcgaccacgctgactgaagcgggttacgttggcgaggatgttgagaacatcatcctgcgcctgatccagaacgctggcggcgacatcgaacgagcacagaccggcattatctatatcgatgaaatcgataagatcggacgcaaggacgagaatccatccattactcgcgacgtttcggggagaggcgtccagcaggcgctgctcaagatgctcgaagggaccgtcggcaacgtgccgcccccagncggggcgaaacacccgcatcaaggattcacccaggtggataccagcaacttcctttttcatctggggcggaacatttggtcggtccgggacaagaagatcgaacccccaactgggcggtcccgcaacccccattgggaattcccggggaaaatttcccgaattcaagttccccaa

SEQ ID NO: 3918 - protein, 279 aa, Unknown
  Obtained from environmental sample
  DOMAIN (109)...(276): ATPase family associated with various cellular activities (AAA)
  misc_feature (1)..(279): Xaa is any amino acid
MKKNSEDVLRCSFCNKSQNDVRKLIAGPTVFICDECVAVCQDIIDEDQNYEPSPRNVHLPKPPEIKGFLDQYVIGQDKSKKKLAVAVYNHYKRIEMSRKKSDIELQKSNILLIGPTGTGKTLLAQTLARLLSVPFAIVDATTLTEAGYVGEDVENIILRLIQNAGGDIERAQTGIIYIDEIDKIGRKDENPSITRDVSGRGVQQALLKMLEGTVGNVPPPXGAKHPHQGFTQVDTSNFLFHLGRNIWSVRDKKIEPPTGRSRNPHWEFPGKISRIQVPQ

SEQ ID NO: 3919 - DNA, 444 bp, Unknown; identical to SEQ ID NO: 2221
  Obtained from environmental sample
  misc_feature (1)..(444): n is a, c, g, or t

SEQ ID NO: 3920 - protein, 147 aa, Unknown; identical to SEQ ID NO: 2222
  Obtained from environmental sample
  misc_feature (1)..(147): Xaa is any amino acid

SEQ ID NO: 3921 - DNA, 534 bp, Unknown; identical to SEQ ID NO: 3657
  Obtained from environmental sample
  misc_feature (1)..(534): n is a, c, g, or t

SEQ ID NO: 3922 - protein, 177 aa, Unknown; identical to SEQ ID NO: 3658
  Obtained from environmental sample
  misc_feature (1)..(177): Xaa is any amino acid

SEQ ID NO: 3923 - DNA, 438 bp, Unknown
  Obtained from environmental sample
  misc_feature (1)..(438): n is a, c, g, or t
gtgttcattattcacgtggggttgattagaatacaatggaacaaacttcttgcaagggaatttactggcccctcacggccaggtcgtaaagttggaatatctggagatactcgcccctccaagaaattagaaatattcttcagggattgcgatgtattagtttttgaatctacttttataactccagagaaagataatgctattgaacggtttcattctaccgcattagaggcttcattattagcaaaaatcgcaaaagttaaaaaactaatacttactcattttagttccaggtatactaatctcaagttaatcgaaatggaagcaaaaaaaaatttcgaaaatattcatatagcacacgactacgacgtaattagtgttccatatccagagaaagaattaattaaaaaaaatgaaggattggagaagataaaataa

SEQ ID NO: 3924 - protein, 145 aa, Unknown
  Obtained from environmental sample
  misc_feature (1)..(145): Xaa is any amino acid
MFIIHVGLIRIQWNKLLAREFTGPSRPGRKVGISGDTRPSKKLEIFFRDCDVLVFESTFITPEKDNAIERFHSTALEASLLAKIAKVKKLILTHFSSRYTNLKLIEMEAKKNFENIHIAHDYDVISVPYPEKELIKKNEGLEKIK

SEQ ID NO: 3925 - DNA, 468 bp, Unknown
  Obtained from environmental sample
  misc_feature (1)..(468): n is a, c, g, or t
atggtacgaggacttgattattacactggtacgattatcgaatgccggattgacggctatccgtccagcgtcgctggtggtggtcgttacgataatttggtcgagagtttaattggccaaaagatcccagcttttgggctgtcatttggcgtcgatcgattagtggatgttctcgatgaagacaaaggattatctgagacaacaatatttatcgccagactgccggaaaccacggaggcacttaacccttgggttcgagaacttagaaattcaggtaaaaatgttgaagtatatttagacgaaacggtggaattaggcaaacaaataaaatacgccgacaaacgagggtttgttgaaatgttaattccgctggaagccgattggaaagagggtaaaatcgtcgtcaagaaccttgaaagtggcgatcaaaaatcagttgatcgaaagagtcttactgatgccaaataa

SEQ ID NO: 3926 - protein, 155 aa, Unknown
  Obtained from environmental sample
  misc_feature (1)..(155): Xaa is any amino acid
MVRGLDYYTGTIIECRIDGYPSSVAGGGRYDNLVESLIGQKIPAFGLSFGVDRLVDVLDEDKGLSETTIFIARLPETTEALNPWVRELRNSGKNVEVYLDETVELGKQIKYADKRGFVEMLIPLEADWKEGKIVVKNLESGDQKSVDRKSLTDAK

SEQ ID NO: 3927 - DNA, 372 bp, Unknown
  Obtained from environmental sample
  misc_feature (1)..(372): n is a, c, g, or t
ttgaaagtggcgatcaaaaatcagttgatcgaaagagtcttactgatgccaaataattttcccgctaagaagcacccaagcctctttgcacttgaggaatcaatcctcgaatattggcaaaaagaaaaaatctttgaaaaatctttagaacaaaataaaaacaatgaaagtttattcgttttacgacggaccgccgttaataacgggcattccgcactacgcaactttattaccagtatcgccaaagatgttatccccacgatccaaaccatgaaaggcaaatatgttcgcccggactgggggttgggaatgttcaccgggctgcccagccgaaaacttcagttgaaaaaaaagttagggtttgaaatctaa

SEQ ID NO: 3928 - protein, 123 aa, Unknown
  Obtained from environmental sample
  misc_feature (1)..(123): Xaa is any amino acid
MKVAIKNQLIERVLLMPNNFPAKKHPSLFALEESILEYWQKEKIFEKSLEQNKNNESLFVLRRTAVNNGHSALRNFITSIAKDVIPTIQTMKGKYVRPDWGLGMFTGLPSRKLQLKKKLGFEI

SEQ ID NO: 3929 - DNA, 801 bp, Unknown
  Obtained from environmental sample
  misc_feature (1)..(801): n is a, c, g, or t
atgatctatgtggctgttcgcgacaaaaactggacaacagcgccatacaaaattgaagaagaaaaaatacaggtgaaagagaaaagctttttaatcagttatactgcttttcacgagctcggtgaaattctttataaatcgtttgtagagataaaaggagaggaggatggtacaatatcattttcttttaaaggtgaagccctatcttcttttgaaagaaatcgcattggcctgtgtgtattacatcctatgaaggaatgtgccggtaataaagccaccataatttgtccggatggctcatcttatgaaggcttgtttccaaaaccagttagcccgcatcaaccttttaaaaatatccggcaattaaaatggaaagttggcgaacagattgaagcaaatgttttttttgaaggcgatatttttgaaacagaagaccaacgaaactggtcggataattcttataaaacttacagcacacctcttgaaattccgtatcctgctttagtaaaaaaaggtgacagggtagaacaaaaggtaattttacaaatttcagaagaagcaggtgagcaaaaccaggctccaaaaatttttgaagaaaataaaattccttttccaaaaattggctatgcccgttctgaggagccattgacacatgccgaaataaacctgcttagaaaaattccttttgatcattaccgcgttacattaagtttgtgtaaagaggattggaaagaaggctggctcttagctgttgaagaaacgaaaaaattggctaccgaaatcgaactggttgttttttaa

SEQ ID NO: 3930 - protein, 266 aa, Unknown
  Obtained from environmental sample
  misc_feature (1)..(266): Xaa is any amino acid
MIYVAVRDKNWTTAPYKIEEEKIQVKEKSFLISYTAFHELGEILYKSFVEIKGEEDGTISFSFKGEALSSFERNRIGLCVLHPMKECAGNKATIICPDGSSYEGLFPKPVSPHQPFKNIRQLKWKVGEQIEANVFFEGDIFETEDQRNWSDNSYKTYSTPLEIPYPALVKKGDRVEQKVILQISEEAGEQNQAPKIFEENKIPFPKIGYARSEEPLTHAEINLLRKIPFDHYRVTLSLCKEDWKEGWLLAVEETKKLATEIELVVF

SEQ ID NO: 3931 - DNA, 594 bp, Unknown
  Obtained from environmental sample
  misc_feature (1)..(594): n is a, c, g, or t
atgttgaaaaatatgaagaaaggctttagaattattgcggcatggttgctggtattatctataagttgtaataatacccctgccccgggcaaaaaagaaaatgtaccaaatcaaagttcccaggcagaaacaaaaaagaaatcaattgttttctttggaaacagtcttacagcaggttatggcctgagtccttcagaagcttttcctgcgctcatccaaaataaaatcgactcgttgcaacttccgtacaaggtgatcaatgcaggagtaagcggcgaaacatcttcaggtggtaacagtcgtattgattggatcgtacgtcagccactggatatatttatacttgaactcggtgctaacgatgggctgagaggcatacctattgcggaaacaaaaaaaaaccttcagtctattattgataaagtaaaagcaaaaaacccggaagctaaattagtccttgcaggtatgcaagtaccaccaaatatgggacaaacatacggaactgattttcgaaatatttattccgatttgnccaatnaaaataaaatgacatttgatccattttttatngnaaagcgtcggtggcgagcttaa

SEQ ID NO: 3932 - protein, 197 aa, Unknown
  Obtained from environmental sample
  DOMAIN (49)...(188): GDSL-like Lipase/Acylhydrolase
  misc_feature (1)..(197): Xaa is any amino acid
MLKNMKKGFRIIAAWLLVLSISCNNTPAPGKKENVPNQSSQAETKKKSIVFFGNSLTAGYGLSPSEAFPALIQNKIDSLQLPYKVINAGVSGETSSGGNSRIDWIVRQPLDIFILELGANDGLRGIPIAETKKNLQSIIDKVKAKNPEAKLVLAGMQVPPNMGQTYGTDFRNIYSDLXNXNKMTFDPFFXXKRRWRA

SEQ ID NO: 3933 - DNA, 486 bp, Unknown
  Obtained from environmental sample
  misc_feature (1)..(486): n is a, c, g, or t
ttgaatgcagatttatatcagtactcttctgcaggtcattataacgatatggacatgctgcaagttgggagaggtatgagttacgatgaagacaaaacgcatttctccatgtggtgcatgctgaattctccgcttcttgccggtaatgatctgcgcaacatgacgaagcaaacaatagaaatactgaccaacaaagagatcattgcgttgaaccaggatgaaggatttattcaggcaaaaagactgttccgtgaaaacaatgtggaagtttgggtgaaacctttaggaaacggaaagtcaaaggcaatagcttttttgaatcgtggagatcaggatactttgtttacattgactcctgaaaaaataaatatcagaaagaaaagcaggttaagagatctgtggcttcataagaagttgggaaaaatgagaaagagtaaatcattctctattcctaaacatggcatcgtagttcttaaacagtattga

SEQ ID NO: 3934 - protein, 161 aa, Unknown
  Obtained from environmental sample
  misc_feature (1)..(161): Xaa is any amino acid
MNADLYQYSSAGHYNDMDMLQVGRGMSYDEDKTHFSMWCMLNSPLLAGNDLRNMTKQTIEILTNKEIIALNQDEGFIQAKRLFRENNVEVWVKPLGNGKSKAIAFLNRGDQDTLFTLTPEKINIRKKSRLRDLWLHKKLGKMRKSKSFSIPKHGIVVLKQY

SEQ ID NO: 3935 - DNA, 462 bp, Unknown
  Obtained from environmental sample
  misc_feature (1)..(462): n is a, c, g, or t
atgatgttcatggtcaatggagatagttccatcactttattggattctgcatggacaaaaatccctgcggcttcaactttcacgcgcaataatgtagatgcccaaagcaattggaatatgaaaaacttcatcaatgaatgtgtcatagcaggtacctattccatcatcggaaaggatggaaagccaaccccggtttattttttaccgaatggccaggtaacgggtattaagcctttcctttcgtatgaaatctgttatgcgggagattgcctggaggaaacagaagaatctgctcagatcatcgaatttacaaacgacaaggctgaaaaagatctttatgtcatcaggatgccaaatgggaaaaaacaggtacagttttttaaagttggccctgcaaagcctgatattaaaggggaaagaagtattggagaactggcatttgagttaacttccgggatgtaa

SEQ ID NO: 3936 - protein, 153 aa, Unknown
  Obtained from environmental sample
  misc_feature (1)..(153): Xaa is any amino acid
MMFMVNGDSSITLLDSAWTKIPAASTFTRNNVDAQSNWNMKNFINECVIAGTYSIIGKDGKPTPVYFLPNGQVTGIKPFLSYEICYAGDCLEETEESAQIIEFTNDKAEKDLYVIRMPNGKKQVQFFKVGPAKPDIKGERSIGELAFELTSGM

SEQ ID NO: 3937 - DNA, 621 bp, Unknown; identical to SEQ ID NO: 1351
  Obtained from environmental sample
  misc_feature (1)..(621): n is a, c, g, or t

SEQ ID NO: 3938 - protein, 206 aa, Unknown; identical to SEQ ID NO: 1352
  Obtained from environmental sample
  DOMAIN (24)...(204): Protein of unknown function (DUF820)
  misc_feature (1)..(206): Xaa is any amino acid

SEQ ID NO: 3939 - DNA, 954 bp, Unknown
  Obtained from environmental sample
  misc_feature (1)..(954): n is a, c, g, or t
gtgatcttgataaaactgcccgacagcctgcacaatatgcgcacgcttgaccatatgaagcgggataaacaaattaagatcgccagcgagacacttttcctttatgcaccgcttgctcatcgtttgggattaaataccatcaaaacagaactggaggatctcggccttaaatacaccgattcggaagcctattatgatgtcgcaaataaattaaaggaaagccagcccgacagaaaaagatttattcagaaattcatagagcctctaaaggacatcctttcagaacaggggcttaagttcaagatctttggccgtccaaaatccattttcagtatttacaataagattaaaaccaaacatgttgcttttgaagagatctacgatctgtttgcaatccgtattgtgatagatactccgtatgaaaatgaaaaaagcgactgctggaaagtgtattccatcatcaccgatttttatcatcccagccctgaaaggctgcgcgactggatcagtactccaaaaagcaatgggtacgaaagtctccatacaaccgtaatgggccctgaaggtaaatgggtggaagtacagatcaggtcaaccaggatggatgaccttgcggaaaacgggtatgctgcacactggaagtataaagacagtgctgcagaaaaagaaagcaagctcgaaagctggctgcttcgtatccgtgatatgctcgaaaatcccgatccgaatgctcttgagttcatcgatgattttaagctgaaccttttcagcgatgagatgtttgtgtttacacctaaaggcgatatgaaaacgctgccggtgggagccacagctcttgacttcgcatttgagatccacactaaagtgggagaacactgtatcggggccaaggttaatcataaactggtaccacttagtcatgaacttgcgagtggcgaccaggtagaggtttaa

SEQ ID NO: 3940 - protein, 317 aa, Unknown
  Obtained from environmental sample
  DOMAIN (256)...(317): TGS domain
  misc_feature (1)..(317): Xaa is any amino acid
MILIKLPDSLHNMRTLDHMKRDKQIKIASETLFLYAPLAHRLGLNTIKTELEDLGLKYTDSEAYYDVANKLKESQPDRKRFIQKFIEPLKDILSEQGLKFKIFGRPKSIFSIYNKIKTKHVAFEEIYDLFAIRIVIDTPYENEKSDCWKVYSIITDFYHPSPERLRDWISTPKSNGYESLHTTVMGPEGKWVEVQIRSTRMDDLAENGYAAHWKYKDSAAEKESKLESWLLRIRDMLENPDPNALEFIDDFKLNLFSDEMFVFTPKGDMKTLPVGATALDFAFEIHTKVGEHCIGAKVNHKLVPLSHELASGDQVEV

SEQ ID NO: 3941 - DNA, 432 bp, Unknown
  Obtained from environmental sample
  misc_feature (1)..(432): n is a, c, g, or t
atgctgagtctgacctgtaaaacggccgtgaaagccgttatttacctggcttcaaaatatggttcgggcaacaatgccgggatcagggaagttgccggctttataaatggtaacgaacacaccgtaggcaaactattgcagaccctggtaagggaaggtgtgattaatagtgtgaaaggcccttccggcggtttttatatttcaaaggagcaattgcgaaaacctatcataacaattgtggatgctattgatggcagggatgtatttaaagaatgcggcctgggcctcagtaaatgctccgcaacgcatccctgccccatacacgatgattataaaataagccgcgagcacattgaaaagcttttctcacaaaaaaggatcatcgatctttgtgaaccggtcaataaaggatttgcccacctggcaggatga

SEQ ID NO: 3942 - protein, 143 aa, Unknown
  Obtained from environmental sample
  DOMAIN (2)...(122): Transcriptional regulator
  misc_feature (1)..(143): Xaa is any amino acid
MLSLTCKTAVKAVIYLASKYGSGNNAGIREVAGFINGNEHTVGKLLQTLVREGVINSVKGPSGGFYISKEQLRKPIITIVDAIDGRDVFKECGLGLSKCSATHPCPIHDDYKISREHIEKLFSQKRIIDLCEPVNKGFAHLAG

SEQ ID NO: 3943 - DNA, 801 bp, Unknown
  Obtained from environmental sample
  misc_feature (1)..(801): n is a, c, g, or t
atgaaatcatcctcactagaaaaagcccttcgatggattggttatggttatgcggttgccgcaccaataataacgatacttttcccacagcttcttgtagcatatccaataatcggccttgtgttggccccatcctgggttggtctcctaggtaaaatcttatatgacaataatgagcaattttatttttggttctcgaaaacatggctgaagctatcgcgtagctacgtggattggtccctgtcggtcaaattaaaagctccacaaaatcctaaagtactgaacaggatcaaagacaaaatcttaaaaagctatcctgacgcaaagatttggcacaatgaggatttcaagaagatcattgagttgtctataggttgcaatataaggctcgaatatatagtgtggggcgacgggctcgataatgagcaaacaactctacagtttagcgtttcagaattatcggtgcctttcaacaagagcgaacagatatcagaacatatcctctcgatcatcaacgatatattgctccctgaaagtcatcctgaaagacagcaatatattttgcgtgtgaaattcggtgaacgcaatccgtacttcggtgtttttgttcgcaaactgcggttaccggatcaaagtctggcaagtttcaaagttgagtattatcaaagcgtgnggcataaaaaagaaaaggtagaggttggcagcaaggaagtcgcggtcataacagacagtttgccaagtctacaaattctctcgcaacgtttcataactctagcaagtcttgatctgacgaatcaatag

SEQ ID NO: 3944 - protein, 266 aa, Unknown
  Obtained from environmental sample
  misc_feature (1)..(266): Xaa is any amino acid
MKSSSLEKALRWIGYGYAVAAPIITILFPQLLVAYPIIGLVLAPSWVGLLGKILYDNNEQFYFWFSKTWLKLSRSYVDWSLSVKLKAPQNPKVLNRIKDKILKSYPDAKIWHNEDFKKIIELSIGCNIRLEYIVWGDGLDNEQTTLQFSVSELSVPFNKSEQISEHILSIINDILLPESHPERQQYILRVKFGERNPYFGVFVRKLRLPDQSLASFKVEYYQSVXHKKEKVEVGSKEVAVITDSLPSLQILSQRFITLASLDLTNQ

SEQ ID NO: 3945 - DNA, 360 bp, Unknown
  Obtained from environmental sample
  misc_feature (1)..(360): n is a, c, g, or t
atggagcagacacaattaaatatcggcgacaaaattgaattatccggtggctatgacttcgaaataagctatttaaaaaatccgcctgccgataagaggacaggaagagtaatacaattcattactggacaaaacaagacaccggccgccgttgctaaacttgaccaaattattagtggtgacaaaataacaggcgacatcgtggttttagaactaagatatcaaggagccacctggacagacaatacgtttactgttcatatcgaactatgtgactttattccagacaacaaaccatggaaagacagaaaacaaggtgaatgggttgaggcagcggcaacccttaaaaaaattggctga

SEQ ID NO: 3946 - protein, 119 aa, Unknown
  Obtained from environmental sample
  misc_feature (1)..(119): Xaa is any amino acid
MEQTQLNIGDKIELSGGYDFEISYLKNPPADKRTGRVIQFITGQNKTPAAVAKLDQIISGDKITGDIVVLELRYQGATWTDNTFTVHIELCDFIPDNKPWKDRKQGEWVEAAATLKKIG

SEQ ID NO: 3947 - DNA, 459 bp, Unknown
  Obtained from environmental sample
  misc_feature (1)..(459): n is a, c, g, or t
gtgaacgagttaaaaaggggtcagcttacccagcaggaaaaaataatgtacctaagacttttgattcacttcgtgggggatatgcatcaaccaatgcacgtgggcagacccgacgatcgtggtggtaacagggttcgtgtgctctggttcaacgacccatacaatctgcaccaggtgtgggacgaagtattgatcaacttccaaaaactcagttatacggagtttgctaaagcgatcaattatacaactaaagaacagagaaaacagtggatggcagagcccattagcctttggatatataacacctaccaatataccgaacagatttatggggatgtaaaaacaaaggaagataagttgagctacgaatataacttcaaatacaaggaagtagtggagcagcaactattgaaaggaggcgtacaccttgccgggattttgaacgacatatttgggtaa

SEQ ID NO: 3948 - protein, 152 aa, Unknown
  Obtained from environmental sample
  DOMAIN (2)...(152): S1/P1 Nuclease
  misc_feature (1)..(152): Xaa is any amino acid
MNELKRGQLTQQEKIMYLRLLIHFVGDMHQPMHVGRPDDRGGNRVRVLWFNDPYNLHQVWDEVLINFQKLSYTEFAKAINYTTKEQRKQWMAEPISLWIYNTYQYTEQIYGDVKTKEDKLSYEYNFKYKEVVEQQLLKGGVHLAGILNDIFG

SEQ ID NO: 3949 - DNA, 825 bp, Unknown
  Obtained from environmental sample
  misc_feature (1)..(825): n is a, c, g, or t
atgaggagtatactggttgaaaaaagcgtatttgaaattgtttgcccttctgactataaaattcgctataaagcttttcattataccggcgaagcggtagttactgaaggaaagcaaaaaatatatcgctgggaagtaaaaaatctgcaggccgtaaaaaaagaatttgcaggtcctgaatggcagaaaataacgccgacagttgttgtgggcgctaccaattttgaaattgcagggtataaaggaaacatgagcgactggaatgagtttggaaaatttatttacagtcttaaggaaaatcgtgacaaacttccggaaacagtcaaagcaaaagtgcacgaactgattgacaatataccggatgtaaaaaagaaaattgaaatgctgtatacttatatgcagcaaaacacccgatatataagtgtacagttaggcataggaggctggcaaccatttgatgcacaatacgtagcccaaaagaattatggagattgtaaggccttaactaattacatgttttcgctattaaaagaggcaggtataaggtctgtgtatacgttggtaaaggccggtaaaaacagtcggtatattgtcgaagattttcctgcacagcagttcaatcatgttattttatcagtgcccttacaaaaagatactgtgtggctcgaatgtactgatcaaactttgcctgctggctatttaagcggatttacatcanaccgatacgcattaatggtgcaggaagatggtggtcatcttgttaaaactcccagctataactttcaaaacaatttacaaatacgaaaaataaaggcgagcgtttga

SEQ ID NO: 3950 - protein, 274 aa, Unknown
  Obtained from environmental sample
  misc_feature (1)..(274): Xaa is any amino acid
MRSILVEKSVFEIVCPSDYKIRYKAFHYTGEAVVTEGKQKIYRWEVKNLQAVKKEFAGPEWQKITPTVVVGATNFEIAGYKGNMSDWNEFGKFIYSLKENRDKLPETVKAKVHELIDNIPDVKKKIEMLYTYMQQNTRYISVQLGIGGWQPFDAQYVAQKNYGDCKALTNYMFSLLKEAGIRSVYTLVKAGKNSRYIVEDFPAQQFNHVILSVPLQKDTVWLECTDQTLPAGYLSGFTSXRYALMVQEDGGHLVKTPSYNFQNNLQIRKIKASV

SEQ ID NO: 3951 - DNA, 609 bp, Unknown
  Obtained from environmental sample
  misc_feature (1)..(609): n is a, c, g, or t
ttgaatcaagtttttgagatactaaggcagacaagggagaataaaggctggaacaaaagccaaatggctgatgaattaggcatatccagccagctttacggccaatatgagaccgggaagaagaaacctgtaaccacattttttttaaaatggaagcaaaagtttggcattgatctgttaacaggtggcgtggatttgaaaaaccaggtttataaatgtgatataaggaaaggcaaacagcaccgggaagtattaagaaccattaaaacaatagcccttcctttttgggaagaagtattggaagatagtaatccggaagattatgttttcagtaaaggattaagacccggccccatacaaataagagctgaccaaattactaagcgttggtataagtatgtaaaaaaaccattaggaataaccgcagatttctacagtttaaaacacgtaaacagttctgaaatggtggatatattgagcgaacatgatgctgctaaattaatggggcatacaacaacaggcatggttcgcaaaatttatgataccaaaagagaagataggcaacataccagaattaaagatgttgggaatagttttaaaaagctatga

SEQ ID NO: 3952 - protein, 202 aa, Unknown
  Obtained from environmental sample
  DOMAIN (8)...(62): Helix-turn-helix
  misc_feature (1)..(202): Xaa is any amino acid
MNQVFEILRQTRENKGWNKSQMADELGISSQLYGQYETGKKKPVTTFFLKWKQKFGIDLLTGGVDLKNQVYKCDIRKGKQHREVLRTIKTIALPFWEEVLEDSNPEDYVFSKGLRPGPIQIRADQITKRWYKYVKKPLGITADFYSLKHVNSSEMVDILSEHDAAKLMGHTTTGMVRKIYDTKREDRQHTRIKDVGNSFKKL

SEQ ID NO: 3953 - DNA, 882 bp, Unknown
  Obtained from environmental sample
  misc_feature (1)..(882): n is a, c, g, or t
atggacagaatggtctttttccaaatcattatttgcagggccgatcgtgaaattgattattcaatcatcgagaaaatttctcttttttgtaacgtacccaaacagaacgtgtatcaatccatagatactgaccttatttataaagttcctttatcttttcatcaacagggactggataaacgtattacagaactgttggggatgtgggtagccgaaccgaagatggatgacatcaataaagtgatcttcaatgctgcgaatccgcttaaagtggtgaatatcggagtagtgggaaaatacactgagttaattgaaagttataaatcattggatgaagctttaagacatgcggccattgccaatcaagtgaaacttaatcttacttatattgatgctgaagatctcgagaaaggtgttaagactgacttgctggagaaagtagatggaattctggtaccaggaggctttggagcacgtggaacagaaggtaagatcatggccgtaaagtatgcccgggaaaataaaaaacctttctttggtatatgtctaggccttcagctttcgatcattgagtatgcacgaaatattgtgggcattaaaaatgcgaccagcatggagtttgccgataagggagactttgttgttcattacatgcatggtcagagtaaggaaggtgcaaaaggtggaagcatgcggcttggtgcctatgaatgcaagcttaacgaaggaagccttgctggaaagatttacggtaaaactaacatttctgaacgtcacaggcatcgcctggaagttaataatgaatacttaaaacaactgacagataagggccttatagtttctggactaaacccaggattgaatctggtggaagtggattga

SEQ ID NO: 3954 - protein, 293 aa, Unknown
  Obtained from environmental sample
  DOMAIN (1)...(80): CTP synthase N-terminus
  misc_feature (1)..(293): Xaa is any amino acid
MDRMVFFQIIICRADREIDYSIIEKISLFCNVPKQNVYQSIDTDLIYKVPLSFHQQGLDKRITELLGMWVAEPKMDDINKVIFNAANPLKVVNIGVVGKYTELIESYKSLDEALRHAAIANQVKLNLTYIDAEDLEKGVKTDLLEKVDGILVPGGFGARGTEGKIMAVKYARENKKPFFGICLGLQLSIIEYARNIVGIKNATSMEFADKGDFVVHYMHGQSKEGAKGGSMRLGAYECKLNEGSLAGKIYGKTNISERHRHRLEVNNEYLKQLTDKGLIVSGLNPGLNLVEVD

SEQ ID NO: 3955 - DNA, 465 bp, Unknown
  Obtained from environmental sample
  misc_feature (1)..(465): n is a, c, g, or t
atgaaactcgccgccgattcgcatcagaaactcgaagaatttgttggtcattattttcaggacgatagttttcgtctgccgccgatatatttgtacggcggcggatttactggtttttttacatatttcatcaaagttcacggaatcactttcggatgccggatatttataatgcccgcattaatttcagtgaatccaagatcggagccgagactttcggaaaagctggccgcgcacgagatcacgcattctctgcaataccggaagcacggctttttcggctttttttataattatttaaagagcttcataaagaatctgagaaccaaaaaaaaatgggatctggattccagacaggaagcttatctggaaattccgttcgagatcgaagcgcgcgacgcggccgacaaattcgtcgaatggaatgcccgaaagcgccttttgaaagctcaaaacatcacttaa

SEQ ID NO: 3956 - protein, 154 aa, Unknown
  Obtained from environmental sample
  misc_feature (1)..(154): Xaa is any amino acid
MKLAADSHQKLEEFVGHYFQDDSFRLPPIYLYGGGFTGFFTYFIKVHGITFGCRIFIMPALISVNPRSEPRLSEKLAAHEITHSLQYRKHGFFGFFYNYLKSFIKNLRTKKKWDLDSRQEAYLEIPFEIEARDAADKFVEWNARKRLLKAQNIT

SEQ ID NO: 3957 - DNA, 411 bp, Unknown
  Obtained from environmental sample
  misc_feature (1)..(411): n is a, c, g, or t
atggcaacgaaaaaactgacctctgtattcatcgtagaagacaatgccgttcagcgctccatgctgagtgatcatctttcaaaatatcccaagctgaagatccgcgagttttccagcggcgactcatgcctgaaggaaatgatctccggaaacgtggaagaaccggaattggtgctcatggattatttcctcgacagctctttcggcacatcgaaggacggattggaaacccttacgaaactgaaagaaatttttccggatacggatgtggtcatgcttacttctgtcgagaaccagaagatcatcgaccttgcaaagaaaaaaggtgcgctggattatatcgtgaagagcgcaggtagtttccaaaaactggattcgattatcaattcgaattacgaagtggtttcataa

SEQ ID NO: 3958 - protein, 136 aa, Unknown
  Obtained from environmental sample
  DOMAIN (7)...(136): Response regulator receiver domain
  misc_feature (1)..(136): Xaa is any amino acid
MATKKLTSVFIVEDNAVQRSMLSDHLSKYPKLKIREFSSGDSCLKEMISGNVEEPELVLMDYFLDSSFGTSKDGLETLTKLKEIFPDTDVVMLTSVENQKIIDLAKKKGALDYIVKSAGSFQKLDSIINSNYEVVS

SEQ ID NO: 3959 - DNA, 363 bp, Unknown; identical to SEQ ID NO: 3697
  Obtained from environmental sample
  misc_feature (1)..(363): n is a, c, g, or t

SEQ ID NO: 3960 - protein, 120 aa, Unknown; identical to SEQ ID NO: 3698
  Obtained from environmental sample
  DOMAIN (7)...(116): Glyoxalase/Bleomycin resistance protein/Dioxygenase superfamily
  misc_feature (1)..(120): Xaa is any amino acid

SEQ ID NO: 3961 - DNA, 885 bp, Unknown
  Obtained from environmental sample
  misc_feature (1)..(885): n is a, c, g, or t
atggatcagattgtgctggaggataaacataagcggatttacaaaagaataaacatcagcaacgatggaaagtttttgctgggcggcatcttgataggggaggcggctgcttacaatatcctgttgcaaacggtcaataataaaatcgtaattcctccggatgcggaagacctgatccttggagtgcgtggtggctcagctaaaagtgggacgggtgtaatgggtttgcctgaagaagcattgatctgctcctgcgaagcaatttccaaaggagagatctgcaatgcagtcaccgaacaaaacctttcttcagtcgaagcattaaagaaatgcacaaaggccgggaccggatgcggtggatgtgttcctcttgtaaaagacctgctggtcgggaccatgaaagccaatggagtctacgtaaaaaatattgtgtgtgagcatttcaattattcacgtcaggaattgttcgaccttgtaaaaatgaatgccatcaaaacatatgatggtgttttggaacattttggaaaaggagatggctgcgaaatttgtaagccggctgtagcgagtattttagcgagtctatggaatgagcttatcctgaaacaggaaacgatccaggatagcaatgaccgttttcttgcaaatatccaaaagggtggaacatattctgtagtgcctcgaatcgctggcggagagatcactccggataaattgattgtaattggccaggtggcaaagaaatacaagctctacacaaaaattacgggaggacagcgaatcgatctattcggcgcgcatttgagcgatcttccggatatatgggaagaactcatcgaagcaggttttgaagtggacatgcctatggcaaatccctacgtactgtga

SEQ ID NO: 3962 - protein, 294 aa, Unknown
  Obtained from environmental sample
  DOMAIN (214)...(280): Nitrite/Sulfite reductase ferredoxin-like half domain
  misc_feature (1)..(294): Xaa is any amino acid
MDQIVLEDKHKRIYKRINISNDGKFLLGGILIGEAAAYNILLQTVNNKIVIPPDAEDLILGVRGGSAKSGTGVMGLPEEALICSCEAISKGEICNAVTEQNLSSVEALKKCTKAGTGCGGCVPLVKDLLVGTMKANGVYVKNIVCEHFNYSRQELFDLVKMNAIKTYDGVLEHFGKGDGCEICKPAVASILASLWNELILKQETIQDSNDRFLANIQKGGTYSVVPRIAGGEITPDKLIVIGQVAKKYKLYTKITGGQRIDLFGAHLSDLPDIWEELIEAGFEVDMPMANPYVL

SEQ ID NO: 3963 - DNA, 888 bp, Unknown
  Obtained from environmental sample
  misc_feature (1)..(888): n is a, c, g, or t
gtgaattataaaaaattaaaaccaggaaaatatatcttcaaacttaaggcacaaattgcaggaggaaactggcaggatgaaattgttgaatatcctgtgataataacgccggcattttggcaaactgcctggttcaaattgctcatcttctttgtagcagttttctttatttttttcctggtgagaaaaagaatccagggtattaaacaaaaagagcagcaaagaagcaggcatgaaaaggaattgctggaattggaagccaaagctcttcgcgcacaaatgaacccgcattttattttcaatagcctgaactcgatcaaatcgctgatcaataaaaatgaaaatgaaatagcggcagactatcttactactttttcaaaattaatcaggacactgtttcagaactccgaccgccgggagatcagcctgtatgaagaaatagaaacctgcaaactttacacgaccattgaaaaaatgaggtttggtgataaggttgaatttttatttaacgtagatgaaaacattgaccttaaagatgtaaaagttccggcgctcattctacaaccatttattgaaaatgcgatatggcatggcctggtacccaaggagtgcggcggcaaaatttcgataactgtgcaggaaacgaatgacgctatcgtctgtacgatagatgataatgggataggtcgcgaggtttcaaagatctataangtgcaatatccatctcaccatgaatcaaaaggtatgggtttaacacaatcaagacttgaacttgataggctaatgaatgaccgggaagacagcatccggataattgataaggtaaacactgatggcgcatcagcgggaacaaccatcatccctaaccttaaaggaaatatcttatga

SEQ ID NO: 3964 - protein, 295 aa, Unknown
  Obtained from environmental sample
  DOMAIN (86)...(170): Histidine kinase
  misc_feature (1)..(295): Xaa is any amino acid
MNYKKLKPGKYIFKLKAQIAGGNWQDEIVEYPVIITPAFWQTAWFKLLIFFVAVFFIFFLVRKRIQGIKQKEQQRSRHEKELLELEAKALRAQMNPHFIFNSLNSIKSLINKNENEIAADYLTTFSKLIRTLFQNSDRREISLYEEIETCKLYTTIEKMRFGDKVEFLFNVDENIDLKDVKVPALILQPFIENAIWHGLVPKECGGKISITVQETNDAIVCTIDDNGIGREVSKIYXVQYPSHHESKGMGLTQSRLELDRLMNDREDSIRIIDKVNTDGASAGTTIIPNLKGNIL

SEQ ID NO: 3965 - DNA, 969 bp, Unknown
  Obtained from environmental sample
  misc_feature (1)..(969): n is a, c, g, or t
gtgaatttaaacgaacgttttccagagtattttacacgcgntaagaaaataaaagacggttcggaatattttggtccctacgccaacgtgaaagctatgcgcagtgttttggatatcatacgtcaaacatttcccttaagaaattgtacgtacgatctgaaacaagaaaatattgataaaggaaaattccgtccgtgtttggaatatcatattggacattgtaaagcaccttgtgttggatttcaaaaagaaaacgattacaattcgaacattaaagagatccgcgagatcattaaaggcgatattcattttgcgatccgcgatatgaaaacgcaaatgaaaaaagcggccgaagatctggaatttgaaaaagcggaagaactcaaacagcgaattgaattgctggaagcttaccagggtaaatcaaccatcgcgcatccttctattacagatacggatgtattcaatatggtgagtgacgaaaaatcagcctacgtgacctatttcaaaatgatgaatggaactatcgtgcaaagccaaaccgttgagttgagaaaaaagttggatgagaccgacgaggaacttttggtatttgctatggtagaattgagaagcaggtttaattcgaagagcaaagaaatacttgttccgtttgaacctgaagtgaaattaccggatgcggaatatgttgttccgaaaattggtgacaagaaaaagttaatggatctgtgttggagaaattccacggaatttaaacacgagcaagataagcaaactgccattgttgatccggaaagacacaccagtcgcattatgcaaaccatgatgaaagacttgcgtttgaaagaagaaccgcgtcgtattgaaggatttgacaatagcaatattcagggaaactacgcggtgagcgccatgcccgtttttattgatggcaaaccccgcaaaaaagataccgacattttaatgtga

SEQ ID NO: 3966 - protein, 322 aa, Unknown
  Obtained from environmental sample
  misc_feature (1)..(322): Xaa is any amino acid
MNLNERFPEYFTRXKKIKDGSEYFGPYANVKAMRSVLDIIRQTFPLRNCTYDLKQENIDKGKFRPCLEYHIGHCKAPCVGFQKENDYNSNIKEIREIIKGDIHFAIRDMKTQMKKAAEDLEFEKAEELKQRIELLEAYQGKSTIAHPSITDTDVFNMVSDEKSAYVTYFKMMNGTIVQSQTVELRKKLDETDEELLVFAMVELRSRFNSKSKEILVPFEPEVKLPDAEYVVPKIGDKKKLMDLCWRNSTEFKHEQDKQTAIVDPERHTSRIMQTMMKDLRLKEEPRRIEGFDNSNIQGNYAVSAMPVFIDGKPRKKDTDILM

SEQ ID NO: 3967 - DNA, 753 bp, Unknown
  Obtained from environmental sample
  misc_feature (1)..(753): n is a, c, g, or t
atggcatcaaaaagtgaaactctccggaaaataaccactaaagccggctctaaaactgatgaaaaaacatcaggcactaaattatcacctgtgaagtctactgaaaaatacgcacctaccaaaaaacatttgtctcctttgcatatcgcagttgccggaaatatcggtgcaggtaaaactacgctgacgactctcctcgcaaagaatatgaaatgggaaccacactttgaggatgttgacgacaatccttacctgaatgatttttatgatgacatgcaacgatggtcattcaatctccagatttttttcctcaattcacgtttcgaacagatcacacgaatccgccagagtggaaaaaccgttatccaggaccggacgatctatgaggatgcgcacattttcgctccgaaccttcattcgatgggactgatgacgacccgtgattttaataattacctgtcgttgttcacgctgatgactaaattcgtttctccgccggacctgctgatttacctgcggggttctgttccgactctggtgaaccagatagcaaaacgcggacgtgattatgaaaattcaatccgcatcgattatcttaaacggcttaacgaacgctacgaagcatggatttcaacatacgaacagggtaagctcctggtaattgatattgatgatatcaacttcgcagataatcccgaggatctcggaaaaatcattaacaagatcaatgcggagatcaatggtttgttttaa

SEQ ID NO: 3968 - protein, 250 aa, Unknown
  Obtained from environmental sample
  DOMAIN (99)...(244): Deoxynucleoside kinase
  misc_feature (1)..(250): Xaa is any amino acid
MASKSETLRKITTKAGSKTDEKTSGTKLSPVKSTEKYAPTKKHLSPLHIAVAGNIGAGKTTLTTLLAKNMKWEPHFEDVDDNPYLNDFYDDMQRWSFNLQIFFLNSRFEQITRIRQSGKTVIQDRTIYEDAHIFAPNLHSMGLMTTRDFNNYLSLFTLMTKFVSPPDLLIYLRGSVPTLVNQIAKRGRDYENSIRIDYLKRLNERYEAWISTYEQGKLLVIDIDDINFADNPEDLGKIINKINAEINGLF

SEQ ID NO: 3969 - DNA, 471 bp, Unknown
  Obtained from environmental sample
  misc_feature (1)..(471): n is a, c, g, or t
gtgaacacttcaatttactcaaaccaggcccgactcggttcgatagagcaattccgaaagcaaaatggaaccaaatacaaaaaagggattctgatcgtcgaagatgacgccggcgttcggcagttcctgagaatgattctgacctcggatggataccagattttcgaagcggacggcgaagccgaggcgcgaaaaatttgggggcagcatttttctcaaattgatcttttgctcacagacctttgcattccctaccagaccactggcgtgcaactcgcaaaaaagttgcgggtggaaaaatcgtggctcaaagttatttacacgagcgggtttagtcctgaaatcgtcgccgctgacaacctttcacttgtcgaacacgtgaacttcatttgcaaaccctatcccgccagcaaactactggaaacggttcggcgctgcttcgaggaaaaaattagcgaatttgcaaactaa

SEQ ID NO: 3970 - protein, 156 aa, Unknown
  Obtained from environmental sample
  DOMAIN (28)...(151): Response regulator receiver domain
  misc_feature (1)..(156): Xaa is any amino acid
MNTSIYSNQARLGSIEQFRKQNGTKYKKGILIVEDDAGVRQFLRMILTSDGYQIFEADGEAEARKIWGQHFSQIDLLLTDLCIPYQTTGVQLAKKLRVEKSWLKVIYTSGFSPEIVAADNLSLVEHVNFICKPYPASKLLETVRRCFEEKISEFAN

SEQ ID NO: 3971 - DNA, 876 bp, Unknown
  Obtained from environmental sample
  misc_feature (1)..(876): n is a, c, g, or t
ttgtctgccgaagatataggaatatggataaagacggtcaagggaattgatcttccattaattcctgatctcaaaagaattagagaatttactgatggcattcctataattttgaatgaatggataaatcaatctgaaagtttaaactatgatgaattagaagaatttaaaaatagtaggactaataaattcttatgtaaatatattttagaacgtaaaagaattttaaataatgatacactaactataaaaaatctaaaccgtttagtgattcttcttgagccccttaatactactgacttggctaaatatcttaacctggattttgatgatttgcaaatatttattgataaattgttagagagaggcatatttgaaaaaagagatatttatttttggtttagtcatgatttggtaagaaaatgtcttgagaacagtttaacagaagaatatagagaaaatttgcatagatatgctgcaaaattcttcttagacctttttaatgaaggagaaaagttaggaaatgtcaagaatgccgtatttataggatgtgcgtatcatcttcaccaagcaggagaatccatgaaggagaaatgcattcaatttaataaagatctcgcacaaagagcatctagtataggagatctagatcttgctgaacggtgttatgatagaattatagatgattcggaagaagtnaaagatactttagatgcttatcttgcgcttgctcatgatatctatatcgtgtggnggagatacgatgatgcctataccatttatcaagaatttataaaaaatagttcttctaaatcaatctgccaaattctttcttatatggcacaaatacattatataaaaggggatatgaaatag

SEQ ID NO: 3972 - protein, 291 aa, Unknown
  Obtained from environmental sample
  misc_feature (1)..(291): Xaa is any amino acid
MSAEDIGIWIKTVKGIDLPLIPDLKRIREFTDGIPIILNEWINQSESLNYDELEEFKNSRTNKFLCKYILERKRILNNDTLTIKNLNRLVILLEPLNTTDLAKYLNLDFDDLQIFIDKLLERGIFEKRDIYFWFSHDLVRKCLENSLTEEYRENLHRYAAKFFLDLFNEGEKLGNVKNAVFIGCAYHLHQAGESMKEKCIQFNKDLAQRASSIGDLDLAERCYDRIIDDSEEVKDTLDAYLALAHDIYIVWXRYDDAYTIYQEFIKNSSSKSICQILSYMAQIHYIKGDMK

SEQ ID NO: 3973 - DNA, 336 bp, Unknown
  Obtained from environmental sample
  misc_feature (1)..(336): n is a, c, g, or t
ttgccaactgctcatatccttttgtatgcgttatcgggtctgtatattcgcattcagaatctaagctctcttcaaacaaacgaagcctctttaagtgatcatcctccgcccaagcttgtgtatatatttcccagatatcttgacgtaaactatttttcatttggattagagtccaaattaggatcaaaacttctaggaaaaaaaggggtcaagaacaccattaatcacttgtgcatagaaaattgcgccacggctgacttaggtaaactgggtgccgaactgacttattggctttttgaatttttaaaagttgggaaaattaaagttaataattaa

SEQ ID NO: 3974 - protein, 111 aa, Unknown
  Obtained from environmental sample
  misc_feature (1)..(111): Xaa is any amino acid
MPTAHILLYALSGLYIRIQNLSSLQTNEASLSDHPPPKLVYIFPRYLDVNYFSFGLESKLGSKLLGKKGVKNTINHLCIENCATADLGKLGAELTYWLFEFLKVGKIKVNN

SEQ ID NO: 3975 - DNA, 393 bp, Unknown
  Obtained from environmental sample
  misc_feature (1)..(393): n is a, c, g, or t
ttgaccctggtttttaaactgctcgacttgagccactttattcctaggaaaaaaatgaaaaaatattataaagtttttattattttaatgattagtttattcgtgtcttcagcatattctgaaaattttttgagaactagaaatctacgaaaatttcatgaagcagagacattagatctaagaaatcaaaacataaaagatgaagatttgccaaatatattatcttatcttaaccagcattctgaaaanaaaattcttaatttggcagataataaaattccgaaaaaggggcgaccatacttgctgaaaataaacaaatctcaaagggaattactttcaatcttcttggcgataagcgtgcgattccttgggaaaaaaccaacccctacttga

SEQ ID NO: 3976 - protein, 130 aa, Unknown
  Obtained from environmental sample
  misc_feature (1)..(130): Xaa is any amino acid
MTLVFKLLDLSHFIPRKKMKKYYKVFIILMISLFVSSAYSENFLRTRNLRKFHEAETLDLRNQNIKDEDLPNILSYLNQHSEXKILNLADNKIPKKGRPYLLKINKSQRELLSIFLAISVRFLGKKPTPT

SEQ ID NO: 3977 - DNA, 1206 bp, Unknown
  Obtained from environmental sample
  misc_feature (1)..(1206): n is a, c, g, or t
atgcgaagccaattcaaaaggagaagcgtcttttctaataacattggtattatttacgactacgaaggcaattatccgcttgctttaaaaaactactttgaagcgctgaagatccaggaaaagatcaaagataaaaacggagttgcctacaccctgagcaatatcggtttgatctacagcaatcaaaacagcaacgaagaagcgctgaaataccattaccgctcactcctgctcagaaaagaattgaaatttaaaggtggaattgccgcttcttacaacaacatcggaatttgtcacctcaacaccaaagactataaaaaagcgctttattttttctcaagatcgaaagaaattgacgtggaattgaaagattctatgggtttaatggacgatctgaacaacatgggaatctgttatatgaaaaccaaccagattgataaagcgcttgaaactttcaacgaatgcttagaactgcggatccattttgatgatcagttcggaatttcgaaagtatatagcaacatcggaacctgttattccattgacaagcaactggacaaagctgaagaatactttaagaaaggattggaaatagccaaacgaatcaacggaaaagagaacatttggtattcttacgaaaacctgagtgagatctatgaaaccgagggcgatttcaagaaagcgtttgactacatgcgcatggcccagaaggaaaaagatgagctgaccagtgaaagttctattcgggaagaagcagaaacagaactcacctatcagtttgaaaagaaaaatgaactggaacgcgttaaacgcatcaagcaaaatgtaaaagatcaggagcagaaaaagcaagcgcaaattctcgtttggttcatggtgagcattattgcagtggttggtttctttccttgtggttntgntccngacgctggaaaaatagcttctgagcagcgtcgtattattgatttgcagcgcgccgatatttcagaaaagaataccgaaaatgtagactcgatcaactatgccccgcgaaatcaaaacggctatataccatcgccagaatacttgaacagaattttcaaaaacttgccttggttaatcagcccaaaaaattgttgcccgaaattttttcgggaaccccccgtggagggagaaacccattttgccgttgaaattgtcccgaaaaggggtcccgggaaaatttag

SEQ ID NO: 3978 - protein, 401 aa, Unknown
  Obtained from environmental sample
  DOMAIN (9)...(42): TPR Domain
  misc_feature (1)..(401): Xaa is any amino acid
MRSQFKRRSVFSNNIGIIYDYEGNYPLALKNYFEALKIQEKIKDKNGVAYTLSNIGLIYSNQNSNEEALKYHYRSLLLRKELKFKGGIAASYNNIGICHLNTKDYKKALYFFSRSKEIDVELKDSMGLMDDLNNMGICYMKTNQIDKALETFNECLELRIHFDDQFGISKVYSNIGTCYSIDKQLDKAEEYFKKGLEIAKRINGKENIWYSYENLSEIYETEGDFKKAFDYMRMAQKEKDELTSESSIREEAETELTYQFEKKNELERVKRIKQNVKDQEQKKQAQILVWFMVSIIAVVGFFPCGXXPDAGKIASEQRRIIDLQRADISEKNTENVDSINYAPRNQNGYIPSPEYLNRIFKNLPWLISPKNCCPKFFREPPVEGETHFAVEIVPKRGPGKI

SEQ ID NO: 3979 - DNA, 660 bp, Unknown
  Obtained from environmental sample
  misc_feature (1)..(660): n is a, c, g, or t
atgattttcagtgtgatggatattaaacctgaaaatcaaccgcatattcttaagtggggaattctgagtgcaatcgtttttagaatatttttcatctttgccggagtggcattgatcaacctattccaccctatcatttatgtttttgcaatcatactactttttgcttcttacaaaatggcatttggcggtgagcagaaaattgatgtggaaaataactggttaattaaaattgccagaaaatattttaaacttaatactgcttacgaaggcaaaaagttttttataaaaattaataaaaaattttacatcacaacaacttttcttacacttcttttaatagaatcttcagatatagtttttgcagtagattcaattccagccattatagctataacaaaagatactttcataataatttcttcaaacatcttcgctatccttggattgcgtgctttgtattttgccctggcaggattggtcgatttatttgtttacttaaaatatggtgtatcaataatacttttttatgtcggtataaaaatgctgctttctgaaatttataaaataccaacagagttttccctggccataataatattattcctgggcggttcaatcctgttatcactttttaaacggaatcgatttaaacattaa

SEQ ID NO: 3980 - protein, 219 aa, Unknown
  Obtained from environmental sample
  DOMAIN (1)...(210): Integral membrane protein TerC family
  misc_feature (1)..(219): Xaa is any amino acid
MIFSVMDIKPENQPHILKWGILSAIVFRIFFIFAGVALINLFHPIIYVFAIILLFASYKMAFGGEQKIDVENNWLIKIARKYFKLNTAYEGKKFFIKINKKFYITTTFLTLLLIESSDIVFAVDSIPAIIAITKDTFIIISSNIFAILGLRALYFALAGLVDLFVYLKYGVSIILFYVGIKMLLSEIYKIPTEFSLAIIILFLGGSILLSLFKRNRFKH

SEQ ID NO: 3981 - DNA, 837 bp, Unknown
  Obtained from environmental sample
  misc_feature (1)..(837): n is a, c, g, or t
gtgntgtttcctcagataaaaaacatcgtacaaaaaagtttgttcccgcagatgatattttcaattcttttgatggtggtgatttctactgccttttaccttaccgttcgtaccatgatacgcaaaaaaaaacttagcgagataaaaaatgattttatcaataacatgacgcatgagtttaaaacgccgctggcaaccatctcactggcagtggatgccttaaaaaacgaaaaggttaccaacgatccccaaaaacttggttatttcaggagcattattaaagaagaaaatcaacggatgaacaggcaggtggaaactattttgaaatcagcattaatggaaaggcaggaagtagagctaaacctgaaacctattaatgtacaccaggtaattgaagatgtcgtagataattttatgctgcggctagatgaaaaaggaggtacacttgaaatgaatttacacgcagggcaatttatcattgaagcagatgaagttcacttttctaaccttatcaataatttgctggacaatgctgtgaagtactccaaagaaaatgttccgccaaaagtttgcattaccactacttctaatgcaaaaaagattttcataaaaattgaagacaatggcattggtatgacaagggaaaccttgaaacgcatatttgaaaaattttacagggcccacacaggcaatattcataatgtaaagggttttggcctgggattgagttatgtcaaaaccgttgttgaagcacatgaaggagtaataaaagcagatagtattttaggtaaaggaagctgttttaccatagaattaccattgcaaaaggaattataa

SEQ ID NO: 3982 - protein, 278 aa, Unknown
  Obtained from environmental sample
  DOMAIN (48)...(116): His Kinase A (phosphoacceptor) domain
  misc_feature (1)..(278): Xaa is any amino acid
MXFPQIKNIVQKSLFPQMIFSILLMVVISTAFYLTVRTMIRKKKLSEIKNDFINNMTHEFKTPLATISLAVDALKNEKVTNDPQKLGYFRSIIKEENQRMNRQVETILKSALMERQEVELNLKPINVHQVIEDVVDNFMLRLDEKGGTLEMNLHAGQFIIEADEVHFSNLINNLLDNAVKYSKENVPPKVCITTTSNAKKIFIKIEDNGIGMTRETLKRIFEKFYRAHTGNIHNVKGFGLGLSYVKTVVEAHEGVIKADSILGKGSCFTIELPLQKEL

SEQ ID NO: 3983 - DNA, 381 bp, Unknown
  Obtained from environmental sample
  misc_feature (1)..(381): n is a, c, g, or t
atgaaaagaaaaaaaattttcattttgatcatatctgttgaattgatatgtatactttggcttagtatctcttcttttcaaaagcaatatgctacaaaggtatacgtaaactggatggatgggcactcatttgtctttcataaaatagattcattgaagagcttttatgagcccaagcctcatacaaaagcagtacaatccttgaaatttttaggagatgagtacaactatagcgttacctacacgtataacaatgatggattacatcaaaaagaaaatacccctgtgaataagtcggtagggacatatagaattatgacagtaggtgattcatttacatttggatataatctcaatactgaggatacattcctcacataa

SEQ ID NO: 3984 - protein, 126 aa, Unknown
  Obtained from environmental sample
  misc_feature (1)..(126): Xaa is any amino acid
MKRKKIFILIISVELICILWLSISSFQKQYATKVYVNWMDGHSFVFHKIDSLKSFYEPKPHTKAVQSLKFLGDEYNYSVTYTYNNDGLHQKENTPVNKSVGTYRIMTVGDSFTFGYNLNTEDTFLT

SEQ ID NO: 3985 - DNA, 387 bp, Unknown
  Obtained from environmental sample
  misc_feature (1)..(387): n is a, c, g, or t
atggcaaaaaaaaatctttttttcatcctctttgtacaaatgacaatactcttgattttattgctttccttcaaaccatttacccaaaagtcttctttattgattcccacaccaatcaactctcccgataaaatataccttgaaaaagcaaaatggaaacagtatttattgaaagttggtgcagaaaaaggatataaagattttatcacttcctacaaaaatgtaaaaaattataatgtgaaacacggatctctccactatattggagagattctctatgaaagtgaaggagctaaaggtataaagatatgtgatgattcttttttttatgcatgttatcacggattttttggacaattctttcaaaaaaaggcatatccgatatag

SEQ ID NO: 3986 - protein, 128 aa, Unknown
  Obtained from environmental sample
  misc_feature (1)..(128): Xaa is any amino acid
MAKKNLFFILFVQMTILLILLLSFKPFTQKSSLLIPTPINSPDKIYLEKAKWKQYLLKVGAEKGYKDFITSYKNVKNYNVKHGSLHYIGEILYESEGAKGIKICDDSFFYACYHGFFGQFFQKKAYPI

SEQ ID NO: 3987 - DNA, 888 bp, Unknown
  Obtained from environmental sample
  misc_feature (1)..(888): n is a, c, g, or t
atgtatggctatgcaaaggatacaactcctcatatagatgcttggttcaaaaatggagtcatattttcaaatatgcatactattgttccgtctacttatccctcttttgtaacgctgatgaccggtctaagcccatttgagagtaatatatttagcaatttcgatattttacatagtacaggagaggatgataatcggaaattccaaaaaataactgcaagtacaccgcttttagcagagatctttaaaaaaaacggatataaaacggctgcttatataacgaacggtgttttggatgggaatgcaacaggattacaaaggggttttgatttgtatagaatccaagggagaggatttaatagggagaatattaaaggaataaatgaattgccaacaaacagtgaaaataaaaagtataaaaacatagttaatgaagccgcagagtggatacaggcaaataaaagttcacatttttttatgtggcttcatattatggaccctcattcaccctatgttcctgataaagagtatgtttgctcaacaaataggaaatattgtgaccaaattcaaaaaaacggtttagcaaatttagaattattacgaaactctcttgcaggatgtcagaaaaaattacttcctagtgaagaagtagaggtatttgaaacactttatgatggagcaatcaaatcaatggataggatgattgggaaatttctagacagactagataaggaaaatattagtgataatactatagtattactttatggcgatcatggagagggttttgatcataacgtgtattttgagcatataaacgatctgtataattcacatacgcgcattccttttatcattaaatatccttccttagagaaaaggaaatga

SEQ ID NO: 3988 - protein, 295 aa, Unknown
  Obtained from environmental sample
  DOMAIN (1)...(295): Sulfatase
  misc_feature (1)..(295): Xaa is any amino acid
MYGYAKDTTPHIDAWFKNGVIFSNMHTIVPSTYPSFVTLMTGLSPFESNIFSNFDILHSTGEDDNRKFQKITASTPLLAEIFKKNGYKTAAYITNGVLDGNATGLQRGFDLYRIQGRGFNRENIKGINELPTNSENKKYKNIVNEAAEWIQANKSSHFFMWLHIMDPHSPYVPDKEYVCSTNRKYCDQIQKNGLANLELLRNSLAGCQKKLLPSEEVEVFETLYDGAIKSMDRMIGKFLDRLDKENISDNTIVLLYGDHGEGFDHNVYFEHINDLYNSHTRIPFIIKYPSLEKRK

SEQ ID NO: 3989 - DNA, 897 bp, Unknown
  Obtained from environmental sample
  misc_feature (1)..(897): n is a, c, g, or t
gtgacaagaaggctttttgaatctggttatattgattcattaaccattcagcccgactcgctgcagtttgctatcatcctgaaaaaataccagcgggacaaaaaactaaaagcagatggcaaaattggcgcacaaacaatacgaatgttgaatttgtccgaccaggaaaaattcaatcgtattgctattacaatggatagatataaaatgttgcccgaaaagatgcccgggaagtatatctgggtgaacattccttcattttcattaaagttgctgagtaatgatacattgatagtgagcagcaaggtcgtggtcggtaaaccacaaacaaggactcctgtacttaccagcgctgtatcagaaatgatcacctatccgcaatggaccattccggaaagcattattgaaaaagaaatcttaccgggaataaaaaaagacacagcatatcttacaaaaaagggatatagtttactgaatagtaagaacgaagaagtagatccggattctgtcgattggtcaaagtatacaaagcggataccttataaagttatccagggcagtggtgatgacaatgcgcttggcgttttgaaatttaatttttacaataaatattccgtttatctgcatgatacaaatcaacgttctttttttgggtctgattcaagggcattgagtcatggttgtgttcgggtccaggaatgggaaaaaatggcttattatatcatggagaatgagaagaacgtgaccaatgcgggcaaatcaaaagcaattccggtagattcactcactcattggctggaaataaagaaaaacacagcatacccatacgatccaaagtgccggtttttatcaggtattttacctgcgaggcaaacagggacaaatcagtttttttga

SEQ ID NO: 3990 - protein, 298 aa, Unknown
  Obtained from environmental sample
  misc_feature (1)..(298): Xaa is any amino acid
MTRRLFESGYIDSLTIQPDSLQFAIILKKYQRDKKLKADGKIGAQTIRMLNLSDQEKFNRIAITMDRYKMLPEKMPGKYIWVNIPSFSLKLLSNDTLIVSSKVVVGKPQTRTPVLTSAVSEMITYPQWTIPESIIEKEILPGIKKDTAYLTKKGYSLLNSKNEEVDPDSVDWSKYTKRIPYKVIQGSGDDNALGVLKFNFYNKYSVYLHDTNQRSFFGSDSRALSHGCVRVQEWEKMAYYIMENEKNVTNAGKSKAIPVDSLTHWLEIKKNTAYPYDPKCRFLSGILPARQTGTNQFF

SEQ ID NO: 3991 - DNA, 582 bp, Unknown
  Obtained from environmental sample
  misc_feature (1)..(582): n is a, c, g, or t
ttggcaaaaattctgctgaaaccatcaaacttgcttctgttagatgaacctacgaaccatctggacatgcaatccaaagaaattttgcttcgcgcgttgcaagaatatgaaggaacaattttgttcatttctcatgatcgctattttatggatcagcttgctcaaaaagttttggaattaaaagatgggattttgaccgaatatctcgggacttattctgagtatcttgcaaaaataactaccagtgaagttcggccagaaattgagaccgctgagctgccgcaaccatcaacgcataaaacaaaagatcaaaaaaagcaggaagcattaaatcggcaggaacaagcaagatggaaaaaggaatttttgcagccgattcaagatttagaagcaaaaattgcgaaacatgagacgagattgaaagaacttgagcaaattcttgctgatgaaaatacgtatcaagagaaaaatagatacttcgagttaattgatgaatatcaaaagctcaaatccacgattcaagaatcctacaaaaattgggaacacctccaaactcgattgaatcaatctaagccacaataa

SEQ ID NO: 3992 - protein, 193 aa, Unknown
  Obtained from environmental sample
  misc_feature (1)..(193): Xaa is any amino acid
MAKILLKPSNLLLLDEPTNHLDMQSKEILLRALQEYEGTILFISHDRYFMDQLAQKVLELKDGILTEYLGTYSEYLAKITTSEVRPEIETAELPQPSTHKTKDQKKQEALNRQEQARWKKEFLQPIQDLEAKIAKHETRLKELEQILADENTYQEKNRYFELIDEYQKLKSTIQESYKNWEHLQTRLNQSKPQ

SEQ ID NO: 3993 - DNA, 384 bp, Unknown
  Obtained from environmental sample
  misc_feature (1)..(384): n is a, c, g, or t
atgggtttgatccttaatcccaagactgccatgcaaaaagagttaagaaatacggatgaggctattattgatgtaattaaaaagcacccgcggtttttcagacctccttatggcattactaaccncaatctggcaggggcagtaataggaggttcgtatgagactattggctggagtattcgttcgtttgacactattagtaaaaataaaaccaagctatggaaccgtattaccggtagcctgaaacccggtgacatagttttgtttcatgactattgcgatatcacgattgaattactgccagactttattgatcatacagaaaaggttggtttgaaaattgtaaggttggatgaactggtaaacttagagccgtatgcgtaa

SEQ ID NO: 3994 - protein, 127 aa, Unknown
  Obtained from environmental sample
  misc_feature (1)..(127): Xaa is any amino acid
MGLILNPKTAMQKELRNTDEAIIDVIKKHPRFFRPPYGITNXNLAGAVIGGSYETIGWSIRSFDTISKNKTKLWNRITGSLKPGDIVLFHDYCDITIELLPDFIDHTEKVGLKIVRLDELVNLEPYA

SEQ ID NO: 3995 - DNA, 729 bp, Unknown
  Obtained from environmental sample
  misc_feature (1)..(729): n is a, c, g, or t
gtggaggaggccaaaaaaggagtggtatcctcactatgttcctggccaacggattgttttgatgaaatttgcctaatggaaatactcttaaaatatttttctgattttacaccaaaacaaatagagcaatacaaagctttggaaaatttgtataaggaatggaatgaaaagataaacgtcatctcaagaaaagacattgaaaggctgtacgaaaaacatgtacttcattcactagctatcgcggcagcttttgactttccaccaggactaaatattattgacataggaaccggcggtggctttcccggagtgccgcttgctatattttttcctgaagtaaattttcatttagtggacagcattggcaaaaaattaaaaattgttgatgtagtgtcagaggctatcggtttaaataacataaccacacagcatattcgtgcagaagaaataaagaacaggaaatttgatttcgcgataagtcgcgccgtggcatcgttaaaagatctttggcgatggagcaaacccttgttgaaaggatcaaactacaagacacagggtataagtgaagaacaaatattgcttaaatcaggattgatttgcctcaaaggtggtgacttaacacaagagataattgaaagcggaaccaaaccaaaaagtatagagatcacagatttgtttgatgaagaattttttaaagagaaatatttattgtacgtgtctagaggctga

SEQ ID NO: 3996 - protein, 242 aa, Unknown
  Obtained from environmental sample
  DOMAIN (40)...(211): Glucose inhibited division protein
  misc_feature (1)..(242): Xaa is any amino acid
MEEAKKGVVSSLCSWPTDCFDEICLMEILLKYFSDFTPKQIEQYKALENLYKEWNEKINVISRKDIERLYEKHVLHSLAIAAAFDFPPGLNIIDIGTGGGFPGVPLAIFFPEVNFHLVDSIGKKLKIVDVVSEAIGLNNITTQHIRAEEIKNRKFDFAISRAVASLKDLWRWSKPLLKGSNYKTQGISEEQILLKSGLICLKGGDLTQEIIESGTKPKSIEITDLFDEEFFKEKYLLYVSRG

SEQ ID NO: 3997 - DNA, 321 bp, Unknown
  Obtained from environmental sample
  misc_feature (1)..(321): n is a, c, g, or t
atgtctattataacaaatgggtttatggaatcacaacatatcaagcttgaatcatcaggtattaaaaaatacttcaggcatatatttatttctgaagaaatcggttttataaaacctgatccaagagttttcatacatgccttatctcattcgaaaatatctgatgccgaagcaataatgattggtgatacttatgagaccgatatagtaggcgcgagtgcagcaggcattgaccaggtgtttttcaaccacagaaacaatgacgtttacaaatcaacttacacgattaaaaacctgaaggagctgctggatattatttaa

SEQ ID NO: 3998 - protein, 106 aa, Unknown
  Obtained from environmental sample
  misc_feature (1)..(106): Xaa is any amino acid
MSIITNGFMESQHIKLESSGIKKYFRHIFISEEIGFIKPDPRVFIHALSHSKISDAEAIMIGDTYETDIVGASAAGIDQVFFNHRNNDVYKSTYTIKNLKELLDII

SEQ ID NO: 3999 - DNA, 504 bp, Unknown
  Obtained from environmental sample
  misc_feature (1)..(504): n is a, c, g, or t
atggatggcattattggtgagttagttgttagaggttcaaatgtaatgcgtggttattggaatgctcctgagttaactaaaacagtttttaaaaacgagggaattttaggagagagatatctatatacgggagatttgttccataaggataaagaaggttttttatattttcatggcagaaaggatgatctaataaaaaccaaaggggaaagagttagccccaaagaaattgaaaatgtaatttataaaattgaggatgtaattgaagctgcagttattggtatacctgatgaaattcttggaaatgctttggaagcttttattgtaaaaaagaatggatctcccctgaatgaaaaagacattcaaaaattttgttctgaaagattagaaaattttatggttccaaaatacgttgtttttataagtgaattaccaaagactgagaatgggaaaattaatagaaaagcaataaaggaactgaaacacgagttatttactaattaa

SEQ ID NO: 4000 - protein, 167 aa, Unknown
  Obtained from environmental sample
  misc_feature (1)..(167): Xaa is any amino acid
MDGIIGELVVRGSNVMRGYWNAPELTKTVFKNEGILGERYLYTGDLFHKDKEGFLYFHGRKDDLIKTKGERVSPKEIENVIYKIEDVIEAAVIGIPDEILGNALEAFIVKKNGSPLNEKDIQKFCSERLENFMVPKYVVFISELPKTENGKINRKAIKELKHELFTN

SEQ ID NO: 4001 - DNA, 408 bp, Unknown
  Obtained from environmental sample
  misc_feature (1)..(408): n is a, c, g, or t
atgaattatccttttttatcaaatattaaatatctttttgttaaaagtcgttcattttcaaatttaaaagatactgcaacttttgtaacaaaatctaaattattaggaaaaggagttgaattatgtggatggaatattagtccactccaatcttctattaatttaaatcgtccagaagttttacttcaaacaataaaaacacctcaatatgcagatattataaccaatactggaattttacatgatggaattattcatccacaagtatctttaggatatcatttattaaatttaaatttaaaaaataaatattatattggaataccagaaagacataatgatggaattgtaaatccaacagtattaggaccaaaaatattaaaaattttaaaaaataaacaagattaa

SEQ ID NO: 4002 - protein, 135 aa, Unknown
  Obtained from environmental sample
  misc_feature (1)..(135): Xaa is any amino acid
MNYPFLSNIKYLFVKSRSFSNLKDTATFVTKSKLLGKGVELCGWNISPLQSSINLNRPEVLLQTIKTPQYADIITNTGILHDGIIHPQVSLGYHLLNLNLKNKYYIGIPERHNDGIVNPTVLGPKILKILKNKQD

SEQ ID NO: 4003 - DNA, 369 bp, Unknown
  Obtained from environmental sample
  misc_feature (1)..(369): n is a, c, g, or t
gtggtcaacaacatctattcggctctgaaacccggcggcgtgctggtaatggattatatcaattccatcccggctgaaaagaaattaatagggaatgaagaaaaagaaatagatggcatcatctacaacatcaatcgttggacgaacgaaactcattttttcaagaagatcagaattgacaacatcgcaatggcggaaccagttgaacacattgagagggtgaaaaaatttagcgtcgatgactttcaaaatttgttcacggccaatggacttcaactggaaaaagtgtacggtgactattatttgaatgaatacgacccagaaaattctccaagattgatcttaatagctaaaaaaatcaaatcgtga

SEQ ID NO: 4004 - protein, 122 aa, Unknown
  Obtained from environmental sample
  misc_feature (1)..(122): Xaa is any amino acid
MVNNIYSALKPGGVLVMDYINSIPAEKKLIGNEEKEIDGIIYNINRWTNETHFFKKIRIDNIAMAEPVEHIERVKKFSVDDFQNLFTANGLQLEKVYGDYYLNEYDPENSPRLILIAKKIKS

SEQ ID NO: 4005 - DNA, 651 bp, Unknown
  Obtained from environmental sample
  misc_feature (1)..(651): n is a, c, g, or t
gtgttacaaacctttgataacacagagcaggatgactttatagacgagactggcattcccagggaagttttccagttagattatttgatgacacccagcctacccatctacggaaaagcaagcgctggacctgatggccaggttctcctggacgaaccgaatttcggcggagcagttgacgaatcttccttcattcgcatcgatggacaggaatacgatcttcatacgctcaaaggcgatgaccatcaaatcaatatctcacttagagactttgtgtcatccattcttcccaagaagctgggcaaaaccggtgggaaagcgtatggctggctaaaagtaattgggaatagtatgaacgatactaaactgattccgatcaatgaaggcgattatgtattgttctttgagaaccgcaaccccactgtaagcaaaattgttattgctgcgcagtcaacacccgaaacaggaacgcttcgacttttcataaaacaactcattaaaaagaatgatcaattattcttacactcgcagtctcacggcaaggatccagataccggacgagattatgaagacatggaagtaaatgaccggtatcagataattggagaggtggttgcggtagcaaagcaaaagaaaaccaagacccactaa

SEQ ID NO: 4006 - protein, 216 aa, Unknown
  Obtained from environmental sample
  misc_feature (1)..(216): Xaa is any amino acid
MLQTFDNTEQDDFIDETGIPREVFQLDYLMTPSLPIYGKASAGPDGQVLLDEPNFGGAVDESSFIRIDGQEYDLHTLKGDDHQINISLRDFVSSILPKKLGKTGGKAYGWLKVIGNSMNDTKLIPINEGDYVLFFENRNPTVSKIVIAAQSTPETGTLRLFIKQLIKKNDQLFLHSQSHGKDPDTGRDYEDMEVNDRYQIIGEVVAVAKQKKTKTH

SEQ ID NO: 4007 - DNA, 471 bp, Unknown
  Obtained from environmental sample
  misc_feature (1)..(471): n is a, c, g, or t
ttgcatggtggtatatatactagtaagagtttttgtttatatatcattaagcctttgaaaaataaagtaatattaagaggaaattacatgtcacgtattatccctattaacgaaccagttgtaccttcagaatttggatatggttcaggttggcgctcttttgaaagtaaatttcactctcgtggcaaggtttgtactctcaatagtaagcagtatgtcattgttataaaaaaagccaaagaccgtcttggtattggtaaaatttgtgtggttattgcggcttttttacttacttgtgggcttatctgtcgttctacacgatttaaaaattgggcaatgaaacaaacacactcagagaaagtccgttttgctatacctgtagataactttactaagttacaggctatgcctcaacgtgatgaaattgccaagaaattggcagacctcaactcatttatcgagatcatataa

SEQ ID NO: 4008 - protein, 156 aa, Unknown
  Obtained from environmental sample
  misc_feature (1)..(156): Xaa is any amino acid
MHGGIYTSKSFCLYIIKPLKNKVILRGNYMSRIIPINEPVVPSEFGYGSGWRSFESKFHSRGKVCTLNSKQYVIVIKKAKDRLGIGKICVVIAAFLLTCGLICRSTRFKNWAMKQTHSEKVRFAIPVDNFTKLQAMPQRDEIAKKLADLNSFIEII

SEQ ID NO: 4009 - DNA, 372 bp, Unknown
  Obtained from environmental sample
  misc_feature (1)..(372): n is a, c, g, or t
ttgaaaaaacagggatcccgttccggtttcaacgcttatttgatgaaagcagttttgtttgacagagttgctttgattcaaaacgggaaatttctttctatcaatacaccccaggggcattgtttgaagtttttcaaaaccattgtggcccgtgaagtcatcaaggatgctttcattattaaacgagtggttcaaaaagattttgtagaagatgtttatccttttggagaatatcatcatgtggtgatgaaagacaggtcaggtgagccgttgcttcgccaatttatccgggagcataataatgaacatgcagttttgcaaacgacacaaccagatatagaagattgttttattgcattaatgaagaattaa

SEQ ID NO: 4010 - protein, 123 aa, Unknown
  Obtained from environmental sample
  misc_feature (1)..(123): Xaa is any amino acid
MKKQGSRSGFNAYLMKAVLFDRVALIQNGKFLSINTPQGHCLKFFKTIVAREVIKDAFIIKRVVQKDFVEDVYPFGEYHHVVMKDRSGEPLLRQFIREHNNEHAVLQTTQPDIEDCFIALMKN

SEQ ID NO: 4011 - DNA, 429 bp, Unknown
  Obtained from environmental sample
  misc_feature (1)..(429): n is a, c, g, or t
ttggtaaattcgatgctaatttattcaaaagaaaaaacacaagagcagaanatgaccagggaacagaacaagtcccgggattttaatttgatatttatacatagagtattcaagtcctggtcaacaggacttttttgttttagttacttttggagattatgtacaaattttgcatcattggttgtggacgaattgcgcaacgacatgcagaaaatattagtaggggtgaaaaactggttgcggtttgcgatttggaaaaaccaaagccgattgatttgccagcaaatatcaggtaaagcctggtactctataacaaattttaaaaaaggaaaaaaaaaaatgaatccgggttgccctccaaggacttcggcaaaaattcaaaaaaattttacggaaggcaaaatgttctttgaaaaaacaaggttttaa

SEQ ID NO: 4012 - protein, 142 aa, Unknown
  Obtained from environmental sample
  misc_feature (1)..(142): Xaa is any amino acid
MVNSMLIYSKEKTQEQXMTREQNKSRDFNLIFIHRVFKSWSTGLFCFSYFWRLCTNFASLVVDELRNDMQKILVGVKNWLRFAIWKNQSRLICQQISGKAWYSITNFKKGKKKMNPGCPPRTSAKIQKNFTEGKMFFEKTRF

SEQ ID NO: 4013 - DNA, 657 bp, Unknown
  Obtained from environmental sample
  misc_feature (1)..(657): n is a, c, g, or t
ttggagattatgtacaaatttgccatcattggttgtggacgaattgcgcaacgacatgcagaaaatattagtagggttggaaaacttgttgcggtttgcgatatagaaaaacaaaaagcagatgaatttgcaggcaaatatcaatgtaaagcctggtactctatagacgaacttttaaaaaaggaaaaagaaatagatgtaatcagtgtttgcactccaaatggacttcatgcagaacatacaataaaatctttacaggaaggcaaacatgttctttgcgaaaaaccaatgtgtattacgagtgctgctgcatggcaaatgatcaacacagaaaaatttagccgtaaaaaattgtttgttgtaaaatcagccaggtttaattctttacttaaacatttaaatgatttaattgaaaagggcagtttaggaaatctgtatagctttcagttaagttgtttctggagccggccaaaaaactactatgaagactggcatggaaaattgtttccggacggaggcacattatatacccaattcagtcattacattgatgctatgatttggttgtttggtgaaatagatgacgtgaagggttatcgtgaaaataaagcacataagaacgttatagaatttgaagatacgggcaccattgcgtaa

SEQ ID NO: 4014 - protein, 218 aa, Unknown
  Obtained from environmental sample
  DOMAIN (5)...(122): Oxidoreductase family, NAD-binding Rossmann fold
  misc_feature (1)..(218): Xaa is any amino acid
MEIMYKFAIIGCGRIAQRHAENISRVGKLVAVCDIEKQKADEFAGKYQCKAWYSIDELLKKEKEIDVISVCTPNGLHAEHTIKSLQEGKHVLCEKPMCITSAAAWQMINTEKFSRKKLFVVKSARFNSLLKHLNDLIEKGSLGNLYSFQLSCFWSRPKNYYEDWHGKLFPDGGTLYTQFSHYIDAMIWLFGEIDDVKGYRENKAHKNVIEFEDTGTIA

SEQ ID NO: 4015 - DNA, 702 bp, Unknown
  Obtained from environmental sample
  misc_feature (1)..(702): n is a, c, g, or t
atggttgcgcacggcgtttaccataagtttgtaattatggatgattttaaaaagtattttgatgcgaataaggatttgtggaaccaacgggtagctgtacataaagattctgccttttatgatgtggatggatttaaaaaaggcgacagctctttaaaacaaattgaactaagtgaactgggcgatgtaaatggtaaaaagttgctgcacctgcaatgccattttggaatggacactctttcctgggcacgactgggcgcagaagtaacagggattgatttttctgaaggcgccattgataccgcaaataagctaagcgctgaaaccggcataccggccacatttatttgtgcaaacctttacgatatcaaagatcacctgcatgaaaaatttgatatcgtttacacttcttacggcgttatttgctggctgcctgacctggaaaaatgggcggatttaattgcttcttatttaaaaccgggcggcgtcttttatatggcggaatttcacccggtgctatggatgtttgatgaaaattttgaaaaagtaaaatactattatcataaccaggagttgattacggttaacagcgaaggcacctatgcagataaatatgcggacattaaagcaaaagaatatagctggaaccacagcctaagcgaagtgatcaatgttttaataagccgtgngtttacgcattga

SEQ ID NO: 4016 - protein, 233 aa, Unknown
  Obtained from environmental sample
  misc_feature (1)..(233): Xaa is any amino acid
MVAHGVYHKFVIMDDFKKYFDANKDLWNQRVAVHKDSAFYDVDGFKKGDSSLKQIELSELGDVNGKKLLHLQCHFGMDTLSWARLGAEVTGIDFSEGAIDTANKLSAETGIPATFICANLYDIKDHLHEKFDIVYTSYGVICWLPDLEKWADLIASYLKPGGVFYMAEFHPVLWMFDENFEKVKYYYHNQELITVNSEGTYADKYADIKAKEYSWNHSLSEVINVLISRXFTH

SEQ ID NO: 4017 - DNA, 804 bp, Unknown
  Obtained from environmental sample
  misc_feature (1)..(804): n is a, c, g, or t
atgtcatatccttaccaggttcaatcattagaagaatataaagaagcttacaaaaaaagtatagaggaacccgagtcattctggagtgatatagcccaacatttcttgtggaaaaaaaagtgggataaagttttagaatggaatttcaaggaacccgatactaaatggtttatcaatggcaaattgaatattacagaaaactgtattgacaggcacctggcaacaatgggtgagaagccagctattatctgggaacccaacaacccggaagaccgcgtacgtatagttacctataatcgtttacataaaagggtttgccagtttgcacaagtgcttattaacaatggcgtaaaaaaaggtgaccgtgtttgtatttatatgggtatggttcccgaactggtatatgccgtattgggttgtgcaagagttggtgccattcatagtgtaatctttggtggcttttctgcacaaagtattgcggacaggctggaagatgcaggggctgaatatattgtaacctgcgatggtgcctaccgtggcgaaaaaattattccgttaaaagacgtaattgatgatgcattgatcgggaataaaacagttaagcgagttattgtatacacacgtacccgcacacccgtttccatgatcaaaggcagagatgtttggtgggaagatgaaatggaacatgccgaaacccaggtggaaaaagataatgttgtctcaatgccggccaccgaaaacgacgccgaagatccgttgtttattttatacacttcgggtagtaccggaaaaccaaaggtgtag

SEQ ID NO: 4018 - protein, 267 aa, Unknown
  Obtained from environmental sample
  misc_feature (1)..(267): Xaa is any amino acid
MSYPYQVQSLEEYKEAYKKSIEEPESFWSDIAQHFLWKKKWDKVLEWNFKEPDTKWFINGKLNITENCIDRHLATMGEKPAIIWEPNNPEDRVRIVTYNRLHKRVCQFAQVLINNGVKKGDRVCIYMGMVPELVYAVLGCARVGAIHSVIFGGFSAQSIADRLEDAGAEYIVTCDGAYRGEKIIPLKDVIDDALIGNKTVKRVIVYTRTRTPVSMIKGRDVWWEDEMEHAETQVEKDNVVSMPATENDAEDPLFILYTSGSTGKPKV

SEQ ID NO: 4019 - DNA, 360 bp, Unknown
  Obtained from environmental sample
  misc_feature (1)..(360): n is a, c, g, or t
ttgagagataatttctggatcactgacttacgacgattcgtttcatccatagtcaatcaagtagttgtcaccctgaagaagctgcccaacggtgtgcgttactggnncgctggtgagagtcgatcgtcgaaacggaaaaactgccaagcttggaaaatgctgaaaaacgtggcgcatacagccgtccagtgcacgctttntagcctgcttttgncccaaagccactcatttttgtttttgatcttccaaatagataccatgccctttttgatttggtgccaagccattacaaccggttacctaaaaaggctaacaacctcaaccgcaaggcttcatattaaaaaaaacgaaatcccctaa

SEQ ID NO: 4020 - protein, 119 aa, Unknown
  Obtained from environmental sample
  misc_feature (1)..(119): Xaa is any amino acid
MRDNFWITDLRRFVSSIVNQVVVTLKKLPNGVRYWXAGESRSSKRKNCQAWKMLKNVAHTAVQCTLXSLLLXQSHSFLFLIFQIDTMPFLIWCQAITTGYLKRLTTSTARLHIKKNEIP

SEQ ID NO: 4021 - DNA, 537 bp, Unknown
  Obtained from environmental sample
  misc_feature (1)..(537): n is a, c, g, or t
atgagtgataatagaaaaaaaaggcggcaagaaattatacaagcttggcatgaggatttgagtaaatatccacacagaccatggctaaaggaagtttcaattatagctattgcctggtataggtatgggcagttagttgataatatgcctgaagggttattaaagaaaattaagctaaaattttattggctaatatttcatttaatagaaatagctattggcgtttctctgccgaaatctgctgaaattggtggtggtttaagaattcatcattttggcaatatttttatacatagaaatgcgaagataggcaaaaattgtgttttgaggcagggtgttacgatcggcaatagacataatgatgatttagttccggaaatatctgatagcgttgagttaggggcttatgctcagatattaggtaatgtgaaattaggcaagaattccaaggtcggtgcaatgactgttgttttacaggatgttccctctggaaaaactatttgcggtaatcccggcaggataattaatagggtttag

SEQ ID NO: 4022 - protein, 178 aa, Unknown
  Obtained from environmental sample
  DOMAIN (100)...(117): Bacterial transferase hexapeptide (three repeats)
  misc_feature (1)..(178): Xaa is any amino acid
MSDNRKKRRQEIIQAWHEDLSKYPHRPWLKEVSIIAIAWYRYGQLVDNMPEGLLKKIKLKFYWLIFHLIEIAIGVSLPKSAEIGGGLRIHHFGNIFIHRNAKIGKNCVLRQGVTIGNRHNDDLVPEISDSVELGAYAQILGNVKLGKNSKVGAMTVVLQDVPSGKTICGNPGRIINRV

SEQ ID NO: 4023 - DNA, 474 bp, Unknown
  Obtained from environmental sample
  misc_feature (1)..(474): n is a, c, g, or t
ttgcataagaagacgttattgaaaattttcagtgcatgcataatgccaaaaatgaagctcgttatgcatacaataatattctctatcnntataancaaatattctgtcaattataatgcaatccctcatgctattttcacaagtccacaaatngcaggtgtaggatatacagacaacaatttaaagaaagagaacatagaatatgttaaatctacatatccttatattgaaacaggaatgggaaaagcaatagaagataaagatggatttgtaaaatttcttattgataaaaaaaataaatatattcttggatgtcatattatgggaacagatgcatcgattttaattcatgaagtactggtggcaatgagaacaggtaatggtacagtagataacatcactcaaactatacacatacatcctgcattatcagaggtagtaagcaaagcagctgcttctattaataatctttga

SEQ ID NO: 4024 - protein, 157 aa, Unknown
  Obtained from environmental sample
  DOMAIN (41)...(151): Pyridine nucleotide-disulphide oxidoreductase, dimerisation domain
  misc_feature (1)..(157): Xaa is any amino acid
MHKKTLLKIFSACIMPKMKLVMHTIIFSIXIXKYSVNYNAIPHAIFTSPQXAGVGYTDNNLKKENIEYVKSTYPYIETGMGKAIEDKDGFVKFLIDKKNKYILGCHIMGTDASILIHEVLVAMRTGNGTVDNITQTIHIHPALSEVVSKAAASINNL

SEQ ID NO: 4025 - DNA, 900 bp, Unknown
  Obtained from environmental sample
  misc_feature (1)..(900): n is a, c, g, or t
atgcggatcgcttatattgcaactggagccgcgggaatgtattgcggcacctgccttcacgataacacgctcgcagctgcgctcatcaaaaaaggacatcaggtagcattgattccaacgtacactccgatccgcacggatgaagaagatgtcagcatgaatcagatcttttatggcggtatcaatgtttatttgcagcagaaatccaattttttccgccatacacataaattgctcgatcgcatgcttgatagtcccgctttattgaatcgcttatccaaccttagttcttcaaccgatgccgcagatcttggtgaacttacagtttcggtaatgaaaggttctgatggaaaccagaaaaaggaattggagaagctggttgattggcttcaatctgaatatcgtccggatgtgattcatctaaacaactgcatgtttgtgggaatggttcctgaattaaaaaagcggttgaacgttccagtggtttgctcattatcaggtgaagatctgtttcttgaaggtttgaaggagccatacaaaaaagaagcgatgaaattattgcagcaacgcgcccaagaagtggatggcttcattgctccaagttcttattacgcccagtttatgaccgattatttaaatgtcgaaaaacaaaagatgcatgttgtagctttgggactcattttaaaagacatggtgaaggacacttcaatccaactcgagatccatttatttttggttatcttgcgcgggtttgtccggaaaaaggatttgatggtgccgctgaaacgtttcaatttcttgcaaaaaatatggcacgaaataaaatccgctttcattccgcaggaaatcttttcaaaaaagatctgggattttttcaaagaccgtgaaacaaataaatga

SEQ ID NO: 4026 - protein, 299 aa, Unknown
  Obtained from environmental sample
  misc_feature (1)..(299): Xaa is any amino acid
MRIAYIATGAAGMYCGTCLHDNTLAAALIKKGHQVALIPTYTPIRTDEEDVSMNQIFYGGINVYLQQKSNFFRHTHKLLDRMLDSPALLNRLSNLSSSTDAADLGELTVSVMKGSDGNQKKELEKLVDWLQSEYRPDVIHLNNCMFVGMVPELKKRLNVPVVCSLSGEDLFLEGLKEPYKKEAMKLLQQRAQEVDGFIAPSSYYAQFMTDYLNVEKQKMHVVALGLILKDMVKDTSIQLEIHLFLVILRGFVRKKDLMVPLKRFNFLQKIWHEIKSAFIPQEIFSKKIWDFFKDRETNK

SEQ ID NO: 4027 - DNA, 609 bp, Unknown
  Obtained from environmental sample
  misc_feature (1)..(609): n is a, c, g, or t
ttgatgagaggtgaatggattagcacggtctgttttactccagatagtagatacattcttggagaatactcatttgaaaaaaaagtaaatctttgggatactcaaacaggtgaacttgttacgacacttccaattaatctacaaattgggtcaatggatatttcaccagatggttctaaaatcgctttatcctgttatcataaaattcaagtttggagtttgataagccaaaagcaactcttatcagttgatgataattcagtaaatggttttgctattaaatatagccatgacggcaaaaaattagctgtcggtttgggaagtggagaaataaaaatcttggattctgaaacattgaatttgctttattcattgcaaggtcattttaaaccagttctttctgttgcatttagcaaagacgacaagaatttgattagtggttcatctgaccaaatggctaaactttggaatctccaaactaaagttgaattaaaatcattagtcaatgagcataaaggtcaggtgagttctgttgcttttagtccaacttcaaatttatttgcgacaacaggtgatgacaaactaatcagattatggaagattcaatga

SEQ ID NO: 4028 - protein, 202 aa, Unknown
  Obtained from environmental sample
  DOMAIN (120)...(157): WD domain, G-beta repeat
  misc_feature (1)..(202): Xaa is any amino acid
MMRGEWISTVCFTPDSRYILGEYSFEKKVNLWDTQTGELVTTLPINLQIGSMDISPDGSKIALSCYHKIQVWSLISQKQLLSVDDNSVNGFAIKYSHDGKKLAVGLGSGEIKILDSETLNLLYSLQGHFKPVLSVAFSKDDKNLISGSSDQMAKLWNLQTKVELKSLVNEHKGQVSSVAFSPTSNLFATTGDDKLIRLWKIQ

SEQ ID NO: 4029 - DNA, 585 bp, Unknown
  Obtained from environmental sample
  misc_feature (1)..(585): n is a, c, g, or t
atgagcaatgacaagcatctcatcatggatatcggaggaggtagcacggaatttatcatcgccaacggaaacaaaattttctggaagagatcttttaatatcggagctgcacgattgcttgagatgttcaagccttctgatcccatcagccctgatgaagtgaggaaactgaaagattatctttcaaaagtgctggctccgcttaccggtgcaataaaaaaacatgaagtcaccacccttgtcggatcttcgggatcgttcgacacattcgctgaaatcatcggctggaaatttcaccgcagggatgtgctgaagaatacagagacgtaccggtttaacttgaatgaatttgaacgattgaacagcctgttactgaaatccactacttcccagcgaaagagaatgaaaggtttggttaaaatgcgtgttgatatgattgtactcgcaagcatctgtaccagttatgtgctgaaaaaatatggcctcaccgaaatggttgtctctaagtatgctttaaaggagggagcactatggcaggcagtcagcttaaaacgcatcgtgaagaaacggtctgtcggcaagtag

SEQ ID NO: 4030 - protein, 194 aa, Unknown
  Obtained from environmental sample
  misc_feature (1)..(194): Xaa is any amino acid
MSNDKHLIMDIGGGSTEFIIANGNKIFWKRSFNIGAARLLEMFKPSDPISPDEVRKLKDYLSKVLAPLTGAIKKHEVTTLVGSSGSFDTFAEIIGWKFHRRDVLKNTETYRFNLNEFERLNSLLLKSTTSQRKRMKGLVKMRVDMIVLASICTSYVLKKYGLTEMVVSKYALKEGALWQAVSLKRIVKKRSVGK

SEQ ID NO: 4031 - DNA, 639 bp, Unknown
  Obtained from environmental sample
  misc_feature (1)..(639): n is a, c, g, or t
atggaggggtcaagagctgagctgatttattacggggtcaggcaaagttttccaatgagcaatgacaagcatctcatcatggatatcggaggaggtagcacggaatttatcatcgccaacggaaacaaaattttctggaagagatcttttaatatcggagctgcacgattgcttgagatgttcaagccttctgatcccatcagccctgatgaagtgaggaaactgaaagattatctttcaaaagtgctggctccgcttaccggtgcaataaaaaaacatgaagtcaccacccttgtcggatcttcgggatcgttcgacacattcgctgaaatcatcggctggaaatttcaccgcagggatgtgctgaagaatacagagacgtaccggtttaacttgaatgaatttgaacgattgaacagcctgttactgaaatccactacttcccagcgaaagagaatgaaaggtttggttaaaatgcgtgttgatatgattgtactcgcaagcatctgtaccagttatgtgctgaaaaaatatggcctcaccgaaatggttgtctctaagtatgctttaaaggagggagcactatggcaggcagtcagcttaaaacgcatcgtgaagaaacggtctgtcggcaagtag

SEQ ID NO: 4032 - protein, 212 aa, Unknown
  Obtained from environmental sample
  DOMAIN (2)...(202): Ppx/GppA phosphatase family
  misc_feature (1)..(212): Xaa is any amino acid
MEGSRAELIYYGVRQSFPMSNDKHLIMDIGGGSTEFIIANGNKIFWKRSFNIGAARLLEMFKPSDPISPDEVRKLKDYLSKVLAPLTGAIKKHEVTTLVGSSGSFDTFAEIIGWKFHRRDVLKNTETYRFNLNEFERLNSLLLKSTTSQRKRMKGLVKMRVDMIVLASICTSYVLKKYGLTEMVVSKYALKEGALWQAVSLKRIVKKRSVGK

SEQ ID NO: 4033 - DNA, 423 bp, Unknown
  Obtained from environmental sample
  misc_feature (1)..(423): n is a, c, g, or t
ttgaaaatgacattaaagcaacttattaaactggagaatcaggcaaaagaagtttgggttgtatccccctccctgcactatgacattgaaaacaaagatttttctgaattagtcagcgtcaacctcggagaaaaaaccaagtacaaatacatcgtaccggcgactgcagaaatcgaaaagaatctccgcctttaccaaaagcgctataatatctcttcccaggatatcctcaataattttttaatcctgccaccttcggaattcacgccattcatcactgaattagccatctataatgcctctacggattgtatcgcctgtgcccgctcggccagcgacgacggcaatgaggtgatctcttataatagcaacacagctaaagcaaatggcaaagagcttcaaggatctttgaaaaaaatatag

SEQ ID NO: 4034 - protein, 140 aa, Unknown
  Obtained from environmental sample
  misc_feature (1)..(140): Xaa is any amino acid
MKMTLKQLIKLENQAKEVWVVSPSLHYDIENKDFSELVSVNLGEKTKYKYIVPATAEIEKNLRLYQKRYNISSQDILNNFLILPPSEFTPFITELAIYNASTDCIACARSASDDGNEVISYNSNTAKANGKELQGSLKKI

SEQ ID NO: 4035 - DNA, 399 bp, Unknown
  Obtained from environmental sample
  misc_feature (1)..(399): n is a, c, g, or t
ttgcatcggttttcagcattggcagacgatcctaaccagaaagttttggacgcctttaataaaacgtttcagcatgttaaggaagtagcctggacagaaggcgaacattcttacgaagtaaagttcaagcaaaatgaaattctttctaaagtaacgtacgataaagaaggtaatattttgagaaccctgcgctattattatgaacagaatctgcccctccttattttctctaaagtgaaaaccaaattctctgataaaaaaatatttggtgttacagaagaatcttcagatgaagggacttactatcatattgttttggaagatgaaaaacactggatcaatattactgccgacagctttggcggaataaaagttgataagaaattcaacaaggcctaa

SEQ ID NO: 4036 - protein, 132 aa, Unknown
  Obtained from environmental sample
  misc_feature (1)..(132): Xaa is any amino acid
MHRFSALADDPNQKVLDAFNKTFQHVKEVAWTEGEHSYEVKFKQNEILSKVTYDKEGNILRTLRYYYEQNLPLLIFSKVKTKFSDKKIFGVTEESSDEGTYYHIVLEDEKHWINITADSFGGIKVDKKFNKA

SEQ ID NO: 4037 - DNA, 804 bp, Unknown
  Obtained from environmental sample
  misc_feature (1)..(804): n is a, c, g, or t
atgaagaaagagtttttaaaaatcggcattgcgatactggtattgtttgccatagcgattccattgagtctgcatcgagaaaaaaaaatcaagaatgcgatatccgaagatgaaaatattaaattattttcactggatttcaaaaccgtacaaaaatttaaattcaagaatcaatttggagacgttgagatcgagagaagagataaaagcaaagacggtaaatataatgatgaatttgacacgcgtagctttgaattcaatgaacctcgtgaatggatagtaaccaaaccctatcgcgctctagcagattcaatggtgataagcggttttttaaatcaaattcaccttttggaaagtcaaaaaacaattcaagaaacaaaagagaggaaagcggaatatgatctggatccagctgttatttccatagatatttttgactcaaagacggaagtgccgaaacttaccgttcaaatgggatccgaaaatcctgatggcacaggctattatttcatgacctccaacaaaccgggaatttatctgggtgaccggattttacagccctatgaaaatcaaaaattggaagagtggaaagagaagaaaatcattggctttgctagaagcaatgatgtcgaaaaattgcaggttcgacatgtagaaaaaaaagaccaatcttttattgcaaccnaaattgaaaccgactggaagctcggggaagtcaaagaatctctattggcagactcagtccagatcaacagtttttttctcctacatggatggccttcggtcctaaaaaattacagatga

SEQ ID NO: 4038 - protein, 267 aa, Unknown
  Obtained from environmental sample
  SIGNAL (1)...(19)
  misc_feature (1)..(267): Xaa is any amino acid
MKKEFLKIGIAILVLFAIAIPLSLHREKKIKNAISEDENIKLFSLDFKTVQKFKFKNQFGDVEIERRDKSKDGKYNDEFDTRSFEFNEPREWIVTKPYRALADSMVISGFLNQIHLLESQKTIQETKERKAEYDLDPAVISIDIFDSKTEVPKLTVQMGSENPDGTGYYFMTSNKPGIYLGDRILQPYENQKLEEWKEKKIIGFARSNDVEKLQVRHVEKKDQSFIATXIETDWKLGEVKESLLADSVQINSFFLLHGWPSVLKNYR

SEQ ID NO: 4039 - DNA, 525 bp, Unknown
  Obtained from environmental sample
  misc_feature (1)..(525): n is a, c, g, or t
atgacagattttgatgcagttctcactcccggaaaaaacaacgaatttataaatacgattattgaaatttccaaaggttcaatgcataaaattgaatatagtagagacttaaaaacatttattttggatagagttgagccttcaatttttgcaaaaccagtaaattacgggtttattccgcaaactcttgatgaagatggtgatgcacttgacacacttgtgattactgatgaacccattccaatgggagtagctttaaaagcaaaagttattgcaattctaaactttgtcgatgatggagaaaacgattacaaaatcatttgtgttcccttggatgatagaaactccggcgattcaattcagaccattgacgatctaaatccaagatggaagcaaaaaattgaacatcattttagccattacaaagaccttaagaaacctggaagcactaaagtagaaggatggggaagtgccgaggaagcttggaaaattatcgaagaatgtaccgcccgcttcagtaaataa

SEQ ID NO: 4040 - protein, 174 aa, Unknown
  Obtained from environmental sample
  DOMAIN (18)...(174): Inorganic pyrophosphatase
  misc_feature (1)..(174): Xaa is any amino acid
MTDFDAVLTPGKNNEFINTIIEISKGSMHKIEYSRDLKTFILDRVEPSIFAKPVNYGFIPQTLDEDGDALDTLVITDEPIPMGVALKAKVIAILNFVDDGENDYKIICVPLDDRNSGDSIQTIDDLNPRWKQKIEHHFSHYKDLKKPGSTKVEGWGSAEEAWKIIEECTARFSK

SEQ ID NO: 4041 - DNA, 699 bp, Unknown
  Obtained from environmental sample
  misc_feature (1)..(699): n is a, c, g, or t
gtggatgccacattgatgtcatttttacttgtttattacacgggaaaacttggagaaggcctctcaaatcaaatgagaatgacaaaatcgatgggaattaagtattcagttaaatggtggaaaaaaaataaaatgacaaaaccgccagaaataaatccatgtgagtttttgatcaataaaattaattggagatacgataaaggaaggcccggtgttacagaaagtaaagtcctctttggagacagtgctataaaactaaaaacaatttcaaacaaagcagagtatcatgatataaaatnttcgctcctttttacatcaccaccctattattcaataactgattaccatgctgaccagtggttaagattgtggttattaggaggcactataaaaccgaaagtaatcagcgataagcatcgaagcagatttctaaataaagagaaatattttgatcttcttgataatgtgtttggaatgtgctcaaaaatgctgaaaagaaaaagtactatttatgtaagaacagatagaagggatttcacattctatactactctttttattcttatgaaacattttcccaaacatacattagaagtaatttcaaagccaatcggaagaaataaaagaacacaaacaaaattgcatggtaacacttcatctgtaccaggcgaagtagatattatcatgactagacaataa

SEQ ID NO: 4042 - protein, 232 aa, Unknown
  Obtained from environmental sample
  misc_feature (1)..(232): Xaa is any amino acid
MDATLMSFLLVYYTGKLGEGLSNQMRMTKSMGIKYSVKWWKKNKMTKPPEINPCEFLINKINWRYDKGRPGVTESKVLFGDSAIKLKTISNKAEYHDIKXSLLFTSPPYYSITDYHADQWLRLWLLGGTIKPKVISDKHRSRFLNKEKYFDLLDNVFGMCSKMLKRKSTIYVRTDRRDFTFYTTLFILMKHFPKHTLEVISKPIGRNKRTQTKLHGNTSSVPGEVDIIMTRQ

SEQ ID NO: 4043 - DNA, 885 bp, Unknown
  Obtained from environmental sample
  misc_feature (1)..(885): n is a, c, g, or t
atgtaccactcacttgtcattctaatagcaagaatattgattaaaaagttcaatgtagagtttatcgattttccgctattaataaggctaaatcccaatgttcctcttaaaactagaggtaacggtgcagtatgtntaaggatcaaaagcaataacaatgaaaaaatcaaggaagaagtttcacaaattatagagaattattcggatataggcgatggtgcaaatccaggtttagctttctatgaagaaaataacattaacaaagacttgtcacagtttagcaaaaatgcaatggatactatattaagtaaacaattagccataaaaatagcaaaaaagtacaatatgcaatttcgagtctacgggaaaggccatggaattgtaggcgcactatcggctataggatgtgttttagactcagatcatacttttgaaacgctagcctacaggagagaagaaaatataggaaaaagcagaaaaacaaacgattttaaagtaaaaagactaagcgaagaatcctatccatatacttataataactatgatcaaaaaaactcgagggttctgattacaccccatggtcctgatccagtattttgtggtattagaggcgaagatccattattgactttgtattttttaaaaaatttgtgtatagaagaagtgctggatggctacatgatatttagatccaatcagggaacaaatcttcatcttacaaaagagaaacgaagagtagacatgaaaccttatacggcaggatacattaattgtgaagtcacaacaatgccctatacaattaatggcggacatgtaatcttcaaggtaaaagataggtacgactatgtgttaccagttgcagtatatcaactcgacagggtctaa

SEQ ID NO: 4044 - protein, 294 aa, Unknown
  Obtained from environmental sample
  misc_feature (1)..(294): Xaa is any amino acid
MYHSLVILIARILIKKFNVEFIDFPLLIRLNPNVPLKTRGNGAVCXRIKSNNNEKIKEEVSQIIENYSDIGDGANPGLAFYEENNINKDLSQFSKNAMDTILSKQLAIKIAKKYNMQFRVYGKGHGIVGALSAIGCVLDSDHTFETLAYRREENIGKSRKTNDFKVKRLSEESYPYTYNNYDQKNSRVLITPHGPDPVFCGIRGEDPLLTLYFLKNLCIEEVLDGYMIFRSNQGTNLHLTKEKRRVDMKPYTAGYINCEVTTMPYTINGGHVIFKVKDRYDYVLPVAVYQLDRV

SEQ ID NO: 4045 - DNA, 546 bp, Unknown
  Obtained from environmental sample
  misc_feature (1)..(546): n is a, c, g, or t
ttgggaaagcaaccgaaggcccccccccccggggatttccaatgccgacaaaatgcggaccctgtaggggtcccacatgtgcggaggaatccaatggccacgaccttcaccaagatcctcatccatttcgtcttctccaccaaaaaccgcgcgcccctgatcacgcccgacatcgaaccacggctacacgcctacatgcgcggcatcgccaagaatcacgaatcgccggtgatctcgatgaatggcacgagtgaccacgttcacatgctgatctccatgtcaaagaaaattgccgtcgccacgctcatggaagaagtgaagcgggattcgtcgagttggatcaagaaacagggcgaggagttcagcggtttttattggcaggaaggatacggggcgttttccatcggagaatcgggcgtggaaggggtgtcagagtacatcgaaaatcagaagaagcatcatgcgcgaacgacgttcaaggaggagtttttgatgcttttgaagaaatacaagattgattacgacgagcgctatatttggacgtga

SEQ ID NO: 4046 - protein, 181 aa, Unknown
  Obtained from environmental sample
  DOMAIN (44)...(143): Transposase IS200 like
  misc_feature (1)..(181): Xaa is any amino acid
MGKQPKAPPPGDFQCRQNADPVGVPHVRRNPMATTFTKILIHFVFSTKNRAPLITPDIEPRLHAYMRGIAKNHESPVISMNGTSDHVHMLISMSKKIAVATLMEEVKRDSSSWIKKQGEEFSGFYWQEGYGAFSIGESGVEGVSEYIENQKKHHARTTFKEEFLMLLKKYKIDYDERYIWT

SEQ ID NO: 4047 - DNA, 939 bp, Unknown
  Obtained from environmental sample
  misc_feature (1)..(939): n is a, c, g, or t
atgcagtttactggtccactgatggcaaagggctatgaggatactttcttatactcttatagcaatttcatcagtaataatgaagtgggaagctctgcgaatatttccggaatcaccgtaaatgagcttcatgaattaatgatcgaaaggcaaaagaattggaacctttcattgagtgcttcttctacgcatgataccaagagaggagaagatacaagggcaaaattaaatgtacttagtgaaattccggagttatggtttgaaataattcgtgaatggagtaatttgaatgaagcaattcgccataacaacattccagacagaaatgaagaatattttatatatcagactttgcttggttcatttccttttgaagaagatctgacctggagtgacaggctttgtgattacatgataaaagctttacgggaagcaaaaattcattctacatggaataatccggataaggaatatgaagatagcattactactttcattaaaggagctttgaataattctgccttcaataaatctttaaaagatttcaatgaatacatttcaaaacaaagtgtaataaattcactttcgcagacaatattaaaaatcaccttaccgggaattcctgatttttaccagggctcggaattatgggattttaagtttgtcgatcctgataatagaacaaaccctgattatgaaaaacgtacaaaattccttaatgaaataggtcagcattcagacccggtagagtttttgaaagaattctccgatgggaaaataaaactttgggtgataaaaactttacttagcgaaagaataaaaatgaaaacttattcaatccggagatatctgcactgcaaaggntggcagcatgcgatagataatgcgttgcagaaatatacaagatatttatcctatgtacaagtgtttcataaataa

SEQ ID NO: 4048 - protein, 312 aa, Unknown
  Obtained from environmental sample
  misc_feature (1)..(312): Xaa is any amino acid
MQFTGPLMAKGYEDTFLYSYSNFISNNEVGSSANISGITVNELHELMIERQKNWNLSLSASSTHDTKRGEDTRAKLNVLSEIPELWFEIIREWSNLNEAIRHNNIPDRNEEYFIYQTLLGSFPFEEDLTWSDRLCDYMIKALREAKIHSTWNNPDKEYEDSITTFIKGALNNSAFNKSLKDFNEYISKQSVINSLSQTILKITLPGIPDFYQGSELWDFKFVDPDNRTNPDYEKRTKFLNEIGQHSDPVEFLKEFSDGKIKLWVIKTLLSERIKMKTYSIRRYLHCKGWQHAIDNALQKYTRYLSYVQVFHK

SEQ ID NO: 4049 - DNA, 300 bp, Unknown
  Obtained from environmental sample
  misc_feature (1)..(300): n is a, c, g, or t
ttggctaccaggaatgctccaaccaaaatgccactaacaaaaaataaattccatacttcctttttccaatcgtatttgaaaaaagaaatattggctggaaaacaggcggcacatacgtgccgtagcgaggaggaaataccaaacgatttattaccagtgattaagagcgttggaaccattagtccaatcaacggcccggctacataccaagnccagggcgaagtaaaaatatttagaagcataattagattattctttacaggttttttaatatcagtaatatttgaaatacttatatag

SEQ ID NO: 4050 - protein, 99 aa, Unknown
  Obtained from environmental sample
  misc_feature (1)..(99): Xaa is any amino acid
MATRNAPTKMPLTKNKFHTSFFQSYLKKEILAGKQAAHTCRSEEEIPNDLLPVIKSVGTISPINGPATYQXQGEVKIFRSIIRLFFTGFLISVIFEILI

SEQ ID NO: 4051 - DNA, 798 bp, Unknown
  Obtained from environmental sample
  misc_feature (1)..(798): n is a, c, g, or t
atggaggatagattattattaaataaaataaattataatgaaggcaccattgattgttatggtaagacatacaagctcaatgatactaacttcccaactatagatccaaaaaacccttattctttgacaaaagaagaaagagaagttgttgataaattagcatcttcatttttaaacagtgagaagcttcaaaaacacataaggtttcttttgtcaaacggtagtatgtatttaaaggttaattcgaatcttctttaccatggatgtattcctgtaaatgaagacggaacatttaaaaaagttaaaataggttcatccggtaaagaatacagtggcaaatcatattttgatagacttgaaatattagttagagaaggatatttccataaaaacaatcctgaaggaaagctgtatggaatggatttgacttggtatttgtggactggtcctgattcgcctttatttggcaagaataaaatgaccacattcgaaagatattttatagatgataatgaaactcacaaggaaaagaaaaatccgtattttaaattagaagacaatgagttaatgtgtggcataatatttgaagaatttggcttgaagcctgaaaattctcacattattaacggtcatgtgcctgttaaaagtaaaaatggagaaagtccaattaaggctaatggtaagcttatagttattgatggtggattttcaaaagcttatcaaggaactactggtattgctggatacactctcatatataattcctatggactcatattggtatctcatatcctttaa

SEQ ID NO: 4052 - protein, 265 aa, Unknown
  Obtained from environmental sample
  DOMAIN (1)...(265): Firmicute fructose-1,6-bisphosphatase
  misc_feature (1)..(265): Xaa is any amino acid
MEDRLLLNKINYNEGTIDCYGKTYKLNDTNFPTIDPKNPYSLTKEEREVVDKLASSFLNSEKLQKHIRFLLSNGSMYLKVNSNLLYHGCIPVNEDGTFKKVKIGSSGKEYSGKSYFDRLEILVREGYFHKNNPEGKLYGMDLTWYLWTGPDSPLFGKNKMTTFERYFIDDNETHKEKKNPYFKLEDNELMCGIIFEEFGLKPENSHIINGHVPVKSKNGESPIKANGKLIVIDGGFSKAYQGTTGIAGYTLIYNSYGLILVSHIL

SEQ ID NO: 4053 - DNA, 951 bp, Unknown
  Obtained from environmental sample
  misc_feature (1)..(951): n is a, c, g, or t
ttgcgttatttaaagcttttaactaaacaatttcctaccatagcctcatgctgtactgaaattataaatttgcaggcaatattaaatcttccaaagggtacagagcatttcttgtctgatattcatggagaatatgaaccatttaatcatgtgcttaagaatggctcaggcaatattaaaaggaagataactgaagtttttggtgatattatgactgagaaggatattaaaagtcttgcaacgcttatttattatcctgagcaaaagctagaaatcattcataagttggaagaaaatattgatgaatggtataagataacaattcatagacttattgaggtgagcagaaaggcagcttttaaatatacacgtatgaaggtaaggaaagcactgcctgtggaatttgcttacataatagaagaattgatgcacaaaggtcacgaagagtatgataaggaagagtattacagcgaaataatcaactccattatcagagtgggaagggctgatgaatttattgtttcaatgtcaaagcttattcaaagactggttattgacaggcttcacattgttggagatatttttgacagaggtcccggtgctgacaaggtaatggatacacttattaattatcattctgttgatattcaatggggaaatcatgatgtgttgtggatgggcgctgctgctggcagcgaagcatgtattgcaacagttataagaatttgtacacgatatgctaatttggacaccatagaagatggctatggaattaatattttaccattagcaacatttgctttagaattttatagtgatgatgactgcgtacaatttaaacctaaaattgagggcgatattgtatataatgaatatgatttaaaacttattgcaaaaatgcataaagctatttcaatattcaagtttagctttgaagagaataaattatag

SEQ ID NO: 4054 - protein, 316 aa, Unknown
  Obtained from environmental sample
  DOMAIN (1)...(315): Firmicute fructose-1,6-bisphosphatase
  misc_feature (1)..(316): Xaa is any amino acid
MRYLKLLTKQFPTIASCCTEIINLQAILNLPKGTEHFLSDIHGEYEPFNHVLKNGSGNIKRKITEVFGDIMTEKDIKSLATLIYYPEQKLEIIHKLEENIDEWYKITIHRLIEVSRKAAFKYTRMKVRKALPVEFAYIIEELMHKGHEEYDKEEYYSEIINSIIRVGRADEFIVSMSKLIQRLVIDRLHIVGDIFDRGPGADKVMDTLINYHSVDIQWGNHDVLWMGAAAGSEACIATVIRICTRYANLDTIEDGYGINILPLATFALEFYSDDDCVQFKPKIEGDIVYNEYDLKLIAKMHKAISIFKFSFEENKL

SEQ ID NO: 4055 - DNA, 879 bp, Unknown
  Obtained from environmental sample
  misc_feature (1)..(879): n is a, c, g, or t
ttgcagactgagtacactcctcggaatgaagaagtaatcactgaaataaaaggacgattatcggaaaatgaatttattgatgaaagtaaagcgctgtcatttaatgcaaaagcgttgtttcatattatccgtgccgatgcaggtcaactgagcggtgattatatttttgctaaaagtgaaatgaagatcgttgttgatctctttgaaaaaaatcctgttcaaaaggaagagcagtcaacgcgatatatcaatctcctcaataattatctaaacagttgttttctcgcacacgattttgaagattttcctgaagtgctcgaaaaattaaaaaaaataaaacctgccagggaagaagaggaagtcatattatttaaaaatcggtactacctcgaaatggtgtatttcgcaaacctcggccgctgggaagaggctgcagggctcattcctgacgtggttcagggcctctcggaatttggtgcgagaatgtcgtcatccagccggatcatgctgatgtacaatatcgctgttacatattttatcctgcatgattatgataaaagccttacatggttttatgagatcgataagaataactggaaagatgtgcgcacagatcttcaaaatacatctcgattatttcagatcatcattcattacaacctgacaaattataatgtcgccgcgaatatgttatttaacctgaaaagaaatctcaatctgtataaacgcgtcagcgtttttgaaaaaatattttttaaaatgatcgatcagctgattgatgaaccggataaaaaatcaaaaattgagatcatattaaaaatcaggaaagaactcgaaagtataaagagacagctttccggtctttcctgctatcaatga

SEQ ID NO: 4056 - protein, 292 aa, Unknown
  Obtained from environmental sample
  misc_feature (1)..(292): Xaa is any amino acid
MQTEYTPRNEEVITEIKGRLSENEFIDESKALSFNAKALFHIIRADAGQLSGDYIFAKSEMKIVVDLFEKNPVQKEEQSTRYINLLNNYLNSCFLAHDFEDFPEVLEKLKKIKPAREEEEVILFKNRYYLEMVYFANLGRWEEAAGLIPDVVQGLSEFGARMSSSSRIMLMYNIAVTYFILHDYDKSLTWFYEIDKNNWKDVRTDLQNTSRLFQIIIHYNLTNYNVAANMLFNLKRNLNLYKRVSVFEKIFFKMIDQLIDEPDKKSKIEIILKIRKELESIKRQLSGLSCYQ

SEQ ID NO: 4057 - DNA, 366 bp, Unknown
  Obtained from environmental sample
  misc_feature (1)..(366): n is a, c, g, or t
atgttccagatcaacggcgattcgatgaatccaatccccgataaatcgtgggtgattggcgagtacctcgaaaactggtacgacatgaaggatggcgaggcatatatcatcctcacgcaggaagagggtctcgtattcaagatagttcagaaccaactgaagaaaaagaaaaatgtgatcctcaaatcactgaattcactctatgaaccctacgaactgcatgtcggcgaaatcagagaagtatggaagttctgtaattacctgagcaacgaattgccggataatacatttacaaaagatgaactgctgacgaagattttacacctcgaaaaagaagtgagaggcattagagagtctatttcataa

SEQ ID NO: 4058 - protein, 121 aa, Unknown
  Obtained from environmental sample
  misc_feature (1)..(121): Xaa is any amino acid
MFQINGDSMNPIPDKSWVIGEYLENWYDMKDGEAYIILTQEEGLVFKIVQNQLKKKKNVILKSLNSLYEPYELHVGEIREVWKFCNYLSNELPDNTFTKDELLTKILHLEKEVRGIRESIS

SEQ ID NO: 4059 - DNA, 417 bp, Unknown
  Obtained from environmental sample
  misc_feature (1)..(417): n is a, c, g, or t
atgaagaatacaataaattataatcatatggtttcagatttgagaaaaacattttctccaaaaaaatattataagcttgctgaagttaaagataaaatagagaaggtagcttttgatgttgtaagatttatggatggtaatgatatcgaaggtttatggaaaatagaaaaaaaggatgatggagaatatattattgctacttatgaaagcgattcttcgcaattagagaaaaaaactgcatcaaaagaacgtaaatggaaagtttcattatctaatgacgaaaatgatataaatatattttatgataattatccagtaaaaaaaatagctgctaaatcattaatttcatctgaaactgaaaaacttagcgttgcaaaaaatttaaccagcaatctaaatacgaataaaaatctgtag

SEQ ID NO: 4060 - protein, 138 aa, Unknown
  Obtained from environmental sample
  misc_feature (1)..(138): Xaa is any amino acid
MKNTINYNHMVSDLRKTFSPKKYYKLAEVKDKIEKVAFDVVRFMDGNDIEGLWKIEKKDDGEYIIATYESDSSQLEKKTASKERKWKVSLSNDENDINIFYDNYPVKKIAAKSLISSETEKLSVAKNLTSNLNTNKNL

SEQ ID NO: 4061 - DNA, 330 bp, Unknown
  Obtained from environmental sample
  misc_feature (1)..(330): n is a, c, g, or t
ttgaatgaaaaattatataaagaatattggcgtntaataaatacccagctaacaaaacgacaaaaagaagtattaactttggccgcatctattgaaaagttaactcaaacagatattgcaaaaaaacttaaagtaaatcaaagttcaatcacaaaagcaattcacggaaattgtgattatggaaaaaattctaaaaaagataaaaataaaaaaggaaagaaaatttacggaggggcgcgcaaaaaattacaaaaattagcaaaagaagatccggttattcaagaaattattaaagaaatattagaattacagaagtctttagactattaa

SEQ ID NO: 4062 - protein, 109 aa, Unknown
  Obtained from environmental sample
  misc_feature (1)..(109): Xaa is any amino acid
MNEKLYKEYWRXINTQLTKRQKEVLTLAASIEKLTQTDIAKKLKVNQSSITKAIHGNCDYGKNSKKDKNKKGKKIYGGARKKLQKLAKEDPVIQEIIKEILELQKSLDY

SEQ ID NO: 4063 - DNA, 612 bp, Unknown
  Obtained from environmental sample
  misc_feature (1)..(612): n is a, c, g, or t
atgaatcaaaatcaagcatataatattttagggatttcaccaaattcaacagaagaagaggcaaaaaaagcgtttcgtaaattatccatacaatatcatccagataaattttcacaagcttcaaatcaagaacaaaaacaagctgaagaaaagtttaaagaaataaatgcggcatatcaaactataattaatcctaattcttccggagaatcaaatttctcctccagctcaatagctgatattatggattttattaataacaattttgacggatttgcaggagctgattttggttttggaaaaagttccacacataaacaagtaattattcaagctaaagaattagatttaactttagaatttaaagaatccattttaggttgcaataagactatagaatatgaaagaagaataaaatgcaaagattgtaaaggatatggttataaaccatcgaataaaaaatgtgatgtttgtttaggaaatggcagaaaagttataaattcgaagcaaggaaataatttttttacttcgaccatgccttgcaatgtctgtaacggtataggtaaaaaaattaaaaattgtgatgagtgtaaatctgatggattattttag

SEQ ID NO: 4064 - protein, 203 aa, Unknown
  Obtained from environmental sample
  DOMAIN (127)...(203): DnaJ central domain (4 repeats)
  misc_feature (1)..(203): Xaa is any amino acid
MNQNQAYNILGISPNSTEEEAKKAFRKLSIQYHPDKFSQASNQEQKQAEEKFKEINAAYQTIINPNSSGESNFSSSSIADIMDFINNNFDGFAGADFGFGKSSTHKQVIIQAKELDLTLEFKESILGCNKTIEYERRIKCKDCKGYGYKPSNKKCDVCLGNGRKVINSKQGNNFFTSTMPCNVCNGIGKKIKNCDECKSDGLF

SEQ ID NO: 4065 - DNA, 1017 bp, Unknown
  Obtained from environmental sample
  misc_feature (1)..(1017): n is a, c, g, or t
atggatctcgaggcattcctgtcggaaacgatatttgttgtttcccgaaaacgtcccgctcgcgcaggaaaagatttgcatggctatccagattcgatcatctctgaagagcgtctcgcgcaatcggtcaaaaaaatcntgcgttacaaataccgcgtcggtcttgacgattacaaacccatcaagctcgccaacctgactagcgatttgaacaccgtgcagaacgtggctttccaatatgagctgtacgaaaacgcgattaccgtcattaaaaacgaagacgaaatcctgccgataaaaaaactcgaagatgagaaaatcgcctatgtcaaactcggcgatgacaagcattcaccgtttttatcgacgcttcaaaaatataccgagataaccgaaatcagcgaagaaaacctcgacagcctaaaagtcaggctcaaaccgtttacaaaagtcatcgtcgggttccacaaagccgacggcgcctggaaagatcacagctggaaacccgaagatgtcgccaagctcgattcgattgccaagtacaacaaagtgattctcgacgttttcgccaaaccgtattcgatgcttcaggtcaataatttcgccgatatcaaggctatagtcgtttcgtatcagaacaccgatgtttcgcaagtggtttcgggcgagttgatttttggcgcggtcgaatctaaaggaaagttaccagtaacgatcaatgcggcatttccggtcaacttcgggttgcagaccaaaaaaatcaacaggcttggttttacatcacctgaaaacgtgggcatggattcgcgcgttctgagcaaaatcgacgacatcgccaaaaaagcgatttcggccaaaatgacgcctggcatccaaattttagtggctcgaaaaggaaaggtcatttatcagaaatcattcgggacacatacctatgaaagcaatcaaaaagtgctgaacaccgatttatatgacgtcgcatcgctgactaaaatggttctacatgcccaggtctga

SEQ ID NO: 4066 - protein, 338 aa, Unknown
  Obtained from environmental sample
  misc_feature (1)..(338): Xaa is any amino acid
MDLEAFLSETIFVVSRKRPARAGKDLHGYPDSIISEERLAQSVKKIXRYKYRVGLDDYKPIKLANLTSDLNTVQNVAFQYELYENAITVIKNEDEILPIKKLEDEKIAYVKLGDDKHSPFLSTLQKYTEITEISEENLDSLKVRLKPFTKVIVGFHKADGAWKDHSWKPEDVAKLDSIAKYNKVILDVFAKPYSMLQVNNFADIKAIVVSYQNTDVSQVVSGELIFGAVESKGKLPVTINAAFPVNFGLQTKKINRLGFTSPENVGMDSRVLSKIDDIAKKAISAKMTPGIQILVARKGKVIYQKSFGTHTYESNQKVLNTDLYDVASLTKMVLHAQV

SEQ ID NO: 4067 - DNA, 657 bp, Unknown
  Obtained from environmental sample
  misc_feature (1)..(657): n is a, c, g, or t
atgtatatgggcaggtatgcacatcaaaaaggcgcagtatatataagtagccccgattatgaaaaatgcccgatgcccgacaagccggaatatgctttcatcggaagaagtaatgtgggcaagtcatcgctcattaatatgctttgcgataatgataaattagctaagacttctaactcgcctggcaaaactcaaatgatcaatcactttgaaatcagcagcgtttcaaaggtgggcgaaaacgatcaaacaaaatggtacctggtagatctgcccggatatggatttgccaaaatttcactaaacagcaggaggagatgggagcagatgattgaaaattatttacggaaaagagaaaacctggtgaacgtttttgtgttagttgattcgcgtcatgctccgcaaaaactggatattgaatttataaagaacctcaatttatggcaagtcccttttacgcttattttcactaaagcggataaagaaaagcaggcggtggttagtaaaaacataaaatcatttttagaaaatctgcgtacaacgcaacaatttctaccacaacattttgtttccagttctgtaaaaaaattaggaaagagtaagatattggatttgatacaagagaagaataatgatttgcttgaggataaaaaatga

SEQ ID NO: 4068 - protein, 218 aa, Unknown
  Obtained from environmental sample
  misc_feature (1)..(218): Xaa is any amino acid
MYMGRYAHQKGAVYISSPDYEKCPMPDKPEYAFIGRSNVGKSSLINMLCDNDKLAKTSNSPGKTQMINHFEISSVSKVGENDQTKWYLVDLPGYGFAKISLNSRRRWEQMIENYLRKRENLVNVFVLVDSRHAPQKLDIEFIKNLNLWQVPFTLIFTKADKEKQAVVSKNIKSFLENLRTTQQFLPQHFVSSSVKKLGKSKILDLIQEKNNDLLEDKK

SEQ ID NO: 4069 - DNA, 528 bp, Unknown; identical to SEQ ID NO: 111
  Obtained from environmental sample
  misc_feature (1)..(528): n is a, c, g, or t

SEQ ID NO: 4070 - protein, 175 aa, Unknown; identical to SEQ ID NO: 112
  Obtained from environmental sample
  DOMAIN (15)...(175): ubiE/COQ5 methyltransferase family
  misc_feature (1)..(175): Xaa is any amino acid

SEQ ID NO: 4071 - DNA, 834 bp, Unknown
  Obtained from environmental sample
  misc_feature (1)..(834): n is a, c, g, or t
atgctaagggatatagaatctattgttgcactaaaggatagcttaggatttactggtaaccttaagatttttaatcagggtggatatggccttgcagaagcagttgacggagtacctgattttattgatatccacgcctcatctccaagaaatgattacagaggtccctctttaaatagctctgaatataaaatcgacaaaactctgatggacatttacagatttgattttaataatgacaaaatgctttgcgatagtaagaatactgatgattgtcagattatgcaaatcaattctgcagataattatgtaagatatcatcttgtaacactgatggagaaaatccgaaatacaaccaaagctcctccacttaaagccattgtacttgggtgcacgcactatccatatcttttgaaatatatacagggtacattaaaggaattatataattataagaaaaatggaaaatatgtttacaggccattgatggcggaaagtattaaaataattgatcctgcagaaaatgttgccatcgagcttttcaattatcttcaaaaaaatcacctctttaattccaacgacggcgggatacacagtagtgaattctatataagcgtaccaaatatgactaatccaaataccattgtagatcaagaaggaagatttacctacaaatacaagtatggcaggactgcaggagatattcaagaatatgtgaaaatagttccgttctctaaaaataacatatctgtcgaaaccgtanagagattgaaagctgtagtcccaacaacatttgatctaataaatattttgaacttactaataataaattaa

SEQ ID NO: 4072 - protein, 277 aa, Unknown
  Obtained from environmental sample
  misc_feature (1)..(277): Xaa is any amino acid
MLRDIESIVALKDSLGFTGNLKIFNQGGYGLAEAVDGVPDFIDIHASSPRNDYRGPSLNSSEYKIDKTLMDIYRFDFNNDKMLCDSKNTDDCQIMQINSADNYVRYHLVTLMEKIRNTTKAPPLKAIVLGCTHYPYLLKYIQGTLKELYNYKKNGKYVYRPLMAESIKIIDPAENVAIELFNYLQKNHLFNSNDGGIHSSEFYISVPNMTNPNTIVDQEGRFTYKYKYGRTAGDIQEYVKIVPFSKNNISVETVXRLKAVVPTTFDLINILNLLIIN

SEQ ID NO: 4073 - DNA, 924 bp, Unknown
  Obtained from environmental sample
  misc_feature (1)..(924): n is a, c, g, or t
gtgacaccggcgcatgacatcaacgacttcaggcttggacaaaaacacaagctgccggtgatcgatgcgttgaccgaagatggcaagatcagtgaagcggcaggcgcgtatgttggcatggatcgttttgcatgcaggaaactcatcatcaaggatcttgaatcacaaggcctgcttgagaaggtagaagagatcaacaacaaagtcggatatagcgaaagaactgatgcggtgatagaaccgaaattatcaatgcaatggttcgtgaaaatggagcagctcagcaagcctgccctggaagaggtattaaccagcgatgtgaaattaattcctgaaaagtatgtgaatacttacaaacactggatggagaatgtgcacgactggtgcatcagccgacagctctggtggggtcagagaattccggcatggtacgataaaaatggaaataccgttgttgcaaaatcatcgggagaagcattggaaaaattaaaagctattgatgagaatgtaaagatcgaagatataaaacaggatgaggatgttctggatacctggttttcatcgtggttatggccgcttacagtatttgatccggatgtgatcaaaaatggatggaagaacgcaaacaccgatctgaaatattattatccaaccaacgaccttgtaaccgctcctgagattttgtttttctgggtggcgcggatgatcattgcaggaaaagagtacacgggactganacctttttcgaatgtttacctcaccggtattgtgcgtgataaacaaggaaggaaaatgagncagtcgttgggaaactctcctgatcctcttgatctgatcaataaatacngcgctgatggcgttcgtgttggcatgctgttaagttcacctgcagcaatgatttattattcgacgaagttattgtga

SEQ ID NO: 4074 - protein, 307 aa, Unknown
  Obtained from environmental sample
  DOMAIN (1)...(303): tRNA synthetases class I (I, L, M and V)
  misc_feature (1)..(307): Xaa is any amino acid
MTPAHDINDFRLGQKHKLPVIDALTEDGKISEAAGAYVGMDRFACRKLIIKDLESQGLLEKVEEINNKVGYSERTDAVIEPKLSMQWFVKMEQLSKPALEEVLTSDVKLIPEKYVNTYKHWMENVHDWCISRQLWWGQRIPAWYDKNGNTVVAKSSGEALEKLKAIDENVKIEDIKQDEDVLDTWFSSWLWPLTVFDPDVIKNGWKNANTDLKYYYPTNDLVTAPEILFFWVARMIIAGKEYTGLXPFSNVYLTGIVRDKQGRKMXQSLGNSPDPLDLINKYXADGVRVGMLLSSPAAMIYYSTKLL

SEQ ID NO: 4075 - DNA, 540 bp, Unknown
  Obtained from environmental sample
  misc_feature (1)..(540): n is a, c, g, or t
ttgtcgaggaatgacttgaacatcaaagcatttgcagtggatatcgatggtaccttaacggaaaatggaaatggaatgatctacctaccagcggtttcaaaaatgaggtttcttgaaaagattggatatcgagtattctttgttacgggtcgttcttcagtggaagcctatgttttgtcagtattccttggcataactagggtagcagtaggagagaatggaggagttgtttctaaaggaccttcagatcatacaattcttggaaataaggatttatgtttgaagggttatgaaatattgaaacaatcactctctaatgtagatatcaaacccgtatttcccaggttatctgaagttgtattgcaaaggacctttgatatggaggagggcaagaatatactgaaagaaaagggattgaaattggatatagttgatagcaaatatgcatttcatatcaatgagctgggtgtgaataaggctagaggtctaaatcttgcattagagttcctaagaatgaaccaaaagaagagtagcatctga

SEQ ID NO: 4076 - protein, 179 aa, Unknown
  Obtained from environmental sample
  misc_feature (1)..(179): Xaa is any amino acid
MSRNDLNIKAFAVDIDGTLTENGNGMIYLPAVSKMRFLEKIGYRVFFVTGRSSVEAYVLSVFLGITRVAVGENGGVVSKGPSDHTILGNKDLCLKGYEILKQSLSNVDIKPVFPRLSEVVLQRTFDMEEGKNILKEKGLKLDIVDSKYAFHINELGVNKARGLNLALEFLRMNQKKSSI

SEQ ID NO: 4077 - DNA, 828 bp, Unknown
  Obtained from environmental sample
  misc_feature (1)..(828): n is a, c, g, or t
ttgtcacagtatatggaaaaattgatagaggaaactaggttaaggataaagcatctgataaattgtaatgcaatagaggtaagttttacacaaagcactactcaaggactaaatcttgttgcaaatggtatagattggaaaaaaggagacataataattcttagaggtggaagacatgaacattacgcaaactattttccatggttatatatagcgaagaggaaaaaattaaaaataaaagtattaaaaatagatcaaaatggattttttgatatagatgaattagagaaattggctaaattaaaaagatcgaaattagtagttctaagtcatgtattatataacaatggttctataatgcctgtagaagaagttggaaaaattgcaagagaaaataatttactttattgcattgattcagctcaatctgttggttctttaaatgtagacattaaaagaattggatgtgatttcatggcattccctagttttaaatggatttgtggtccattagggataggaatattttattgtagtaaaaaatctaaagatgttttaattccagatagcataggaggagaatctggacagattgtttcagacgattctttgattcataatgatataccacaaaaatttgaaacaggatttcgtaattatcctgcactagcaggtttagaatcatctcttagatatattttaagaatagggatgcataanataacgtcaataaattctaaaacttcatcgattttacgaaatgagttgttaaaaatagatggtattgatattcatggaataaatgataaaaaatgcgcaatttcatag

SEQ ID NO: 4078 - protein, 275 aa, Unknown
  Obtained from environmental sample
  DOMAIN (1)...(272): Aminotransferase class-V
  misc_feature (1)..(275): Xaa is any amino acid
MSQYMEKLIEETRLRIKHLINCNAIEVSFTQSTTQGLNLVANGIDWKKGDIIILRGGRHEHYANYFPWLYIAKRKKLKIKVLKIDQNGFFDIDELEKLAKLKRSKLVVLSHVLYNNGSIMPVEEVGKIARENNLLYCIDSAQSVGSLNVDIKRIGCDFMAFPSFKWICGPLGIGIFYCSKKSKDVLIPDSIGGESGQIVSDDSLIHNDIPQKFETGFRNYPALAGLESSLRYILRIGMHXITSINSKTSSILRNELLKIDGIDIHGINDKKCAIS

SEQ ID NO: 4079 - DNA, 597 bp, Unknown
  Obtained from environmental sample
  misc_feature (1)..(597): n is a, c, g, or t
gtgcaggcacttttacaaagggttcagttaatgggggtgcaaatttttacaaacattgaaataaatggttttgaaagggtaaatggaaaaatagaattaaaaacaaatcaattatttaatttagatacaaagcaacttttaatatgcactaatgcattcacgaaggaactgttaccaaacattgatattacaccggtacgtggccaggtgctggttacttctaaaataaaaaagctttcatggcaagggagctttcattctgatgaaggtttctattatttccgtaacataggaaaaaaagttttgcttggcggtgcaagaaataaagcttttaaagaagaagaaactacggaaacgaaaacaagtgatacaatacaaaacgagttggaaaaatacctttgcgaagtagtactgcccaattataaagaccaatacactatcgactatcgatggagcggcattatggcaatgggtagcgaaaaaatgcccattctaacagaagttgaatcaaatattttttgtgcagttagaatgagcgggatgggtgtagccctggcaccaatagccggaagaaaaatcagcaaaatgatgttgtag

SEQ ID NO: 4080 - protein, 198 aa, Unknown
  Obtained from environmental sample
  misc_feature (1)..(198): Xaa is any amino acid
MQALLQRVQLMGVQIFTNIEINGFERVNGKIELKTNQLFNLDTKQLLICTNAFTKELLPNIDITPVRGQVLVTSKIKKLSWQGSFHSDEGFYYFRNIGKKVLLGGARNKAFKEEETTETKTSDTIQNELEKYLCEVVLPNYKDQYTIDYRWSGIMAMGSEKMPILTEVESNIFCAVRMSGMGVALAPIAGRKISKMML

SEQ ID NO: 4081 - DNA, 879 bp, Unknown
  Obtained from environmental sample
  misc_feature (1)..(879): n is a, c, g, or t
ttgcctattcctccagtggaagtgataagaaacattggccaaaagattcaaaaagctaacatagatactcaggaaaagatggagagcataattttctcgacactttgggaatctaatctgctcaccgaagaatttccgatgatacaggagacaagaattactatgggaaaaatcgaacaggcacaggaaattttggaggcgctaggtttaccctctgctcaacaaaatgaagtctcggcattaactttgctggcattggctcagttatcagaagaagattcatggaaaaatgccaaaaacccgatgttacgtgtccatgatattttgattgaagttaagcaaagatatgggcgtgtatatgcagaaaatagccgcgagacaataaggcgcaaggtattacaccaattcgagcaagctggaatcgtaattcgaaatgcaaatgacgcaacacgcccaacgaatagcggtttgactaattacatgctgtctgatttagcattggatgttattcgtgcttatgatagttcaaaatggaaggcaaaggtcaagaattttactgggcaacagggtaagttgctagatgtttatctaaaagctagagaacagacaaaaatcccattgcaagttggggaaggaataatttacaaactatcacctggcaagcacaataaacttgaagttgcaatcgtagaagaattctgtccgcgttttgcgccaggggcaaaacttatttatctgggtgatacgtcacaaaaaacattgatatttgatgaatctgtttttgccaaacttggtattcctctgtcacaacacgggaaatttcccgatgtagttttgtatgactcgaaaaagaaatggcttttcttaatgaggctgtaa

SEQ ID NO: 4082 - protein, 292 aa, Unknown
  Obtained from environmental sample
  DOMAIN (60)...(291): BsuBI/PstI restriction endonuclease C-terminus
  misc_feature (1)..(292): Xaa is any amino acid
MPIPPVEVIRNIGQKIQKANIDTQEKMESIIFSTLWESNLLTEEFPMIQETRITMGKIEQAQEILEALGLPSAQQNEVSALTLLALAQLSEEDSWKNAKNPMLRVHDILIEVKQRYGRVYAENSRETIRRKVLHQFEQAGIVIRNANDATRPTNSGLTNYMLSDLALDVIRAYDSSKWKAKVKNFTGQQGKLLDVYLKAREQTKIPLQVGEGIIYKLSPGKHNKLEVAIVEEFCPRFAPGAKLIYLGDTSQKTLIFDESVFAKLGIPLSQHGKFPDVVLYDSKKKWLFLMRL

SEQ ID NO: 4083 - DNA, 327 bp, Unknown; identical to SEQ ID NO: 3131
  Obtained from environmental sample
  misc_feature (1)..(327): n is a, c, g, or t

SEQ ID NO: 4084 - protein, 108 aa, Unknown; identical to SEQ ID NO: 3132
  Obtained from environmental sample
  misc_feature (1)..(108): Xaa is any amino acid

SEQ ID NO: 4085 - DNA, 525 bp, Unknown
  Obtained from environmental sample
  misc_feature (1)..(525): n is a, c, g, or t
atgcgttattggattttaaaatgtgcctttagcattttgcctgtcttgtttttttcgcctcttgtttttgcccaactgggaaaaattaccattgatcttgagaaagataagccaacgaagtataaaaccaagacccttaagtcagaaaagacaggtcagaagaaatttacactgccgcgaagagtgattcaaaacacagtctctcattacaattattattttaatgccaacaataaaattaatgaagttattgaaagagcccgtttaagtaataacgatatttattataagctgctcccgttctacagctactctttaaaaaatacatcatctcaggccagcgaacttgattcagtaatttataaagccactgcaggtatcctgattcatgatttgagaagtgcgtgggtagataatttttacctgctcataggtaaagcttacctgttgaaacaagcctttgaatctgcatcaatggcttttcaatttataactacaacctctatcccaaaaaaaataggatga

SEQ ID NO: 4086 - protein, 174 aa, Unknown
  Obtained from environmental sample
  misc_feature (1)..(174): Xaa is any amino acid
MRYWILKCAFSILPVLFFSPLVFAQLGKITIDLEKDKPTKYKTKTLKSEKTGQKKFTLPRRVIQNTVSHYNYYFNANNKINEVIERARLSNNDIYYKLLPFYSYSLKNTSSQASELDSVIYKATAGILIHDLRSAWVDNFYLLIGKAYLLKQAFESASMAFQFITTTSIPKKIG

SEQ ID NO: 4087 - DNA, 534 bp, Unknown
  Obtained from environmental sample
  misc_feature (1)..(534): n is a, c, g, or t
atgagaaaaattttcgccgtggctgcattattcaccagcagtcaactggcagcgcagaacgcaccagaagaagacagtattaaaacattagacaaggttgtgatcaccgcaactaagtatccaaccaaacaaagcaatactggtaaattagtttcagtagttacaaaagaacagattgaaaaaagtgttggaaaggatttagcgcagttattaaatgaacaaaccggtttaacagtcagcggttcttacagtaatcccggaaaagacaaatcaattttcttcaggggcgcaagtagtaaatataccttgatcttattagatggcattccactaaatgatccttccgggtctggtggcacttttgatattcgtctcattcccatggaacaaatagaaggaattagaattttaaaaggaagtcaatccacactgtatggttctaatgcaatagctggagtgatcaatatattttcaaaaaaccagctagctcacactgacaggaatggctacttattacgcactacatatttttaa

SEQ ID NO: 4088 - protein, 177 aa, Unknown
  Obtained from environmental sample
  SIGNAL (1)...(18)
  misc_feature (1)..(177): Xaa is any amino acid
MRKIFAVAALFTSSQLAAQNAPEEDSIKTLDKVVITATKYPTKQSNTGKLVSVVTKEQIEKSVGKDLAQLLNEQTGLTVSGSYSNPGKDKSIFFRGASSKYTLILLDGIPLNDPSGSGGTFDIRLIPMEQIEGIRILKGSQSTLYGSNAIAGVINIFSKNQLAHTDRNGYLLRTTYF

SEQ ID NO: 4089 - DNA, 444 bp, Unknown
  Obtained from environmental sample
  misc_feature (1)..(444): n is a, c, g, or t
ttgccaacactgcataagattttgccaacactgcataagatgagaagttatttatcctgtcgtgcacttatagcttactgcttgcttttcccggctattgtccattctcaaatacaaaaaatatatctccatcccaaagctgttgggggaggaaaacagtcacagtttatagattccattcgattcatccctttggaagtaaaggatggaattgaaataggggtgtataataatatccaggttactgataaatacttcctgataactgcatacctcaataagacccttctgttgtattccaaaaaaggggattttgtaaaaaaaataatttataaaaaattgggtgatagttttttcccctcttacaacgaacaaacaaatcaaatcgttttttttgggaacaataaaaattatgcgcttacatcgaaggatcagtgcaaataa

SEQ ID NO: 4090 - protein, 147 aa, Unknown
  Obtained from environmental sample
  misc_feature (1)..(147): Xaa is any amino acid
MPTLHKILPTLHKMRSYLSCRALIAYCLLFPAIVHSQIQKIYLHPKAVGGGKQSQFIDSIRFIPLEVKDGIEIGVYNNIQVTDKYFLITAYLNKTLLLYSKKGDFVKKIIYKKLGDSFFPSYNEQTNQIVFFGNNKNYALTSKDQCK

SEQ ID NO: 4091 - DNA, 480 bp, Unknown
  Obtained from environmental sample
  misc_feature (1)..(480): n is a, c, g, or t
ttgctaactgatgtaatgatgccaacattagctggaaaccattnggctaaacaggtaaaacagacataccctcatgtaaaaatattagccttgtccatgagcggccagggtgacctggtaaatgaaatgatcgaagacgctgatatttcaggctatgtcctgaagaacatcggcaagcaggaattggtccaagccctggaaaaaattgcgggcgggggaatttacttcagtgaagaagtattaaaagaactggaacggagcagtcggcgtaaaaaacaaaaagaagaagcccatcttaccggtcgtgaagttgagatcatcaacctgatcgaaaaagaattcaataataaaaagattgcctgtacactatatatttcggaaagaacggttgaaacacataggaaaaatattttcagaaagacaaataccaattccgtgataggattggtgaaatatgcgtatgagcataggttgatctaa

SEQ ID NO: 4092 - protein, 159 aa, Unknown
  Obtained from environmental sample
  DOMAIN (96)...(153): Bacterial regulatory proteins, luxR family
  misc_feature (1)..(159): Xaa is any amino acid
MLTDVMMPTLAGNHXAKQVKQTYPHVKILALSMSGQGDLVNEMIEDADISGYVLKNIGKQELVQALEKIAGGGIYFSEEVLKELERSSRRKKQKEEAHLTGREVEIINLIEKEFNNKKIACTLYISERTVETHRKNIFRKTNTNSVIGLVKYAYEHRLI

SEQ ID NO: 4093 - DNA, 477 bp, Unknown; identical to SEQ ID NO: 3335
  Obtained from environmental sample
  misc_feature (1)..(477): n is a, c, g, or t

SEQ ID NO: 4094 - protein, 158 aa, Unknown; identical to SEQ ID NO: 3336
  Obtained from environmental sample
  DOMAIN (95)...(152): Bacterial regulatory proteins, luxR family
  misc_feature (1)..(158): Xaa is any amino acid

SEQ ID NO: 4095 - DNA, 1053 bp, Unknown
  Obtained from environmental sample
  misc_feature (1)..(1053): n is a, c, g, or t
atgaagttggaaaagaaatcgggcaaggatgaacgatccattctgatcgggatgattgtcaacgatcaggtattatcgcggatcgtacctaaatgggaagaaaacgcattccaatcggagttgggaaataccgtagctccctggtgtgttaagttctatggtaaatacaggaaagcacccaaagcatccattcaaggactcttcgagaagtggtccagaaagcagaaggataaagatgccgtaagtctaatcagcaatttcatttcgtcattgtcggacgagtacgatcaactcaataaagaaatcaatcctgattatttggtggatcgtgctggcgaatatttcaatcgggttaaactgggccggctcaaagatcaattagaagaggcattagatgaaaaagacacagaacgagccacacagatcctggaaacccaccgatctgttgaacttggtgaagaagtctttatacatccatactctgatgttgaaatcaatagagcggcatatgaagacatcagcaaacccttattccgttataacggccccatcggaaaatcttcggagacccaactcgcagagaaaacttcatcgctttccaagggccagaaaaatcaggtaaatcgtattggcttcaagacatttgtcatagaggggcacaaaatagaatacgtgttgccttcttcggaatgggtgatatgtccacccaacaaacgatcagacgtatacngggaacggatttgccgtaaaccattgaaaaagaagaactattggttatccgtgactccgaaaaaagaggatggggaaaaattgattctcccaccatggaaaaccgaaaccaaaggaaaaaatccgttcaaaaaattgaaaaggccccgaaaaattcattcgccccaattccttccagggaatttattcaatttagaggccacccatatttcctggcccaatcaaggtttttgccaaactggaaaacggagggaggggccgaaaaaatgcattcttggacccaaagggaccggagggccgaatccctttttttcttatagagaa

SEQ ID NO: 4096 - protein, 351 aa, Unknown
  Obtained from environmental sample
  misc_feature (1)..(351): Xaa is any amino acid
MKLEKKSGKDERSILIGMIVNDQVLSRIVPKWEENAFQSELGNTVAPWCVKFYGKYRKAPKASIQGLFEKWSRKQKDKDAVSLISNFISSLSDEYDQLNKEINPDYLVDRAGEYFNRVKLGRLKDQLEEALDEKDTERATQILETHRSVELGEEVFIHPYSDVEINRAAYEDISKPLFRYNGPIGKSSETQLAEKTSSLSKGQKNQVNRIGFKTFVIEGHKIEYVLPSSEWVICPPNKRSDVYXERICRKPLKKKNYWLSVTPKKEDGEKLILPPWKTETKGKNPFKKLKRPRKIHSPQFLPGNLFNLEATHISWPNQGFCQTGKRREGPKKCILGPKGTGGPNPFFSYRE

SEQ ID NO: 4097 - DNA, 750 bp, Unknown
  Obtained from environmental sample
  misc_feature (1)..(750): n is a, c, g, or t
atgttaacaatatctatgatgatgagggaaatgctcaatatcaaagatatgaagattctacaagcaaatactgatggtattacgatcatgttccccaggaaggatgaagaaagagtacagcagattataaaggagaatgagaaaataacaggtctcaatgtggagcaagcagaatactctataatggttattaacgatgttaacaactacatgagtatagatgttaacggcgatattaaacagaaaggttgttttcttacaagagatagtatgattaaaggaggcttttatgagaagaatcctagtcagaatatagttgctattgcccttaataagtactttagcgagaatattcctgttgaggatactattaacgaatgtaacgatatccatgagtttatgattggtgttaagagaactaagacttttaagtggttagttaatactgttaaggattcaggagttatttcttcagagttaatggttgatagggtaatccgttattatgtaggtggtacaagttctataagtaagatgtggttaaaaggagaagtagacaaggacggagagaaagattctagtggatttactcttcttagtgctcattatcccattaccttagcacaaattattagtaacaacgagattgtatccagcaaaggtgtaagaaaaggacagaatatctttcctaacttaaatagagaatattatattaatgaatgtaagaaaataattgaaaatatatgctag

SEQ ID NO: 4098 - protein, 249 aa, Unknown
  Obtained from environmental sample
  misc_feature (1)..(249): Xaa is any amino acid
MLTISMMMREMLNIKDMKILQANTDGITIMFPRKDEERVQQIIKENEKITGLNVEQAEYSIMVINDVNNYMSIDVNGDIKQKGCFLTRDSMIKGGFYEKNPSQNIVAIALNKYFSENIPVEDTINECNDIHEFMIGVKRTKTFKWLVNTVKDSGVISSELMVDRVIRYYVGGTSSISKMWLKGEVDKDGEKDSSGFTLLSAHYPITLAQIISNNEIVSSKGVRKGQNIFPNLNREYYINECKKIIENIC

SEQ ID NO: 4099 - DNA, 1056 bp, Unknown
  Obtained from environmental sample
  misc_feature (1)..(1056): n is a, c, g, or t
atgataaatgtaaaaaagtccaggaagaaaatagacaagaaacttggggaacctattgataacaatgtttggtttcacgatatcgaagtctttcctaattatagtctgtttgtctttgagaataaagataccttggatcaggtgactatagaaattcatgataaagatactggggatttagctcagtttttaagtttaaaagtgggtaataaagatataggattgataggttataattgcctaggatacgatggacaagttattgaatacattgtaaagaatccaggatgcactgtagctcaaattaaagagtttaatgacttagtcattaactctacctttcccccgtacagggttgagaagttgagttacaactacctagatctaatgttgattaataactatggaattcatagtgctaaaagtacaagtcttaagcagttgtcctttttctacagggttaaatcagttatggatagcccttgtgactttcagaaaccagttaaagagagtgataaagaaagtattattaaatattgtataaaggacgttagtgtaacaagggagacttatgagttaactattcctttgattaatcttagagttaatctgggaaaagtagagggactagatttcataaacgatcctgaaactaaactagctaaaaaatacttctggaatgtaattagtaaatttacaggagagagtattcaagttatcanggaacgaagaacctacagagatnagatagagggtaagtatattatccttccttatatcaacttcagactaaagagtttacgaaataaaacaatctatgaaaaaatcgttctttatcgactgttactagacgtatcaataagagtattagtgtatatctctaaaaagctgttgagaagagtagtatttatgaactgcttaactatgcgggagaagctactgggtggtataaatggagttatatcaaagaaagtagtgatcctgattggacaaacagttttacccggtaacattccaaaaattgcccgccccaaaattggggttatttacctttaa

SEQ ID NO: 4100 - protein, 351 aa, Unknown
  Obtained from environmental sample
  misc_feature (1)..(351): Xaa is any amino acid
MINVKKSRKKIDKKLGEPIDNNVWFHDIEVFPNYSLFVFENKDTLDQVTIEIHDKDTGDLAQFLSLKVGNKDIGLIGYNCLGYDGQVIEYIVKNPGCTVAQIKEFNDLVINSTFPPYRVEKLSYNYLDLMLINNYGIHSAKSTSLKQLSFFYRVKSVMDSPCDFQKPVKESDKESIIKYCIKDVSVTRETYELTIPLINLRVNLGKVEGLDFINDPETKLAKKYFWNVISKFTGESIQVIXERRTYRDXIEGKYIILPYINFRLKSLRNKTIYEKIVLYRLLLDVSIRVLVYISKKLLRRVVFMNCLTMREKLLGGINGVISKKVVILIGQTVLPGNIPKIARPKIGVIYL

SEQ ID NO: 4101 - DNA, 387 bp, Unknown
  Obtained from environmental sample
  misc_feature (1)..(387): n is a, c, g, or t
atgcttctcatagaattcatagaaacgtttaaacgtagcatcatcccagaagaatacataaagtgtatacatcaaagccgagaaactatagattccaatgtgcccgtggaatggaagaatgatgtggaaaaactatccgtaaagaataccgagggttctgaatcgtcgtgtggcaaggaggacaggaatgagaatttcggagaaagatgtgaaatacaccgagaagccacgaagaannaagtgcatgtcttcataaagttttcccatgaatccaatcttggtgagatagaagttgtgtaccatgcctttcaaccactcacctccaaaactcaggnnaggatcaaaaaattcggattgatttatggaacaccccatagaaatacttga

SEQ ID NO: 4102 - protein, 128 aa, Unknown
  Obtained from environmental sample
  misc_feature (1)..(128): Xaa is any amino acid
MLLIEFIETFKRSIIPEEYIKCIHQSRETIDSNVPVEWKNDVEKLSVKNTEGSESSCGKEDRNENFGERCEIHREATKXXVHVFIKFSHESNLGEIEVVYHAFQPLTSKTQXRIKKFGLIYGTPHRNT

SEQ ID NO: 4103 - DNA, 633 bp, Unknown
  Obtained from environmental sample
  misc_feature (1)..(633): n is a, c, g, or t
ttgtttaactttgccagaatgtcaaagaagaaaatcttttatatcaatttttttattttcctggcgctgggattttacttcatactcaccacgattgcgcctgaaatgggacggaagaggatccccccgatcagtttcgtacggcctttcaggtttgtgaaccaggatggccgcatcctcaccaataaggatgtggaaggcaaagtatatgtagctgaattcttttttaccacctgcccagggatttgtccggatatgaataacaatatgcggcaggtatacgataagttccttgatgagccggattttctgatactggcacataccagtgatcctgagaatgattccgctacgaatctgaaggcttacgcggattcgatgaaagtaaatactgcaaaatggatatttcttacgggccgtaaggatagtttatacactatggcgcgcgtaagttatacgatcgatgatcccgccaacaacctcaaaagcatagaagatgattttttgcatactcagttttgggcactcgtcgacaaaaagggcaatgtgcgtaagatctacgatggtttaaaggaaagtgaagtcaggttgctaatgcgagacataaagaaattattaaaggaaaaagcatag

SEQ ID NO: 4104 - protein, 210 aa, Unknown
  Obtained from environmental sample
  DOMAIN (17)...(188): SCO1/SenC
  misc_feature (1)..(210): Xaa is any amino acid
MFNFARMSKKKIFYINFFIFLALGFYFILTTIAPEMGRKRIPPISFVRPFRFVNQDGRILTNKDVEGKVYVAEFFFTTCPGICPDMNNNMRQVYDKFLDEPDFLILAHTSDPENDSATNLKAYADSMKVNTAKWIFLTGRKDSLYTMARVSYTIDDPANNLKSIEDDFLHTQFWALVDKKGNVRKIYDGLKESEVRLLMRDIKKLLKEKA

SEQ ID NO: 4105 - DNA, 549 bp, Unknown
  Obtained from environmental sample
  misc_feature (1)..(549): n is a, c, g, or t
ttgagggccataaacgtgtatcagtcttatgaatataagctgaagtcaattattaagaggaaacttacgacctttattgataaggaattacccttgttaagctctctacctcctcatgcagctcatcttaccaaatatagtaagatggggggaatcgattataaattatcagatcttactaatttcagtaaggaaataaaaataatttccccaaacaaaaaatactctcgtaatggaggtaaaacttaccctgctaaacctgattcaaatgaaagaaatgacaatctcccagagtattatattaataaccctctgaaattaataaaaaatacagaaagctccggtggtgtagaggctaatacgagccacacaatccggctaagcatttcgccctctcaaggcgacgatcccgggttcaaatcccggccggagcatcctgttatctgcttatttaccatcaactttggctcctcgaaaggccttttccgtatacgatttacgattcatacagtaacggcccaattttctaaagactgctttgggtcctag

SEQ ID NO: 4106 - protein, 182 aa, Unknown
  Obtained from environmental sample
  misc_feature (1)..(182): Xaa is any amino acid
MRAINVYQSYEYKLKSIIKRKLTTFIDKELPLLSSLPPHAAHLTKYSKMGGIDYKLSDLTNFSKEIKIISPNKKYSRNGGKTYPAKPDSNERNDNLPEYYINNPLKLIKNTESSGGVEANTSHTIRLSISPSQGDDPGFKSRPEHPVICLFTINFGSSKGLFRIRFTIHTVTAQFSKDCFGS

SEQ ID NO: 4107 - DNA, 552 bp, Unknown
  Obtained from environmental sample
  misc_feature (1)..(552): n is a, c, g, or t
gtgaacaccaactacaggatagagatattttattctccttctgagcataaaacatattcaggagaattgccacatggtatcaaaggtgaatttggtcatgggatcaaatctgtgataatcacacttaaccatgttgctaatgtttcagagcccaaaatacatgaatttctggaaaatattggtgtttatatatccaaagccactatttctcgaattttgacaaaagatgttgatattttccatcaggagaaaactgagatttttctggaaggtcttaaggctacgccttatcagcagattgacgatacaggtgcgagagtcaatggtaacaatcattatactcagatcctttgtaatccttattatgttgcttattttacagttcccaacaagagtcgagaaaatattttagatgtacttttatgtggaaaagaaaaaacgtactgctttaatgatgaagcatttgatctgatgaaaacgtttaatgtttcccaaatctggatggaaaaactctcttctttaaaaacaaaatattcagtgacgaagaaatga

SEQ ID NO: 4108 - protein, 183 aa, Unknown
  Obtained from environmental sample
  misc_feature (1)..(183): Xaa is any amino acid
MNTNYRIEIFYSPSEHKTYSGELPHGIKGEFGHGIKSVIITLNHVANVSEPKIHEFLENIGVYISKATISRILTKDVDIFHQEKTEIFLEGLKATPYQQIDDTGARVNGNNHYTQILCNPYYVAYFTVPNKSRENILDVLLCGKEKTYCFNDEAFDLMKTFNVSQIWMEKLSSLKTKYSVTKK

SEQ ID NO: 4109 - DNA, 651 bp, Unknown
  Obtained from environmental sample
  misc_feature (1)..(651): n is a, c, g, or t
atgaaatacacaactgatgcctatcttataacatgccttactaacctgcatgctggtagcggcgatgccaactatggcgttgttgataatcttgttcaacgagactcaatcactgagattcctataattaactcttcttctttgaaaggtgctttaagagagtattttgcggaggagtggaaggatagtcccggtaaacgtaaactgaattatgtctttggccctgatcctaaaagaaatcaaggctctgaacttggaataggtaattacaagttctttgatgctaatttaattgttcttcctgttcgaagcacttcgaaaccgtttttcagagggacagcagaatttatacttaatgaactaaaggataaggcctctcaactgggtgtgaaaaattttgatattataccttataatgcaacaactgtaggtaaagaaagtcctcagattttatctgaaaattcttcgtgcattttagaagactatgtagctatcaacgctttaatattaaatactttagaaaatcatngtggtgataacccggcgctttttcatgaagatgactttaaagagttagctaaaaaacttcctgtaatagccagaaaaaaactggagaacgggcagagtaagaactttggtatgaggaagtag

SEQ ID NO: 4110 - protein, 216 aa, Unknown
  Obtained from environmental sample
  DOMAIN (8)...(205): Protein of unknown function (DUF324)
  misc_feature (1)..(216): Xaa is any amino acid
MKYTTDAYLITCLTNLHAGSGDANYGVVDNLVQRDSITEIPIINSSSLKGALREYFAEEWKDSPGKRKLNYVFGPDPKRNQGSELGIGNYKFFDANLIVLPVRSTSKPFFRGTAEFILNELKDKASQLGVKNFDIIPYNATTVGKESPQILSENSSCILEDYVAINALILNTLENHXGDNPALFHEDDFKELAKKLPVIARKKLENGQSKNFGMRK

SEQ ID NO: 4111 - DNA, 825 bp, Unknown
  Obtained from environmental sample
  misc_feature (1)..(825): n is a, c, g, or t
atgaaatacacaactgatgcctatcttataacatgccttactaacctgcatgctggtagcggcgatgccaactatggcgttgttgataatcttgttcaacgagactcaatcactgagattcctataattaactcttcttctntgaaaggtgctntaagagagtattttgcggaggagtggaaggatagtcccggtaaacgtaaactgaattatgtctttggccctgatcctaaaagaaatcaaggctctgaacttggaataggtaattacaagttctttgatgctaatttaattgttcttcctgttcgaagcacttcgaaaccgtttttcagagggacagcagaatttatacttaatgaactaaaggataaggcctctcaactgggtgtgaaaaattttgatattataccttataatgcaacaactgtaggtaaagaaagtcctcagattttatctgaaaattcttcgtgcattttagaagactatgtagctatcaacgctttaatattaaatactttagaaaatcatgttggtgataacccggcgctttttcatgaagatgactttaaagagttagctaaaaaacttcctgtaatagccagaaaccaactggagaacgggcagagtaagaacctttggtatgaagaagtagtccccagggaaagccgatttatcttttttgtttctaaaacgaaagacgaagatatagttactcaaaaggagtttgatgacattctagtggataaaacaatccagattggtgcaaacgcctcaataggttatggatttacaaaaattaaaagaataagcaaaagcaatgaataa

SEQ ID NO: 4112 - protein, 274 aa, Unknown
  Obtained from environmental sample
  DOMAIN (8)...(267): Protein of unknown function (DUF324)
  misc_feature (1)..(274): Xaa is any amino acid
MKYTTDAYLITCLTNLHAGSGDANYGVVDNLVQRDSITEIPIINSSSXKGAXREYFAEEWKDSPGKRKLNYVFGPDPKRNQGSELGIGNYKFFDANLIVLPVRSTSKPFFRGTAEFILNELKDKASQLGVKNFDIIPYNATTVGKESPQILSENSSCILEDYVAINALILNTLENHVGDNPALFHEDDFKELAKKLPVIARNQLENGQSKNLWYEEVVPRESRFIFFVSKTKDEDIVTQKEFDDILVDKTIQIGANASIGYGFTKIKRISKSNE

SEQ ID NO: 4113 - DNA, 375 bp, Unknown; identical to SEQ ID NO: 3677
  Obtained from environmental sample
  misc_feature (1)..(375): n is a, c, g, or t

SEQ ID NO: 4114 - protein, 124 aa, Unknown; identical to SEQ ID NO: 3678
  Obtained from environmental sample
  misc_feature (1)..(124): Xaa is any amino acid

SEQ ID NO: 4115 - DNA, 312 bp, Unknown
  Obtained from environmental sample
  misc_feature (1)..(312): n is a, c, g, or t
atgataatcagtataaaagtttggatattgaaacaaatatccaactgcgtaaacacctgtacgttgtgcgcaattggacaacccctaaaacttatggaaaaagcatttaactatataaccttagttctcataatctgtttattgacagcctgcaatccattttcaaagccatgngacaaaatttatgaagatcaacaaaaacttttcaaaaataaccgacagacatttgaattagctgcaactcttttagacagttcctctgtatcggacacaactcttcccgatacggacaatcattttaaactgccctga

SEQ ID NO: 4116 - protein, 103 aa, Unknown
  Obtained from environmental sample
  misc_feature (1)..(103): Xaa is any amino acid
MIISIKVWILKQISNCVNTCTLCAIGQPLKLMEKAFNYITLVLIICLLTACNPFSKPXDKIYEDQQKLFKNNRQTFELAATLLDSSSVSDTTLPDTDNHFKLP

SEQ ID NO: 4117 - DNA, 540 bp, Unknown; identical to SEQ ID NO: 3681
  Obtained from environmental sample
  misc_feature (1)..(540): n is a, c, g, or t

SEQ ID NO: 4118 - protein, 179 aa, Unknown; identical to SEQ ID NO: 3682
  Obtained from environmental sample
  misc_feature (1)..(179): Xaa is any amino acid

SEQ ID NO: 4119 - DNA, 462 bp, Unknown
  Obtained from environmental sample
  misc_feature (1)..(462): n is a, c, g, or t
atgcaaatcgaaatcatcccgtattctccggaattaaaagaacacctgaaaacgcttaattacgagtggctggaggaatatttccatgtagaagaaggagaccggatttcgctttccaatccgcaggaaatcattttagataaaggtggatttatcttctttgctaaaaacggcgaaaagataataggaacggcttcattgctcaaaaagacagaaactatttttgaattggggaaaatggcagttgctaaaaatgcccgcggattgggaatagggaagttgttattggaacattgcctggaatttgcaacccaaaaaaagatggaatcacttattttatattccaataccaaattggaacctgcaattcatttgtatcggaaatatggattcgaggaaattgaattggaacaaggagtgtacgaacgtgggaacattaaaatggaaaaacgaattttttaa

SEQ ID NO: 4120 - protein, 153 aa, Unknown
  Obtained from environmental sample
  DOMAIN (53)...(132): Acetyltransferase (GNAT) family
  misc_feature (1)..(153): Xaa is any amino acid
MQIEIIPYSPELKEHLKTLNYEWLEEYFHVEEGDRISLSNPQEIILDKGGFIFFAKNGEKIIGTASLLKKTETIFELGKMAVAKNARGLGIGKLLLEHCLEFATQKKMESLILYSNTKLEPAIHLYRKYGFEEIELEQGVYERGNIKMEKRIF

SEQ ID NO: 4121 - DNA, 669 bp, Unknown
  Obtained from environmental sample
  misc_feature (1)..(669): n is a, c, g, or t
ttgtctaacatggttaaagaaggctgtgagttcgcagtaattgaagcaggttcacatggaatacatcagggaagaattgcaggaattaattttgaagtaagtgtcttaactaatattgctccagaacatttggattatcataaaactttcaaagaatataaaagagtaaaaatgtcatttgtgaattcagctaaatttaaagttattgctccaaaagatactaatttgaatgtgcttccaggtaaatttaataatttaaatgttgaagctgctattgaggcatgccaaaaattgggaatttcatcttcgaagcaggaattaattaaaactttaaaagcatttacgctacctgaaggacgtttagatgaaattaaaaataacggtggtccacggatttttgtggattttgcgcacactccaggatctcttagtgcagcactaacttatttaaggtctctttcgagtggtaagcttatttctgtttttggatgcgcctcggaacgggatatcaaaaagcgccgaaaaatgggaaagatatccggagaacaggcagacttatctatttttacggttgaggattccagatttgaaaacataaatcacatcttttatcagatgaagttggatgcaaaaaattatattgtatccggagagaaangaggcatctga

SEQ ID NO: 4122 - protein, 222 aa, Unknown
  Obtained from environmental sample
  DOMAIN (117)...(205): Mur ligase family, glutamate ligase domain
  misc_feature (1)..(222): Xaa is any amino acid
MSNMVKEGCEFAVIEAGSHGIHQGRIAGINFEVSVLTNIAPEHLDYHKTFKEYKRVKMSFVNSAKFKVIAPKDTNLNVLPGKFNNLNVEAAIEACQKLGISSSKQELIKTLKAFTLPEGRLDEIKNNGGPRIFVDFAHTPGSLSAALTYLRSLSSGKLISVFGCASERDIKKRRKMGKISGEQADLSIFTVEDSRFENINHIFYQMKLDAKNYIVSGEKXGI

SEQ ID NO: 4123 - DNA, 786 bp, Unknown
  Obtained from environmental sample
  misc_feature (1)..(786): n is a, c, g, or t
ttgctctgggaaacaataacctccggaaaggaatggaaaggtgactttcataataaaaaaagagatgggaaactctattgggaatcggcttccatatccccgatccttgatgaagatggtaagattactcatttccttgccgtgaaggaagatattaccgaaagaaaaaagctgacatcagaccttgtagatgcaaaagtcaaagccgaatcgagtgacaaactaaaaactgcattcctgaataatatttcacatgaagtacgtacccctttgaatggaatcctcgggttttccgaatttataattcagcctgatattcaacaggaagaaaaagaattatatctggagatactcaaagaaagcagcgaacgcctggtcaataccattacgaactacatggatatgtcgctgatagtatcaggaaatatggtagttaaatccaggaaagttgatctccttcttgttcttgacaaagtttaccaaaattatcttccaaaatgtaagaccaaaaatctggagtttacaaaacagattcctccggatactaaaactcagttaaaaacagacgatggattacttgaaaaggttttatcccatctgatggacaatgcaataaaatttacaattaagggtggtataaattttggcttcaattatactggtaatgaatttgagttatttgttaaagatactggttccgggatagatcctgaagcgcagagttcagtgtttaagattttcatgcaggaagacatgcaaatacgagaggttataaggaagcgctag

SEQ ID NO: 4124 - protein, 261 aa, Unknown
  Obtained from environmental sample
  DOMAIN (188)...(261): Histidine kinase-, DNA gyrase B-, and HSP90-like ATPase
  misc_feature (1)..(261): Xaa is any amino acid
MLWETITSGKEWKGDFHNKKRDGKLYWESASISPILDEDGKITHFLAVKEDITERKKLTSDLVDAKVKAESSDKLKTAFLNNISHEVRTPLNGILGFSEFIIQPDIQQEEKELYLEILKESSERLVNTITNYMDMSLIVSGNMVVKSRKVDLLLVLDKVYQNYLPKCKTKNLEFTKQIPPDTKTQLKTDDGLLEKVLSHLMDNAIKFTIKGGINFGFNYTGNEFELFVKDTGSGIDPEAQSSVFKIFMQEDMQIREVIRKR

SEQ ID NO: 4125 - DNA, 729 bp, Unknown
  Obtained from environmental sample
  misc_feature (1)..(729): n is a, c, g, or t
ttgatacccctccaaaagagggattccaaagatttgatggataaatacccgtttaatgaatctattctatcgattgatagttttcaatatacagttcatcaagaagggagtgtggaaaattctcacgcaagcagtcagatattacctgggactgttcatctaaagaatagaatgtatcaaacttgttggagctgggttcagttgaactatttgttcaataaagagataccagatgaggagtggcatatttcacccggtcgcaatggtgaatcggttgagtttttacctaatttcgagaaaagacattatcttatcaaggctcaatttaattactttgctgatatcttttattataaactcttttcagcttgggataatttaggacatattctcaataatatgtatgaactaaaaattgaaagagctaatttttatgaagctgttaaaacattgaaagacgtaaaatcagacttacacgataatctcaataatttaatagaatcagatgactttaagaaaatgcgtaaatacagacatagctcaacccataatgagttaataggacttatcaattccggttttacaaaagtttctgagaatcattatacagcgggttttcaagaatatgtaacatcttcgcaaattaaagataatgccgataaatccttaaatttaattactcaagcaattaaatttattaaagagcaagttcaaagtgatatgacataa

SEQ ID NO: 4126 - protein, 242 aa, Unknown
  Obtained from environmental sample
  misc_feature (1)..(242): Xaa is any amino acid
MIPLQKRDSKDLMDKYPFNESILSIDSFQYTVHQEGSVENSHASSQILPGTVHLKNRMYQTCWSWVQLNYLFNKEIPDEEWHISPGRNGESVEFLPNFEKRHYLIKAQFNYFADIFYYKLFSAWDNLGHILNNMYELKIERANFYEAVKTLKDVKSDLHDNLNNLIESDDFKKMRKYRHSSTHNELIGLINSGFTKVSENHYTAGFQEYVTSSQIKDNADKSLNLITQAIKFIKEQVQSDMT

SEQ ID NO: 4127 - DNA, 1008 bp, Unknown
  Obtained from environmental sample
  misc_feature (1)..(1008): n is a, c, g, or t
atgcttccctcaaaaaagacttcaattatttatgatgctaatgatgatgaattagtaaagactgctgcgcatctttttcaaaaagatgtggaaatgattaccgggattagcctttcattgacgaatacagtttcttcttcaagaaattttatcattatcggtactattgataaatcccatttcatccgtcaactcatccaaagcaacaaacttgaagtaaaaaaaataaaaactacatgggaaggttatcttatccaggttgtaaaaaatccatttccaggtgtaagtgaggcattggtaataaccggcagtgacaggcggggcacagctttcggtgtttttgaattaagcaggcaaatgggcatatcaccatggtattggtgggcagatgttcccgtaatgaaaaaaaacagcctttattttaagaaaggcattatactttctgatgcgccaaaagtaaaatatcggggcatttttatcaacgatgaggcgcctgcattgagtaactggagcaaggaaaaattcggtggcttcaatcatcttttttatgaaaaggtttttgagctaatgctgcgtctcaaatcaaattatatctggccagccatgtggggaaatgcattttatgatgatgattcattgaatataaaaaccgcagataagtatggcatcataatcggtacatcgcatcatgagccgctgatgcgggcacatgacgaatggagaagatatggcagcggcaagtggaactatgatagtaatgaagtgaagctgaaagccttctggcggtttggtatacaaagagcaaccaatgaaaaaatagtaagcgtaggcatgcgaggcgatggagatgaacctatgagcagggaaactgcaacatctctacttgaaagaattgtaaaagaccagcggcaaatcatccaagacgtaaccgggcaacccggcaaccacaacaccacagcttttgggccttgtattaagaagtgcaggattattatgataaaggcatga

SEQ ID NO: 4128 - protein, 335 aa, Unknown
  Obtained from environmental sample
  misc_feature (1)..(335): Xaa is any amino acid
MLPSKKTSIIYDANDDELVKTAAHLFQKDVEMITGISLSLTNTVSSSRNFIIIGTIDKSHFIRQLIQSNKLEVKKIKTTWEGYLIQVVKNPFPGVSEALVITGSDRRGTAFGVFELSRQMGISPWYWWADVPVMKKNSLYFKKGIILSDAPKVKYRGIFINDEAPALSNWSKEKFGGFNHLFYEKVFELMLRLKSNYIWPAMWGNAFYDDDSLNIKTADKYGIIIGTSHHEPLMRAHDEWRRYGSGKWNYDSNEVKLKAFWRFGIQRATNEKIVSVGMRGDGDEPMSRETATSLLERIVKDQRQIIQDVTGQPGNHNTTAFGPCIKKCRIIMIKA

SEQ ID NO: 4129 - DNA, 657 bp, Unknown
  Obtained from environmental sample
  misc_feature (1)..(657): n is a, c, g, or t
atgaataatgattcatcaacagatgcaaaatcagaagggttcaaaatcagcaagttatttcaatactttctgcagggggttttaatcattgctcccatcaccattactatttacaccatttactgggtggtttcttctattgataacttaattcccattttttatacgaaatcacaggacggaagatttgttgttcaaaattatggactgggatttttaattatcatcctggccatttgcctgatcggctatttaagttctttttttattaagctgaaaatgttcagcctgtttgaatccatgatggcaaaaacacccggtatccgttttatttataccaccgtaaaagatttttttgaagcttttgcaggtgagaaaaaaaaattcaataagccggttttggcaaacattgatgataatgatgtttggcgtgttggttttattacacaggaagaagtgaaagactttcattttatagattatgtggcagtgtatattcctgcctcctattctatcgccggcaatgtttatttattaccgagaaaccgggtaaaacctattactaatatcaatgccacagatgcaatgaaatttgcaataagcggtggcgttacccatatccaggaaataaaagaaacaatcaaaagcaaggagtag

SEQ ID NO: 4130 - protein, 218 aa, Unknown
  Obtained from environmental sample
  DOMAIN (64)...(212): Protein of unknown function (DUF502)
  misc_feature (1)..(218): Xaa is any amino acid
MNNDSSTDAKSEGFKISKLFQYFLQGVLIIAPITITIYTIYWVVSSIDNLIPIFYTKSQDGRFVVQNYGLGFLIIILAICLIGYLSSFFIKLKMFSLFESMMAKTPGIRFIYTTVKDFFEAFAGEKKKFNKPVLANIDDNDVWRVGFITQEEVKDFHFIDYVAVYIPASYSIAGNVYLLPRNRVKPITNINATDAMKFAISGGVTHIQEIKETIKSKE

SEQ ID NO: 4131 - DNA, 393 bp, Unknown
  Obtained from environmental sample
  misc_feature (1)..(393): n is a, c, g, or t
atgcaccagtcgggaaagaagcaagatcatttctatagactcgggtgttgtagggaattacatgctcttcatttcctccctacaataaataagcttaatctatcacgggtcatttatcatcacacaaggttctacatgggtatttacattagacttaatattattccaaataaaattagtaaaaaagattggaattcaacttataaagaggctgaacaattaataaactcctatccatttttggatattgtttcagataaggacacttatagctgttcatggaattatgctgatagtccctcagaaaaaccaattaaatactgtaatgataatattggatttcgaatgttcggtgacctggttaccatggaaaccgctgaaagtttcgaatga

SEQ ID NO: 4132 - protein, 130 aa, Unknown
  Obtained from environmental sample
  misc_feature (1)..(130): Xaa is any amino acid
MHQSGKKQDHFYRLGCCRELHALHFLPTINKLNLSRVIYHHTRFYMGIYIRLNIIPNKISKKDWNSTYKEAEQLINSYPFLDIVSDKDTYSCSWNYADSPSEKPIKYCNDNIGFRMFGDLVTMETAESFE

SEQ ID NO: 4133 - DNA, 705 bp, Unknown
  Obtained from environmental sample
  misc_feature (1)..(705): n is a, c, g, or t
gtggtcaagaatgcaggcactaataaaaaagtgacgcttgaattaggaggaaaagcagctaatatcatttttgatgatgcgcctatcgaccaagcgattgaagggatcatcaatgggatcttctttaaccaaggccatgtctgttgcgcaggctcacgtttattcgttcaggaaaatgttgctgatattgtgatcagtaaattaaaacaacgtttggaaactttgatcgttggtgatcctttagataagaatactgatatcggcgcgatcaactcaaaagaacaactaaataaaataaacgatttcattaagatcgggattgacgaaggtgcagagatgtatcaaagttcatgctccattccttcaaaaggatttttctgcaagcctactctgtttctacatacttcacaatcacaccgcattgtgcaggaagagatttttggtccggtgttagctatacaaactttcagaacgattgaggaagtgattgaaaaagcgaataatattccatacggattaagcgcaggtgtttggaccgacaaaggctcaaagatatttaatctcacttctaaattacgcgccggtgtagtttgggcgaatacttacaataaattcgatccagcttccccattcggcggatataaagaaagcggttttggacgcgaaggcggtttacatggattaatgccttacttaagcttttaa

SEQ ID NO: 4134 - protein, 234 aa, Unknown
  Obtained from environmental sample
  DOMAIN (1)...(234): Aldehyde dehydrogenase family
  misc_feature (1)..(234): Xaa is any amino acid
MVKNAGTNKKVTLELGGKAANIIFDDAPIDQAIEGIINGIFFNQGHVCCAGSRLFVQENVADIVISKLKQRLETLIVGDPLDKNTDIGAINSKEQLNKINDFIKIGIDEGAEMYQSSCSIPSKGFFCKPTLFLHTSQSHRIVQEEIFGPVLAIQTFRTIEEVIEKANNIPYGLSAGVWTDKGSKIFNLTSKLRAGVVWANTYNKFDPASPFGGYKESGFGREGGLHGLMPYLSF

SEQ ID NO: 4135 - DNA, 612 bp, Unknown
  Obtained from environmental sample
  misc_feature (1)..(612): n is a, c, g, or t
atggtgacatatcgttcgatcgatctacctgagcatttctcttacctttctttgtatactgtaaaacaaattttcaattcccagggattggagctctttgatgtagaagaaattcccacgcacggaggctcgttgagaatttatggaaaacatacagaggattcgggtaaggtagtttcagaaaacgtaaggttgttgttggaaaaagaaataggaaaaggaatgaatacgcttacgtattataaggattttcagaaaaaagcgcttaccgttaaactcggtttcattgaatttcttacacagcaaaacttattaaacaaaagagtggccggatatggtgctgccgcgaaaggaaatactttattgaattattgcggtataaaaaatgaccagattgaatttgttgttgacgctaatcctcataagcaaaataaatggcttcctgcgagccatatacctgtagtaaatgaagcctatttaaaagaaacaaaacctgattatgtagttatttttccatggaatttaaaggatgaaattgtaaagcaattaaattatatcagagattgggatggaaagtttgtagttcctattccgcagttggaagtaatttaa

SEQ ID NO: 4136 - protein, 203 aa, Unknown
  Obtained from environmental sample
  misc_feature (1)..(203): Xaa is any amino acid
MVTYRSIDLPEHFSYLSLYTVKQIFNSQGLELFDVEEIPTHGGSLRIYGKHTEDSGKVVSENVRLLLEKEIGKGMNTLTYYKDFQKKALTVKLGFIEFLTQQNLLNKRVAGYGAAAKGNTLLNYCGIKNDQIEFVVDANPHKQNKWLPASHIPVVNEAYLKETKPDYVVIFPWNLKDEIVKQLNYIRDWDGKFVVPIPQLEVI

SEQ ID NO: 4137 - DNA, 387 bp, Unknown
  Obtained from environmental sample
  misc_feature (1)..(387): n is a, c, g, or t
gtgtatacgtatgctgatccaaaaaatatagtcgtgttcaatagttgtaccaatcctgtggcagcatgggaattcataaaaaccatgataaataaaaatggagacctgcaactacttgaagtaactggccagttgccaagaagaaaaaatttggagacagataatttttacaaagactattttatacgcaatccaatgatggtgcctttcgcaaaagaaattccgtttgtgaaaggagttgataattgtgaagtgatagttgaggtgcttgatattatttcgcaggaatacgaagcatgcgtgatatatggaaaaaagactcctgaaaaatcaatagctgatgcggagttagcagtaaatgtattgttagggaaacaagacaattag

SEQ ID NO: 4138 - protein, 128 aa, Unknown
  Obtained from environmental sample
  misc_feature (1)..(128): Xaa is any amino acid
MYTYADPKNIVVFNSCTNPVAAWEFIKTMINKNGDLQLLEVTGQLPRRKNLETDNFYKDYFIRNPMMVPFAKEIPFVKGVDNCEVIVEVLDIISQEYEACVIYGKKTPEKSIADAELAVNVLLGKQDN

SEQ ID NO: 4139 - DNA, 318 bp, Unknown
  Obtained from environmental sample
  misc_feature (1)..(318): n is a, c, g, or t
atggaggatattcttcataaaaacgaagtatatgagatggtagggctttgtatggaagtgcataattatttagggcacggttttctggaaattgtttacaaagatgctttggaaattgaattcaaagagaatctgataatgtacgagagagaaaaagagtttacaattaaatacaagcaacatattttgacacgaaaattttattcagatttttttgtgatagataaaattatagtagaaatatctactaaagaaggggtatcaaatgactataccacccagactttaaattatctaaaagcctctggtttggactga

SEQ ID NO: 4140 - protein, 105 aa, Unknown
  Obtained from environmental sample
  misc_feature (1)..(105): Xaa is any amino acid
MEDILHKNEVYEMVGLCMEVHNYLGHGFLEIVYKDALEIEFKENLIMYEREKEFTIKYKQHILTRKFYSDFFVIDKIIVEISTKEGVSNDYTTQTLNYLKASGLD

SEQ ID NO: 4141 - DNA, 318 bp, Unknown
  Obtained from environmental sample
  misc_feature (1)..(318): n is a, c, g, or t
atggaggatattcttcataaaaacgaagtatatgagatggtagggctttgtatggaagtgcataattatttagggcacggttttctggaaattgtttacaaagatgctttggaaattgaattcaaagagaatctgataatgtacgagagagaaaaagagtttacaattaaatacaagcaacatattttgacacgaaaattttattcagatttttttgtgatagataaaattatagtagaaatatctactaaagaaggggtatcanatgactataccacccagactttaaattatctaaaagcctctggtttggactga

SEQ ID NO: 4142 - protein, 105 aa, Unknown
  Obtained from environmental sample
  misc_feature (1)..(105): Xaa is any amino acid
MEDILHKNEVYEMVGLCMEVHNYLGHGFLEIVYKDALEIEFKENLIMYEREKEFTIKYKQHILTRKFYSDFFVIDKIIVEISTKEGVSXDYTTQTLNYLKASGLD

SEQ ID NO: 4143 - DNA, 360 bp, Unknown; identical to SEQ ID NO: 1765
  Obtained from environmental sample
  misc_feature (1)..(360): n is a, c, g, or t

SEQ ID NO: 4144 - protein, 119 aa, Unknown; identical to SEQ ID NO: 1766
  Obtained from environmental sample
  misc_feature (1)..(119): Xaa is any amino acid

SEQ ID NO: 4145 - DNA, 834 bp, Unknown
  Obtained from environmental sample
  misc_feature (1)..(834): n is a, c, g, or t
atggtgcagtttgcattatttgcaatcgctattaattccggtgaaggcaatagccatccattttattttgagcaattcattaaaaatttcaaacttgacagccacacggcgttgtattctttaaaaacattagagcaggatgggtggctggattttaatgaaaagaatttcagtccctcaacaattgtgtttacgaccaataaagaacagttatatcaattccaggaaagctatcctgaatatgagcaattgcttactactttgcttcgcacttacgaaggaatttttggtttccccgcttttatctcagaaaatcttttgagccgtctcctgcgtgtcggggaagaaaaaataaaagatgatttaaaaaaaattacagcctttcacattatcgaatatataccgcaaaacgatgcaccctttatcatttttaaaaagaaccgggtggcaacggaaaatcttaccatcaatttatcattgtacaaaaaaagaaaagaagcatttattgaacgtgtaaaaaaaattattgagtatacacaaacaaaagaatgcaggagcatttttgtcaaccattattttggcgactatgatattaaagcctgcggtatttgtgataattgccgcagggcaaagactttacatttgtcaacagaagaattcgaaaaaatcaaaaactgcattttcgttgttcttaaaacaaaaagcatcggctcatcggaattattgcgaacgctccagggcatcagcaaagaaaaagcctggagtgttttaaattttctccaggctgaacaaaaggtttttataaatgaaaaaggcgaattgtctttgagctaa

SEQ ID NO: 4146 - protein, 277 aa, Unknown
  Obtained from environmental sample
  misc_feature (1)..(277): Xaa is any amino acid
MVQFALFAIAINSGEGNSHPFYFEQFIKNFKLDSHTALYSLKTLEQDGWLDFNEKNFSPSTIVFTTNKEQLYQFQESYPEYEQLLTTLLRTYEGIFGFPAFISENLLSRLLRVGEEKIKDDLKKITAFHIIEYIPQNDAPFIIFKKNRVATENLTINLSLYKKRKEAFIERVKKIIEYTQTKECRSIFVNHYFGDYDIKACGICDNCRRAKTLHLSTEEFEKIKNCIFVVLKTKSIGSSELLRTLQGISKEKAWSVLNFLQAEQKVFINEKGELSLS

SEQ ID NO: 4147 - DNA, 729 bp, Unknown
  Obtained from environmental sample
  misc_feature (1)..(729): n is a, c, g, or t
ttggccaacgtcaaagaggccatatggatcaacttaggctattgcaacgacgaggaagagaataaagaacaagcagaagcaacaggacattttacattgacaaccaagagcgtatatacgtgcccgaattgtaaagaaaaaagtgttggtgatattcacgagatccagatttctaatgcagaatacgagattatggatagtatcacaaacgaggcgcaagctggcaataattataaatatatctatcctcatgctttggatttcaaaaagaatgattttcgtttgaatattaatgtcggaaaaattaaacagcgttgcaaaggcaccatcgaagatgctatcaaaagagacaagcaagccacagaaagtggaaatttcgataaattacttactacccttcgaaaatataaaatcgagattgaaaaatcgaccaaatggaacaaaagcagtgaccaaaagaagatcttcgaaatgagtcaatttattatcctatgcgaagacgaagccaatttaaatgcggttgtcgatgtgttaaaaagagcgcccgaattccatatgacactctcagaagacaaaaattactttgtcgaacagttccagactcattatcgaattcacatcgtcaaactctattgcccctcaccgtatgatgtgtatattgaaatgcaactcattttaaaggctatgcacaaatggaaagtttcgaaattgagtcaagaattggattaa

SEQ ID NO: 4148 - protein, 242 aa, Unknown
  Obtained from environmental sample
  misc_feature (1)..(242): Xaa is any amino acid
MANVKEAIWINLGYCNDEEENKEQAEATGHFTLTTKSVYTCPNCKEKSVGDIHEIQISNAEYEIMDSITNEAQAGNNYKYIYPHALDFKKNDFRLNINVGKIKQRCKGTIEDAIKRDKQATESGNFDKLLTTLRKYKIEIEKSTKWNKSSDQKKIFEMSQFIILCEDEANLNAVVDVLKRAPEFHMTLSEDKNYFVEQFQTHYRIHIVKLYCPSPYDVYIEMQLILKAMHKWKVSKLSQELD

SEQ ID NO: 4149 - DNA, 732 bp, Unknown
  Obtained from environmental sample
  misc_feature (1)..(732): n is a, c, g, or t
atggaccctagatatgaagtgtatataggtaacgacatagacaatgaaatagaccttaataaatcgagcgaagacaaactaaagcacatcattaatcaaaatgagctgatggaaggtgatgaattaatagagatgacccaaattaatgaaaagtctccttcgaatatatgcaaaaatttccaacaatcttatgacaactctcctctattttttaataaaagtccgactttagataattatttattaccaaatcaagacgtcacccctgataaaaaatattccagagctgaaaatgaaatttcgagcttgaatgaaacagaatgcgaatttaatttagagaaggctttagaaaaaataaactcttgtgataatagtaatatgagtatgagtattaatatgagtttgagcaaaataaaacaagaaaatctcaaaattgagaatgaaattactcaagaagaccttttcaatgaaactaatttagttcctatcgacagaaattttcacaataataataatttctcaattttcattctcaaaaataaaataaaagaattatataataatgattatacatatatgattacacctctgaagcaattcgattcttgtgaggagtataattattataaaaaattgcaagttgaaagtgaatttaaagaaatcagaaaatcaatttatcaaaattttatttattttccttataatataaaattaataaatcttcttgtctga

SEQ ID NO: 4150 - protein, 243 aa, Unknown
  Obtained from environmental sample
  misc_feature (1)..(243): Xaa is any amino acid
MDPRYEVYIGNDIDNEIDLNKSSEDKLKHIINQNELMEGDELIEMTQINEKSPSNICKNFQQSYDNSPLFFNKSPTLDNYLLPNQDVTPDKKYSRAENEISSLNETECEFNLEKALEKINSCDNSNMSMSINMSLSKIKQENLKIENEITQEDLFNETNLVPIDRNFHNNNNFSIFILKNKIKELYNNDYTYMITPLKQFDSCEEYNYYKKLQVESEFKEIRKSIYQNFIYFPYNIKLINLLV

SEQ ID NO: 4151 - DNA, 456 bp, Unknown
  Obtained from environmental sample
  misc_feature (1)..(456): n is a, c, g, or t
ttgttacaaacattttacaaaatgaaaaaagaagcacaacaaatatttttacccggcggatttaagcaattcaggattctcaaaactaagtatgttctaaacgataagaatgttttagttattggttcaggaagtgaaaaaattgccgagaagatgattgaatccggcgcaggttctgccactatgattgtaaatgattatgattcattgatcaacgcacggttaaatcttattaaggacagtaaagttttagttaagatgatggattttgataacacagattttgatgctgaacagtttgatcttgtttatgggcaggcttcaatttcattattgaacagaaataaaatcataaaagaaataaaacgaattctanaacctgaagcaactttgtgtgttactgaaattaccacgtttacagaggattatcctccatttgtaaaaaacattttttga

SEQ ID NO: 4152 - protein, 151 aa, Unknown
  Obtained from environmental sample
  misc_feature (1)..(151): Xaa is any amino acid
MLQTFYKMKKEAQQIFLPGGFKQFRILKTKYVLNDKNVLVIGSGSEKIAEKMIESGAGSATMIVNDYDSLINARLNLIKDSKVLVKMMDFDNTDFDAEQFDLVYGQASISLLNRNKIIKEIKRILXPEATLCVTEITTFTEDYPPFVKNIF

SEQ ID NO: 4153 - DNA, 690 bp, Unknown
  Obtained from environmental sample
  misc_feature (1)..(690): n is a, c, g, or t
ttgttaaaatcgctgtttctctttacctccttttcctctttctttctcttagtcttaattttgcagccaatgaaaagcttcgacgttcctattgtttaccgcagtccgctgatttccgccattaagaaaaaacgcaaagagcaggacaggatgaagcgggatttctctcctacgcttcttgattttggtccgatcaaaatttatctggcccgccattttggattttgctatggggtggaaaatgctatcgacattgcattcaggacgattgaagaaaatcccggtaagagaatgtatttactgagcgaaatgattcacaatccgcaggtaaatacagatttaaaagcaagcggcgttaaatttttacaggataacgccgggaaacagatcattcctttcgaaagcctgactgcggaagacattgttctgataccggcatttggaaccacgttagtcattgaaaaaaaactgaaagacatcggcattcaggtagaacaatacaacactacctgcccttttgttgaaaaagtatggaaccgcagtgaagtcattgcaaagaacgactatactattgtgatccatggcaagcccaatcatgaagaaacaagagccaccttctcacatgcatctgctaacgctccctcgatagtggtgagagatatggagcaaacaaaagaactggcaaaataa

SEQ ID NO: 4154 - protein, 229 aa, Unknown
  Obtained from environmental sample
  SIGNAL (1)...(18)
  DOMAIN (67)...(229): LytB protein
  misc_feature (1)..(229): Xaa is any amino acid
MLKSLFLFTSFSSFFLLVLILQPMKSFDVPIVYRSPLISAIKKKRKEQDRMKRDFSPTLLDFGPIKIYLARHFGFCYGVENAIDIAFRTIEENPGKRMYLLSEMIHNPQVNTDLKASGVKFLQDNAGKQIIPFESLTAEDIVLIPAFGTTLVIEKKLKDIGIQVEQYNTTCPFVEKVWNRSEVIAKNDYTIVIHGKPNHEETRATFSHASANAPSIVVRDMEQTKELAK

SEQ ID NO: 4155 - DNA, 444 bp, Unknown; identical to SEQ ID NO: 4089
  Obtained from environmental sample
  misc_feature (1)..(444): n is a, c, g, or t

SEQ ID NO: 4156 - protein, 147 aa, Unknown; identical to SEQ ID NO: 4090
  Obtained from environmental sample
  misc_feature (1)..(147): Xaa is any amino acid

SEQ ID NO: 4157 - DNA, 426 bp, Unknown
  Obtained from environmental sample
  misc_feature (1)..(426): n is a, c, g, or t
atgaaagcataccacagttacgaccttatgggttttcttcatcatctgcagaccacacttgataaagctgaagtaggtggtaagcgtgttacagtttatgaaaaaggtttatttttcgatgagtttattactaaatatgaaaatgagcgattgatggagcttaggattaaaacctatcctgaaaaaatttcatctaaagttcttgatgagcatattgtaattggaggcaagcatgttaatatacttcaggatatttaccggttgcagccattagctgatggtaattcccttttaacgttgtcaagtcgttttcaaataaatacacccattaactggtatgcatcgtggtggtccaaaatgctgatgtctgatttgttgagtggcgaattggatttgattaagcgcaggtgcttgacaatccaataa

SEQ ID NO: 4158 - protein, 141 aa, Unknown
  Obtained from environmental sample
  misc_feature (1)..(141): Xaa is any amino acid
MKAYHSYDLMGFLHHLQTTLDKAEVGGKRVTVYEKGLFFDEFITKYENERLMELRIKTYPEKISSKVLDEHIVIGGKHVNILQDIYRLQPLADGNSLLTLSSRFQINTPINWYASWWSKMLMSDLLSGELDLIKRRCLTIQ

SEQ ID NO: 4159 - DNA, 552 bp, Unknown
  Obtained from environmental sample
  misc_feature (1)..(552): n is a, c, g, or t
atgtacaaagcagaactagtttcaaattttgagcaactgaaaaagattcatttgttgaaccagcaaaacctgaaattaaatctttcaaaagagatatgccgtgaagaagggtttgttagctggttgtacccgctggaattattgaagcaaatgcatttgatatctccttccgtcattgttcagcatgaagggcagatagcagggtatgcgttaaccgcaacaaaagaaatgcgacccttccatcccgacctggacataatgtttcaaaacctgcaggagttgcagtacgaaggaagaagtcttgcttactgtaatttttattgtatgggtcagatctgcgtggcaaaaaattttcgtggccaggggatagttaatttattgtatcaaaaacataaagagataaacagtaagcagtatgaatttatcctgacagaaatatctaccgcgaatctccgttccctgaaagcccatgaaaaaatcggctttaaaaaaatttacaactaccgtgacaagatggatgactgggatgtcgtggtctggaactggaattag

SEQ ID NO: 4160 - protein, 183 aa, Unknown
  Obtained from environmental sample
  DOMAIN (58)...(163): Acetyltransferase (GNAT) family
  misc_feature (1)..(183): Xaa is any amino acid
MYKAELVSNFEQLKKIHLLNQQNLKLNLSKEICREEGFVSWLYPLELLKQMHLISPSVIVQHEGQIAGYALTATKEMRPFHPDLDIMFQNLQELQYEGRSLAYCNFYCMGQICVAKNFRGQGIVNLLYQKHKEINSKQYEFILTEISTANLRSLKAHEKIGFKKIYNYRDKMDDWDVVVWNWN

SEQ ID NO: 4161 - DNA, 429 bp, Unknown
  Obtained from environmental sample
  misc_feature (1)..(429): n is a, c, g, or t
ttgtacccgctggaattattgaagcaaatgcatttgatatctccttccgtcattgttcagcatgaagggcagatagcagggtatgcgttaaccgcaacaaaagaaatgcgacccttccatcccgacctggacataatgtttcaaaacctgcaggagttgcagtacgaaggaagaagtcttgcttactgtaatttttattgtatgggtcagatctgcgtggcaaaaaattttcgtggccaggggatagttaatttattgtatcaaaaacataaagagataaacagtaagcagtatgaatttatcctgacagaaatatctaccgcgaatctccgttccctgaaagcccatgaaaaaatcggctttaaaaaaatttacaactaccgtgacaagatggatgactgggatgtcgtggtctggaactggaattag

SEQ ID NO: 4162 - protein, 142 aa, Unknown
  Obtained from environmental sample
  DOMAIN (17)...(122): Acetyltransferase (GNAT) family
  misc_feature (1)..(142): Xaa is any amino acid
MYPLELLKQMHLISPSVIVQHEGQIAGYALTATKEMRPFHPDLDIMFQNLQELQYEGRSLAYCNFYCMGQICVAKNFRGQGIVNLLYQKHKEINSKQYEFILTEISTANLRSLKAHEKIGFKKIYNYRDKMDDWDVVVWNWN

SEQ ID NO: 4163 - DNA, 582 bp, Unknown
  Obtained from environmental sample
  misc_feature (1)..(582): n is a, c, g, or t
atggatttaaatacctttacgacacgttttatttttaatattatgaacagaatatttttaatagttgttttatttatcagctcaacttgtttttcacaaaaatcattgagagattctctttttagcgggaagctgaaagccgattctgccttggtggcgaaaagtaagatcgtcaaagactcaaccaaaaaaacagaaattgatccgtcaaccgggaaaactgaagttgacccggcaataaagcaaaataattcagaaaaaacggaattaaagtattcagataataacagaacctggaagaaatttgtagacgagtacactaagatcatcaatacagaaatactaactacaaagaaagtcaagaaaggtggctatacggtaaccttggaatatgaaattggaacagatggtgtcgtatccactaaaaacataatctgcgatccaaagagtgaatccctcgtgaatctgatccaggaaaggatgatgccaaatgcccctcaattagcgcctcaggtcgttaacggggcgccacgaaaatccaccaaaagacaaatacttgtttttgtgaaagagaagaactaa

SEQ ID NO: 4164 - protein, 193 aa, Unknown
  Obtained from environmental sample
  misc_feature (1)..(193): Xaa is any amino acid
MDLNTFTTRFIFNIMNRIFLIVVLFISSTCFSQKSLRDSLFSGKLKADSALVAKSKIVKDSTKKTEIDPSTGKTEVDPAIKQNNSEKTELKYSDNNRTWKKFVDEYTKIINTEILTTKKVKKGGYTVTLEYEIGTDGVVSTKNIICDPKSESLVNLIQERMMPNAPQLAPQVVNGAPRKSTKRQILVFVKEKN

SEQ ID NO: 4165 - DNA, 672 bp, Unknown
  Obtained from environmental sample
  misc_feature (1)..(672): n is a, c, g, or t
gtggaaaagtttttggggagtaacagttccaagccccgattccggaaggggggaaatttacggaagtcaacgcgttgttcgatgagagagacctccaagttcaacggagtttggatgggatgggaaattggaatgggccgtgacacccggcaatgccaagctttatttatacccatccgggacctgcattatttttgcggaaaaagaccgtccgttggccggggacattatcagggcgtcaggacgctgatcgaatgcggtttgttcgatgaagcccctgttgatttcgagggcgttaagatttcgccgaggaaattccttttgaatatcatcaacccgctgctcgtaccgcaggagggagatggcgatgtctgcgtcatgtacaacaccgtgactggcaccaaagaccaggctccacacaaggtggaatactttatgtgggaaaaggcagacgatgagttctctgccatggcgcgagtaaccagttttccggctgcgattggcgcaaaactgattgcattaggaaaaaccgatctcaaaggaattcgtgcgccggaagaatgtattatgggagagaattacaaatggttcctggaggaactggaggataagaacatcacgatcaaggaaaagtcgtatcctattggggaaaacgaacttcttcctgcatag

SEQ ID NO: 4166 - protein, 223 aa, Unknown
  Obtained from environmental sample
  misc_feature (1)..(223): Xaa is any amino acid
MEKFLGSNSSKPRFRKGGNLRKSTRCSMRETSKFNGVWMGWEIGMGRDTRQCQALFIPIRDLHYFCGKRPSVGRGHYQGVRTLIECGLFDEAPVDFEGVKISPRKFLLNIINPLLVPQEGDGDVCVMYNTVTGTKDQAPHKVEYFMWEKADDEFSAMARVTSFPAAIGAKLIALGKTDLKGIRAPEECIMGENYKWFLEELEDKNITIKEKSYPIGENELLPA

SEQ ID NO: 4167 - DNA, 420 bp, Unknown
  Obtained from environmental sample
  misc_feature (1)..(420): n is a, c, g, or t
atggcgcgtttagtcctcgtattcattcttctccatcagactctcgtcgcgcaagacatcaattacgcaaaagaagtaatccagaacttaacgagtacaaaattgaaagggcggggatatgtcggccgtggtgactatctcgcggctcaatatatcgcgggtgaatttgagaaagcccatcttatcggtttttcaaatacttgttttcagccgttcaacatgcccgttaatacatttcccggcgcaatggtattggaaataaatggcaaaaaacttgtacccgggatagattttttagttgacccaggggcaccaggtataaaaggaaaagttgaggtaataagcctgtcagtccaagacttgattgatcctgaacaatggaagggccaaataaaattgtccaaaggcgcgtttgtctaa

SEQ ID NO: 4168 - protein, 139 aa, Unknown
  Obtained from environmental sample
  SIGNAL (1)...(17)
  misc_feature (1)..(139): Xaa is any amino acid
MARLVLVFILLHQTLVAQDINYAKEVIQNLTSTKLKGRGYVGRGDYLAAQYIAGEFEKAHLIGFSNTCFQPFNMPVNTFPGAMVLEINGKKLVPGIDFLVDPGAPGIKGKVEVISLSVQDLIDPEQWKGQIKLSKGAFV

SEQ ID NO: 4169 - DNA, 717 bp, Unknown
  Obtained from environmental sample
  misc_feature (1)..(717): n is a, c, g, or t
ttgtgggtagaaataaatgcatatgccattgaaggcagtttgtctattttttttaaagacgttacttttcaaaaagagcaggagagaaaaattcgggaactgaatgagcgctattcccacataatggattttatttctgaggccatctgggagtggaagattggtgagcccactgcaacctggtttggaaataacctttcaaaacttttggactggaattcgtctgattgcggatccgtgaaaacatgggaggatgctattcatcccgatgatgtacaaagagtaaaaaatagatttgaatctgcggttagtaacggtgaaatttattactcccaggaataccggcttatgaaaggaaacggtgattttatttatgtccgcgacagggcacatatcattagaaacaaggagggagtttgcattaaagtaattggtgtaacagatgatatttcggatcaaaaaaagtttcaggatgttttattagaaagtgtaaccaaggtggctatagcctcgcaggaaaaggaaagaaccaggctgggcagggaattgcacgataatgtaaaccagatactaaccgcttccaaacttttttttgaaaatgttgaatttcatcctgaaaagagagaagaatttacaggtatgggaattgaacttctgaaaaacgccatcagcgaaatcaggattttatcaaaatcgctggtaacgcccgccgaatag

SEQ ID NO: 4170 - protein, 238 aa, Unknown
  Obtained from environmental sample
  misc_feature (1)..(238): Xaa is any amino acid
MWVEINAYAIEGSLSIFFKDVTFQKEQERKIRELNERYSHIMDFISEAIWEWKIGEPTATWFGNNLSKLLDWNSSDCGSVKTWEDAIHPDDVQRVKNRFESAVSNGEIYYSQEYRLMKGNGDFIYVRDRAHIIRNKEGVCIKVIGVTDDISDQKKFQDVLLESVTKVAIASQEKERTRLGRELHDNVNQILTASKLFFENVEFHPEKREEFTGMGIELLKNAISEIRILSKSLVTPAE

SEQ ID NO: 4171 - DNA, 627 bp, Unknown
  Obtained from environmental sample
  misc_feature (1)..(627): n is a, c, g, or t
ttgctgaagataattgaaggtacaaatgctaacgttccccctaaaggaggaaggaagcaccctgagcagccgcttatcagcataaacacgaagaatatattgttcgtttgcggcggtgcatttgacgggcttgaaaaagtaattcagcaaagagtttcgcaaacatctatcggattcggtaaagagataatcagcaagaaatcgaaggaatatgatgcgcttatggctcaggtagagcccgatgacctgataaggtacggactcatcccagagttcacaggcaggctccccgtaaccgctgtgctgaactcactgaacgaagaggcgctgctttctatactgaccgagcctaaaaatgctatcataaaacagtacaagaagcttttcagaatggaaggcgttgaccttgaatttgaagaagatgctcttgttgcggttactaaaaaagcaattaccaaaggcaccggagccagggctcttagatcaatacttgaagagataatgatagatattatgtataagcttccttcaaagganaatgttaccaagtgtgttgtcacaaaagacgtgataaccaaaagagatcagccggtttatatatctgaatctacaaaacaatacgcttaa

SEQ ID NO: 4172 - protein, 208 aa, Unknown
  Obtained from environmental sample
  misc_feature (1)..(208): Xaa is any amino acid
MLKIIEGTNANVPPKGGRKHPEQPLISINTKNILFVCGGAFDGLEKVIQQRVSQTSIGFGKEIISKKSKEYDALMAQVEPDDLIRYGLIPEFTGRLPVTAVLNSLNEEALLSILTEPKNAIIKQYKKLFRMEGVDLEFEEDALVAVTKKAITKGTGARALRSILEEIMIDIMYKLPSKXNVTKCVVTKDVITKRDQPVYISESTKQYA

SEQ ID NO: 4173 - DNA, 1008 bp, Unknown
  Obtained from environmental sample
  misc_feature (1)..(1008): n is a, c, g, or t
ttgaccctcacccgttttgccgtaaacgaggtgtcggtaggagatgttaggctgtacgttccatacgccatatcaataatggtatgcgtgctacaattgttccattcagaagaaggcattagcgtaggtctcagttatttaaaagaaagaggatacagggaggatattgtaaagaaatttgaactggggtataacacagaagcccgcaatgattttagcgcggccgccattaaaaatcagtatagtggggatttacttgtaaaagccggcctttgcgttcagcgggataatgagtttgtcgataattaccgcaaccgtattatttttcccatacataatcaaacggggaaaattctaggttttggtgcaagggttatccgtaccaacgaccgcgcccctaagtacatcaatacaccggagaatgagatctatataaaaagcaaaatcctttatgggtcatattttgccaggcaggctatcaacaaaatggatgaatgcctactggtagaaggttacacggatgtgatcagtttgcaccaggctggtattgagaatgtttgtgcaagtggtggtacttccctcacggttgaccagttaaggctggtaaaaaagtttacaaataatcttaccatactttacgatggcgacagtgccggagtgaaagctgcgttaagaggcctcgatctcgcccttgaacaaggccttaatgtaaagttggtattgataccaaataacgaggacccggatagttatgtgaacaaggtgggagctgcagcttttatcgattttgtaaagaaacataaaaaggattttatcttgtttcagctccgacctgccctggctgatgtaggaacagattccgttaaaaaaatcgagcttgttaacaaaattgcagaaaccctttcaaagctttataaaacccaggaatttacccgcgtccggattatattcccaaggtggcagaaatttaaaaaaagaaaaagccggactccaaaccttgggttataa

SEQ ID NO: 4174 - protein, 335 aa, Unknown
  Obtained from environmental sample
  DOMAIN (164)...(243): Toprim domain
  misc_feature (1)..(335): Xaa is any amino acid
MTLTRFAVNEVSVGDVRLYVPYAISIMVCVLQLFHSEEGISVGLSYLKERGYREDIVKKFELGYNTEARNDFSAAAIKNQYSGDLLVKAGLCVQRDNEFVDNYRNRIIFPIHNQTGKILGFGARVIRTNDRAPKYINTPENEIYIKSKILYGSYFARQAINKMDECLLVEGYTDVISLHQAGIENVCASGGTSLTVDQLRLVKKFTNNLTILYDGDSAGVKAALRGLDLALEQGLNVKLVLIPNNEDPDSYVNKVGAAAFIDFVKKHKKDFILFQLRPALADVGTDSVKKIELVNKIAETLSKLYKTQEFTRVRIIFPRWQKFKKRKSRTPNLGL

SEQ ID NO: 4175 - DNA, 879 bp, Unknown
  Obtained from environmental sample
  misc_feature (1)..(879): n is a, c, g, or t
atgattgacttctgccataaaaacagcctgccgatagattttatcagtactcactcgtatggagtaaagcaaggatttttagatgaatatggaatttcaggaacagtgctcgccaaagaagaaaatgcagtaagcggcgatgtgcttcagtcaagaaaagagattgagaattcaccgctaaaaaatctcgaattgcattacacggagtggagtgcttcgtatactcctgccgatcctattcatgatagctatcacgaagcagcatacgttcttcaaaaattaaagcaagtgggcagtgcagccaactccatgtcgtactgggtgtttactgatatttttgaagaacccggtccccgctttgaaccttttcacggaggctttggaatgttgaacattcaaggcattaacaagcctgttttttattcttatcaatttttaaaccgtttgggaaatattgaattggcgaataaagatgccgcttcctggatttgtaaggattcttcgggaaatttgcaggcattagtttgggattatacgtacacacttcctgattccaccaacaaccagcagtattatatccgcgaccttccggcaaaatcaaaagggaaattaaacatcaaagtagccaacattcctgccggcaattatgcgcttgaagtgtatagagtaggatatcatagcaatgatgcttattcaacttatttatcaatgggaaaaccacggcagcttacaaagcaacaggtggagcaaattaagaaacaaaatgatggctcaccggtgttaaaagaaatcatcactataaaagacgaagtttctttttccaaagacttagacattcgtgagaatgatgtttactttttgaatttaataaaattataa

SEQ ID NO: 4176 - protein, 292 aa, Unknown
  Obtained from environmental sample
  misc_feature (1)..(292): Xaa is any amino acid
MIDFCHKNSLPIDFISTHSYGVKQGFLDEYGISGTVLAKEENAVSGDVLQSRKEIENSPLKNLELHYTEWSASYTPADPIHDSYHEAAYVLQKLKQVGSAANSMSYWVFTDIFEEPGPRFEPFHGGFGMLNIQGINKPVFYSYQFLNRLGNIELANKDAASWICKDSSGNLQALVWDYTYTLPDSTNNQQYYIRDLPAKSKGKLNIKVANIPAGNYALEVYRVGYHSNDAYSTYLSMGKPRQLTKQQVEQIKKQNDGSPVLKEIITIKDEVSFSKDLDIRENDVYFLNLIKL

SEQ ID NO: 4177 - DNA, 363 bp, Unknown
  Obtained from environmental sample
  misc_feature (1)..(363): n is a, c, g, or t
atggctcataaacatttcacctatttctgcttcatcaaaatcagcaagcttgttttctccaacccaataatttgcatgagtaccgggattatacatggcgaggatctcagcattatttccgtcgcaatgcaggtgcgtactaagaataccgcggttatcatcttctgttggttgcaatacaacggctcctgcgccatcaccaaagatcacagttatatttcttccacgggtgctaaagtcaagtccgaaagaatgtttttcacttgcaacaacaagtatgttcctgtacatgcctgtccttataaactgatctcctgtgctaagcgcataaacaaaaccagaacattgatctcttatatctaa

SEQ ID NO: 4178 - protein, 120 aa, Unknown
  Obtained from environmental sample
  misc_feature (1)..(120): Xaa is any amino acid
MAHKHFTYFCFIKISKLVFSNPIICMSTGIIHGEDLSIISVAMQVRTKNTAVIIFCWLQYNGSCAITKDHSYISSTGAKVKSERMFFTCNNKYVPVHACPYKLISCAKRINKTRTLISYI

SEQ ID NO: 4179 - DNA, 363 bp, Unknown; identical to SEQ ID NO: 4177
  Obtained from environmental sample
  misc_feature (1)..(363): n is a, c, g, or t

SEQ ID NO: 4180 - protein, 120 aa, Unknown; identical to SEQ ID NO: 4178
  Obtained from environmental sample
  misc_feature (1)..(120): Xaa is any amino acid

SEQ ID NO: 4181 - DNA, 612 bp, Unknown
  Obtained from environmental sample
  misc_feature (1)..(612): n is a, c, g, or t
ttgttcgaagaagcgtatgcaacatcgaaggaaattaccgttttcgagaaaataggtaaacctgaatttaaaaaagccgacacactgacaaaccgtgaaatttcagccgaattaaaaaaagcgaaagaattgctgaataaataccaggttgaccttagcaccatttaccctgtggacgatcgcaccctttacagctttattgtggatgaattcatgcaaaagcccattcaggattttttgatccccgggtttatgtcctgttttatttacgaggaatttcatcccaaccatgaaggtgacataaaatggctggtaaggaacaccgtggaagcactgatgaacaagaatgaaaacgggcatgaactttcacgcattgaaaatttccaggaattgaatgccttcttcaacgcgtttgaaatatttacattgcatcattttaacatacatacgctccaaattgaaggtgatgatgccgaatgcgttttcagtataaaattttcaggccgtattgatgtagtctccaccaaagtggtgttcagcggaaatggaaaggcaaaactgaaataccatgatccttcgtggaatatttcccggctggaactgcctgtttaa

SEQ ID NO: 4182 - protein, 203 aa, Unknown
  Obtained from environmental sample
  misc_feature (1)..(203): Xaa is any amino acid
MFEEAYATSKEITVFEKIGKPEFKKADTLTNREISAELKKAKELLNKYQVDLSTIYPVDDRTLYSFIVDEFMQKPIQDFLIPGFMSCFIYEEFHPNHEGDIKWLVRNTVEALMNKNENGHELSRIENFQELNAFFNAFEIFTLHHFNIHTLQIEGDDAECVFSIKFSGRIDVVSTKVVFSGNGKAKLKYHDPSWNISRLELPV

SEQ ID NO: 4183 - DNA, 342 bp, Unknown
  Obtained from environmental sample
  misc_feature (1)..(342): n is a, c, g, or t
atgcgacaacataatttcactgaaataaacataagtgttcccgtcttagatggccctaatgaaattaatttatcttcaaatttgctgactcgatttccgacagaacttactcaaatgacgatggttgatagtatttctttgtatgaacgaaacaaatcaaaaacaaaatcaagtcaaatcaaatcaaaacaaaacaaacaaacaaaacaaaacaaaccaatacaaaacaacaatacaaaacaaatcaaaacaaaacaatacaaaacatatacagagccaataatttgctttctggttctcttccctctgaatttttcgcaatgcaatcaattcgaaagttag

SEQ ID NO: 4184 - protein, 113 aa, Unknown
  Obtained from environmental sample
  misc_feature (1)..(113): Xaa is any amino acid
MRQHNFTEINISVPVLDGPNEINLSSNLLTRFPTELTQMTMVDSISLYERNKSKTKSSQIKSKQNKQTKQNKPIQNNNTKQIKTKQYKTYTEPIICFLVLFPLNFSQCNQFES

SEQ ID NO: 4185 - DNA, 498 bp, Unknown
  Obtained from environmental sample
  misc_feature (1)..(498): n is a, c, g, or t
atgatttcaagtgatggtctgtcgaacacaaccaatgttttgattggaattattgttggagttggaatttgtttccttttgattttcactattgttttgattattgttttattgcgtagaaaacgagcacaacaaagacttgaagcaagagaaataattttgaaagataaaaaacaatcccaaaataatgataaacatgatcagacaacttatgttggagttgaaaacaaagcaatgaacgaaattccatctcaagcacaaaacacaaatctttctatttattccgatacactaccacctccagacaacaacaatcaagaaaataatatttattcaacttttatgcaaaatgaaacagatccaaaaattcaaggaattaaaaaatggattattgatttcaaacaattagagctcgaaacaaaagttggttccggaaatttcggagaagtttggaaaggtaaagaaagaaacagaggaaaaaaaaacaaacatgaataa

SEQ ID NO: 4186 - protein, 165 aa, Unknown
  Obtained from environmental sample
  misc_feature (1)..(165): Xaa is any amino acid
MISSDGLSNTTNVLIGIIVGVGICFLLIFTIVLIIVLLRRKRAQQRLEAREIILKDKKQSQNNDKHDQTTYVGVENKAMNEIPSQAQNTNLSIYSDTLPPPDNNNQENNIYSTFMQNETDPKIQGIKKWIIDFKQLELETKVGSGNFGEVWKGKERNRGKKNKHE

SEQ ID NO: 4187 - DNA, 1128 bp, Unknown
  Obtained from environmental sample
  misc_feature (1)..(1128): n is a, c, g, or t
atgaatcataaaagaaaattagatcaggatcttgttaacgctcagactgcaagaagggttcttgatagagttgttgggtataaattatccccaatcttgtggaaaaaagttaaaagacatttatccgccgggcgtgtccaatctgtcgccttacgattgatagtcgaaagagaaaacgagattaaaaactttgaagcaaaagtattttgcagaataaatcttttaacaactaaaagtggaaataaagacactatcgattttgagttgacaaaaatagatagcgataaacttgaagaatcaacagaaataaaactttatgacggtacttataaatattcacacacaaaactcgataaagaagttgcggaacaaattataaaagagattgaaaattcaggattaaaaataaccgatgtccaacagcgggaatcaaaaagatcatcttacccaccttttattacatcgactctacaacaagcatcatttagaaggtttggttatgccggaaaaagaacaatgtctcttgcacaaagactctacgaagaaggttatataacttatcatagaacagactcctttaacctatctaatgtttttataaaatcatcgcgagaatatatccaaaaagaatttggtaaagaatatttatcctctgacgttaaggtttttaagacaaaatcaaaatctgctcaagaagcgcatgaagcaatccgacctgttaaagttgaagtgaataaagaggtcatccaacaagaattaggcaacgattacgcanacctttatgatctaatttatagacgggcagtggcaactcagatgagtgatgcaatttttgcatcaaccnaattaattggagaaataaagaaggacaaaacttacactttcgaggcaaatggtagtgttttgaaatttgcgggttttatgaagctttatacaatcaaagaggagggaggacaaaatttacccgaaataaaaattggaggatttttggattatgaaagctcaaaagtccagaaaaacaccaccactcccccttccagaaataacgaaacatcccttgttttctctcttcgaaaaaagggttatagaaaaaccatcacttatgccccatttaccctccccttttga

SEQ ID NO: 4188 - protein, 375 aa, Unknown
  Obtained from environmental sample
  DOMAIN (4)...(375): DNA topoisomerase
  misc_feature (1)..(375): Xaa is any amino acid
MNHKRKLDQDLVNAQTARRVLDRVVGYKLSPILWKKVKRHLSAGRVQSVALRLIVERENEIKNFEAKVFCRINLLTTKSGNKDTIDFELTKIDSDKLEESTEIKLYDGTYKYSHTKLDKEVAEQIIKEIENSGLKITDVQQRESKRSSYPPFITSTLQQASFRRFGYAGKRTMSLAQRLYEEGYITYHRTDSFNLSNVFIKSSREYIQKEFGKEYLSSDVKVFKTKSKSAQEAHEAIRPVKVEVNKEVIQQELGNDYAXLYDLIYRRAVATQMSDAIFASTXLIGEIKKDKTYTFEANGSVLKFAGFMKLYTIKEEGGQNLPEIKIGGFLDYESSKVQKNTTTPPSRNNETSLVFSLRKKGYRKTITYAPFTLPF

SEQ ID NO: 4189 - DNA, 780 bp, Unknown
  Obtained from environmental sample
  misc_feature (1)..(780): n is a, c, g, or t
atgagcactcattcggaaaacctgacccttctgcaaaagataggatttcaggtaaataaggaatggaaactttgccgtgatataaaggaagttttgctatacagcagaaagcttgaacagaaaagggaatccctgccttatgaaattgacggtgcagtaattaaagtgaattctctcagacagcaaagaattctcggcagtattgcaaagtcaccgagatgggctgtggccttcaaattcaaagcgaaacaggcaacaacaaaacttaacagaattttctggtcagtaggaaggactgggactgtgactcccgttgcggatttggaacctgtgtttttagccgggtcaactataagtcgtgcaacccttcataatatggatgaaataaaaagaaagaatatccatgaaggtgatattgttataattgagaagggcggagatgtaatacctaaaattgttgcagttgctgatattgaaagcactgatgaaaaacatattcctgaagttccggttaactgtccggtttgcaattcagtattatataagcctgaaaacgaagttgcgatttactgtgaaaatcatcagtgtccggcacaggtaaaaggaaggattgaacattttgcagcacgtggagcgatggatattgagggcttgggtgaagtgctcatcaatgtttttgtaaatcttggatttcttaatacatatgcggatatttattcgctgaatcatcacaaggaagaattgataagccttgaaagattaggaaaaaaaagccattga

SEQ ID NO: 4190 - protein, 259 aa, Unknown
  Obtained from environmental sample
  DOMAIN (1)...(83): NAD-dependent DNA ligase adenylation domain
  misc_feature (1)..(259): Xaa is any amino acid
MSTHSENLTLLQKIGFQVNKEWKLCRDIKEVLLYSRKLEQKRESLPYEIDGAVIKVNSLRQQRILGSIAKSPRWAVAFKFKAKQATTKLNRIFWSVGRTGTVTPVADLEPVFLAGSTISRATLHNMDEIKRKNIHEGDIVIIEKGGDVIPKIVAVADIESTDEKHIPEVPVNCPVCNSVLYKPENEVAIYCENHQCPAQVKGRIEHFAARGAMDIEGLGEVLINVFVNLGFLNTYADIYSLNHHKEELISLERLGKKSH

SEQ ID NO: 4191 - DNA, 645 bp, Unknown
  Obtained from environmental sample
  misc_feature (1)..(645): n is a, c, g, or t
atgattttacaaaagtatttcattccagtttatactaaatggtaccaatcaaacctttgtgaattgtgttttcctcaaaatattacaggtgaaaaatgtttagttgagacaagttttgcttcgattacaccaagattaatttttggctttccaaaagtaaaaagaactaagaacttaaataatattttaaatctaagtagctccctattatatggaaatctaaaaaagggaaataataagtacttatactatacaagggtcggagatattatcaataaaaaggtaaacggagaagaaataaataaaaagaatataataaaatggttaagagatttgagagtcaacttattcgataaaccacaattcaaaagtaataagattgttctaattactccctcanatggtactaaatcaaatttcattgatttagttaatgaatatgtattcgactacaccgcanattgtttaagcatttctctatatgatgaatatattgaaaatacggaatcattgtatgccgatgggctatataaagcagatgttgcattttatgttgatgatgttttatcaaccgctaattcttttttagaaataaatatgttgttaaatatatcagaaataaaatangttctggnaaaaggatag

SEQ ID NO: 4192 - protein, 214 aa, Unknown
  Obtained from environmental sample
  misc_feature (1)..(214): Xaa is any amino acid
MILQKYFIPVYTKWYQSNLCELCFPQNITGEKCLVETSFASITPRLIFGFPKVKRTKNLNNILNLSSSLLYGNLKKGNNKYLYYTRVGDIINKKVNGEEINKKNIIKWLRDLRVNLFDKPQFKSNKIVLITPSXGTKSNFIDLVNEYVFDYTAXCLSISLYDEYIENTESLYADGLYKADVAFYVDDVLSTANSFLEINMLLNISEIKXVLXKG

SEQ ID NO: 4193 - DNA, 675 bp, Unknown
  Obtained from environmental sample
  misc_feature (1)..(675): n is a, c, g, or t
ttgtttcaattatttgttttagatacattttataagctctttgaatataacaacttaagtaaaagctacattcatcaggatttacttgatagcatttttaatgaaaataaggttttagacaagctaattactttccatctattgcgaagcaaaatagaagatattttatttgacttaaagaatccaatatatgagcagcacagcgagctactaaatagatatcgacataatattgaatatgttatcttaaaaataatctgtagtactccaataatttactataaaagcataagagagtcatcatttgattgggttattgctatgcttgaacacgtaagaaccggaggaaataatgaattagcttattgtattaacaatcttaattctgaaaatataatcaactttttcgtagtgaatgcagaaaattactattcagaactacaaaaattaaaatttcttttaaaaagaacggtccaattaaaaagtaactacataatacacccaacttttttcaaatcaataaaaattttaataaatactttattcacaaactatgacagatgtgaaaaaattaaaaatgattcggattccttgtttctagaaaaagtgattaaacttttcaaattaaagtatccgcacttaagaagtcaagcgttcaattatattaaagaatag

SEQ ID NO: 4194 - protein, 224 aa, Unknown
  Obtained from environmental sample
  misc_feature (1)..(224): Xaa is any amino acid
MFQLFVLDTFYKLFEYNNLSKSYIHQDLLDSIFNENKVLDKLITFHLLRSKIEDILFDLKNPIYEQHSELLNRYRHNIEYVILKIICSTPIIYYKSIRESSFDWVIAMLEHVRTGGNNELAYCINNLNSENIINFFVVNAENYYSELQKLKFLLKRTVQLKSNYIIHPTFFKSIKILINTLFTNYDRCEKIKNDSDSLFLEKVIKLFKLKYPHLRSQAFNYIKE

SEQ ID NO: 4195 - DNA, 501 bp, Unknown
  Obtained from environmental sample
  misc_feature (1)..(501): n is a, c, g, or t
ttgtcgaaccagtgcatggtcagtaaaccaaaatctcacactaaaccaatgtccacaaagatgaatcctgatgaaattgaaattgttcttgtagaagataatcccgatgatgcagaattaactattcgggctttaagaaaagcaaacgtatcaaatccccttatacatctggaagacggtgctgaagcattagactttattttttgcacaggaaaatattctgatagaaacggtaacataaagccacggctcattttgctggatctaaatatgccaaaagtgaatggaattgaagtgcttcgtcaactgaagtcagatgagaacactaaaacaattcccgtggtagtactcacatcatcccaggaagatcccgatgtgaaaacttgttatcagcttggggttaatagttatattgtaaagcctgtaggttttacaaattttacaaaagctatatctgaagtgggattatactgggtgcttcaaaattaccaggcgagataa

SEQ ID NO: 4196 - protein, 166 aa, Unknown
  Obtained from environmental sample
  DOMAIN (26)...(159): Response regulator receiver domain
  misc_feature (1)..(166): Xaa is any amino acid
MSNQCMVSKPKSHTKPMSTKMNPDEIEIVLVEDNPDDAELTIRALRKANVSNPLIHLEDGAEALDFIFCTGKYSDRNGNIKPRLILLDLNMPKVNGIEVLRQLKSDENTKTIPVVVLTSSQEDPDVKTCYQLGVNSYIVKPVGFTNFTKAISEVGLYWVLQNYQAR

SEQ ID NO: 4197 - DNA, 561 bp, Unknown
  Obtained from environmental sample
  misc_feature (1)..(561): n is a, c, g, or t
atgatggccaacagaactacagatgctttatttcagctcattcaggccctggaaaagtcagaaaaaagaaattttaagctatacataaaacgaagttctggtaataaagatcttaaaattatagagttgtttgatgctattgaaaaaatgaacgactataatgaaactctccttttaaaaaaacttacttctatacaaaaaccgcaattagctaatacaaaggctcacttgtataaacagcttctttccagtcttcgcctgttgaaaagtacagaaagcatagaccttcaactacatgagcaattagattttgcacgcattttatataataaggggttgtatttgcagagcctcaaaatattagaaaaggttaaggaactggctattgcttataaccaagatagcttccttctgcaagtgatctcactggaaaagaaaattgaaaatctctacattacccgtagcatgcaaaaccgtgccgacaggttaaccattgaggccaatgaagtaaatgaaaggcggacaatgataacccggcttcaaatctcgcctacattctga

SEQ ID NO: 4198 - protein, 186 aa, Unknown
  Obtained from environmental sample
  misc_feature (1)..(186): Xaa is any amino acid
MMANRTTDALFQLIQALEKSEKRNFKLYIKRSSGNKDLKIIELFDAIEKMNDYNETLLLKKLTSIQKPQLANTKAHLYKQLLSSLRLLKSTESIDLQLHEQLDFARILYNKGLYLQSLKILEKVKELAIAYNQDSFLLQVISLEKKIENLYITRSMQNRADRLTIEANEVNERRTMITRLQISPTF

SEQ ID NO: 4199 - DNA, 555 bp, Unknown
  Obtained from environmental sample
  misc_feature (1)..(555): n is a, c, g, or t
atgaacaaattagaacaaagaaagcttttcgtaaaaagaaattttgaacttacagacaagggattaaaatatggattcaagaacctgacaagttctttagagattgaaattccttatgaagacattggaacaaagaagattcatcaaagactcacaaacaataatttattggttctggcaatttttatgttcttctcttcaacggctaaggcgtattactttataacgggagagcataacgacctcatgtttacattaatcgttttggtaatttttgcggttatctccctattggcctatcatagttataaggactatgttttaattgaagccgtaaatccaccatttattgagttctattcaaagcgacctgataaagattctgtcgaaaattttattactgaacttcaaagtaggacgaagaatttcttgataaaaaaatatgcagagcgagataataacataccccttgaaaatcagttggagaccattagttatctgaagaatcgaaatataattgatgaaaaagaatacgaggaactgacgagtaagtga

SEQ ID NO: 4200 - protein, 184 aa, Unknown
  Obtained from environmental sample
  misc_feature (1)..(184): Xaa is any amino acid
MNKLEQRKLFVKRNFELTDKGLKYGFKNLTSSLEIEIPYEDIGTKKIHQRLTNNNLLVLAIFMFFSSTAKAYYFITGEHNDLMFTLIVLVIFAVISLLAYHSYKDYVLIEAVNPPFIEFYSKRPDKDSVENFITELQSRTKNFLIKKYAERDNNIPLENQLETISYLKNRNIIDEKEYEELTSK

SEQ ID NO: 4201 - DNA, 552 bp, Unknown
  Obtained from environmental sample
  misc_feature (1)..(552): n is a, c, g, or t
ttgaacataccaacgaccctttgcctttgcaaaaattgcgggttaaaaatttgcgatgcctacagggcacagtatggctgcatttttatttctgtaatgccaaccaatatgtatggaccaattgataattacgatctgaccacttctcatgtgctgcctgcctgttgcgtaaagtttcacgaaggaaaacaagctggtaaaaaagaagtggtgatctggggcaccggcacaccacgcagggagtttatgcatgtagatgatgctgcagaagcctgcctgtttttaatgaagcattataatgatgccgggctgataaatatcggcgtaggtgaagacctctccataaaagaacttgcagaattgataaaagagataactggctttgaaggcagcattgtttttgatacatcaaaaccagatggcacgccaagaaaattaatggatgtatcaaagctcaatgcacttggctggaaagcaactattcctttacaagaaggaataaagaatgtttaccacgatcacttcgaatcaacgaaacgaataagccaatag

SEQ ID NO: 4202 - protein, 183 aa, Unknown
  Obtained from environmental sample
  misc_feature (1)..(183): Xaa is any amino acid
MNIPTTLCLCKNCGLKICDAYRAQYGCIFISVMPTNMYGPIDNYDLTTSHVLPACCVKFHEGKQAGKKEVVIWGTGTPRREFMHVDDAAEACLFLMKHYNDAGLINIGVGEDLSIKELAELIKEITGFEGSIVFDTSKPDGTPRKLMDVSKLNALGWKATIPLQEGIKNVYHDHFESTKRISQ

SEQ ID NO: 4203 - DNA, 402 bp, Unknown
  Obtained from environmental sample
  misc_feature (1)..(402): n is a, c, g, or t
ttgcaaatgaagaccaaaattgtaatcaatccgaagtatagttttctcagccaatacattaatcagatacctgaacactttgaagctcttaccgaagttctgtacaaagacagaaatgtgatcaaggctgataaggtctccaacgtagaggtagtgatcaaatcctttcatcgaaattatctttccaatcgcattcgttatacattttttcatccgtcaaaggctaagagagccttcgacaacggaatggaattgataaagcgtggttttctaacacccgatccggttgcatttatagaacgttttgagtacggcctgatgaacgagagtttttttatttgcctgaggtcggacttcaccaagctggaatttcactttacaagcnggtgggaacaattctga

SEQ ID NO: 4204 - protein, 133 aa, Unknown
  Obtained from environmental sample
  misc_feature (1)..(133): Xaa is any amino acid
MQMKTKIVINPKYSFLSQYINQIPEHFEALTEVLYKDRNVIKADKVSNVEVVIKSFHRNYLSNRIRYTFFHPSKAKRAFDNGMELIKRGFLTPDPVAFIERFEYGLMNESFFICLRSDFTKLEFHFTSXWEQF

SEQ ID NO: 4205 - DNA, 501 bp, Unknown
  Obtained from environmental sample
  misc_feature (1)..(501): n is a, c, g, or t
gtgcgtttgataaatttaggtccgttatttttgttattgcctgacagtttttctcctgcaaaaaaagaattcttaactggctttttaaatatttttcccaaaaagtatcaactctttgttgagctccgcaatccggaatggtatgcggataaaacaattttaaatgaattactgactaacttctctgagcataatactggtctgattatcaccgataccgaaggccgccgagatatggctcacatgaatctgaccattccaaaggtgttcatacgctttgtgggcaatagtttgcacaaaacagattattcgcgttgtgatgactgggtgaagcggatcaaatattggattgaaagtggaattgaagaagtatatttttttatgcacatgcacgacgaggccaattcgcccgagcttactgtttattttattgaacaactcaataaagcctgcaaactaaatttgcataatcccgaatggagaaaggaaaaaactgcatga

SEQ ID NO: 4206 - protein, 166 aa, Unknown
  Obtained from environmental sample
  misc_feature (1)..(166): Xaa is any amino acid
MRLINLGPLFLLLPDSFSPAKKEFLTGFLNIFPKKYQLFVELRNPEWYADKTILNELLTNFSEHNTGLIITDTEGRRDMAHMNLTIPKVFIRFVGNSLHKTDYSRCDDWVKRIKYWIESGIEEVYFFMHMHDEANSPELTVYFIEQLNKACKLNLHNPEWRKEKTA

SEQ ID NO: 4207 - DNA, 354 bp, Unknown
  Obtained from environmental sample
  misc_feature (1)..(354): n is a, c, g, or t
ttgaaattatctttatttaaaaaaatgcaaccaaaacttttcatttctctttttatcctcattgccacttcctgttcttcaaataaatatgctgctaccaacagagattacaagcgacatgcaaaaaatttatccaggcaaatcaagcaaattcctaaaaataattttacatcttccgcttctccttggattggaaccacaaactttggtttgcgcaatcctaattttgtggtgatccatcataccgcgcaaaacagttgtgatcagactttcacaacattcacacttccgcgaaactcaagtagcgctcattatgtgatctgtaaagatggcccgcatacaacacatgcttaa

SEQ ID NO: 4208 - protein, 117 aa, Unknown
  Obtained from environmental sample
  misc_feature (1)..(117): Xaa is any amino acid
MKLSLFKKMQPKLFISLFILIATSCSSNKYAATNRDYKRHAKNLSRQIKQIPKNNFTSSASPWIGTTNFGLRNPNFVVIHHTAQNSCDQTFTTFTLPRNSSSAHYVICKDGPHTTHA

SEQ ID NO: 4209 - DNA, 318 bp, Unknown
  Obtained from environmental sample
  misc_feature (1)..(318): n is a, c, g, or t
atgccaccgattacatttgatggattatttaacgacctggataaaaggctgaacctgggggtgtatattgacctgacaggatcaaaaccaaaactcattattgatgagtgggaagcattgtttagaaataaccaggttgcgacatttgaaaacctccccaacttaaaaagccaggttgcaaaagaactcatctattcaaatataaaatttggcggcaagtctcttgaccagatcgccaattcttttccgggaggagtcaggtttttgggtttcaaaactgaaaagtatttaatcgttggaaactgccccggtagataa

SEQ ID NO: 4210 - protein, 105 aa, Unknown
  Obtained from environmental sample
  misc_feature (1)..(105): Xaa is any amino acid
MPPITFDGLFNDLDKRLNLGVYIDLTGSKPKLIIDEWEALFRNNQVATFENLPNLKSQVAKELIYSNIKFGGKSLDQIANSFPGGVRFLGFKTEKYLIVGNCPGR

SEQ ID NO: 4211 - DNA, 474 bp, Unknown
  Obtained from environmental sample
  misc_feature (1)..(474): n is a, c, g, or t
ttgatgaaagatggcagtatcggcggttggtcgaacatgaatttaaaaaacttattgcctgaggaggcgggtatatttatatgtgattataagaaaagagatgcaattttgaagaaccggcgccaagcagcagattcacttaaaaacaaaaatggcgggccgcttggaattttatatttgaaggaaatagttatcggttcatcgaacgaacctttccacagtttagcacttgctaaacttcccggtattaaaaaaacttccaatgatttattttcttttaatgaaggtccatcactacgattgaaaaactcaaagatcaatggaatagaaaaaatcgttgtcaaggtaaaatctattaagaaagccaggacgtttttagttgagaataaccttcttggtgcagccactacaacctccatttacattgatccaaaagtgcttgacgggttaataattgaacttaccgataattag

SEQ ID NO: 4212 - protein, 157 aa, Unknown
  Obtained from environmental sample
  misc_feature (1)..(157): Xaa is any amino acid
MMKDGSIGGWSNMNLKNLLPEEAGIFICDYKKRDAILKNRRQAADSLKNKNGGPLGILYLKEIVIGSSNEPFHSLALAKLPGIKKTSNDLFSFNEGPSLRLKNSKINGIEKIVVKVKSIKKARTFLVENNLLGAATTTSIYIDPKVLDGLIIELTDN

SEQ ID NO: 4213 - DNA, 918 bp, Unknown
  Obtained from environmental sample
  misc_feature (1)..(918): n is a, c, g, or t
atgattctcgatgacggcggcgacctcacgaaaatcatgcacgccgagtatccggaactgatgaaagacgtcaaaggcgtttccgaagaaacaaccaccggcgtcttgcgcctgcacgacatggcgaagaaaggcacgctgaaagtgcctgcaatcaacgtcaacgattctgttactaaatcaaagttcgacaacaagtacggctgccgtgaatcgctcgtcgattccatccgccgcgctaccgacatcatgatggccggtaaagtggctgtcgtcgccggttacggcgacgtgggcaagggctccgccgactcgctgcgccatgcaggttgccgcgtgatcgtcaccgaaatcgacccgatctgcgcgctgcaggctgcgatggaaggctacgaagtattgacgatggaagactctgttccgcgcggcgacatcttcgtcacaacaacaggcaacaaggacgtcatcaccgtcgaccatatgcgcggcatgaaagacggcgcaatcgtctgcaacatcggccacttcgacaatgaaatccaggtcgagccgctgcgcaacatgaaatgggtcaacatcaagccacaggtcgaccagatcgaattcccgtcaggcaagcgaatcatcctgctggccgaaggccgccttgtgaacctcggctgcggcacaggccacccttcgtttgttatgtccgcgtcattcacgaaccagacgctggcgcagattgaactctgngaaaatcattcccaatacgaaaataaagtttacgtactgccgaaagaacttgatgaaaaagtagcacgtctccacttggaaaaagtgggtgcgaagctatctaaactgaccaangaacaggccgactatatcggtgtccctgttttccgggtcgttccaaaaaagacgactattggatactaa

SEQ ID NO: 4214 - protein, 305 aa, Unknown
  Obtained from environmental sample
  DOMAIN (1)...(300): S-adenosyl-L-homocysteine hydrolase
  misc_feature (1)..(305): Xaa is any amino acid
MILDDGGDLTKIMHAEYPELMKDVKGVSEETTTGVLRLHDMAKKGTLKVPAINVNDSVTKSKFDNKYGCRESLVDSIRRATDIMMAGKVAVVAGYGDVGKGSADSLRHAGCRVIVTEIDPICALQAAMEGYEVLTMEDSVPRGDIFVTTTGNKDVITVDHMRGMKDGAIVCNIGHFDNEIQVEPLRNMKWVNIKPQVDQIEFPSGKRIILLAEGRLVNLGCGTGHPSFVMSASFTNQTLAQIELXENHSQYENKVYVLPKELDEKVARLHLEKVGAKLSKLTXEQADYIGVPVFRVVPKKTTIGY

SEQ ID NO: 4215 - DNA, 843 bp, Unknown
  Obtained from environmental sample
  misc_feature (1)..(843): n is a, c, g, or t
atgaaatangggaatgagatcatttactatcaaaggcctctaaaatcccaaaaaagcagggtttccatttgtgagtttgaaggaaagttcgagaccatcagcaaagaagacaaatcgagggaagtttttgttggtccgaaggttgcaccaaggtcttctccgctattccagctttgtaagatatgggaaacaataaatcatataaaactgaagtcgaagacaggagatgaactggaaatcaacccagagcaaagactaaagttatttgaatttctggacaatcatgaacacttatctacttctgaatttttcaaaatcctgaatgtaaggaaagaagattactatgttaacaagcagttggaaaaaggactacaaggcaatataaccaaggctaaaatttctgctattctgaaggatctgcctaataaagatgaactaacaagatttgatctttctttagatcataaaaccggagaattatttgaagaaaaagtgtcttctacttttgaaaaggaacctttatacagattgtggcacattctctattcattacctgaaaaagatgatgcaataaaaacactttttaagcaattttccttatctccaacagttgcagaaaaattagctgagctggatttcactaagtcaggatttggaaacaaatcatccaaggctataaggaaaattcttccttttctgcaaaaagggatgacctacagtgatgcctgcgctgaagctggctataatcacagtaattccataaccagcgaagaaaatctatcaaggaacctactggaggcccttcccagcttaccaaaaaacagtctgaggcagcctatgtga

SEQ ID NO: 4216 - protein, 280 aa, Unknown
  Obtained from environmental sample
  misc_feature (1)..(280): Xaa is any amino acid
MKXGNEIIYYQRPLKSQKSRVSICEFEGKFETISKEDKSREVFVGPKVAPRSSPLFQLCKIWETINHIKLKSKTGDELEINPEQRLKLFEFLDNHEHLSTSEFFKILNVRKEDYYVNKQLEKGLQGNITKAKISAILKDLPNKDELTRFDLSLDHKTGELFEEKVSSTFEKEPLYRLWHILYSLPEKDDAIKTLFKQFSLSPTVAEKLAELDFTKSGFGNKSSKAIRKILPFLQKGMTYSDACAEAGYNHSNSITSEENLSRNLLEALPSLPKNSLRQPM

SEQ ID NO: 4217 - DNA, 999 bp, Unknown
  Obtained from environmental sample
  misc_feature (1)..(999): n is a, c, g, or t
gtgaccggaaaaatagaattgaaggaactaggaagagtacttctacacctcaatcaaaagagaggttataaaagcagcaggaagagtgacgtagaccaaagtaaggaaacagaatatgtagcagcagtcaataacaggtttggacaaattcaagaactcgggtttactgttgggcaatatttttatcatggccttaaagaagatcctcattatagggtaaaagaacaggtatttccaagaatagcctaccaggaagagtttgacctcataataaaagaacagaaaaagcattatcctaatctactaacggaccagaaatgcaatgaaataaggaatgagatcatttactatcaaaggcctctaaaatcccaaaaaagcagggtttccatttgtgagtttgaaggaaagttcgagaccatcagcaaagaagacaaatcgagggaagtttttgttggtccgaaggttgcaccaaggtcttctccgctattccagctttgtaagatatgggaaacaataaatcatataaaactgaagtcgaagacaggagatgaactggaaatcaacccagagcaaagactaaagttatttgaatttctggacaatcatgaacacttatctacttctgaatttttcaaaatcctgaatgtaaggaaagaagattactatgttaacaagcagttggaaaaaggactacaaggcaatataaccaaggctaaaatttctgctattctgaaggatctgcctaataaagatgaactaacaagatttgatctttctttagatcataaaaccggagaattatttgaagaaaaagtgtcttctacttttgaaaaggaacctttatacagaatgtggcacattctctattcctttactgaaaaagatgatgcattaaaaacactttttaagcaattttccctatcttccacagttggcgaaaaattactgagctggatttccctaatccgggattgggaaacaaatctcccaaggctttaa

SEQ ID NO: 4218 - protein, 332 aa, Unknown
  Obtained from environmental sample
  misc_feature (1)..(332): Xaa is any amino acid
MTGKIELKELGRVLLHLNQKRGYKSSRKSDVDQSKETEYVAAVNNRFGQIQELGFTVGQYFYHGLKEDPHYRVKEQVFPRIAYQEEFDLIIKEQKKHYPNLLTDQKCNEIRNEIIYYQRPLKSQKSRVSICEFEGKFETISKEDKSREVFVGPKVAPRSSPLFQLCKIWETINHIKLKSKTGDELEINPEQRLKLFEFLDNHEHLSTSEFFKILNVRKEDYYVNKQLEKGLQGNITKAKISAILKDLPNKDELTRFDLSLDHKTGELFEEKVSSTFEKEPLYRMWHILYSFTEKDDALKTLFKQFSLSSTVGEKLLSWISLIRDWETNLPRL

SEQ ID NO: 4219 - DNA, 969 bp, Unknown
  Obtained from environmental sample
  misc_feature (1)..(969): n is a, c, g, or t
atgcttccctcaaaaaagacttcaattatttatgatgctaatgatgatgaattagtaaagactgctgcgcatctttttcaaaaagatgtggaaatgattaccgggattagcctttcattgacgaatacagtttcttcttcaagaaattttatcattatcggtactattgataaatcccatttcatccgtcaactcatccaaagcaacaaacttgaagtaaaaaaaataaaaactacatgggaaggttatcttatccaggttgtaaaaaatccatttccaggtgtaagtgaggcattggtaataaccggcagtgacaggcggggcacagctttcggtgtttttgaattaagcaggcaaatgggcatatcaccatggtattggtgggcagatgttcccgtaatgaaaaaaaacagcctttattttaagaaaggcattatactttctgatgcgccaaaagtaaaatatcggggcatttttatcaacgatgaggcgcctgcattgagtaactggagcaaggaaaaattcggtggcttcaatcatcttttttatgaaaaggtttttgagctaatgctgcgtctcaaatcaaattatatctggccagccatgtggggaaatgcattttatgatgatgattcattgaatataaaaaccgcagataagtatggcatcataatcggtacatcgcatcatgagccgctgatgcgggcacatgacgaatggagaagatatggcagcggccagtggaactatgatagtaatgaagtgaagctgaaagccttctggcgggtttgtatacaaagagcaaccaatgaaaaaatagtaagcgtatgcctgcgaggcgatggagatgaacctatgagcagggaaactgccacacctctacctgaaagaatggaaaaaaccaccggcaatcatccaaaacgtaacggggaaacggggaaaacaaaccaaagttttggccttggataa

SEQ ID NO: 4220 - protein, 322 aa, Unknown
  Obtained from environmental sample
  misc_feature (1)..(322): Xaa is any amino acid
MLPSKKTSIIYDANDDELVKTAAHLFQKDVEMITGISLSLTNTVSSSRNFIIIGTIDKSHFIRQLIQSNKLEVKKIKTTWEGYLIQVVKNPFPGVSEALVITGSDRRGTAFGVFELSRQMGISPWYWWADVPVMKKNSLYFKKGIILSDAPKVKYRGIFINDEAPALSNWSKEKFGGFNHLFYEKVFELMLRLKSNYIWPAMWGNAFYDDDSLNIKTADKYGIIIGTSHHEPLMRAHDEWRRYGSGQWNYDSNEVKLKAFWRVCIQRATNEKIVSVCLRGDGDEPMSRETATPLPERMEKTTGNHPKRNGETGKTNQSFGLG

SEQ ID NO: 4221 - DNA, 627 bp, Unknown
  Obtained from environmental sample
  misc_feature (1)..(627): n is a, c, g, or t
atgccaaaaattgataatgtatttgggaatgagaagctccgcaaagcctggaatagcctaaagccatgggtcgtttttgtggctgtacttatggtattgagatacacaggggctttatcagggatctctatccttaccggaagggcgttaatggaaacaggcgtcatggacgtcaagccggaagagcccgcagtagcgaaaaaattcaattataatttcagcatcaaggatatgaatggcaatgtcctcgatgtgaaggacttaaaaggtaaaacgatcttccttaacctatgggcaacatggtgcgggccctgccggatggaaatgccctctattcaaaaattgtacagtcaggtagataaagacaaggtcgtgttcatcatgctctcaattgatcgcgaaaacgacatcgagaaaataaagagttacataaaggataaagaatttacttttccagtttacacacctgcgagtcttttgcctaatcagctccaggtcgggatgatccccaccacatttgtaatcaaccacgaaggccgcattgtggccagcgaaaagggagcggccaattacgacacgcccgaattcaaggcatttctggaaaaacaggtcctgccaggtcagtaa

SEQ ID NO: 4222 - protein, 208 aa, Unknown
  Obtained from environmental sample
  DOMAIN (73)...(205): Thioredoxin
  misc_feature (1)..(208): Xaa is any amino acid
MPKIDNVFGNEKLRKAWNSLKPWVVFVAVLMVLRYTGALSGISILTGRALMETGVMDVKPEEPAVAKKFNYNFSIKDMNGNVLDVKDLKGKTIFLNLWATWCGPCRMEMPSIQKLYSQVDKDKVVFIMLSIDRENDIEKIKSYIKDKEFTFPVYTPASLLPNQLQVGMIPTTFVINHEGRIVASEKGAANYDTPEFKAFLEKQVLPGQ

SEQ ID NO: 4223 - DNA, 468 bp, Unknown
  Obtained from environmental sample
  misc_feature (1)..(468): n is a, c, g, or t
atgagatcaaagatatttttattgatgctgtntactgcatcattttattctccatctttattttcgcaaaaggtaaaaaacaatcgtgcaactatattgaatcatattgcagtatatgttcaggacctgcaaaaaagcacccatttttattcaacaatcattggtttggagaccatcccggaaccttttcatgacggcaaacatacctggtataaaattggccaacaaagccagttacatttaatacaaggtgcagggttgccattacctcaaaataaaaacagtcacctgtgttttagtgttgaatctgtggaagattttgtaacaacactcaaaaataacaatattgaattcgaggattggcctggtgaaaaaaataaaattaccatgcgggttgatggagtgaaacagatttattttaaagaccctgatggttattggattgaaattaacaatgactctttgtag

SEQ ID NO: 4224 - protein, 155 aa, Unknown
  Obtained from environmental sample
  SIGNAL (1)...(19)
  DOMAIN (32)...(150): Glyoxalase/Bleomycin resistance protein/Dioxygenase superfamily
  misc_feature (1)..(155): Xaa is any amino acid
MRSKIFLLMLXTASFYSPSLFSQKVKNNRATILNHIAVYVQDLQKSTHFYSTIIGLETIPEPFHDGKHTWYKIGQQSQLHLIQGAGLPLPQNKNSHLCFSVESVEDFVTTLKNNNIEFEDWPGEKNKITMRVDGVKQIYFKDPDGYWIEINNDSL

SEQ ID NO: 4225 - DNA, 489 bp, Unknown
  Obtained from environmental sample
  misc_feature (1)..(489): n is a, c, g, or t
atgagtgatacaatttcaatagcaagattaaatcttttacacccactaatcagggaggatgccatagcagcttaccaggaagcggtcaaactcactcctgaaggtgtccacccggtaattgtacaaacgctaagaacttntgaggagcaggatttactatatcagaaaggacgtacaaggccggggcctaaagttaccaacgcaaaaccgggatcttcttttcaccaatatgcgctggccgttgacgcgtgtttggagattaatggaaagcttgtttggaaggttgataaaaattggatgataatggtagaatgttttaaaaaatacggttttgattggggtggcgactggaaaagttttaaggattacccacactttgaaaaaacatttggttacacttggaaagaacttttagcactacataatgccggaaagattgaaggcgattatgtgaaaattaaccttacgccttctaatatagtttcctga

SEQ ID NO: 4226 - protein, 162 aa, Unknown
  Obtained from environmental sample
  DOMAIN (14)...(150): D-alanyl-D-alanine carboxypeptidase
  misc_feature (1)..(162): Xaa is any amino acid
MSDTISIARLNLLHPLIREDAIAAYQEAVKLTPEGVHPVIVQTLRTXEEQDLLYQKGRTRPGPKVTNAKPGSSFHQYALAVDACLEINGKLVWKVDKNWMIMVECFKKYGFDWGGDWKSFKDYPHFEKTFGYTWKELLALHNAGKIEGDYVKINLTPSNIVS

SEQ ID NO: 4227 - DNA, 768 bp, Unknown
  Obtained from environmental sample
  misc_feature (1)..(768): n is a, c, g, or t
gtgatatcgaacaaccgtcctgaatggaatatccttgatatgggaatgctccaggccggaatcgtaaacgtaccgctgtataccacacttagtgcaaatgagacccagtttatcctcaatgacagcggtgcaaaactgatttttgtttcagacaaagcattgtatgaaaaagttctttccgtaaaatcacagttacctgcggtgtcggacgtcatcaccttcgaaaaaattacaggcgtttcaaactggaatgatttcctggagaaaggaaaacagaataaaaatgaaaaggagctgacagattctaagaaatcgattcttccggaagatgtcgcaacgctgatctatacatcaggtaccacaggtaatcccaaaggcgtgatgctcacacataacaatctcgtgagtaatgtttggggaacaagaacactgatacctgcaggatataaagcaaaagcactaagcttccttccactgtgccatgtatatgaacgcatgcttacgtacttatatatgtatgtaggtatttcgatctattatgcgcaaagcatggatacgattgtagataacatcaaggaagtaaagcctgatgtattttctacagtgcctcgtttgctggaaaaagtttacgacaggatcgttgcaaagggcaaagaacttacaggaattaaacgcaaactttttttctgggcattgaacctcggactgaaatataaaatgaacggcgaaaacggattgtattatgaaatccagttatgngcttgctaa

SEQ ID NO: 4228 - protein, 255 aa, Unknown
  Obtained from environmental sample
  misc_feature (1)..(255): Xaa is any amino acid
MISNNRPEWNILDMGMLQAGIVNVPLYTTLSANETQFILNDSGAKLIFVSDKALYEKVLSVKSQLPAVSDVITFEKITGVSNWNDFLEKGKQNKNEKELTDSKKSILPEDVATLIYTSGTTGNPKGVMLTHNNLVSNVWGTRTLIPAGYKAKALSFLPLCHVYERMLTYLYMYVGISIYYAQSMDTIVDNIKEVKPDVFSTVPRLLEKVYDRIVAKGKELTGIKRKLFFWALNLGLKYKMNGENGLYYEIQLXAC

SEQ ID NO: 4229 - DNA, 333 bp, Unknown; identical to SEQ ID NO: 165
  Obtained from environmental sample
  misc_feature (1)..(333): n is a, c, g, or t

SEQ ID NO: 4230 - protein, 110 aa, Unknown; identical to SEQ ID NO: 166
  Obtained from environmental sample
  misc_feature (1)..(110): Xaa is any amino acid

SEQ ID NO: 4231 - DNA, 390 bp, Unknown
  Obtained from environmental sample
  misc_feature (1)..(390): n is a, c, g, or t
ttgcaaatgaagaccaaaattgtaatcaatccgaagtatagttttctcagccaatacattaatcagatacctgaacactttgaagctcttaccgaagttctgtacaaagacagaaatgtgatcaaggctgataaggtctccaacgtagaggtagtgatcaaatcctttcatcgaaattatctttccaatcgcattcgttatacattttttcatccgtcaaaggctaagagagccttcgacaacggaatggaattgataaagcgtggttttctaacacccgatccggttgcatttatagaacgttttgagtacggcctgatgaacgagagtttttttatttgcctgaggtcggacttcaccaagctggaatttcacttacaagcggggtga

SEQ ID NO: 4232 - protein, 129 aa, Unknown
  Obtained from environmental sample
  misc_feature (1)..(129): Xaa is any amino acid
MQMKTKIVINPKYSFLSQYINQIPEHFEALTEVLYKDRNVIKADKVSNVEVVIKSFHRNYLSNRIRYTFFHPSKAKRAFDNGMELIKRGFLTPDPVAFIERFEYGLMNESFFICLRSDFTKLEFHLQAG

SEQ ID NO: 4233 - DNA, 609 bp, Unknown
  Obtained from environmental sample
  misc_feature (1)..(609): n is a, c, g, or t
ttgcaatttagaaatttactcatcgattattcattatcttcctctcaaaaacgtttcatgttgaagtatttggtaatattcattgtgtgccttcagttcaccgccggtgcccagagctacgaccttttgatctcaaatggaaagattattgacggcacaggcaacccgtggtttatgggagatatcgcgatcaaggagggaaaaattgttaaagttggccgaattgcaggggatgcaacacgcattattgatgcaaacggcatgatcgtgtgccccggatttattgatgtgcacacccatattgaaggcagcgccttaaaatatcccacggcaccaaattttattcacgatggcgttaccacagttgtaacccgtaatttgcgattttctgaggttgatattgaggactacttttcaaagctcgatagcgccagggtgtccatcaacgtagcgactcttattgggcatatggaattaaaaacaactgttaagggaaaaaaatattccgtgcgcctgaacccctcggaaacaaaagcaaaaggaaacactcttattaataaaaaccatgggaagaacgggggccaattggaattttttcccagggaatga

SEQ ID NO: 4234 - protein, 202 aa, Unknown
  Obtained from environmental sample
  misc_feature (1)..(202): Xaa is any amino acid
MQFRNLLIDYSLSSSQKRFMLKYLVIFIVCLQFTAGAQSYDLLISNGKIIDGTGNPWFMGDIAIKEGKIVKVGRIAGDATRIIDANGMIVCPGFIDVHTHIEGSALKYPTAPNFIHDGVTTVVTRNLRFSEVDIEDYFSKLDSARVSINVATLIGHMELKTTVKGKKYSVRLNPSETKAKGNTLINKNHGKNGGQLEFFPRE

SEQ ID NO: 4235 - DNA, 414 bp, Unknown
  Obtained from environmental sample
  misc_feature (1)..(414): n is a, c, g, or t
atgtgtgtcgaatcgacatttagaaacttcaaattttcaaattgtattttgccaattaataaatctccttcaaaactagtgctggaaagatccaaagcattccatttaataacatttacttcttggcgtttcgttgtcacaaaaaataaatcgtcgatacctttatttaaagataaatctacatctatattcatttgcgctaattgtgcacaatataccttcacacttgattgtaattttgtagattgcaatattaacttttgcaaacaaggaaaatcacccaaagcaggtaatatttcagatgcatggttatataaatcaatacctgataagttttatattttcaaatttgtaaattgctgcataactaatctattttcatctaaactcgaagtagcaaagaatatcgtttga

SEQ ID NO: 4236 - protein, 137 aa, Unknown
  Obtained from environmental sample
  misc_feature (1)..(137): Xaa is any amino acid
MCVESTFRNFKFSNCILPINKSPSKLVLERSKAFHLITFTSWRFVVTKNKSSIPLFKDKSTSIFICANCAQYTFTLDCNFVDCNINFCKQGKSPKAGNISDAWLYKSIPDKFYIFKFVNCCITNLFSSKLEVAKNIV

SEQ ID NO: 4237 - DNA, 330 bp, Unknown
  Obtained from environmental sample
  misc_feature (1)..(330): n is a, c, g, or t
atgattgtaacttttctcatcgttagcgttactacagggctcttgcagttgcatcaatttaaaacatcctcttattttgttcttggatcacctcaaccaaaagagaatgtcaccattacagcgctttttaaccaaatgggcaaaccagatatggtgaaggagcttttgatcgatgctatcaataaattaaaatctgatcatcctgatcttggcatcaatttaaaatatatcgaacttcatgatttgactcacaatgccaccaaagatgaaatgttgaagactatatcaaatgggacgcatatcgatattatatccttagatcagatatga

SEQ ID NO: 4238 - protein, 109 aa, Unknown
  Obtained from environmental sample
  misc_feature (1)..(109): Xaa is any amino acid
MIVTFLIVSVTTGLLQLHQFKTSSYFVLGSPQPKENVTITALFNQMGKPDMVKELLIDAINKLKSDHPDLGINLKYIELHDLTHNATKDEMLKTISNGTHIDIISLDQI

SEQ ID NO: 4239 - DNA, 465 bp, Unknown
  Obtained from environmental sample
  misc_feature (1)..(465): n is a, c, g, or t
atgcaagcaaagccactgacaggatataaatacattcaagatgagataaaaagctttgtcagcgactttggatttaatgtttataatccctccacattatatagagtaacagtaaacgatctgctacaatttctttcattccaaaaaggtgtcagctcattgagtaatcaaatgacgatcaatattgtccaacagggcttatttgttccaggttgttcatttgaaaaattacagccaggcaatcgaatcggacaatttataaattctgaacaagacaaatggtggtattgtgacgacgatnaggtaaaagagagtgtaacggaaatcaaggaaatcttactaaaagtatttttcccttctttgattctgcaccaattcacaaaactttctgaaactattaatctgaaaattatggtttgtttgggggatcccacgcaatttttaaacaaggttttttctttctaa

SEQ ID NO: 4240 - protein, 154 aa, Unknown
  Obtained from environmental sample
  misc_feature (1)..(154): Xaa is any amino acid
MQAKPLTGYKYIQDEIKSFVSDFGFNVYNPSTLYRVTVNDLLQFLSFQKGVSSLSNQMTINIVQQGLFVPGCSFEKLQPGNRIGQFINSEQDKWWYCDDDXVKESVTEIKEILLKVFFPSLILHQFTKLSETINLKIMVCLGDPTQFLNKVFSF

SEQ ID NO: 4241 - DNA, 507 bp, Unknown
  Obtained from environmental sample
  misc_feature (1)..(507): n is a, c, g, or t
atgaaaaaaaaaatcaccatcctcattttattttttttcatctgcctgtttgcattgagccagggacgcactgttcagacaacaagaccctgtgataaagaaatgttgaaaaaaatagcgggccgatggatgcctattggcaggtttttaagtccaaaaaaatcaatacaacaggagcaggaaattgtgcaccggcttgatgtaatacaaaaaatggcctttaatgtttaccctgaacccatggcttttgatgccgttcagggatatggcatagccaataaagattttgcttcacaacttaaaattgaaaccacagcttatggaaccagcgattcttatataaatggtatttcaatcatattctatgaatactttgtaaagttttgtgattatttctgcggcaacagtaataagaatgaatattttaaaggtgccggctgcgaaacgggaacaaacatcggtgtcactataaataatcttgatccacttttctttcattatacttga

SEQ ID NO: 4242 - protein, 168 aa, Unknown
  Obtained from environmental sample
  SIGNAL (1)...(20)
  misc_feature (1)..(168): Xaa is any amino acid
MKKKITILILFFFICLFALSQGRTVQTTRPCDKEMLKKIAGRWMPIGRFLSPKKSIQQEQEIVHRLDVIQKMAFNVYPEPMAFDAVQGYGIANKDFASQLKIETTAYGTSDSYINGISIIFYEYFVKFCDYFCGNSNKNEYFKGAGCETGTNIGVTINNLDPLFFHYT

SEQ ID NO: 4243 - DNA, 789 bp, Unknown
  Obtained from environmental sample
  misc_feature (1)..(789): n is a, c, g, or t
atgtcttcgcagtcaaaaacctcccctctgcaacacgattacaaatacaagctcggattttcactgcaggacctgggttggataaaatacctcaagccgcaaaatgcacgcgacttcaccatggaaatagaccaaacgcttgattttgattctttccagggatcgggagatacccctcttgcggatgtagataaatcgctcaatgacaaatacccgatggatgccggagacgataaattccgcatgaacctgcctaccgttgcaagcatccagggagattattatgccggcaagaacatccatataaattccacgttcaattacgcatttcagttcagaaaaaatgagaacaaaattcatgaggtaacaactttcagcattagtccgcgctgggactggaaatggctgggtttctatatgcctttctcctacaacaaatactctcatacccgtgtaggtatgagtatgcgcataggtccgctgatcgtaggaatggccgatatccttccgctcgtttcaaaacgcgatgtatacggggttgattttcacatgatgctgaaagtgcctcatattcagttaaaaaagaaaaacaagaaccccaggaccaagagcaaatttgacacaaacaaagaaatttctccaaaaaagaagaaagaacgcaatacccctaatgcanaccgtgaacagaaatcacgcaagcacattttccctaaaatacgtatctttaanaagaagaaaagacgtgcttccgtagatgataaagagcacacaatttattttaaactataa

SEQ ID NO: 4244 - protein, 262 aa, Unknown
  Obtained from environmental sample
  misc_feature (1)..(262): Xaa is any amino acid
MSSQSKTSPLQHDYKYKLGFSLQDLGWIKYLKPQNARDFTMEIDQTLDFDSFQGSGDTPLADVDKSLNDKYPMDAGDDKFRMNLPTVASIQGDYYAGKNIHINSTFNYAFQFRKNENKIHEVTTFSISPRWDWKWLGFYMPFSYNKYSHTRVGMSMRIGPLIVGMADILPLVSKRDVYGVDFHMMLKVPHIQLKKKNKNPRTKSKFDTNKEISPKKKKERNTPNAXREQKSRKHIFPKIRIFXKKKRRASVDDKEHTIYFKL

SEQ ID NO: 4245 - DNA, 636 bp, Unknown
  Obtained from environmental sample
  misc_feature (1)..(636): n is a, c, g, or t
atgggatggagaatctttttgttcataggaattttgttgggtctgcaaacccttgtatattttacgtttataaattactggaaaaccacgaagttttataaacctgtccacaggtggtgggtccttgcgccatttctggtctttaacatctctttcatagtaatatccgtaatttggggaagaaagttcacaccgcctgaatggttcagaatagtagctttatacccattttatgtatggatagctgcgacgtttttcatatccctgtggcttcttattgggaagataatcaaactgcccttccagatcccaatctggatcgcgaaaatattcaaaccgcttcgccggaagatcaattcagtaaaagaaaaaaaagctgtgagaactgtagatctttcaaggagaaaatttgtgcggtatgcaaccatgggtatatcaacctacgcatttgccgggggcacatacggaatgataaaacacgactcctacgaaattgactacaaaaatattacgatagaagatctgccgcctgaactgcgcggtactactattacgctcttaagtgatattcatgcaggacagtacatgaatgaaaataaaaatgcgccgatatgcagatgttatcaattcgcttga

SEQ ID NO: 4246 - protein, 211 aa, Unknown
  Obtained from environmental sample
  misc_feature (1)..(211): Xaa is any amino acid
MGWRIFLFIGILLGLQTLVYFTFINYWKTTKFYKPVHRWWVLAPFLVFNISFIVISVIWGRKFTPPEWFRIVALYPFYVWIAATFFISLWLLIGKIIKLPFQIPIWIAKIFKPLRRKINSVKEKKAVRTVDLSRRKFVRYATMGISTYAFAGGTYGMIKHDSYEIDYKNITIEDLPPELRGTTITLLSDIHAGQYMNENKNAPICRCYQFA

SEQ ID NO: 4247 - DNA, 375 bp, Unknown
  Obtained from environmental sample
  misc_feature (1)..(375): n is a, c, g, or t
ttggacgaaattatgaagattcaagcagccgaatacacgcgatttataaagaacttttctacgcttgcaaacatcatgacgaaaaagttntatgtcgtcgttccatttttcctcgtgnctgacgctcaaaagtccggcataggccaaagtataaaaagcatcctcaagcccgcgactaaatccagtcaacttctcccagaacagcttaccgaatacagaaatcaagtcctccagcgcactgagcttattcttgatggacttataacgctaggcctaagagcaaaaatactaaaggaagatgagttgactaatttattctatagtttttacaaccctgattcacaaacccaattaaccacacccgatggaaaataa

SEQ ID NO: 4248 - protein, 124 aa, Unknown
  Obtained from environmental sample
  misc_feature (1)..(124): Xaa is any amino acid
MDEIMKIQAAEYTRFIKNFSTLANIMTKKXYVVVPFFLVXDAQKSGIGQSIKSILKPATKSSQLLPEQLTEYRNQVLQRTELILDGLITLGLRAKILKEDELTNLFYSFYNPDSQTQLTTPDGK

SEQ ID NO: 4249 - DNA, 516 bp, Unknown
  Obtained from environmental sample
  misc_feature (1)..(516): n is a, c, g, or t
gtggagataacaacaaaaaaggttcgtcgggccggggaagcagcaatcaaagcaaccagggttttggatcttccgcgcaaaaaggaaaatcaaatcatggagatcaaaccggcggaagggcttctgaaagacagccaaaaaaagcagatcagtctgctaacagaaaccagagcgaagagaataacgctttacaaagccatcaataacgatggctttgtactttcacctctaaattacgttatgaagtttgtcgccatatctgatacccattgccggcacagaaatatcaaactcccaaaaggagatgtactattgcatgcaggggatgttagttataaaggcgacaaagatgaagttgttgattttttaaaatggttcagcaaacaggaatttgcgcataaaatatttatcgccggcaaccatgatttttattttgaaagagcaaaaattgatgaggtaaagacgctcattccaaaagatgtcatttatctaaatgatagcggaactacaatttga

SEQ ID NO: 4250 - protein, 171 aa, Unknown
  Obtained from environmental sample
  misc_feature (1)..(171): Xaa is any amino acid
MEITTKKVRRAGEAAIKATRVLDLPRKKENQIMEIKPAEGLLKDSQKKQISLLTETRAKRITLYKAINNDGFVLSPLNYVMKFVAISDTHCRHRNIKLPKGDVLLHAGDVSYKGDKDEVVDFLKWFSKQEFAHKIFIAGNHDFYFERAKIDEVKTLIPKDVIYLNDSGTTI

SEQ ID NO: 4251 - DNA, 663 bp, Unknown
  Obtained from environmental sample
  misc_feature (1)..(663): n is a, c, g, or t
atgatagatgctgatacaatatctgagattgtgggaaaatatgatctagataatatacacttggcagtcattggtagtcattccgcattggaaataatggatggagcaaaggacgaggggataaaaactgtatgtatttgtcaaaaaggaagagaattaccatatttgagatttaagcgattggtagatgtaataattttagtagataaattctcagacctacttttcaaagagaatcaagagaaacttaaagaaattagtagtattgttgtaccccatcgggcattcactgcatatgtagggtacgattcaatagagaacgaattaaaattaccaatacttggaaataggagcctttttcgtgccgaggaaaggggtgccgacagaaatcagtattatttgttggaacgcgcgcaaataaaccatcctaagatttacaaaaaatattcagatatagacggattagcaatagttaaaattcaagaatctaaaagaaagcttgaaagagcatttttcatagtcagctcagcacaggattatgtcgtaaagtcgcaaaacaagataaaagagaaaatgattacaatggaaagtcttgattcatctgtaattgaacaattcgttgtaggaacatattttaattttaattttttctcatcgccctga

SEQ ID NO: 4252 - protein, 220 aa, Unknown
  Obtained from environmental sample
  DOMAIN (21)...(147): Protein of unknown function (DUF1246)
  misc_feature (1)..(220): Xaa is any amino acid
MIDADTISEIVGKYDLDNIHLAVIGSHSALEIMDGAKDEGIKTVCICQKGRELPYLRFKRLVDVIILVDKFSDLLFKENQEKLKEISSIVVPHRAFTAYVGYDSIENELKLPILGNRSLFRAEERGADRNQYYLLERAQINHPKIYKKYSDIDGLAIVKIQESKRKLERAFFIVSSAQDYVVKSQNKIKEKMITMESLDSSVIEQFVVGTYFNFNFFSSP

SEQ ID NO: 4253 - DNA, 831 bp, Unknown
  Obtained from environmental sample
  misc_feature (1)..(831): n is a, c, g, or t
ttgcccggtttggagaaaaggattcttaccttggggacgaaaaccgttggaagtccccttttttgggggattgaagaatccggaagagatcattatttaacaggcgaaaaatcacccgccctggccgttcaaatgtatgggagcgacgataaggacaaatccaatactttattcaggcttatttgcgccctcgcaaaccgttctaccattgtgttttgcaaccaacgcgagtttgtagaagaagtaagccatgctctgaaagaaaaaagcattgtgaatgtattttatcacggcgctatggaacagcaggaacgcgacagcgccctgtgcaagttccggaacggcacttccaatgtattggtgaccaccgacctggctgcacgcggactggatattccgaacatccgctatattatacattaccagcttcccaatacgcaggaatctttcacccaccgcaatgggcgtacggcccgcatggaagccagcggtaccgccatattgatactggcgcctggcgaaagagttcctgaatacatttcaccggcacctacgaccatcgatctgccgcccacggctgaagtgcctcaaaaaccggtgtggaccactttatttattgcagccggcaaaaaggacaaggtgaacaaagttgatattgtaggcttcctgaccaatagaggccagttgaaaaaagaagatatcgggttgattgaagtaaaagactttttctcttttgtggcggtgcgtaaatcgaaagcgagccataccttgcaaatgatcaaggagcagaagataaaaaataaaaaggtaaagatcgatgtagcgaagtaa

SEQ ID NO: 4254 - protein, 276 aa, Unknown
  Obtained from environmental sample
  DOMAIN (190)...(276): DbpA RNA binding domain
  misc_feature (1)..(276): Xaa is any amino acid
MPGLEKRILTLGTKTVGSPLFWGIEESGRDHYLTGEKSPALAVQMYGSDDKDKSNTLFRLICALANRSTIVFCNQREFVEEVSHALKEKSIVNVFYHGAMEQQERDSALCKFRNGTSNVLVTTDLAARGLDIPNIRYIIHYQLPNTQESFTHRNGRTARMEASGTAILILAPGERVPEYISPAPTTIDLPPTAEVPQKPVWTTLFIAAGKKDKVNKVDIVGFLTNRGQLKKEDIGLIEVKDFFSFVAVRKSKASHTLQMIKEQKIKNKKVKIDVAK

SEQ ID NO: 4255 - DNA, 576 bp, Unknown
  Obtained from environmental sample
  misc_feature (1)..(576): n is a, c, g, or t
atgaaaacggatccgtttatcgggttcgttgatgcaaacattcatgcagctaatggtcttggtaaatacattgccaacctcggaagagttgagaatttagaaaaggtaattgacgagaaccaaatagaggaagtaattatcgcaatagaaaaaaatgaaagaaaagatctggaaaaaattttacaacgtttaagtgaaaaggaagtgaatgtaaaaatgatacctgataaggtagatatattaagtggcgccgtaagaacaaataatgtaatgggtgtgccactcatagaattaaatacaggactcatgaagccgtggcagcagaatataaaacgactaattgatgttacgttttctgctgcggccttactgctcttatcaccgcttttattattcacagcattaaaagtgaaattgtcatctgccggacctgttattttctcacaggagcgaattgggtataaaggcagaccgtttataatatacaagttcagatccatgtatatagatgcagaaaaaaacggaccgttactaagcagcgcagatgacaaaagaatacaccccggggtagggtaa

SEQ ID NO: 4256 - protein, 191 aa, Unknown
  Obtained from environmental sample
  misc_feature (1)..(191): Xaa is any amino acid
MKTDPFIGFVDANIHAANGLGKYIANLGRVENLEKVIDENQIEEVIIAIEKNERKDLEKILQRLSEKEVNVKMIPDKVDILSGAVRTNNVMGVPLIELNTGLMKPWQQNIKRLIDVTFSAAALLLLSPLLLFTALKVKLSSAGPVIFSQERIGYKGRPFIIYKFRSMYIDAEKNGPLLSSADDKRIHPGVG

SEQ ID NO: 4257 - DNA, 330 bp, Unknown
  Obtained from environmental sample
  misc_feature (1)..(330): n is a, c, g, or t
ttgcttaaaaaacctgttcataaaaaaaagcagctcctccgtatacctggcataaccgccaaagtggtaattataaaatgtcttttcatccggcccctggttggcctcccatcctttcagcacgacaatgccaataacatcctgtcggttcaaacacgccttcctgagaccgcgcaacatagtgccggttcctactgcacaaataatatggctatagtcatttgccgggataagatcaatgatctcagctgcgcctttctctccttcgataccagctccaccttcaggaatcacataatatccagggaattcttttgtaagggatactga

SEQ ID NO: 4258 - protein, 109 aa, Unknown
  Obtained from environmental sample
  misc_feature (1)..(109): Xaa is any amino acid
MLKKPVHKKKQLLRIPGITAKVVIIKCLFIRPLVGLPSFQHDNANNILSVQTRLPETAQHSAGSYCTNNMAIVICRDKINDLSCAFLSFDTSSTFRNHIISREFFCKGY

SEQ ID NO: 4259 - DNA, 459 bp, Unknown
  Obtained from environmental sample
  misc_feature (1)..(459): n is a, c, g, or t
atgaaaactattataataatttccacaatcttgataattacttcatgtgccgcccctgttaagatgacagaaagtgacaacttaataaaagtatatgaagacactaaaggcaccaaaggcgaactttatctaagggcaaacgattggatggttaatactttcaaagattccaaaagcgtaattcagcatagtgataaggaggagggagttatactcggcaaatatttactcggaaaatcctacgtttctcaatatagaactgatgagatatttgcagttgttgatattcgattaaaagataataaatctcgtattgaaatcaaaccacaagggtcatggttaaataatggaggtactctgaaatcttatcaatatactagagaaaatgcaataagggatatgaataaactagcagattcattccataaagcgatgcaaaaaaatgctgttgatttttaa

SEQ ID NO: 4260 - protein, 152 aa, Unknown
  Obtained from environmental sample
  SIGNAL (1)...(17)
  misc_feature (1)..(152): Xaa is any amino acid
MKTIIIISTILIITSCAAPVKMTESDNLIKVYEDTKGTKGELYLRANDWMVNTFKDSKSVIQHSDKEEGVILGKYLLGKSYVSQYRTDEIFAVVDIRLKDNKSRIEIKPQGSWLNNGGTLKSYQYTRENAIRDMNKLADSFHKAMQKNAVDF

SEQ ID NO: 4261 - DNA, 558 bp, Unknown
  Obtained from environmental sample
  misc_feature (1)..(558): n is a, c, g, or t
ttgatgtttttaaattcaggggatacattttattcaactgatgtaataaatagttttattaattttagtaaggataagaaaagtaaagtgatctatggaaattccaatgttatcaatagagatggtatggccgttaaattgatcccgccggttaaattgaatttaaacttttggtaccgaaaaaccttaaatcaccaggcggtattttttaaacgagagctttttggatcatacggtttgtataattcctcatacaggtatagtgcagatctggatttcttattaaacgtttttaagaatgaaccggaaacctttgagtatttcaataagatcatttgcaattatcatgagataggattaagtgccaaaccggaaaactatgacaagatcattgaagaaaaagagcaaatattaaaaagccgtttaacttcagatgaatataaaagtgcaagaaagcaatatttgaagggactaccgtttaaaacacggttattgatctatatctctcaaagaccgtttcttaagaaaattgtaggtaaattatatgaaaaaaaatga

SEQ ID NO: 4262 - protein, 185 aa, Unknown
  Obtained from environmental sample
  misc_feature (1)..(185): Xaa is any amino acid
MMFLNSGDTFYSTDVINSFINFSKDKKSKVIYGNSNVINRDGMAVKLIPPVKLNLNFWYRKTLNHQAVFFKRELFGSYGLYNSSYRYSADLDFLLNVFKNEPETFEYFNKIICNYHEIGLSAKPENYDKIIEEKEQILKSRLTSDEYKSARKQYLKGLPFKTRLLIYISQRPFLKKIVGKLYEKK

SEQ ID NO: 4263 - DNA, 954 bp, Unknown
  Obtained from environmental sample
  misc_feature (1)..(954): n is a, c, g, or t
gtgctgcaattaagtaaagaagacggtttacaggaaaatgaattcaataccaattcttttgcccggtcggttgatggcgaattattttttggtggagtaaatggcatcagtagcttttatcccgtctcgatcagcacaaacccggagaaactaaagttattgtttactggcatccgcgcaaatggtgaagatgctgttcctggtacagcagcctgggaagttcaatcgatcaacctcccttattttaaaaactctctgtcgtttgattttattgccatgggaaattacaatgttgaccaatacatttatcaatataaaatggaaggggtagataatgaatggatacagcaaaatggcttgcagacggtcaggtacagtttacctccggggaaatacacgttcaaaatatatgcatcacgatcttacgatgacgatgcaaacccaataaaagaaatcaggataactatccgcaatcctttctggaaaagcgggtggttccttttcctcgttttactggcatttatatcattgcttgcttattttatcaaccagaagatcaaaaaaaaatacgcaaaaaaattacagcaactggaaaatgaacgtcaacttaaacaagagcgcgaacgtatctccaaagaccttcacgacagtttaggggtttacgccaatgcggtcatttataaatctgaactcctggaaaaagaaaccggtgaagaaaaaagaaaaggacttataagtgacctgaaatttgcctccaaggacatcatcgtttccctcaaggaaacagtctgggcattaaaaatgaaaaaatatccgcaaaagaatgctttgtacccattcaaaatttcatgcaaccgccttaccccttttttacacaaatattccattttaaaaacggaagggggtaacctcccaacgacatttggaacttttcgcaatacaagaacgccttaa

SEQ ID NO: 4264 - protein, 317 aa, Unknown
  Obtained from environmental sample
  DOMAIN (103)...(140): Two component regulator three Y motif
  misc_feature (1)..(317): Xaa is any amino acid
MLQLSKEDGLQENEFNTNSFARSVDGELFFGGVNGISSFYPVSISTNPEKLKLLFTGIRANGEDAVPGTAAWEVQSINLPYFKNSLSFDFIAMGNYNVDQYIYQYKMEGVDNEWIQQNGLQTVRYSLPPGKYTFKIYASRSYDDDANPIKEIRITIRNPFWKSGWFLFLVLLAFISLLAYFINQKIKKKYAKKLQQLENERQLKQERERISKDLHDSLGVYANAVIYKSELLEKETGEEKRKGLISDLKFASKDIIVSLKETVWALKMKKYPQKNALYPFKISCNRLTPFLHKYSILKTEGGNLPTTFGTFRNTRTP

SEQ ID NO: 4265 - DNA, 528 bp, Unknown
  Obtained from environmental sample
  misc_feature (1)..(528): n is a, c, g, or t
atgaaaaaagccaggtattttttacttcttgttttttattcctttttacttcttgtttttaactcatgttctgtaaataaagcaaagatagacaacagcctgaaaaaatattttgatgcaaaaaatgttgacggttgttttactttacttaataatgctgatggtcttataacggtttataatatgaatcttgatacgaccagagtacttcccgcatcaaccttcaaaattgttaattcactggtcggccttcaaacaggtgctattaaggatgagagcatgataattaaatgggatgggatacggcgaccggtaaaagaatggaataaggatatgaatatgaaagaggcatttaaagtaagttgtgttccatattaccaggaagtagccaggcgtattggaagggataccatgaaattgtggatagacagtcttgcctatggtaataggaatattgagggtcctgttgattccttttggttgaataatcatttgaagatatctccggatgaacaacttggattatga

SEQ ID NO: 4266 - protein, 175 aa, Unknown
  Obtained from environmental sample
  DOMAIN (45)...(174): Penicillin binding protein transpeptidase domain
  misc_feature (1)..(175): Xaa is any amino acid
MKKARYFLLLVFYSFLLLVFNSCSVNKAKIDNSLKKYFDAKNVDGCFTLLNNADGLITVYNMNLDTTRVLPASTFKIVNSLVGLQTGAIKDESMIIKWDGIRRPVKEWNKDMNMKEAFKVSCVPYYQEVARRIGRDTMKLWIDSLAYGNRNIEGPVDSFWLNNHLKISPDEQLGL

SEQ ID NO: 4267 - DNA, 501 bp, Unknown
  Obtained from environmental sample
  misc_feature (1)..(501): n is a, c, g, or t
ttgattatattgatttgtggttatcctggggttggaaaaacgacattagctcatgaacttgctccttttattaatgctgtagttttatctacagataaaattagaaaggaatttattgacacaccgaattatggagaagaagaaaaaagaacagtttataaaatattcatattgatagctaaatatcttcataaagctggaatacattgtattcttgatgctacattttataatcaaaaatcaagagaagatgttaaaactaaactgaacttacgaaatgacgaatacaaaattattgaatgcatttgccctgaagaattagtgatttccagactaaccgatagaagaaacgattattctgacgcagatatatctatttatcaaaaaataagaaaaatttatgaccctattaaagaaaaacatataacagtaaatacaagtcagtctttaaagaagactataccagaagttgtaaatagattacaaaatcatgagtgttga

SEQ ID NO: 4268 - protein, 166 aa, Unknown
  Obtained from environmental sample
  misc_feature (1)..(166): Xaa is any amino acid
MIILICGYPGVGKTTLAHELAPFINAVVLSTDKIRKEFIDTPNYGEEEKRTVYKIFILIAKYLHKAGIHCILDATFYNQKSREDVKTKLNLRNDEYKIIECICPEELVISRLTDRRNDYSDADISIYQKIRKIYDPIKEKHITVNTSQSLKKTIPEVVNRLQNHEC

SEQ ID NO: 4269 - DNA, 336 bp, Unknown
  Obtained from environmental sample
  misc_feature (1)..(336): n is a, c, g, or t
atggggaatagattttatttatatgatagactagattttancgattctttgagatatgcagatgttgtagaagatgtagcacatcttgtaatggatcttgactttcatcaaagaaatgatctaagtaaatttttaattaaagagtatattcaaaaaagtcacgatgagaatatgagtaaattaatttattttatgatgtgttataaagcttgtgttagagccaaagtgtccttctttagagcacaagaagttgacacgaaaaataagaaaattattcatgagatggaagcaaaaaaacatttagaaattgctaaaaaatatataaagtttttttga

SEQ ID NO: 4270 - protein, 111 aa, Unknown
  Obtained from environmental sample
  misc_feature (1)..(111): Xaa is any amino acid
MGNRFYLYDRLDFXDSLRYADVVEDVAHLVMDLDFHQRNDLSKFLIKEYIQKSHDENMSKLIYFMMCYKACVRAKVSFFRAQEVDTKNKKIIHEMEAKKHLEIAKKYIKFF

SEQ ID NO: 4271 - DNA, 417 bp, Unknown
  Obtained from environmental sample
  misc_feature (1)..(417): n is a, c, g, or t
atgaataaaatcacccaactttttaatataaaataccctattattcagggaggaatgatctggaacagtggatataaactggcaagcgcagtgagtaatgccggaggactaggcttaattggagccggatctatgtatcctgatgttttacgtgaacatatccagaaatgtaaaaaagcaacggacaaaccttttggagttaatgtgccaatgttgtatcccaacgttgaagaaatcatgaaaattcttgttgaagaagaggtgaaaattgtttttacttcggcaggtaatccgaaaacatggaccaattatttaaaagaacacggaattactgttgttcatgtagtaagtagttctaaatttgcactaaaatcgcaggaagcaggtgtagatgccgtagtagccgaaaggttttga

SEQ ID NO: 4272 - protein, 138 aa, Unknown
  Obtained from environmental sample
  DOMAIN (1)...(138): 2-nitropropane dioxygenase
  misc_feature (1)..(138): Xaa is any amino acid
MNKITQLFNIKYPIIQGGMIWNSGYKLASAVSNAGGLGLIGAGSMYPDVLREHIQKCKKATDKPFGVNVPMLYPNVEEIMKILVEEEVKIVFTSAGNPKTWTNYLKEHGITVVHVVSSSKFALKSQEAGVDAVVAERF

SEQ ID NO: 4273 - DNA, 405 bp, Unknown
  Obtained from environmental sample
  misc_feature (1)..(405): n is a, c, g, or t
atgaaagcacacatcagaataattttattggcactgtttttcggaactgcagtgcaggcacagacttaccgttttgaagtttctggactcagtatatctgtaaaagaaaagggcaaatggagtaagttcactccgtttaaggaaacgaatattgttgcaagtctgaacactcaaaaaaattatattgcggtatactcagaaattgagcaatattttaaaatagcagactatcgcgataaaaaggaggaagatggtaaagaaatcctgggttttgattgtgtagatcaaaatggagaaacttgtttccttgaaatacaaacacggaaaaaagagaatatgagtcagttgtatgttacttataatgatagaatttttgtatacaacatgaaatatgtgaataaataa

SEQ ID NO: 4274 - protein, 134 aa, Unknown
  Obtained from environmental sample
  SIGNAL (1)...(19)
  misc_feature (1)..(134): Xaa is any amino acid
MKAHIRIILLALFFGTAVQAQTYRFEVSGLSISVKEKGKWSKFTPFKETNIVASLNTQKNYIAVYSEIEQYFKIADYRDKKEEDGKEILGFDCVDQNGETCFLEIQTRKKENMSQLYVTYNDRIFVYNMKYVNK

SEQ ID NO: 4275 - DNA, 450 bp, Unknown
  Obtained from environmental sample
  misc_feature (1)..(450): n is a, c, g, or t
ttgatttggatcgccgttcgagggacgatcacgataacaaaagcaacacgatactccgagccgcatccgatggcggaaactgtttcgccgatcagcatcgtcgctaaatatgaatttgtcgaagatccgaaatcgaaatactcaggtgtgtttaccggcacattccgcagtgactttgtttacgagcctgccaagcccgatgaataccagctcgacaacaacggagatgacggctacatgaataatacgttcgttggtgtctggacatcaaagtccggcaagcagaagaaatgcatctggggattagagcgcctgccctacaccgaagactgggacgaaggcgccggcgagatctacgtcaacaagaagtacgtcaagaacggctggcagtcgtacatgaaacagatcactgcagacaaacccgcgaagaaggatgagtggtgggagtga

SEQ ID NO: 4276 - protein, 149 aa, Unknown
  Obtained from environmental sample
  misc_feature (1)..(149): Xaa is any amino acid
MIWIAVRGTITITKATRYSEPHPMAETVSPISIVAKYEFVEDPKSKYSGVFTGTFRSDFVYEPAKPDEYQLDNNGDDGYMNNTFVGVWTSKSGKQKKCIWGLERLPYTEDWDEGAGEIYVNKKYVKNGWQSYMKQITADKPAKKDEWWE

SEQ ID NO: 4277 - DNA, 801 bp, Unknown
  Obtained from environmental sample
  misc_feature (1)..(801): n is a, c, g, or t
atgaaatcatcctcactagaaaaagcccttcgatggattggttatggttatgcggttgccgcaccaataataacgatacttttcccacagcttcttgtagcatatccaataatcggccttgtgttggccccatcctgggttggtctcctaggtaaaatcttatatgacaataatgagcaattttatttttggttctcgaaaacatggctgaagctatcgcgtagctacgtggattggtccctgtcggtcaaattaaaagctccacaaaatcctaaagtactgaacaggatcaaagacaaaatcttaaaaagctatcctgacgcaaagatttggcacaatgaggatttcaagaagatcattgagttgtctataggttgcaatataaggctcgaatatatagtgtggggcgacgggctcgataatgagcaaacaactctacagtttagcgtttcagaattatcggtgcctttcaacaagagcgaacagatatcagaacatatcctctcgatcatcaacgatatattgctccctgaaagtcatcctgaaagacagcaatatattttgcgtgtgaaattcggtgaacgcaatccgtacttcggtgtttttgttcgcaaactgcggttaccggatcaaagtctggcaagtttcaaagttgagtattatcaaagcgtggggcataaaaaagaaaaggtagaggttggcagcaaggaagtcgcggtcataacagacagtttgccaagtctacaaattctctcgcaacgtttcataactctagcaagtcttgatctgacgaatcaatag

SEQ ID NO: 4278 - protein, 266 aa, Unknown
  Obtained from environmental sample
  misc_feature (1)..(266): Xaa is any amino acid
MKSSSLEKALRWIGYGYAVAAPIITILFPQLLVAYPIIGLVLAPSWVGLLGKILYDNNEQFYFWFSKTWLKLSRSYVDWSLSVKLKAPQNPKVLNRIKDKILKSYPDAKIWHNEDFKKIIELSIGCNIRLEYIVWGDGLDNEQTTLQFSVSELSVPFNKSEQISEHILSIINDILLPESHPERQQYILRVKFGERNPYFGVFVRKLRLPDQSLASFKVEYYQSVGHKKEKVEVGSKEVAVITDSLPSLQILSQRFITLASLDLTNQ

SEQ ID NO: 4279 - DNA, 327 bp, Unknown
  Obtained from environmental sample
  misc_feature (1)..(327): n is a, c, g, or t
ttgataaatattctggaaggaaaatcatatcgaccgataaaagaattaaaaacagattctcttgatcgaaataatttagagcaaatagctggctcgtatgaaatacatcaagtaggccaggttaacattttagtggaaggttcaaaagtaattttaaaactcaatgacggaatggaataccgcatgcacctcgttgataagaaaactttttacattccagggctagacccgtggatttcatttagttcgataaaagacggtaaatttcaaaacatttattggagttcaacagtactgcaagcggcaggtaaaagaatttcaaattaa

SEQ ID NO: 4280 - protein, 108 aa, Unknown
  Obtained from environmental sample
  misc_feature (1)..(108): Xaa is any amino acid
MINILEGKSYRPIKELKTDSLDRNNLEQIAGSYEIHQVGQVNILVEGSKVILKLNDGMEYRMHLVDKKTFYIPGLDPWISFSSIKDGKFQNIYWSSTVLQAAGKRISN

SEQ ID NO: 4281 - DNA, 462 bp, Unknown
  Obtained from environmental sample
  misc_feature (1)..(462): n is a, c, g, or t
ttggnnnncccaaggatcagatggacaatttgcgaacctgtggcggttaaattattattcatgaaattcgtggcaatggagaagaaaatcatcaacacgaaaaacgcacctgcacccatcggtccgtacaaccaggccattttagtgaacggcaccttatatatttccggccagatctgcattgagccatcaaacggcaatttgaaaaacagggatatccaggaagaaacccaccaggtcatgcaaaacctgaagtcgatattatcggaagccggcatgaagttcggtcatgtggtgaaaacgaccattttcctgacagatatgaaccgcttcggtgaggtgaatgagatctatggtaaatatttcgagggtgaatttccagcccgtgaaacggtacaggtttcggccctgccaaagtttgtgaacgttgagatcagcatgattgccgtcaaaagtgaatag

SEQ ID NO: 4282 - protein, 153 aa, Unknown
  Obtained from environmental sample
  DOMAIN (33)...(151): Endoribonuclease L-PSP
  misc_feature (1)..(153): Xaa is any amino acid
MXXPRIRWTICEPVAVKLLFMKFVAMEKKIINTKNAPAPIGPYNQAILVNGTLYISGQICIEPSNGNLKNRDIQEETHQVMQNLKSILSEAGMKFGHVVKTTIFLTDMNRFGEVNEIYGKYFEGEFPARETVQVSALPKFVNVEISMIAVKSE

SEQ ID NO: 4283 - DNA, 537 bp, Unknown
  Obtained from environmental sample
  misc_feature (1)..(537): n is a, c, g, or t
atgacctggtttaaaaaaatccttttccgctgggtcatgtgggcgtctgagaaattctcttcgcggccggagcgtgatcgcatattcaaagccctgtcttccctgctcgactgcattgtaaaactggagaagaaaaaagggcctgtacttaccttcaactgtgaagccgataagtttattattttttccgatcagcataaaggggcaaagaacggtgccgacgactttatgctttgtgaacccaattatattgctgcactcgattattattaccagcataattatttcttcatagcgcttggtgattgcgaggaaatgtgggagaacacactctccggcgtaaaaaagcccatcaaccttcctcgaaaaagaaagcagttttttctgaacaaacgaggcatcaggatcttcggccatcatgacctgcattggcagaatgaaccccttgcaacctttcagctgaaagaaatctacgactgcaacttcccgatttatgaaggaagtctggtacaaacaatggtggaaaagaacaggtga

SEQ ID NO: 4284 - protein, 178 aa, Unknown
  Obtained from environmental sample
  misc_feature (1)..(178): Xaa is any amino acid
MTWFKKILFRWVMWASEKFSSRPERDRIFKALSSLLDCIVKLEKKKGPVLTFNCEADKFIIFSDQHKGAKNGADDFMLCEPNYIAALDYYYQHNYFFIALGDCEEMWENTLSGVKKPINLPRKRKQFFLNKRGIRIFGHHDLHWQNEPLATFQLKEIYDCNFPIYEGSLVQTMVEKNR

SEQ ID NO: 4285 - DNA, 1053 bp, Unknown
  Obtained from environmental sample
  misc_feature (1)..(1053): n is a, c, g, or t
atggacgcgaaagtgcagaaatacctggttgagattgaacctaaagtcgaatgccagtggcgctggcttaacaccagcgcgcttgcgtgcaatcttgatgaaaaaaacaaactaaagtcggcaaccgcctataatattaagattgcgcctggtattaaagcagaagacggagctactattgaaaataatttcaatcaccagtttattacagaacgtcccgatatacgttatgcttggtttaaaaaatcactctctccaggcactcccattattcttgttatcttcaatcagcctgttactaaaaaatcggttgagtccagcttatctgttatttttacagaaggaggaactaacaaacaatacaagttaaaagctgaaccagacccagatgatagggagactccttcttatttgctaatacataataccaaagtgactggagtttctgagcaaaatagtcaacaaaaaagtgataaagatttaaataaaagcacagatgaagaagcaagacgcatgtggttagttatttctagggaggaacttccccttgatactgcgatggccattagaatgaagtcagggctcatatctgtacttggggatgaaaaaggtataggtgatcgtgaagttatacattttcaaacatttccagagtttaaatttctcggcattcaatgcacttccaatgaagaccagccacttttatttacttcagattcagataaactggaaacaggactttgtgacccaatgaaaagtagttttctagtatttagtagtcctgtatcccgttcgcaaatcaaggattatatcgcatttacccctcctcttaacctaaatgcagatggcggcagcccatggggctataacaatgattattctttcctcactngagaacatgaaaaaggcaaaacctatcacattaatattcccgggggtcttaaagctgcgaccgaatacacagtaaaaagcaagtcaccagatagaaatattttttataaatctgggttctggataaatctttatttaccaaagttactgatactgacctaa

SEQ ID NO: 4286 - protein, 350 aa, Unknown
  Obtained from environmental sample
  misc_feature (1)..(350): Xaa is any amino acid
MDAKVQKYLVEIEPKVECQWRWLNTSALACNLDEKNKLKSATAYNIKIAPGIKAEDGATIENNFNHQFITERPDIRYAWFKKSLSPGTPIILVIFNQPVTKKSVESSLSVIFTEGGTNKQYKLKAEPDPDDRETPSYLLIHNTKVTGVSEQNSQQKSDKDLNKSTDEEARRMWLVISREELPLDTAMAIRMKSGLISVLGDEKGIGDREVIHFQTFPEFKFLGIQCTSNEDQPLLFTSDSDKLETGLCDPMKSSFLVFSSPVSRSQIKDYIAFTPPLNLNADGGSPWGYNNDYSFLTXEHEKGKTYHINIPGGLKAATEYTVKSKSPDRNIFYKSGFWINLYLPKLLILT

SEQ ID NO: 4287 - DNA, 849 bp, Unknown
  Obtained from environmental sample
  misc_feature (1)..(849): n is a, c, g, or t
atgaaaaaaattaagatatgccatatctcaacgtatgaagggggaggggctggaacggctgcagtccgactacataaaggattgatctcagaagatattgactcgagttttgtttgtgcgtaccttaccggcaataacgaaaacgtttatcgatgctcacaaattttgcatcctagatggaagagtgttttgcaaaaggttaacctatatagaggtgtagtaaaaaaagaaagggaagctgtaattcgaagccaaggttcttacgattacttcagcatacctttttcagattatagggtagaaaatcatgctaaggttcttgaggcagatatcattcatttgcattggattgcggattttgtaaattattcgagtttttttgaaactgtcaacaagcctatcgtgtggacatttcacgacatgaatccatttatgggtggatttcactaccaaggtgatcttgagaagaataggcacaatgccgaaataataaatcttgagaacaggtatattaagcagaaagaggatattctctcaaaaagcgaatctattgaggtagtgacaccttctaaatggctatatgaggcgtcaagtaaaagcaacgtaactgggcgattttctcatcattacgtgccatatgggctggatacaaatctttttaagcctataccanaggatacttcgcgtgaaatattcggcttgcccaaggataaaaaaatcattgtgtttgtgagtgaaagactgaataatgagcgtaaaggatttaacctactcgttaaagcattttctgaacaaatgggagattatgttcttgtcgctgcaggaaatgattatgcccgaacgacctaa

SEQ ID NO: 4288 - protein, 282 aa, Unknown
  Obtained from environmental sample
  misc_feature (1)..(282): Xaa is any amino acid
MKKIKICHISTYEGGGAGTAAVRLHKGLISEDIDSSFVCAYLTGNNENVYRCSQILHPRWKSVLQKVNLYRGVVKKEREAVIRSQGSYDYFSIPFSDYRVENHAKVLEADIIHLHWIADFVNYSSFFETVNKPIVWTFHDMNPFMGGFHYQGDLEKNRHNAEIINLENRYIKQKEDILSKSESIEVVTPSKWLYEASSKSNVTGRFSHHYVPYGLDTNLFKPIPXDTSREIFGLPKDKKIIVFVSERLNNERKGFNLLVKAFSEQMGDYVLVAAGNDYARTT

SEQ ID NO: 4289 - DNA, 405 bp, Unknown
  Obtained from environmental sample
  misc_feature (1)..(405): n is a, c, g, or t
atgcttcgaggtgaacacatcaaacgtctgattgacgtacgcttaaataacanncctcccagcttgcngggtttttcaaaaaaagatgaccttcgtttttttctccgagaactagctgggatagagtatgtgcacattcccgaactcgcccccacaaaagagattctggattcctataagaagcacaagggcagttggacagtttatgagcaggagtttaatgccctaatggcgaaacggggcatcgaaaatgctttaacacctgaattgcttaagggcgggtgcttactttgcagtgaaaaactgcctcatcattgccatcgcagattggtggcggaatatttacagaaacaatggggcaacatatcgaccaagcatctcattcagataccagactcactttaa

SEQ ID NO: 4290 - protein, 134 aa, Unknown
  Obtained from environmental sample
  DOMAIN (1)...(127): Protein of unknown function (DUF1130)
  misc_feature (1)..(134): Xaa is any amino acid
MLRGEHIKRLIDVRLNNXPPSLXGFSKKDDLRFFLRELAGIEYVHIPELAPTKEILDSYKKHKGSWTVYEQEFNALMAKRGIENALTPELLKGGCLLCSEKLPHHCHRRLVAEYLQKQWGNISTKHLIQIPDSL

SEQ ID NO: 4291 - DNA, 468 bp, Unknown; identical to SEQ ID NO: 2339
  Obtained from environmental sample
  misc_feature (1)..(468): n is a, c, g, or t

SEQ ID NO: 4292 - protein, 155 aa, Unknown; identical to SEQ ID NO: 2340
  Obtained from environmental sample
  SIGNAL (1)...(18)
  misc_feature (1)..(155): Xaa is any amino acid

SEQ ID NO: 4293 - DNA, 696 bp, Unknown
  Obtained from environmental sample
  misc_feature (1)..(696): n is a, c, g, or t
atgagcaaaattaaattccgtaacaggcaggatagcacttttaccactacactacattcaagaattgaagattattttaaggaaaacaaattatctcaaaaaggaaactggctgatgggcgtgaaggttgttttcttccttggaggtttcttaggcagttatttcctgatatacctttcaggagagagtatcttcctttcaataatgagttggctgctgatgggtttcttcaccgcttttgtaggattcaatatttcgcacgacgcggttcatggttctctttctcaaaataaatttttgaaccgggttctcgggtatacattcaacctcgcaggtaccaataagtacatgtggaagatccttcataatgtgatccatcatacttatacaaatattcccggctttgatgaagacttggaaccaggtggtttgatccggctttcaacggaaaacaaattaaagaaaatccacaaataccagcattggtatgcatacctgctttattcccttacttctctttcttgggtgtttaaaaaggactttgaaactttttttagaaaaaaattgggtaattatgaaaacaagagtcatccgttgaaggaatattttattctgtttatttcaaaatttttgtatttcttcgttttcatcgccttgccagttatgcttactccgcttccgggtggttcattctga

SEQ ID NO: 4294 - protein, 231 aa, Unknown
  Obtained from environmental sample
  DOMAIN (71)...(224): Fatty acid desaturase
  misc_feature (1)..(231): Xaa is any amino acid
MSKIKFRNRQDSTFTTTLHSRIEDYFKENKLSQKGNWLMGVKVVFFLGGFLGSYFLIYLSGESIFLSIMSWLLMGFFTAFVGFNISHDAVHGSLSQNKFLNRVLGYTFNLAGTNKYMWKILHNVIHHTYTNIPGFDEDLEPGGLIRLSTENKLKKIHKYQHWYAYLLYSLTSLSWVFKKDFETFFRKKLGNYENKSHPLKEYFILFISKFLYFFVFIALPVMLTPLPGGSF

SEQ ID NO: 4295 - DNA, 363 bp, Unknown; identical to SEQ ID NO: 1977
  Obtained from environmental sample
  misc_feature (1)..(363): n is a, c, g, or t

SEQ ID NO: 4296 - protein, 120 aa, Unknown; identical to SEQ ID NO: 1978
  Obtained from environmental sample
  misc_feature (1)..(120): Xaa is any amino acid

SEQ ID NO: 4297 - DNA, 492 bp, Unknown
  Obtained from environmental sample
  misc_feature (1)..(492): n is a, c, g, or t
atggactctcaatatattggagttatcggcacacttgggacggtgaagtcaaactcatacaaaaaagctttgaagaaaattaaacctgctgtgaaagtttatcaaaacccatgtcccctcttcgttcacttagctgaggacggctggaacaggaacaaaattgcgcagcttatagcggatgaatacctgaagccgttcaagggaaagaatatggatactcttattctggggtgtacacattacccgatattaagggatgttatacaggcttcggccggtaaaaaagttgagcttattgattcaggcaaggaaacagctaaagaagttgagaggatactcagcaagaaaaagttactgagcactcacaaaataacggagcgaaatcattcggttttctatgtatccgatttcccgcacaagttcaaggaagtaagccagcggtttttatcgaaggaattaaaacatgtgcataaagtaaagctggagaattaa

SEQ ID NO: 4298 - protein, 163 aa, Unknown
  Obtained from environmental sample
  misc_feature (1)..(163): Xaa is any amino acid
MDSQYIGVIGTLGTVKSNSYKKALKKIKPAVKVYQNPCPLFVHLAEDGWNRNKIAQLIADEYLKPFKGKNMDTLILGCTHYPILRDVIQASAGKKVELIDSGKETAKEVERILSKKKLLSTHKITERNHSVFYVSDFPHKFKEVSQRFLSKELKHVHKVKLEN

SEQ ID NO: 4299 - DNA, 534 bp, Unknown
  Obtained from environmental sample
  misc_feature (1)..(534): n is a, c, g, or t
gtgtgggaaaagctgaaagatgtaaggctggtacttatcggcaatgaaaatgattacgacaattttaaaaagcaggtaagaaaaaaacgcatcagcaatatttattttaccggtaagctgtcgtgggaaaaagtgcttccttattacatgcacacgtcggttctgtttgcacgacttgacgacaattacaggagtgcaattccttcaaaactttttgaatacctcagcacaggtttgccggtgatttattgcggtgaaggggaagcatcgaacctgctcaggcaattcaatcagaccacagtattgaagtcaaacgatgatgccggtttgaaacgtgcgattaaaaacctgaaagcaacaggtgcggagctcgattttgaaaacagggatcacatccagcgtaaatacatcagggaactcatcaacatgagaattgacgacgtgattgccggcgtaatgggcattgaaatacctgaaaggacgcttgtgcctgtttccatgcaggaacagcagcttgcattgtcagtatcttaa

SEQ ID NO: 4300 - protein, 177 aa, Unknown
  Obtained from environmental sample
  misc_feature (1)..(177): Xaa is any amino acid
MWEKLKDVRLVLIGNENDYDNFKKQVRKKRISNIYFTGKLSWEKVLPYYMHTSVLFARLDDNYRSAIPSKLFEYLSTGLPVIYCGEGEASNLLRQFNQTTVLKSNDDAGLKRAIKNLKATGAELDFENRDHIQRKYIRELINMRIDDVIAGVMGIEIPERTLVPVSMQEQQLALSVS

SEQ ID NO: 4301 - DNA, 897 bp, Unknown
  Obtained from environmental sample
  misc_feature (1)..(897): n is a, c, g, or t
atgagcgctaaaagaaaattacgcgtgctcatgcttgctgtctgcagtccaggtgcaatcggaggacaagctgcatgcgcaaggatgcttcttcagcatttcaaagaagtggagtggaggtcgatatctttccctttgccgaaacaatacaattcagttttaagattttttcattcctacaggattctcctgcaatctttcctcatctgcattacaagaaaagcagatgtagttcacatcctcaccgcttgcgccaaaaccgcactttttgaaaagctcatcatcgcaagcattttaaaaatgacaggcgtcaaagtgattctcaatttccagggagcatttgatcattattacaattcgtttacacaacgtgagcagcgctgggtgcaaagacttttggagaatgttgatgtagtgctttgtctgcacacggacattcaaaaattttttatcgaagaaaatattgttcctggagaaaaaattaaagtaatacccaatgccgtcgaagtttcttccaaattagagtatacaacaccttccgacaacaaataccatctcttatatcttggctggctggttacaaataaaggtttgtatacactcgtgcagtctgccggtatattgtatgaaaagttcaaaaaggaaaattttatcatcgacatcattggtcctgaaatcgaagaaggtattatcaccggacttaaggaggaagcagcagagcacaacgtagagaatctggtcaggtttcattcccctgtctttggcgaggagaaagaaaattctttgcttcgatcagcatattcgtttttcccacccgcatggaaagattttcgtttgtattgcttgaagccatgnaagcaggaatggctgtttgtacgaacgacatcantccaatga

SEQ ID NO: 4302 - protein, 298 aa, Unknown
  Obtained from environmental sample
  misc_feature (1)..(298): Xaa is any amino acid
MSAKRKLRVLMLAVCSPGAIGGQAACARMLLQHFKEVEWRSISFPLPKQYNSVLRFFHSYRILLQSFLICITRKADVVHILTACAKTALFEKLIIASILKMTGVKVILNFQGAFDHYYNSFTQREQRWVQRLLENVDVVLCLHTDIQKFFIEENIVPGEKIKVIPNAVEVSSKLEYTTPSDNKYHLLYLGWLVTNKGLYTLVQSAGILYEKFKKENFIIDIIGPEIEEGIITGLKEEAAEHNVENLVRFHSPVFGEEKENSLLRSAYSFFPPAWKDFRLYCLKPXKQEWLFVRTTSXQ

SEQ ID NO: 4303 - DNA, 948 bp, Unknown
  Obtained from environmental sample
  misc_feature (1)..(948): n is a, c, g, or t
ttgttatacttaaccgaagttattatgaatccgcaatattctgttgttatacctgtactcaatgaagaagaaagcctagatgagcttatttctggaattgattctgtcttcaaagacctcaaaaaaaggtacgaaattatttttattgatgatggctctacagatactacactagaacttctcaaaaaatatgccaaggaaaaaaataatattcggatattttctttcagaagaaatttaggaaaatcaaccgcgcttacactcggttttcaaaaagcaaaaggggactacatgatcaccatggatgcagacctacaagatgacccgtccaattttgaaaaactcatactagctcaggaaaaaggtgaatatgacctcgttagcggatggagaaaacaccgaaaagattcattactcaaaattattaattctaaattcttcaataactttgttattccaaagctttttaatgtaaattaccgcgacatgaattcagggctaaagttatacacaaagtctcttgcaaaagaaatcaaaatttatggtggaatgcaccggttcattccgattcttgccaatgaaatgggatacaaagttcatgaagagccaatatcgcataacaaacggaaatacggacaatccaaatataagtcaacaaagatatttactgatattccagatcttattacgatgtattttcttataaaatacaccaaaaagccccttcacttcttttcaaaattaggtgggatactattattgttcggaggattgatattaacctaccttattataataaaacttcttggtgaatcaatcggaggaagaacattgttaatattcggggtattgtttgttatttcaggaatccaaacaatttttactggattacttgcagatctcatggtcaattttaaacgagacaggggagagaagatctccctataa

SEQ ID NO: 4304 - protein, 315 aa, Unknown
  Obtained from environmental sample
  DOMAIN (14)...(179): Glycosyl transferase
  misc_feature (1)..(315): Xaa is any amino acid
MLYLTEVIMNPQYSVVIPVLNEEESLDELISGIDSVFKDLKKRYEIIFIDDGSTDTTLELLKKYAKEKNNIRIFSFRRNLGKSTALTLGFQKAKGDYMITMDADLQDDPSNFEKLILAQEKGEYDLVSGWRKHRKDSLLKIINSKFFNNFVIPKLFNVNYRDMNSGLKLYTKSLAKEIKIYGGMHRFIPILANEMGYKVHEEPISHNKRKYGQSKYKSTKIFTDIPDLITMYFLIKYTKKPLHFFSKLGGILLLFGGLILTYLIIIKLLGESIGGRTLLIFGVLFVISGIQTIFTGLLADLMVNFKRDRGEKISL

SEQ ID NO: 4305 - DNA, 579 bp, Unknown
  Obtained from environmental sample
  misc_feature (1)..(579): n is a, c, g, or t
atggaggaaacacccgaaaagaatccatacctcaaaattataaatctaaaatctttcaataacttgttnattccaagcctttttaatgtaaattaccgcgacatgaattcagggctaaaagttatacacaaagtctcttgcaaagaaaatcaaaattatggtggaatgcaccggttcattccgattcttgccaatgaaatgggatacaaagttcatgaagagccaatatcgcatacnaaacggaaatacggacaatccaaatataagtcaacaaagatatttactgatattccagatcttattacgatgtattttcttataaaatacaccaaaaagccccttcacttcttttcaaaattaggtgggatactattattgttcggaggattgatattaacctaccttattataataaaacttcttggtgaatcaatcggaggaagaccattgttaatattcggggtattgtttgttatttcaggaatccaaacaatttttactggattacttgcagatctcatggtcaattttaatcgagacaagggagaagaagatcttcctattaaatttgaatcgtaa

SEQ ID NO: 4306 - protein, 192 aa, Unknown
  Obtained from environmental sample
  misc_feature (1)..(192): Xaa is any amino acid
MEETPEKNPYLKIINLKSFNNLXIPSLFNVNYRDMNSGLKVIHKVSCKENQNYGGMHRFIPILANEMGYKVHEEPISHTKRKYGQSKYKSTKIFTDIPDLITMYFLIKYTKKPLHFFSKLGGILLLFGGLILTYLIIIKLLGESIGGRPLLIFGVLFVISGIQTIFTGLLADLMVNFNRDKGEEDLPIKFES

SEQ ID NO: 4307 - DNA, 402 bp, Unknown
  Obtained from environmental sample
  misc_feature (1)..(402): n is a, c, g, or t
ttgatcatacnactcataanggaatgtatgcaagatttcatttttattagattgggaaagaatcatcccaggctatttttttctgatatcatatatatcgagtccctcaaaaactatatccgtgtagttacgatcaaaggcaaatacatgatcaaaactcctatgtgcaaggcagaggaggttttacctaaatctaagttttgcagaattcatcgttgttacattgtcttcatcaatgcgattactggatttacgcatgatcatattcagatagacgggaaattcctaccgcttggcgaacaataccgtaaactattgttagaaagagttattactcttgggtcggaaggcaaagcttgcgatacgggtaaccttgttaatgacctaagaaagtcggcatag

SEQ ID NO: 4308 - protein, 133 aa, Unknown
  Obtained from environmental sample
  DOMAIN (20)...(111): LytTr DNA-binding domain
  misc_feature (1)..(133): Xaa is any amino acid
MIIXLIXECMQDFIFIRLGKNHPRLFFSDIIYIESLKNYIRVVTIKGKYMIKTPMCKAEEVLPKSKFCRIHRCYIVFINAITGFTHDHIQIDGKFLPLGEQYRKLLLERVITLGSEGKACDTGNLVNDLRKSA

SEQ ID NO: 4309 - DNA, 849 bp, Unknown
  Obtained from environmental sample
  misc_feature (1)..(849): n is a, c, g, or t
atgaaatattgcctgattttattttctattgtaaacagcctgtttacaaatgcccagcttagtaaagaacagtggcgggaagacatacagtacatggtcaaaaaagtccatgaaattcacccgaacccttattacaaatactcccgggccacgctggataaggccgaggaccggcttttaaataatataaataactgggaacccgaaaagattatagcgaatatctcccggtaccttgccatgatccaggatgggcatacccaattaatccccgtattgcggggagaatcaaaactagaactgcactacctgccttttttctttaaagtttttgatgatggtgtttatataagagtaacgactgattcagcttattcttatttaattggagccaggctcctgcagctgggaaaaattccggtaaaaaaaatcctggaaactttaaaagattatgcctctggcgataacgactattcaaaaaaaattcaaatccctatgggattaagctgtattgaaatattaaaaggttcgggcctgctaaccggcaataagcctgaattaaaattccaaaccagggacaatagagttattaccatagaaccaactatcgttaacactcccccgtttcgtcatgacatacgggaaagaatctccagttcagcaccgttgtacaaacaaaaccaggacaaagcatattcaattaattatctcccaggtgaaaaacttttataccttaattacnagcaaattgcctctgatccgtcactcccggtgcgaaaactggntgataccatcaactatttaagtgaaaaagaagatgttcaaaaatcgttgtggatctccggataa

SEQ ID NO: 4310 - protein, 282 aa, Unknown
  Obtained from environmental sample
  SIGNAL (1)...(18)
  misc_feature (1)..(282): Xaa is any amino acid
MKYCLILFSIVNSLFTNAQLSKEQWREDIQYMVKKVHEIHPNPYYKYSRATLDKAEDRLLNNINNWEPEKIIANISRYLAMIQDGHTQLIPVLRGESKLELHYLPFFFKVFDDGVYIRVTTDSAYSYLIGARLLQLGKIPVKKILETLKDYASGDNDYSKKIQIPMGLSCIEILKGSGLLTGNKPELKFQTRDNRVITIEPTIVNTPPFRHDIRERISSSAPLYKQNQDKAYSINYLPGEKLLYLNYXQIASDPSLPVRKLXDTINYLSEKEDVQKSLWISG

SEQ ID NO: 4311 - DNA, 324 bp, Unknown
  Obtained from environmental sample
  misc_feature (1)..(324): n is a, c, g, or t
atgacgataactctgaacagtgttgctcctaaatatatcagcaaagaaaactggaaaaattcagaagtatgggaaaaaaacatctccatacataaaggggaacatttacatatcgtagcaccatcaggcagtggaaaaacttccctcgttcattttatatatgggttaagaaaagattattcaggctcggttttttatgatgatgatgatataaaaaacctttccgttgaaagcttttctgcattcaggcaaaacaagatcagtattatcttcccagatttacgtttgtttgaaaacatacagtcatggaaaatattgagataa

SEQ ID NO: 4312 - protein, 107 aa, Unknown
  Obtained from environmental sample
  misc_feature (1)..(107): Xaa is any amino acid
MTITLNSVAPKYISKENWKNSEVWEKNISIHKGEHLHIVAPSGSGKTSLVHFIYGLRKDYSGSVFYDDDDIKNLSVESFSAFRQNKISIIFPDLRLFENIQSWKILR

SEQ ID NO: 4313 - DNA, 498 bp, Unknown
  Obtained from environmental sample
  misc_feature (1)..(498): n is a, c, g, or t
atgaaaaataaggtcctgttatcattcctctgctttttcttatacactcatgtttttgcacaaaagatttcgcctgaaataataaacaaacaatggtcagccagatggattgcatctgaaagaaaaatgcagcgggattatggcgtatatcattttagaaaaaaaattaaccttcctgaaagaccctcttcttttattgtacatgtttcggccgataaccggtacaagctttttgtaaatggaaagcttgtatcgttagggccggcccgggctgatgtaactcactggaatttcgaaacagtagatatcgccccttatctgaagacaaatgaaaatgtaatagctgctgttgtctggatttttggagagttcagaacagaagcagaaatatcttatcgcaccggttttattttacagggtgatacggaaaaagaaagtatagtaaacactaataacacatggaaaatgtatccctcaataaaagctattctccactaa

SEQ ID NO: 4314 - protein, 165 aa, Unknown
  Obtained from environmental sample
  SIGNAL (1)...(18)
  misc_feature (1)..(165): Xaa is any amino acid
MKNKVLLSFLCFFLYTHVFAQKISPEIINKQWSARWIASERKMQRDYGVYHFRKKINLPERPSSFIVHVSADNRYKLFVNGKLVSLGPARADVTHWNFETVDIAPYLKTNENVIAAVVWIFGEFRTEAEISYRTGFILQGDTEKESIVNTNNTWKMYPSIKAILH

SEQ ID NO: 4315 - DNA, 798 bp, Unknown
  Obtained from environmental sample
  misc_feature (1)..(798): n is a, c, g, or t
atgatagaaaaaattgttgcggacttatactgtgtaaataaatcatgcaaaaaggtaagattaagtctggaaacatttctggaattaaaagatgagtgcatagaaggatttctttcttgtgaaaattgtacctcaaaatatcccataattcaaggagttccgatattaatggaaaattttcacgaatatgctcgtcaaagaattcttagctttggtaaatggatagtaaattgcaaatcgcctgaaattaaagcttttctcaggtcagaaggtgtaaagattggcaatcctacatacaatgatcgctatgaggagaacagtattttgtacaaatcttatttgaaggctcattatggttacccttcagatgataaattattgtcgctattgaagaaagaaataaagcctgatcacatctacaagatgttggcaagcaatagcctaaatttaaatggaattggattggacattggttgttcgattggttcgagtacctttgaattgtcaaaaaagttatcatatgtatttggaatagatctttcattttcgttcatactggaagctagaaaaagaatgcaaaatagaaaaagtagaaacatggaatttatcgtagcagatgctacaaatctcccttttagatctaaattctttcaaatcgtagttgcactaaatgttattgatagaatggatttcaaaaagctaattttatccataaatagttgcatcaaaaagtacggaaaaatgatcctagcagatccttatcattttgttgacnnatatggtaaagaagaaatttga

SEQ ID NO: 4316 - protein, 265 aa, Unknown
  Obtained from environmental sample
  misc_feature (1)..(265): Xaa is any amino acid
MIEKIVADLYCVNKSCKKVRLSLETFLELKDECIEGFLSCENCTSKYPIIQGVPILMENFHEYARQRILSFGKWIVNCKSPEIKAFLRSEGVKIGNPTYNDRYEENSILYKSYLKAHYGYPSDDKLLSLLKKEIKPDHIYKMLASNSLNLNGIGLDIGCSIGSSTFELSKKLSYVFGIDLSFSFILEARKRMQNRKSRNMEFIVADATNLPFRSKFFQIVVALNVIDRMDFKKLILSINSCIKKYGKMILADPYHFVDXYGKEEI

SEQ ID NO: 4317 - DNA, 345 bp, Unknown
  Obtained from environmental sample
  misc_feature (1)..(345): n is a, c, g, or t
atgaaaaggcattgcaaancagttttgcataaagaagtcagttatggtcattcaaatggatggattcaaaacaagaatgacatcttaaatgactttacaagtggcaaactgatctataataaaattgacaataacagctcggcgatagttgtgataagtaagaaatatgccactgtgaaaacgaatacaaatgcggaggggatggtgaatggggccccatttaatttaaaactgcatatcatgcagttttggataaaaaccaaaaggggttggcaattgctgcgtattttctcatcgaacttgagtttttgggcgggcggcagcacctgggagaggttccggtga

SEQ ID NO: 4318 - protein, 114 aa, Unknown
  Obtained from environmental sample
  misc_feature (1)..(114): Xaa is any amino acid
MKRHCKXVLHKEVSYGHSNGWIQNKNDILNDFTSGKLIYNKIDNNSSAIVVISKKYATVKTNTNAEGMVNGAPFNLKLHIMQFWIKTKRGWQLLRIFSSNLSFWAGGSTWERFR

SEQ ID NO: 4319 - DNA, 378 bp, Unknown
  Obtained from environmental sample
  misc_feature (1)..(378): n is a, c, g, or t
atgaagttagcagctttgatattacttataatctttactcaatcctgtgacattattgagcgaaagaaattcataggagatcggtattatttaatgcatagtgacgaattacagggcgaaaccgtctattataaaacaagtgaaggtgattttatcggcaggattccagtgaaaattgccgaatattctgtaactgatagttttgttttcgcaaaatcgataattaacaatgaagcccaatactttttgattataaagaaatacgattcggattacgctgaagtcacaaatgtcactttaaacatcaattctcagcaattagattcaatttcaaaaaaacatcttcttagtttaagatggcaaaaagtaaatccgtga

SEQ ID NO: 4320 - protein, 125 aa, Unknown
  Obtained from environmental sample
  SIGNAL (1)...(15)
  misc_feature (1)..(125): Xaa is any amino acid
MKLAALILLIIFTQSCDIIERKKFIGDRYYLMHSDELQGETVYYKTSEGDFIGRIPVKIAEYSVTDSFVFAKSIINNEAQYFLIIKKYDSDYAEVTNVTLNINSQQLDSISKKHLLSLRWQKVNP

SEQ ID NO: 4321 - DNA, 564 bp, Unknown
  Obtained from environmental sample
  misc_feature (1)..(564): n is a, c, g, or t
atgataaagaaatattcatttataattgttgtacttgttgttgcatataccctctattcttgtagaatggatgataagaaaattgcaactaatttgtacaaagagcgagcgtttctattgaaagagtttaaaggcaaaagtattatcagtagaggcgggaatttttatcagttatcatattacaagggtacagctgttaatacattttattttgagaaaaaagatacttctttggtgatgacaaatgatacactacagtattcattaaatgaaatcgaggcttttaaaactgctaatattactgatagttccgactacagaaaaactctggataacgaattaagcagactccttagagtaatggatgactttaagattagtaatgtaagtgccgagtttgcatctgtgggtattgagatgaaaatttacttcggtgattataaggctttgctacatatcagtgatattgcagcaataaaagatgaaagatggagagattacatacaatcaggcgaaaagtttgatgaaaattggtattatgtgaaggatgagttatcgaaatag

SEQ ID NO: 4322 - protein, 187 aa, Unknown
  Obtained from environmental sample
  misc_feature (1)..(187): Xaa is any amino acid
MIKKYSFIIVVLVVAYTLYSCRMDDKKIATNLYKERAFLLKEFKGKSIISRGGNFYQLSYYKGTAVNTFYFEKKDTSLVMTNDTLQYSLNEIEAFKTANITDSSDYRKTLDNELSRLLRVMDDFKISNVSAEFASVGIEMKIYFGDYKALLHISDIAAIKDERWRDYIQSGEKFDENWYYVKDELSK

SEQ ID NO: 4323 - DNA, 828 bp, Unknown
  Obtained from environmental sample
  misc_feature (1)..(828): n is a, c, g, or t
ttgctgcatagtgccccgctatgtgttccctacgtacctatcctcctatatggtgaagcactcacccatacaatccatgcaatgaaaagagtacttttgcccacaatgcaactactctccccacaaggattcaaggattacgagctgatcgactgcggtgactttgaaaaactcgagcgcttcggcaaatacatcaccatccggccggagccacaggccgtgtggccggctgttttaaaaaaatcagaatgggaaagccgcgcccatgttcgtttcgagccccgctcatcgagcaacggcgactggaaaaaactcaaacagatgccggaccagtgggagatcgcctatcacctccggtcctcggggggcgccaccaccatccccatcaggttcaggctcggtctgacctcctttaagcacgtgggcattttcccggagcaggcggttaactggcagaagatctattctcactttactgggaaaaaaaaccagaagttcctcaacctgttcgcctacaccggaggcgcttctcttgcagcaaaagctgcgggctgcgaggtgacacacgttgacagcatcaagcaggtagtgacctgggccaatgacaacatgcaacggagcaaccttgacaatatccgctggctcgtggacgacgcgctgaagtttgtaaaaaaggaagtgcgcaggggcaacatctatcaggngatcatcctggatccacctgcttatggtcacggtccgacgggagaaaaatggaagctggaggagaacatctctgaaatgatccggagcgtattgcagctgctcgacacaaaaatcacctgctga

SEQ ID NO: 4324 - protein, 275 aa, Unknown
  Obtained from environmental sample
  misc_feature (1)..(275): Xaa is any amino acid
MLHSAPLCVPYVPILLYGEALTHTIHAMKRVLLPTMQLLSPQGFKDYELIDCGDFEKLERFGKYITIRPEPQAVWPAVLKKSEWESRAHVRFEPRSSSNGDWKKLKQMPDQWEIAYHLRSSGGATTIPIRFRLGLTSFKHVGIFPEQAVNWQKIYSHFTGKKNQKFLNLFAYTGGASLAAKAAGCEVTHVDSIKQVVTWANDNMQRSNLDNIRWLVDDALKFVKKEVRRGNIYQXIILDPPAYGHGPTGEKWKLEENISEMIRSVLQLLDTKITC

SEQ ID NO: 4325 - DNA, 783 bp, Unknown
  Obtained from environmental sample
  misc_feature (1)..(783): n is a, c, g, or t
atgccctcccttagaagagaactgcctaaaaaaagaaaaatcaaacaattaaaacaaaagcaaatgttagaattagaaggactaaacgaatacaacaactcaggcgcactcttaggattagacgcacttgaaggagaagaattgcttggtgcgctgaagcgcatgaacccgatctcccgcatgaaggtgatgaacaaaattgccggaggcgtgaagccgagccgtggatcacgtgcagaaatggaaaagcacttccatgaattgccacagcacatcaaagacggtttattgaaaggagatctgcgccttgcagacacaatcatctacagccgtaagctggtgaattcaaaaacagtaaagctgttcgaaacccaggacgtgaaagaagtaggtatccgcaatgtcagcaatgcgaaactgccgaagaaccaagcgttgctggtaagcggaatcttcctgcttgctgcggttgcggaaaataacacctcggataaaatcatcagtgcgaaatacggtaagatcgaagacttcggtgcgatctcaaatggtgagttcactttgaaagcgaacaagaagatcatcatgagcgatgtggacaacgccatcttcaaaacaagtaataacacacaagtacctattggttactacaagctggccaacccacgtgtcatccacgatgacatcctccttgaggcgacagttgagttgggctcgctggatggaatcgataccgctaagacctatctgtatgtaggcttacacggaacgatcactactccatag

SEQ ID NO: 4326 - protein, 260 aa, Unknown
  Obtained from environmental sample
  misc_feature (1)..(260): Xaa is any amino acid
MPSLRRELPKKRKIKQLKQKQMLELEGLNEYNNSGALLGLDALEGEELLGALKRMNPISRMKVMNKIAGGVKPSRGSRAEMEKHFHELPQHIKDGLLKGDLRLADTIIYSRKLVNSKTVKLFETQDVKEVGIRNVSNAKLPKNQALLVSGIFLLAAVAENNTSDKIISAKYGKIEDFGAISNGEFTLKANKKIIMSDVDNAIFKTSNNTQVPIGYYKLANPRVIHDDILLEATVELGSLDGIDTAKTYLYVGLHGTITTP

SEQ ID NO: 4327 - DNA, 672 bp, Unknown
  Obtained from environmental sample
  misc_feature (1)..(672): n is a, c, g, or t
atgattcacaatccgcaaaagccgccttcgcgagccgaccgcctggagaaactgtttctgttgctgaagaaaaaggatcctgtcaaagcatttgaaatcattcattcctgttatacggaaggcgaagcacaaaagctgattaataatgaggcaaagcacaagcattcagttttcgacgacaatgttcttttcaattccggcaacgatgttctctcgcggataatcgccgttgaatataaaacctacatggttgatgacatccttcagaaagtcgaccgtgccacgatgagcgcatctcttgaaggccgtgagcctttcctcgaccagcgcattatagagtttgttgccaaacttcccagccattacaaatacagggacggcgtcggcaagattatgctccgcgacatcgttcacaaatacattccgcgtgaaatcatgcaccgtcctaaaatgggttttggagtgccggtggagaaatggctgaaaaatgaacttaaagattttttcgaggagaccttttccgctaattcgtctaaagacgtatttgagattctaaacttaaaagaaacacagaatctgaaacgtgagtacctttcagggcggctggaatattttgaacgattgtggtttgtattcttttttatggcgtggtataaaaagtggatgggctga

SEQ ID NO: 4328 - protein, 223 aa, Unknown
  Obtained from environmental sample
  DOMAIN (14)...(150): Asparagine synthase
  misc_feature (1)..(223): Xaa is any amino acid
MIHNPQKPPSRADRLEKLFLLLKKKDPVKAFEIIHSCYTEGEAQKLINNEAKHKHSVFDDNVLFNSGNDVLSRIIAVEYKTYMVDDILQKVDRATMSASLEGREPFLDQRIIEFVAKLPSHYKYRDGVGKIMLRDIVHKYIPREIMHRPKMGFGVPVEKWLKNELKDFFEETFSANSSKDVFEILNLKETQNLKREYLSGRLEYFERLWFVFFFMAWYKKWMG

SEQ ID NO: 4329 - DNA, 324 bp, Unknown
  Obtained from environmental sample
  misc_feature (1)..(324): n is a, c, g, or t
atgagccttgatccaacagagaaaggctatcatcacaagaaaaagaccgtcttagagttggtgaatcttacagaagcacaggctcagatagttgatatatatctgatggaagagcttacaggtaaaagacattggggatgggatcctagagaacccgatatctatatggaatggatgaatggtactcaaaaactacgtaatagggataacatactagtaaatatgtccaaaacgacaaaaagcacatatatatgggagatcagaattatagaaagtacaatggtaatacaactcaaatcgggaaaganctctcaccaccagtag

SEQ ID NO: 4330 - protein, 107 aa, Unknown
  Obtained from environmental sample
  misc_feature (1)..(107): Xaa is any amino acid
MSLDPTEKGYHHKKKTVLELVNLTEAQAQIVDIYLMEELTGKRHWGWDPREPDIYMEWMNGTQKLRNRDNILVNMSKTTKSTYIWEIRIIESTMVIQLKSGKXSHHQ

SEQ ID NO: 4331 - DNA, 336 bp, Unknown
  Obtained from environmental sample
  misc_feature (1)..(336): n is a, c, g, or t
atggtaatacaactcaaatcgggaaagacactctcaccacaagtagcggaaggacaatcaccagaaaagaacgccctgatttatttaaaccccgtaaaagacgttaaggtaagggtaaattccgaatacctttccaaatttggaaagcgtatagtaaaaaagtttatggatagtaataggaaacgtgctgaagattcaaagaaaggaattattcatgctggcaatacagtaggctgtatcagacagtctatgctatcagaacagaatctagaatatcttgcagaaaaatatagtatatatgattatgtggattttatggatggaaacggtttctga

SEQ ID NO: 4332 - protein, 111 aa, Unknown
  Obtained from environmental sample
  misc_feature (1)..(111): Xaa is any amino acid
MVIQLKSGKTLSPQVAEGQSPEKNALIYLNPVKDVKVRVNSEYLSKFGKRIVKKFMDSNRKRAEDSKKGIIHAGNTVGCIRQSMLSEQNLEYLAEKYSIYDYVDFMDGNGF

SEQ ID NO: 4333 - DNA, 801 bp, Unknown
  Obtained from environmental sample
  misc_feature (1)..(801): n is a, c, g, or t
ttgaagcgcgtttggaaaaaatcctgcttgtcaggggatcaaatttcgcggcattacgggaaatcggctgcgctcaatacggggtttgaagctacgaaagaaaatgtggtcattaccatggacgctgatctgcaggattcgccggaagaaatcccggacctctacaaaatgatcacgaaagacggctttgatcttgtctccggctggaaagaaaaacgctacgacccgatcaccaaaaccatcccgacaaaattattcaacgccgccacgcgcaggatgtcgggaataaagctgcacgatttcaactgcggactcaaagcctatcgcagcgatgtggtaaaaagcattgaagtgtacggcgaaatgcatcgttacattcctgtcattgcaaaacgcgcgggctttaccaatattggtgaaaaaagcgtggcgcaccaggcaaggaaatacggcacaacgaaattcggactcgaacgttttgtaaatggctttctcgacctgctttccatttcattcgtcaccaaattcggaaagcgcccgatgcactttttcgggctgaacggaacgctcatgttcatcctcggtttttgcggatttctttacctcatcatcaataagctctggatcgtttaccacgatcattccatcgcgccacgcgttaccgaaagtccgtggttttatatttcgctcgtcgccatggtcatcgggacgcagcttttcctcgcaggcttcctcgccgaattattagcgcgtaattctcctgatcggaatacttatcttattgagaagaaggttggttga

SEQ ID NO: 4334 - protein, 266 aa, Unknown
  Obtained from environmental sample
  misc_feature (1)..(266): Xaa is any amino acid
MKRVWKKSCLSGDQISRHYGKSAALNTGFEATKENVVITMDADLQDSPEEIPDLYKMITKDGFDLVSGWKEKRYDPITKTIPTKLFNAATRRMSGIKLHDFNCGLKAYRSDVVKSIEVYGEMHRYIPVIAKRAGFTNIGEKSVAHQARKYGTTKFGLERFVNGFLDLLSISFVTKFGKRPMHFFGLNGTLMFILGFCGFLYLIINKLWIVYHDHSIAPRVTESPWFYISLVAMVIGTQLFLAGFLAELLARNSPDRNTYLIEKKVG

SEQ ID NO: 4335 - DNA, 609 bp, Unknown; identical to SEQ ID NO: 2069
  Obtained from environmental sample
  misc_feature (1)..(609): n is a, c, g, or t

SEQ ID NO: 4336 - protein, 202 aa, Unknown; identical to SEQ ID NO: 2070
  Obtained from environmental sample
  misc_feature (1)..(202): Xaa is any amino acid

SEQ ID NO: 4337 - DNA, 408 bp, Unknown
  Obtained from environmental sample
  misc_feature (1)..(408): n is a, c, g, or t
atgaaaaagctcacagtaattttattttttgtaattggcgtaacctaccaggtaattggccaaacaaacgggaatcttgcaaagccagggcaatatatccccgctgaagaagtaccacagtatgtaaccgttacagaaacaacctttggtgcagactttgaattttccgaaaaaggcgccgttatagttaatatttaccccaactcgcctgcagatgactatggttttaaaaaaggcgatatcgtaacagaaattggtaacattgcaattacatcagaaacatcatataacaaagcaatgtccacctataagcctgaagaatcagttaaagtaaactttgcccgtaagaatgaccaaaaacataagaaagttacacttggccagaaaacagtttataaaanagtataa

SEQ ID NO: 4338 - protein, 135 aa, Unknown
  Obtained from environmental sample
  SIGNAL (1)...(20)
  misc_feature (1)..(135): Xaa is any amino acid
MKKLTVILFFVIGVTYQVIGQTNGNLAKPGQYIPAEEVPQYVTVTETTFGADFEFSEKGAVIVNIYPNSPADDYGFKKGDIVTEIGNIAITSETSYNKAMSTYKPEESVKVNFARKNDQKHKKVTLGQKTVYKXV

SEQ ID NO: 4339 - DNA, 453 bp, Unknown
  Obtained from environmental sample
  misc_feature (1)..(453): n is a, c, g, or t
ttgccattgggcgaagaaatgaaatacgttcgtaaactggtggaattacatttgcgaccaattagtttaaccaatgaaaatattacggattctgccattcgacgtttattgtttgatgccggccaggatattgacgacctgatgatcctttgtgaaagtgacatcacctccaaaaacaaactaaaggttaagcgttacctggccaattttgaaatggtacgtgaaagatgcaaagaagtggaagaaaaagaccacatccgtaactggcaaccgcccatcaccggaaatatcatcatggaagtatttggaattcctccttcaaagcccgttggcattatcaaggacgcaatcaaggatgcaattttggatggaatcattaccaacgactacgaaacggcgtatcaatatatgctggaaaaaggtaaggaatgcggcctaaagcctgttcactga

SEQ ID NO: 4340 - protein, 150 aa, Unknown
  Obtained from environmental sample
  misc_feature (1)..(150): Xaa is any amino acid
MPLGEEMKYVRKLVELHLRPISLTNENITDSAIRRLLFDAGQDIDDLMILCESDITSKNKLKVKRYLANFEMVRERCKEVEEKDHIRNWQPPITGNIIMEVFGIPPSKPVGIIKDAIKDAILDGIITNDYETAYQYMLEKGKECGLKPVH

SEQ ID NO: 4341 - DNA, 405 bp, Unknown
  Obtained from environmental sample
  misc_feature (1)..(405): n is a, c, g, or t
ttgacgtttaaccaaccgtacagattcatggccattttgaaattcagaatttatttggaagaagatgatagcgtttacagggatgttgtgatccggcatacccaaagttttcaggaattacatgaaacaatactgaaggcatttgagtttgatagcaaacaccaggcaactttttatcgaagcaatgacaactggcaaaggggcagggaaatttcattagagaaatatgacagggcttacaaagctcctccattattaatgaaggaaacaaccatcggttccgaaataaaagatccaaatcaaaaatttatctacgtttatgattttgccaagaactggacttttttagtggaactgataaacgtttcaaaggaagaaaatcaaaactcacctatccttctatga

SEQ ID NO: 4342 - protein, 134 aa, Unknown
  Obtained from environmental sample
  misc_feature (1)..(134): Xaa is any amino acid
MTFNQPYRFMAILKFRIYLEEDDSVYRDVVIRHTQSFQELHETILKAFEFDSKHQATFYRSNDNWQRGREISLEKYDRAYKAPPLLMKETTIGSEIKDPNQKFIYVYDFAKNWTFLVELINVSKEENQNSPILL

SEQ ID NO: 4343 - DNA, 897 bp, Unknown
  Obtained from environmental sample
  misc_feature (1)..(897): n is a, c, g, or t
atgatggtagattcgtttacagcactggttataaggtgccctttaagttcttggaatgccacagaagaacgtgcaagcgtaaccaggaaatttctcgacggcgttagtataaacgcgaccttagaaggtcttgaactgcaggctaaacaactctttcggaaatttgatattgaaggtgtattaatcacaaatgacttattcaaaaaagctttagaaagatcacgcggcaattcaactaaagagccgacaccaacggaaccaacgagaagatcagccctaagtatctgggaggagcgcttaataagccgtaagaaaacgcaagctcacggaacatacaaaacagagaacggctcttataactcgttcaaaaagtttttagaaaaatacaatcttgataaatactcatccgatcaatttctaacatctgacatcgaaaagtattttgagtacctcagtgaattgaatcgcgccaatacagtatcaaaaaagatcaaacatcttaaagcctttttcaaattccttagaaaaaacaaggctgttgtaagtattgatttggattctattaaagctgtagagcggccaggtaacaaattacaccttacacaagatgaactcaatggaattatccatgccgacttacacgatgattataagctagataaagttagagatctatttgtaatacagtgttgcaccggcctgcgtgtaagcgatctaaaacgattaggaagacagcatataacagcagaggtaattttaattagagccttcaaaaatcagtctgatattgaaattccaattacgcctttggtcaagtcgatatttgaaaaatacgattatgcacttccttatctctcagacgctaagtataatttgtatttgaagggagttatataa

SEQ ID NO: 4344 - protein, 298 aa, Unknown
  Obtained from environmental sample
  misc_feature (1)..(298): Xaa is any amino acid
MMVDSFTALVIRCPLSSWNATEERASVTRKFLDGVSINATLEGLELQAKQLFRKFDIEGVLITNDLFKKALERSRGNSTKEPTPTEPTRRSALSIWEERLISRKKTQAHGTYKTENGSYNSFKKFLEKYNLDKYSSDQFLTSDIEKYFEYLSELNRANTVSKKIKHLKAFFKFLRKNKAVVSIDLDSIKAVERPGNKLHLTQDELNGIIHADLHDDYKLDKVRDLFVIQCCTGLRVSDLKRLGRQHITAEVILIRAFKNQSDIEIPITPLVKSIFEKYDYALPYLSDAKYNLYLKGVI

SEQ ID NO: 4345 - DNA, 492 bp, Unknown
  Obtained from environmental sample
  misc_feature (1)..(492): n is a, c, g, or t
atgaaatcattcaaagtaaaaattaaaggcctctcaccttatatgcaacatagaatggatgataagaagctcgcggattgngaaaaacttcgcgggccaattatcggcggtagtgatgcaacaaaagacgatgcaaccagggccgactatcattgttatagaaatgatgaaggtcattgctacattccatcagatcaaataagaggttctttaattggtgcgggcacttacatgaaatcaaagggtggagttcgtacaaaatctatgaggtcgaatgtagcagcatgtttattaccagagccagagcaaattctattacccaattacgatttcatagataaacgatcagctgtaaacaggagcatcaaatcacgtgttatcgtaatcgngncaaggttgtcaacaatggaagctgaaatttactttgatgtttaccaggaaaaaattacaaacgaaacagtgaagcagttaataaactttggcggcccctaa

SEQ ID NO: 4346 - protein, 163 aa, Unknown
  Obtained from environmental sample
  misc_feature (1)..(163): Xaa is any amino acid
MKSFKVKIKGLSPYMQHRMDDKKLADXEKLRGPIIGGSDATKDDATRADYHCYRNDEGHCYIPSDQIRGSLIGAGTYMKSKGGVRTKSMRSNVAACLLPEPEQILLPNYDFIDKRSAVNRSIKSRVIVIXXRLSTMEAEIYFDVYQEKITNETVKQLINFGGP

SEQ ID NO: 4347 - DNA, 1005 bp, Unknown
  Obtained from environmental sample
  misc_feature (1)..(1005): n is a, c, g, or t
ttgaaacaggctcctgtgcttggtatttgttatggtgcccagcttaccgcaaaacagtttggtggcagggttgaaaaaagtagtaaaagagagtatggcagggctatacttcatgttaagaaagaagatgtcttattacagaaccttttaccttcttcacaggtctggatgagccatgctgatacaattcttgaacttcctgaatcatttacacttatggctactacggacagtattcctgtagcagcttttaaaaatgatgatggaatggccaacccactctatggtcttcagtttcatccggaagtttatcattccattgaaggaaaaaagatcctccagaattttcttgtgaacatttgcggttgcaaaagagactggacccctgcacatttcatcacggataccgtaaatgaattaaaggaacgcattggtgacaggaaggtggttatggcgatcagtggaggtgttgattccaccgttgcagccacactcattagtcgtgcgatcggtgataatcttcatggcatatttgtagacaatggagttttgaggaaaaatgaatttgaaacagtacttgagacttataaaaaactgggattaaatgtaaaggggattgatgccagtaagaaattttatgataagctcaaagggaaaactgatcctgaaaaaaagcgaaaggccattggaaagatgttcattgagatcttccaggaagaagcaaaaaaaataaaaaatgttgcactgcttggccagggaacaatctatcccgacgtgattgaaagtgtttcggtacacggtctttcagttacgatccaatcacacccatatgtcggaggcctttccaagaaaatgccccctcggacttgtggagccccctcgtttattatttcaggaatgaaantaagaaaggtgggcctggaaactagggaatccctgaaaaatttaatccggcggcattccattccccaggaccggaacccccccattaggaatacggggggg

SEQ ID NO: 4348 - protein, 335 aa, Unknown
  Obtained from environmental sample
  DOMAIN (1)...(120): Glutamine amidotransferase class-I
  misc_feature (1)..(335): Xaa is any amino acid
MKQAPVLGICYGAQLTAKQFGGRVEKSSKREYGRAILHVKKEDVLLQNLLPSSQVWMSHADTILELPESFTLMATTDSIPVAAFKNDDGMANPLYGLQFHPEVYHSIEGKKILQNFLVNICGCKRDWTPAHFITDTVNELKERIGDRKVVMAISGGVDSTVAATLISRAIGDNLHGIFVDNGVLRKNEFETVLETYKKLGLNVKGIDASKKFYDKLKGKTDPEKKRKAIGKMFIEIFQEEAKKIKNVALLGQGTIYPDVIESVSVHGLSVTIQSHPYVGGLSKKMPPRTCGAPSFIISGMKXRKVGLETRESLKNLIRRHSIPQDRNPPIRNTGG

SEQ ID NO: 4349 - DNA, 843 bp, Unknown
  Obtained from environmental sample
  misc_feature (1)..(843): n is a, c, g, or t
atgccagcactagcacgccgcaatagatactggtttattctagggagagaaacccaaatctccgcggctgaaatagccgctgttttagatacaaagaaatacgaaatttctaattcaattttgaaagttgaaactagcatctctactccaaaagaccttataaaaaaacttggcggcaccatcaagatagccatagaaatcgctagccaaactaacgaacagggcctagaaaatttaattattgaagaactaaaaacagtaacaggaaaaataaactttggcataagtttatatacaaatgaaagaaatgattttgtcgacatgaagcttgcccaagaatttggtaaaaaaattaaaaaggctcttaaaaacgaaggtctgtctgtaagatacgttgaaaaccgagaaccgatattgtcttcagtgactgttgaaaaaaacaatctcaccggccgaggccgggaatttatcatccagaaacagctcggtggtttctccttagccaagaccgatgcggttcagccgtttgaagaatttagtgctcgtgatttcggcagaccaggcagagacgatctgagcggcatgcttccgccaaaactggccatgataatgattaacctggcgcaacaacctacaaataccgttttacttgatcccttttgcggctctggtacgattcttagtgaggccttactccttggctatacaaatttaatcggcacagatatctcagaaaaggctaccagtgacaccaaggaaaacatgatttggatagctgatcagtttggtatttcagataataatgtaaacttaaaaatccaaactgaaagtatgaaaatataa

SEQ ID NO: 4350 - protein, 280 aa, Unknown
  Obtained from environmental sample
  misc_feature (1)..(280): Xaa is any amino acid
MPALARRNRYWFILGRETQISAAEIAAVLDTKKYEISNSILKVETSISTPKDLIKKLGGTIKIAIEIASQTNEQGLENLIIEELKTVTGKINFGISLYTNERNDFVDMKLAQEFGKKIKKALKNEGLSVRYVENREPILSSVTVEKNNLTGRGREFIIQKQLGGFSLAKTDAVQPFEEFSARDFGRPGRDDLSGMLPPKLAMIMINLAQQPTNTVLLDPFCGSGTILSEALLLGYTNLIGTDISEKATSDTKENMIWIADQFGISDNNVNLKIQTESMKI

SEQ ID NO: 4351 - DNA, 852 bp, Unknown
  Obtained from environmental sample
  misc_feature (1)..(852): n is a, c, g, or t
gtgggagttatggtaagtgcagttgctaatggacctaaaacagttgctctgtactctgagaaaacagccgagataaaaacattgaaaatcggtccctggatcaaagaacgtattcttcttgttgatcttggtttttataaaactcaaatgtttgcaagagttgaggaaaatgggggatattttgtctcaaggattaagaagaatatggatcctattcttatttctgttgaagagggactttctaagacaaaaagcaaagagttcgctggaaaacctgttagtgagtgtattaagcaactttcaggaaaagatattgatgcagttgtgaaaataaagtttaaaagaagagcatataaaggcaagcaaaaacaggatgatatgagtgtacgccttgttgcggtatataatgatgaagatgaaaagcaccacatatacatcacaaatattcagaaagatgttttgagtgcaaaagacattgcaaaattatatggagcaagatgggacatagaactgttgtttaaggagttaaaaagcaaatacgcgcttgacgttctggatacaaagaatgaacaggtaattgaaactctaatctggacagcaatgttgacattaatcgttagcagaagaatttattctcttgtaaagaacaatactgctcatcctgaaaaaatggttcgctatactcaagaaagatggagcataatatttgctganaatgcatcaaatttattgacagtgattctgcatagatgtggaattgaaagaacttttgaaacagtgatgagtgtatacgaaagtcaagcattggatccgcatgtaaacagaanaaggttcagagaagaatggttttaa

SEQ ID NO: 4352 - protein, 283 aa, Unknown
  Obtained from environmental sample
  DOMAIN (2)...(206): Transposase DDE domain
  misc_feature (1)..(283): Xaa is any amino acid
MGVMVSAVANGPKTVALYSEKTAEIKTLKIGPWIKERILLVDLGFYKTQMFARVEENGGYFVSRIKKNMDPILISVEEGLSKTKSKEFAGKPVSECIKQLSGKDIDAVVKIKFKRRAYKGKQKQDDMSVRLVAVYNDEDEKHHIYITNIQKDVLSAKDIAKLYGARWDIELLFKELKSKYALDVLDTKNEQVIETLIWTAMLTLIVSRRIYSLVKNNTAHPEKMVRYTQERWSIIFAXNASNLLTVILHRCGIERTFETVMSVYESQALDPHVNRXRFREEWF

SEQ ID NO: 4353 - DNA, 378 bp, Unknown
  Obtained from environmental sample
  misc_feature (1)..(378): n is a, c, g, or t
atgcagaataaaaccgttattcacggcaaggtcaataaattaaacaacaggaaatacaggatcgacaaagccaaagaatcggagatagacatcacgattgaagttatcgaggaggggcaatacactgttgaaaagttcagcgttgatgacctgccaactgaaatgaaggatggaaagcgcattcactggttcaacaacttcggcatcaaaaaagcgggtcaatatatcaaccaaagatatttggtcaccgttccgggtataggaaaagcacaaccggttatttttgatggcaatggcgctccctattattatacgggcgtggtcactgatgacacttttgagctaacagatggcgatcctgccattggaaaaacatag

SEQ ID NO: 4354 - protein, 125 aa, Unknown
  Obtained from environmental sample
  misc_feature (1)..(125): Xaa is any amino acid
MQNKTVIHGKVNKLNNRKYRIDKAKESEIDITIEVIEEGQYTVEKFSVDDLPTEMKDGKRIHWFNNFGIKKAGQYINQRYLVTVPGIGKAQPVIFDGNGAPYYYTGVVTDDTFELTDGDPAIGKT

SEQ ID NO: 4355 - DNA, 555 bp, Unknown; identical to SEQ ID NO: 2513
  Obtained from environmental sample
  misc_feature (1)..(555): n is a, c, g, or t

SEQ ID NO: 4356 - protein, 184 aa, Unknown; identical to SEQ ID NO: 2514
  Obtained from environmental sample
  DOMAIN (21)...(172): Universal stress protein family
  misc_feature (1)..(184): Xaa is any amino acid

SEQ ID NO: 4357 - DNA, 606 bp, Unknown
  Obtained from environmental sample
  misc_feature (1)..(606): n is a, c, g, or t
ttgaagaccaaaactgatggtatcttgttggctccttcctttatagaagaggcaactaaatttacaaaccaatgcagaaagctacaaatcccttatgtatttattgattccgatattcccgatcaacccagcctctcttatatagggcccgatctttaccatagcggatacctggcagccaacctgatcagttatttagttgggggaaaagacaggattttgatagtgaatatttctgcggaaattgaaaatcatcatcatcttttgcgaaaggaggatgggttccgcggctactttaaagagcataatataactgatagcattgaaaagattgatatcaggaaaataagttacaattcaatcaaaaaagaaatctcccaggctttgttaaaatacaaagacattaaggtactatttgttacaaatgccaaggtgtcttttgtggctcagtatttaaaggaagcaaacaggggggatatcgtgttggtggggtatgattttctgaaagaaaatattagttacccggaagaagaaaattataatttttttgatctgccagaaacccaggagagcaggccttacaaaggtatcatgaactctttataa

SEQ ID NO: 4358 - protein, 201 aa, Unknown
  Obtained from environmental sample
  misc_feature (1)..(201): Xaa is any amino acid
MKTKTDGILLAPSFIEEATKFTNQCRKLQIPYVFIDSDIPDQPSLSYIGPDLYHSGYLAANLISYLVGGKDRILIVNISAEIENHHHLLRKEDGFRGYFKEHNITDSIEKIDIRKISYNSIKKEISQALLKYKDIKVLFVTNAKVSFVAQYLKEANRGDIVLVGYDFLKENISYPEEENYNFFDLPETQESRPYKGIMNSL

SEQ ID NO: 4359 - DNA, 975 bp, Unknown
  Obtained from environmental sample
  misc_feature (1)..(975): n is a, c, g, or t
gtgtgggcttcgccgggatttgtcgaacgcgaaatcgaactcactaaggctgtcaattacgaaatgaagattgtgctgacttcagaagaagtgctcgatgaggtaaagatattttcgggaaaaacatccaaaaagaacaatccggccttggacatcctgcgtaaaatctgggaaagaaaacgcaagaacgggctcaagatgttcaatcaataccagtatgaaaagtacgaaaaggtagaatttgacctcaataccatcgacagcgcctttatgaaacgcaagattttcaagggcatggagtttgttttcgacaagattgatacctcaaaagtcaccgggaaaacctatttgcccatctttatcaacgaagccatttctgacgtatatggcgacaacaaaataggaaagaccaaggaaatcctgaaagccaataaaaattccggtttgggcagcggcgacggcgtgaatacgttcatcaaggatttgtacaacgactatgatgtgtataacaattacctgaacttttttgacaaaagctttaccagcccgctttcaaccaccggaatcgacgtctataactatgtgcttaccgatacggcgatgatcgataacaaaaggtgtttcaacattgttttttatccgagaaggaaaaacgaactgacctttaaaggcgatttctgggtcaatgacacgacttttgccatcaagaaaatcaatatggccgtgaccaaaagcgccaatatcaactgggtgaaggacatttatctggagcacgaatttgaagtagtcaacgattcggtttttttgctgacacgcgattatctgatgtctgattttgccctcaataacaaggagacctcaaaaggcgtttacggaaaacgtacttccttgtaccgaaacctacaaatcaacattgaaaacgaagataaattctacaagcagggaattcgattttgtagacctggcggtctataa

SEQ ID NO: 4360 - protein, 324 aa, Unknown
  Obtained from environmental sample
  misc_feature (1)..(324): Xaa is any amino acid
MWASPGFVEREIELTKAVNYEMKIVLTSEEVLDEVKIFSGKTSKKNNPALDILRKIWERKRKNGLKMFNQYQYEKYEKVEFDLNTIDSAFMKRKIFKGMEFVFDKIDTSKVTGKTYLPIFINEAISDVYGDNKIGKTKEILKANKNSGLGSGDGVNTFIKDLYNDYDVYNNYLNFFDKSFTSPLSTTGIDVYNYVLTDTAMIDNKRCFNIVFYPRRKNELTFKGDFWVNDTTFAIKKINMAVTKSANINWVKDIYLEHEFEVVNDSVFLLTRDYLMSDFALNNKETSKGVYGKRTSLYRNLQINIENEDKFYKQGIRFCRPGGL

SEQ ID NO: 4361 - DNA, 453 bp, Unknown
  Obtained from environmental sample
  misc_feature (1)..(453): n is a, c, g, or t
atgaaaaagattcttttctcactgatcgtctgcgtcttttgcctctcatcctgcagtcccttaaaagaagtgcaatacaccggtgtgaaaggattcaacgtgcaaaagatcaatactacaggcattgaaggagacgtaatcctcggggttaaaaatccgaacacctttggttttgcgatctaccccagtgaattcgacgtgacttatagcggtgtttatcttggaaaagctaaactcatgaaacgtgtgtttattaaaagaaataccgaggagaattataatttccatctcagtagcgacttcaaagacgttaacctgatggatgtggtaaaactgttgagcggggccacttttaaaaaccagatcgagataaagggtgagctaaaagcaggtaaatggtggatgaagaaaaaataccctgtagacctgaaagaaaggatcaaactgaactag

SEQ ID NO: 4362 - protein, 150 aa, Unknown
  Obtained from environmental sample
  SIGNAL (1)...(17)
  misc_feature (1)..(150): Xaa is any amino acid
MKKILFSLIVCVFCLSSCSPLKEVQYTGVKGFNVQKINTTGIEGDVILGVKNPNTFGFAIYPSEFDVTYSGVYLGKAKLMKRVFIKRNTEENYNFHLSSDFKDVNLMDVVKLLSGATFKNQIEIKGELKAGKWWMKKKYPVDLKERIKLN

SEQ ID NO: 4363 - DNA, 420 bp, Unknown
  Obtained from environmental sample
  misc_feature (1)..(420): n is a, c, g, or t
atgcaacaatatcttacccttctgcagcatattttacaaaatggtactgacaaaagtgatcgcacaggcacaggcacccgcagcgtttttggttaccaggcaagatttgatttgagcgaaggcttccctttaataactagtaaaaagcttcatcttaaaagtattatttatgagttgctatggtttttgaaaggtgatactaacattaagtttttaaaagaaaataatgtaagaatatgggatgaatgggctgatgaaaatggcgatctcggccctgtatatggaaagcagtggcgcagctgggagggcgcagatggaaaagtggttgatcaggtttcagaaataattaaacaaataaaatttaatcctgacaggcagaagattaattataagggcatggaatgttgccgacttacctaa

SEQ ID NO: 4364 - protein, 139 aa, Unknown
  Obtained from environmental sample
  DOMAIN (1)...(139): Thymidylate synthase
  misc_feature (1)..(139): Xaa is any amino acid
MQQYLTLLQHILQNGTDKSDRTGTGTRSVFGYQARFDLSEGFPLITSKKLHLKSIIYELLWFLKGDTNIKFLKENNVRIWDEWADENGDLGPVYGKQWRSWEGADGKVVDQVSEIIKQIKFNPDRQKINYKGMECCRLT

SEQ ID NO: 4365 - DNA, 366 bp, Unknown
  Obtained from environmental sample
  misc_feature (1)..(366): n is a, c, g, or t
atgattctctacgtcgaanaaatcagcacttctcatatgcgcatcacgcttttcgtctcctgtatcaacagaggctggattcatccaaaaatcaacctctgcggtcagaaaatcgctaccggcggtgtaaatacttgcttcgtactccttaaacgctcctttcacattggtgatcataagatgtttttacttaaaaagcatctcgctatgagcagggtctattaccccactggcttattgaaaaagtttccgaatcttccaattagctttgttttaaatttaagaaaaataattttctttgaaccttataaaagggaggcctaccaattattacttttatgtccaataaatggccaaagtgtttta

SEQ ID NO: 4366 - protein, 122 aa, Unknown
  Obtained from environmental sample
  misc_feature (1)..(122): Xaa is any amino acid
MILYVEXISTSHMRITLFVSCINRGWIHPKINLCGQKIATGGVNTCFVLLKRSFHIGDHKMFLLKKHLAMSRVYYPTGLLKKFPNLPISFVLNLRKIIFFEPYKREAYQLLLLCPINGQSVL

SEQ ID NO: 4367 - DNA, 345 bp, Unknown
  Obtained from environmental sample
  misc_feature (1)..(345): n is a, c, g, or t
ttgctgaattgctgctgcactccttgcaccactcctgcaatgtataattacttttttgtctctgcttatcatgcttttctcagcaagaatagtagcgagtggaataagctgtccaccaatattggcagcgtcaaattcaaattcctcccttacatcaatcagctggaaatcctctttattatccatcatcgatttcaactcattcgccgtaacttctttcatactaaaaatatattaaacgtgagctttcttttctttggtatcgggcttaacaaatggtttggcactctgcatcttaggatcaagatactgaaagaaggtatcgcttctaaggccaagtcttaa

SEQ ID NO: 4368 - protein, 114 aa, Unknown
  Obtained from environmental sample
  misc_feature (1)..(114): Xaa is any amino acid
MLNCCCTPCTTPAMYNYFFVSAYHAFLSKNSSEWNKLSTNIGSVKFKFLPYINQLEILFIIHHRFQLIRRNFFHTKNILNVSFLFFGIGLNKWFGTLHLRIKILKEGIASKAKS

SEQ ID NO: 4369 - DNA, 360 bp, Unknown
  Obtained from environmental sample
  misc_feature (1)..(360): n is a, c, g, or t
atgaaaaccggcctattagtttcagatagaaacgatgactttatagaagcaatcaaaaaattaaagaataataaaagcctgtttaatgagctaagtaaaaacgcaaaacaaaaaattattgatttctattcctctgatgcctgtacaaataagtggaacagtttattgaacgaactatattattctaattgcagttcgtacaaaaaaattgatatcccagacaaaattgaattacctaaaagacatccgcaattaagtatagaagattttagaataccgactgccttcgatttgttattggaaaaaatacgaacaaccaaagcctttcgatattttaaaaaatttattttaaaaagataa

SEQ ID NO: 4370 - protein, 119 aa, Unknown
  Obtained from environmental sample
  misc_feature (1)..(119): Xaa is any amino acid
MKTGLLVSDRNDDFIEAIKKLKNNKSLFNELSKNAKQKIIDFYSSDACTNKWNSLLNELYYSNCSSYKKIDIPDKIELPKRHPQLSIEDFRIPTAFDLLLEKIRTTKAFRYFKKFILKR

SEQ ID NO: 4371 - DNA, 615 bp, Unknown
  Obtained from environmental sample
  misc_feature (1)..(615): n is a, c, g, or t
atgaagaagaaagtagctttttgcacctatgatgctcccttgttttatggtccgaacacctggcttaaaagattattggcagatctaaataaaaaagacttctctattcaggttctaattttttacgaagggaatttagatgaatgtaatgcctgtcaatattttaacagtttgggactttatgttgatacttttccctttaaatctattacacaggacaaaataatatggattttaaaaaccctggcttccaatccaccggatgtatttgttccaaatatgcttgtcggtgccctttatgccgccaggtggataaaaaaagcaggcatcccgacggttggtgttatgcattctgacgataaattttatgatgctgtgacaagagtatttgtaaatggcgatcaggaatataagttatcagcgttcattacgtgttcaaaatttttatttaaaaaagtaaaggctacaaaaccctctaacattattatagatacaatagcatacggaagtcccacagaaaacatcccatcaactgtttttgatgacaataaattaaaattgattttatgtggaaagactggtagaaaaacaaaaaagaataacgggaagtggtga

SEQ ID NO: 4372 - protein, 204 aa, Unknown
  Obtained from environmental sample
  misc_feature (1)..(204): Xaa is any amino acid
MKKKVAFCTYDAPLFYGPNTWLKRLLADLNKKDFSIQVLIFYEGNLDECNACQYFNSLGLYVDTFPFKSITQDKIIWILKTLASNPPDVFVPNMLVGALYAARWIKKAGIPTVGVMHSDDKFYDAVTRVFVNGDQEYKLSAFITCSKFLFKKVKATKPSNIIIDTIAYGSPTENIPSTVFDDNKLKLILCGKTGRKTKKNNGKW

SEQ ID NO: 4373 - DNA, 648 bp, Unknown
  Obtained from environmental sample
  misc_feature (1)..(648): n is a, c, g, or t
gtgattattgaattagagcatccacagttttggggttattttgttttttacaataataaatcgttggtggtaaaaataaaaagacagtctgaaaaactaaaaatcaaaaacctgacaatagcgattgatgccggccatggaggtagcaatagcggtgcgaaaggcgttaacagcggtatttatgaaaaagactacaccttactgatagcaaaagagcttgaaaaatatttaaacaaaaaaggggtgaatgtaatcatgacaagaacgggtgatgaagatttaacgatgattgaccgtacactttttttacgcggacaggagcccgatttgctcataagcattcatttaaattcatcatcaaaccccaatgtttcaggtgcaagtacctattaccgttatattggcttcaggtctttgtcagtgaatattcttgacaggatgctggaacttaaattaaataattttggaaatgtaggcagcttcaatttttcattaagtggcccgacggaatatccaaattgcctggtagaagtggcctttcttagcaatgcggaagatgaaaagaaaatccttaacccttcttttcgaaaagatgttgcttataaaatttacaagggaattgatgactggcttaagcaaattaaataa

SEQ ID NO: 4374 - protein, 215 aa, Unknown
  Obtained from environmental sample
  DOMAIN (100)...(212): N-acetylmuramoyl-L-alanine amidase
  misc_feature (1)..(215): Xaa is any amino acid
MIIELEHPQFWGYFVFYNNKSLVVKIKRQSEKLKIKNLTIAIDAGHGGSNSGAKGVNSGIYEKDYTLLIAKELEKYLNKKGVNVIMTRTGDEDLTMIDRTLFLRGQEPDLLISIHLNSSSNPNVSGASTYYRYIGFRSLSVNILDRMLELKLNNFGNVGSFNFSLSGPTEYPNCLVEVAFLSNAEDEKKILNPSFRKDVAYKIYKGIDDWLKQIK

SEQ ID NO: 4375 - DNA, 942 bp, Unknown
  Obtained from environmental sample
  misc_feature (1)..(942): n is a, c, g, or t
atgtatagcaacgacttaatcttcggaaaagataaaactgagcggattgtcagtattgaagcaaatgaggatcttatcgagatcttcactcgtgacaagaacggcaaactcagttctaggtttgagcctaattcctattggcttctgaccaaccacccagccaatagctctttcattacccttaacggtgacttacattttaaatacgctaaaacctttaaagatcgcaaggacttctttaaatataaacaatatctaagatcgaaacatattgacttttatgccgtaggtgacgttaaagaatctattatgcttcgtaacggttatacatacttcaaaggtttaatgcctaaagaactttctatattaagttttgacttagaaactaccggattaactcacgatgacacatctaaaatcctttgcatttcgactacgagtcgggaccatagtggccgaattagaaaagttctctgggaccacaaggaatattcctcacaagccgaaatgcttacaagatttagtgaatacgttcaagaacaagatccagatatccttataggtcataacattataatgttcgatattccctatatgcaatttattgctgatcgggaaggcgttcaattagaatggggaagaaataaagctcccattgagattgataattacgaatctaagttccgtanagacggtagtcagtcataccattatcacaaagttcgttgttacggtcgtgagatatgcgatactttatttcttacgattaaacacgatgccactgaacgtaaaatagaaagctatggattaaaaccagtaatcaaacaccttgggttagaaaaccaggacgaactttttatgacgcctcgaaaatccgcgaaaaatatacccatcccgaaagagtgggaaaaaatcaaagcgtactgtatggatgataagtga

SEQ ID NO: 4376 - protein, 313 aa, Unknown
  Obtained from environmental sample
  DOMAIN (29)...(273): DNA polymerase family B, exonuclease domain
  misc_feature (1)..(313): Xaa is any amino acid
MYSNDLIFGKDKTERIVSIEANEDLIEIFTRDKNGKLSSRFEPNSYWLLTNHPANSSFITLNGDLHFKYAKTFKDRKDFFKYKQYLRSKHIDFYAVGDVKESIMLRNGYTYFKGLMPKELSILSFDLETTGLTHDDTSKILCISTTSRDHSGRIRKVLWDHKEYSSQAEMLTRFSEYVQEQDPDILIGHNIIMFDIPYMQFIADREGVQLEWGRNKAPIEIDNYESKFRXDGSQSYHYHKVRCYGREICDTLFLTIKHDATERKIESYGLKPVIKHLGLENQDELFMTPRKSAKNIPIPKEWEKIKAYCMDDK

SEQ ID NO: 4377 - DNA, 942 bp, Unknown
  Obtained from environmental sample
  misc_feature (1)..(942): n is a, c, g, or t
atggataaaaaaacattttctatgtctgataacatcaatcaaagcggtggttcagtattgcaatccatgcaaaatttacctggcgttacagttcaagatggaaaagttcaaattagaggtaacgataaggttaccgttcttattgatggaaaacaaactgctttaacaggtttcggaaatcaatctggtttagataacattccagcttcagcagtagaaaaaattgaaatcataaataatccatcatcaaaatacgatgccaatggaaatgcaggaattatcaatattatctacaaaaaaaacaagaaagaagggtttaatggtaaagttggttttactaatggttatgggagtttatgggaaagaaaacaaaacttaccaactattagaccacaatatactataacaccaaaaatcaatcctacattatcattaaattatcgtaaaaacaaaataaatactttctttcaaggagattatttatatacagaaacgctgaataaaaatgaatttgtaactagaacttataacgatggtacaattatcaatcaacaactaaaaagaaatagaaatacgcattttacaactattaaatctggaattgactggaatattaatgagcaaaatacattaacagtttcaggtttatttggttctgaaaaaattattgataatggtgaccaaccgttttttaatgctgactattcacaacgattacgactttggcaatttttggaagatgaattaaaaactacggctatggcaactgcatcataccnacataagtataaagaagcaggacatactttaaatattggattcaattatacctttcatagagaagatgaaaaatattttttcgaaaatattttgccaactttcaacagtaaagattctttcaaaattgtatctgatgaaagcgtaatagaattttattattga

SEQ ID NO: 4378 - protein, 313 aa, Unknown
  Obtained from environmental sample
  misc_feature (1)..(313): Xaa is any amino acid
MDKKTFSMSDNINQSGGSVLQSMQNLPGVTVQDGKVQIRGNDKVTVLIDGKQTALTGFGNQSGLDNIPASAVEKIEIINNPSSKYDANGNAGIINIIYKKNKKEGFNGKVGFTNGYGSLWERKQNLPTIRPQYTITPKINPTLSLNYRKNKINTFFQGDYLYTETLNKNEFVTRTYNDGTIINQQLKRNRNTHFTTIKSGIDWNINEQNTLTVSGLFGSEKIIDNGDQPFFNADYSQRLRLWQFLEDELKTTAMATASYXHKYKEAGHTLNIGFNYTFHREDEKYFFENILPTFNSKDSFKIVSDESVIEFYY

SEQ ID NO: 4379 - DNA, 372 bp, Unknown
  Obtained from environmental sample
  misc_feature (1)..(372): n is a, c, g, or t
atggttcgtttgcacactttgttcttagcacaaagcacgggtaatccctctctcaggaacagtaaatggaaaggacatattgagtctcccgaatcgatggatataatattcgattttaaaaatgacacggtgatagtaacttctgcagatatgactgaactggaaacaatgttgttttggcaaaacggagatacagtaaaactcaaaaaaatcagtggcacgagtccttgtgacgacatcgcaattggatcctaccatattgaatggcaggaaaaaggagataaaattataattcacaatctcgcggacccctgcctggagagagctactgcaataacctcggcccttgcttatttcagagttaaaaagtaa

SEQ ID NO: 4380 - protein, 123 aa, Unknown
  Obtained from environmental sample
  misc_feature (1)..(123): Xaa is any amino acid
MVRLHTLFLAQSTGNPSLRNSKWKGHIESPESMDIIFDFKNDTVIVTSADMTELETMLFWQNGDTVKLKKISGTSPCDDIAIGSYHIEWQEKGDKIIIHNLADPCLERATAITSALAYFRVKK

SEQ ID NO: 4381 - DNA, 489 bp, Unknown; identical to SEQ ID NO: 133
  Obtained from environmental sample
  misc_feature (1)..(489): n is a, c, g, or t

SEQ ID NO: 4382 - protein, 162 aa, Unknown; identical to SEQ ID NO: 134
  Obtained from environmental sample
  misc_feature (1)..(162): Xaa is any amino acid

SEQ ID NO: 4383 - DNA, 756 bp, Unknown; identical to SEQ ID NO: 1969
  Obtained from environmental sample
  misc_feature (1)..(756): n is a, c, g, or t

SEQ ID NO: 4384 - protein, 251 aa, Unknown; identical to SEQ ID NO: 1970
  Obtained from environmental sample
  DOMAIN (9)...(171): Type I restriction modification DNA specificity domain
  misc_feature (1)..(251): Xaa is any amino acid

SEQ ID NO: 4385 - DNA, 573 bp, Unknown
  Obtained from environmental sample
  misc_feature (1)..(573): n is a, c, g, or t
atgtgtttaaatatggatgtcaaagaaataaaccgccatggacaggaactgatcaaacatctgaaaatcagaacatctcctgtagcagtaaaactgattccgaaaggagcagaaattccagaaggtatcaagaaggcaaaagagaatatgactcactgccagtttgtggataaagttagaagaacccgtgaagagttttacactttaaataaaaaccaaatgtgtaaaattggagctggtgcaatgggtcttggctcaattcccaatgatctggtcagcggggagctctattacaaagaattcgagctattcagcacactgagtgcctcaaggcgtactgttgaaatgatccctatcctcccaccgaattcaacagaagctgttctttactctaccctggaaaaaacttcgtttattccaaacgtcgttatggttatcggtaatcctaaacagatgatgttacttacacaggctgtgatgtatgggataggaggaaggcttgaaacgagcttcgcaggagcacagagtgtatgttctgacggcgttgtgcaagttttaaagaaggaaaagtag

SEQ ID NO: 4386 - protein, 190 aa, Unknown
  Obtained from environmental sample
  DOMAIN (9)...(189): Uncharacterized ArCR, COG2043
  misc_feature (1)..(190): Xaa is any amino acid
MCLNMDVKEINRHGQELIKHLKIRTSPVAVKLIPKGAEIPEGIKKAKENMTHCQFVDKVRRTREEFYTLNKNQMCKIGAGAMGLGSIPNDLVSGELYYKEFELFSTLSASRRTVEMIPILPPNSTEAVLYSTLEKTSFIPNVVMVIGNPKQMMLLTQAVMYGIGGRLETSFAGAQSVCSDGVVQVLKKEK

SEQ ID NO: 4387 - DNA, 312 bp, Unknown; identical to SEQ ID NO: 2389
  Obtained from environmental sample
  misc_feature (1)..(312): n is a, c, g, or t

SEQ ID NO: 4388 - protein, 103 aa, Unknown; identical to SEQ ID NO: 2390
  Obtained from environmental sample
  misc_feature (1)..(103): Xaa is any amino acid

SEQ ID NO: 4389 - DNA, 537 bp, Unknown
  Obtained from environmental sample
  misc_feature (1)..(537): n is a, c, g, or t
atggttctttatatgttaccgatgatgcaaaaggatatgtttggaaaatcaattttacaggaaaataaaatgatgatgagagtttttgtatttgtgttgctgctaattcctggtcttgtgaaagctcaaacgaaaaagccggtaacaaagaagcctgcaatttccacttcaaaaacaacaagtggttccggaaacactttaaagagttcaataagccgtgggcagattgtgtacactaaattttgtcttacctgccaccaggtagatggatcaggcgtgcctaatctgaatccgccattgatcaggacacaatggactttgggttccaaaaccgttttgatagagcaggtgttgaaaggttcaaatggcaagattgaaatcgacggcgaaacttttcacaacaccatgcccccattggccacattgaccgatcagcaaattgcagatgtactaacttatgtaagaaacaattttggaaacaaagcaagcatagtaacgccggcagaagtgaaagcggtaagagtgaagacaaaatga

SEQ ID NO: 4390 - protein, 178 aa, Unknown
  Obtained from environmental sample
  misc_feature (1)..(178): Xaa is any amino acid
MVLYMLPMMQKDMFGKSILQENKMMMRVFVFVLLLIPGLVKAQTKKPVTKKPAISTSKTTSGSGNTLKSSISRGQIVYTKFCLTCHQVDGSGVPNLNPPLIRTQWTLGSKTVLIEQVLKGSNGKIEIDGETFHNTMPPLATLTDQQIADVLTYVRNNFGNKASIVTPAEVKAVRVKTK

SEQ ID NO: 4391 - DNA, 498 bp, Unknown
  Obtained from environmental sample
  misc_feature (1)..(498): n is a, c, g, or t
ttgaaggaaagatttgacgtttcaaaaggaaattcgaaaaaagttcttgttatagacgattgcagaatttatggcacggggaatgaaaagctaattatcaaaatggggttttcaggaactaatagcggcatagcttattttacgggcaaacctttttatgatgcaactaaaaaaatgatcgaagtaaaagatattgatttcgatgtaaaaacaaaaagccttttattgaaatcagctgattggctttttaataaacgtatcatcaacgaaattgccagggtgtcaaaatttgatctttctacttatatcgatactgcaaaaattttgatcaataagcaattaaatgcagaatggatcaatggtgtaaaaagtattggctcaattaatgatctgaaaatttcaggcttctatccattaactgactatttcattatccgcagcaacgcaagcggtaacctggtgataaaagtggatgcaatgaattttaatttgcaatga

SEQ ID NO: 4392 - protein, 165 aa, Unknown
  Obtained from environmental sample
  misc_feature (1)..(165): Xaa is any amino acid
MKERFDVSKGNSKKVLVIDDCRIYGTGNEKLIIKMGFSGTNSGIAYFTGKPFYDATKKMIEVKDIDFDVKTKSLLLKSADWLFNKRIINEIARVSKFDLSTYIDTAKILINKQLNAEWINGVKSIGSINDLKISGFYPLTDYFIIRSNASGNLVIKVDAMNFNLQ

SEQ ID NO: 4393 - DNA, 561 bp, Unknown
  Obtained from environmental sample
  misc_feature (1)..(561): n is a, c, g, or t
atgcatgaaaagctacttatagattctttaaaaaagcaggacaagaaagcctgggaaaattctattaatgaatataaggagctcgtctttaaagtgatatgcaaaaagattaaatgtactgaagatgcagaagaactgatgcaggaagtattcgttaaagcatttttgaagataaatcagttcgaaggaagggcaaaattcagcacttggcttgtggggattgcaatcaatactactcggacttttctcaagtctgtatatcatcaaaggcatctacttaatgaaacgattgaaacaaatgaagtaaaattcttagttagtgatgtggatccagaacaagtcctcgtgcaaaaagaaaaaagaaatttattaattcagcttcttagccaactcagcgataagcaacggacggcatgtactctttactttttcgaagatctccagcaaacggagattgctgatattatgggtacttctttggatgcagtagaatcgcttattcatcgaggcaaagaaaaaatgaaagctcttattcaaattccacaaaattctctgttatga

SEQ ID NO: 4394 - protein, 186 aa, Unknown
  Obtained from environmental sample
  DOMAIN (21)...(89): Sigma-70 region 2
  misc_feature (1)..(186): Xaa is any amino acid
MHEKLLIDSLKKQDKKAWENSINEYKELVFKVICKKIKCTEDAEELMQEVFVKAFLKINQFEGRAKFSTWLVGIAINTTRTFLKSVYHQRHLLNETIETNEVKFLVSDVDPEQVLVQKEKRNLLIQLLSQLSDKQRTACTLYFFEDLQQTEIADIMGTSLDAVESLIHRGKEKMKALIQIPQNSLL

SEQ ID NO: 4395 - DNA, 945 bp, Unknown
  Obtained from environmental sample
  misc_feature (1)..(945): n is a, c, g, or t
atgcggtttagccatgaacgctatcaaacgctgacttcaatgttgcccgtaggagtattccataccganttagatggtaactgcttgtacgtaaacncctgttggcaagcaattacagagcttaccctcgaaggaagcaaaaataagccttggtttaggcaggtacatcctgctgatcaggagtatgtcttaaaaagctggaatgaccgtaaagatacagaaaattaccgtgttgagtttcgttttcttttgaccgatggtagagaacgttgggtactcgttcaacttgtgcctgagagagtggataagggaattcggggctatgtgggctcgcttacggacatcacagagctgaaaaagctagaagagaatcgtttaaaagctatgcaagaagcagaggcacaccagcgcaagcttgtggaaatggcagaaaagcatctcaaagaccaagagcaatttattgacaatatatgccacgagctacgtaatcctttaaacggcatttatgggaataccaatttgttaaaagccagtgctaccgcgctggaagaaaaagcacaaacagcacctgaagaagcaaaaatcgattggcgtaaagaactccttaatcacttaattcaagatgctgaagcattaactgctatcgaaaaatgtgcccgttatcaaaaagtgattagcgatgatgtgctaagcctttctaaattagaggcgggaaaaatagagcttaaccccattgattttaagcctaataaacttgtaaaagacgttctagaaatggtcgaaaggcaagctcgccataaaggtattcgcttttccctccatttgcttctcgctgacatcgtcataaaggcagattttcaccgtttaatgcaaatattgctgaatttattaaccaatgcgatcaaatttactcctgatgccggcggggaagtgatcatcagctag

SEQ ID NO: 4396 - protein, 314 aa, Unknown
  Obtained from environmental sample
  DOMAIN (149)...(238): His Kinase A (phosphoacceptor) domain
  misc_feature (1)..(314): Xaa is any amino acid
MRFSHERYQTLTSMLPVGVFHTXLDGNCLYVNXCWQAITELTLEGSKNKPWFRQVHPADQEYVLKSWNDRKDTENYRVEFRFLLTDGRERWVLVQLVPERVDKGIRGYVGSLTDITELKKLEENRLKAMQEAEAHQRKLVEMAEKHLKDQEQFIDNICHELRNPLNGIYGNTNLLKASATALEEKAQTAPEEAKIDWRKELLNHLIQDAEALTAIEKCARYQKVISDDVLSLSKLEAGKIELNPIDFKPNKLVKDVLEMVERQARHKGIRFSLHLLLADIVIKADFHRLMQILLNLLTNAIKFTPDAGGEVIIS

SEQ ID NO: 4397 - DNA, 741 bp, Unknown
  Obtained from environmental sample
  misc_feature (1)..(741): n is a, c, g, or t
atggttaaaagatcttctgaaaaaaatattacgggagagatcctttacccgatcatccatttaaaaggtgaagacattgagctggcgatgacccatagcaatgagcatttcagtgaagaatattatagttatgtgaacgggcagtttacaacacagggaggaacgcaccaggcggcattcagggaagcagttgtaaaaacgatccgtgagttttataaaaaggattttgatcccacggatgttcgtaaatctattgttgcggccattgctgtaaaagtacaggagcctgtttttgaatcacagacaaaaacaaagttaggatcacaggagatagcgcctggcggacaaagcatgcgcagctttgtgaatgattttataaaggagcagctcgataattatttacacaaaaaccaggatgtcgcgaaagcaattgaagcaaagatccttgccaatgaacgtgagcgtaaagagctgagtggaattcagaagctggcgagggagcgtgctaaaaaatcttccctgcataataaaaaattacgcgattgccgtacgcatttagatgatgcaaaagatgttcgaaggttggaaacgactctttttatttgcgagggagattcagccagcggttcaattacaaaaacacgtgatgtaaatactcaagctgtattcagcttaaaaggtaaaccattaaactgttttggtttgggtaaaaagngtggtttacgaaaacgaggaatttaa

SEQ ID NO: 4398 - protein, 246 aa, Unknown
  Obtained from environmental sample
  DOMAIN (5)...(168): DNA gyrase B
  misc_feature (1)..(246): Xaa is any amino acid
MVKRSSEKNITGEILYPIIHLKGEDIELAMTHSNEHFSEEYYSYVNGQFTTQGGTHQAAFREAVVKTIREFYKKDFDPTDVRKSIVAAIAVKVQEPVFESQTKTKLGSQEIAPGGQSMRSFVNDFIKEQLDNYLHKNQDVAKAIEAKILANERERKELSGIQKLARERAKKSSLHNKKLRDCRTHLDDAKDVRRLETTLFICEGDSASGSITKTRDVNTQAVFSLKGKPLNCFGLGKKXGLRKRGI

SEQ ID NO: 4399 - DNA, 999 bp, Unknown
  Obtained from environmental sample
  misc_feature (1)..(999): n is a, c, g, or t
ttgagtctgatgaaaattgatttttacctgcgctttcatacgaaattcggtcagtcgctcgcaataacgggaaacctgcctgtattgggcagtgatgaaccgggcaaagctttgccaatgagctttcttagcgatgaactatggcaggcttctatcgaaattgatccttccgaaacccaaacacttcactaccgctatatttttattgatgaaaagggagtctcggaaaaagaggccgaaaaggaacgcatcattgaaatcaaaaaagcaaagcatgatcttttgctggcagatacctggaatgatccaagccttgtagagaactctttttactctactcctttcaaagaggtttttttcagagaccggaaaagacttaagcttaagaagaacaatttatatacgcatcagttcaaaataaaagcacctcttctttctcctgatgaaacagtttgtttactgggtagctccgaaaccttgggccaatggaatacggacacgccaattttattaagcaaaaaaggaaactggtggatagtaaaccttgaaattccggcatcggaatttgccatgtcgtacaaatatggtgtttacaatttgaagacgggtgcatttatccggtttgaaaatggagacaacaggatactgcataacgatggttctgtccataaaaaaacggtcattcacgatggttttttaagattgcctgttaaccggtggaaaggtactggtgttgccattcctgttttcagtttgcgcagcaataacagttttggcattggtgaatttaacgacatcaaattattagtggactgggctgacgaagctggattgaaaatgatccagctattacccgtcaatgatacttgccgcacgcatacctggaaaagatcttatccctatgcagctatatctgcttttgcccttacatccgatctatgtcaatcttccgaaagtagcaggcaccaaaggccggcagattatcaaggcgctaaataa

SEQ ID NO: 4400 - protein, 332 aa, Unknown
  Obtained from environmental sample
  misc_feature (1)..(332): Xaa is any amino acid
MSLMKIDFYLRFHTKFGQSLAITGNLPVLGSDEPGKALPMSFLSDELWQASIEIDPSETQTLHYRYIFIDEKGVSEKEAEKERIIEIKKAKHDLLLADTWNDPSLVENSFYSTPFKEVFFRDRKRLKLKKNNLYTHQFKIKAPLLSPDETVCLLGSSETLGQWNTDTPILLSKKGNWWIVNLEIPASEFAMSYKYGVYNLKTGAFIRFENGDNRILHNDGSVHKKTVIHDGFLRLPVNRWKGTGVAIPVFSLRSNNSFGIGEFNDIKLLVDWADEAGLKMIQLLPVNDTCRTHTWKRSYPYAAISAFALTSDLCQSSESSRHQRPADYQGAK

SEQ ID NO: 4401 - DNA, 432 bp, Unknown
  Obtained from environmental sample
  misc_feature (1)..(432): n is a, c, g, or t
gtggttgaatttgataaggattataaagtgctttccattgaagaaaaaccacagcaaccaaaatcaaacttcgcagttccgggcctttatttttatgataacgaagtggttagtatttccaaaaatctaaaaccatcacttcgtggtgagtacgaaataacggatgtgaataaagagtacttaaaaagaggcaggttgaaagtttttatccttgaccggggtactgcatggcttgataccggcacatttgaatcattaaatgatgccagcgagtttgtaagagtaattgaaaaaaggcaaggcaccaagatcgggtgtatagaagaaattgcctaccggatgaattttataaaaaaagatcaattattacaacaagccgaagcccttgcaaaaagtggttatggcatttacctcaaaaacctggttaagtaa

SEQ ID NO: 4402 - protein, 143 aa, Unknown
  Obtained from environmental sample
  misc_feature (1)..(143): Xaa is any amino acid
MVEFDKDYKVLSIEEKPQQPKSNFAVPGLYFYDNEVVSISKNLKPSLRGEYEITDVNKEYLKRGRLKVFILDRGTAWLDTGTFESLNDASEFVRVIEKRQGTKIGCIEEIAYRMNFIKKDQLLQQAEALAKSGYGIYLKNLVK

SEQ ID NO: 4403 - DNA, 816 bp, Unknown
  Obtained from environmental sample
  misc_feature (1)..(816): n is a, c, g, or t
atgagtaaacctattgggacgctggagttaagtgttctcgcattaattctaaataggactacgtatctaaagtataagaatatcctgaaggtagagttttttgaagcaccagaactaaagatagtctacaaggttgtatctaggttgcatgagaaattcaagaagaagagagtatatgtcaaagatatttggatgctaattgagaagagagtagacgaagaagatcgttctagattttataaactacttactaagctcaagggtttgtatctgaatatttctcctgatgaagaggagattattgattatagtatcaagcggttctctcaagaaaatatgttgaagcatgttctttctggaaccgtacaagagttacagtcaggacaggaagtagatatacctgacctacgcattcaactagataagattaacgcaattactaaagctaaaataatccacgattacgagtatgttagtacgcacaatgagcgtgtagatgtaatgcaggagccatatagattgcctacgggtatctctgcagagttagataggtctatgtcagggggccttgcagcgggggaactaggcttcttcctagcccctcctggcaggggaaagactctagcattagtgaacgtaggaaccaatgcactaaggcagggaaagaaggtactacatattactctagaaattaatgctagagtagtaggtcaaagatatgatagatgcttgtgccaatctacctatgctgaaattagagagaatcctaaagagttacttacacagttgaaggatgtaaaagagcagtggagctag

SEQ ID NO: 4404 - protein, 271 aa, Unknown
  Obtained from environmental sample
  misc_feature (1)..(271): Xaa is any amino acid
MSKPIGTLELSVLALILNRTTYLKYKNILKVEFFEAPELKIVYKVVSRLHEKFKKKRVYVKDIWMLIEKRVDEEDRSRFYKLLTKLKGLYLNISPDEEEIIDYSIKRFSQENMLKHVLSGTVQELQSGQEVDIPDLRIQLDKINAITKAKIIHDYEYVSTHNERVDVMQEPYRLPTGISAELDRSMSGGLAAGELGFFLAPPGRGKTLALVNVGTNALRQGKKVLHITLEINARVVGQRYDRCLCQSTYAEIRENPKELLTQLKDVKEQWS

SEQ ID NO: 4405 - DNA, 789 bp, Unknown
  Obtained from environmental sample
  misc_feature (1)..(789): n is a, c, g, or t
atgaaaaggaaaatatttttttacaccctgatgagtattcttttggcgggaatatttgcgccaggatattcgcaaaccaacaagattgactatgcgaactccaaggagtatatcatccgcaaattaagtgttgaatcaccttctaccacattggataaacaagtgctggttagaatgatgaaagactggggctattccgaaggccagaaaataaagattcccggagaagatatcactaatctggtagatcgtttatgggatgaagaagttttcaccaatatcaaagtttaccatactgctatcgaaaaagattttattgatctggtagtttatgttgaggaaaaaccaagggtaagcagattttctttacgtgggcctgccaacggacccgctttgaaaaaaacagaagccgacgaattatacgaacatattaaacctatcataggatttcaaaaaccatatactgattatctccaaaagaatgtagaacattatatcaaagactattttgctgataagaactttttcgataccaaagttgaatttgatgtaagtgtagataccatgaaaggngttatgccaggatctcttttagtaaggatcatggttgacaaaaaaaacaaggtaaaagttggccggctaaccgtggaaggcaatgagcatgtaagactaacaaaaatacgccgggcatttaaagaatcaatgtacgagaaatcgagatttgatgtatggcangacctggctgactggataccggggaagagaaagttaaacggatactattattaa

SEQ ID NO: 4406 - protein, 262 aa, Unknown
  Obtained from environmental sample
  SIGNAL (1)...(20)
  misc_feature (1)..(262): Xaa is any amino acid
MKRKIFFYTLMSILLAGIFAPGYSQTNKIDYANSKEYIIRKLSVESPSTTLDKQVLVRMMKDWGYSEGQKIKIPGEDITNLVDRLWDEEVFTNIKVYHTAIEKDFIDLVVYVEEKPRVSRFSLRGPANGPALKKTEADELYEHIKPIIGFQKPYTDYLQKNVEHYIKDYFADKNFFDTKVEFDVSVDTMKGVMPGSLLVRIMVDKKNKVKVGRLTVEGNEHVRLTKIRRAFKESMYEKSRFDVWXDLADWIPGKRKLNGYYY

SEQ ID NO: 4407 - DNA, 741 bp, Unknown
  Obtained from environmental sample
  misc_feature (1)..(741): n is a, c, g, or t
atgacaaaattttcgcatgataccgtggtcccgtacaggcagtcagcgaagagcaagaaggaccaggtggcaggcatgttcgataatatcgcttaccgttacgattttctcaacaggttcctttcaggcggaatcgacatcacatggcgaaagaaaatgcttcgggaattaagcgacgctgcgcccaaaactatactcgacgtagctaccggaacgggcgacgtggctatcctggcggcccagatgcttaagcccgaaaaaattaccgggatcgacatttccggtaaaatgctggaaatcggaagaaaaaaaattactaaactgctgttaaatagtaagatagagctattgcagggcgacagcgaggcaataaattcggctaataatgcgtttgatgcggtgacagtggcgtttggcgtgaggaacttcgaaaacctcgaaaaggggctttcagaaatccttagggtattaaaacccggcggcaaactggtgatacttgaattttcgaggccggttggatctttcaggtgggtatataacctgtatatgaataacctggctccatttttcggcagaatattctgtaaagacaaagaagcataccaatatttacattcatccgtaaaagcatttcctgaaggcaaaacatttctacacattttacaacaagtcggatttcaagaaaccacattaaacagactgaccttaggaatatgtacaattatgggaagaaacagttag

SEQ ID NO: 4408 - protein, 246 aa, Unknown
  Obtained from environmental sample
  DOMAIN (13)...(245): ubiE/COQ5 methyltransferase family
  misc_feature (1)..(246): Xaa is any amino acid
MTKFSHDTVVPYRQSAKSKKDQVAGMFDNIAYRYDFLNRFLSGGIDITWRKKMLRELSDAAPKTILDVATGTGDVAILAAQMLKPEKITGIDISGKMLEIGRKKITKLLLNSKIELLQGDSEAINSANNAFDAVTVAFGVRNFENLEKGLSEILRVLKPGGKLVILEFSRPVGSFRWVYNLYMNNLAPFFGRIFCKDKEAYQYLHSSVKAFPEGKTFLHILQQVGFQETTLNRLTLGICTIMGRNS

SEQ ID NO: 4409 - DNA, 477 bp, Unknown
  Obtained from environmental sample
  misc_feature (1)..(477): n is a, c, g, or t
atgtcaaaggtagtagcaattcctgaagcggttggaattcctccgtcagatgcttttgtgttaaaaggttgttggatcgaagttcaatatccacctaggggtaaattgtttgtgggttatggatcggctggcgagcaatttcatgtacgtgtacataaacatgatgaaattgtaggtcgatacacgcaatatgtgtacgatggaactggaacatcgtatttatcagattttatagataaaacgttactaaaatgcggtctaaagaaatatgactataaaaaggtttgggagcatcgggtagagtatcgagaggatggaccaaaatatataaaatttgacaaaaaagagcataagaaagcattaattcgtaaacaaaaatcatttgaaagacaagcagaaaaatacaaacagaagtatgaatggcacagtaaaatagcaaaatcaataggagaagagatacgagctcttactatataa

SEQ ID NO: 4410 - protein, 158 aa, Unknown
  Obtained from environmental sample
  misc_feature (1)..(158): Xaa is any amino acid
MSKVVAIPEAVGIPPSDAFVLKGCWIEVQYPPRGKLFVGYGSAGEQFHVRVHKHDEIVGRYTQYVYDGTGTSYLSDFIDKTLLKCGLKKYDYKKVWEHRVEYREDGPKYIKFDKKEHKKALIRKQKSFERQAEKYKQKYEWHSKIAKSIGEEIRALTI

SEQ ID NO: 4411 - DNA, 498 bp, Unknown
  Obtained from environmental sample
  misc_feature (1)..(498): n is a, c, g, or t
atgtgttcattagctattggagacattggttattctaatgacttctctggtattttacatcaaacctatggcgataagtatttagtttctcgcgcccataataagctaaatggacacgttaaattctcacaagatacctttccaaaggaaatagtctttgaaagagatcattttattggtgagctatatgagcaaatgaagaagggaatgattaaatttccttatggagactatgaaaagatagcttggttgattgatcattgctgtagtatggaaattaagccatctgtttctagaatgggaggagatcctcaaatccattatgttaagggtagtaccccaaacgacggatttatggctcttttgaatgcttatttagcttataagttcataattacccgaggttttaacaacaacaaccctattttacagcaagctagctttgctaataggaacaaaccattggttacgactgggttcgtgccacgtaagttttga

SEQ ID NO: 4412 - protein, 165 aa, Unknown
  Obtained from environmental sample
  misc_feature (1)..(165): Xaa is any amino acid
MCSLAIGDIGYSNDFSGILHQTYGDKYLVSRAHNKLNGHVKFSQDTFPKEIVFERDHFIGELYEQMKKGMIKFPYGDYEKIAWLIDHCCSMEIKPSVSRMGGDPQIHYVKGSTPNDGFMALLNAYLAYKFIITRGFNNNNPILQQASFANRNKPLVTTGFVPRKF

SEQ ID NO: 4413 - DNA, 960 bp, Unknown
  Obtained from environmental sample
  misc_feature (1)..(960): n is a, c, g, or t
gtgcttcaccgtgtaattttatcaatcggcaatccaaatcattcaatgaatcgcaaactgcaaactgtttactgtaaatttatccggctggcgaagttaaaacacctgttagcagcaatatactttttaacaaccttctgtactgctaaagcacaatcctattctgtttattacaaaactccggagggggatactttacttcagcaaaaactcgcattgcaaagaaatttttcatctcaaacagaagctgtgctttatattgtacaacttccttctttgttgcaaggtaaaggttacatcacggcctcagtcgacagtgttcagtacgattctttattggccacagccgtcgtttatttgggagaacaatacaaatgggcaaggatttcaaccggtgtgcaggatgctgctgttctgcaatctataagatggcctgacaaattggaaggagcgattgatttcaatacgattcagatctggcaaaaaaagattttggattatctggaggaaaatggccgtccctttggaaaggtttatcttgatagtattgatattgcgggaaatgaagtcaacgcagtgttgaagattgaaccggggcccctttataaaattgacagcatcagggtttatggcgatgccaaaatcagtaatgaatttctgcagcgttatttagaaatttccaatggaagtatttataacaagaaaaagcttgaaagagtttcaaaaagaatttcagagatcagttatgtgcaacaggagcatgctcccaccattgattatcttgggacaggctctgttttgaatctatacctcaaaccccgtaagaacagccaggccaacgccttaattggttttttacccaatagcgatgttgcatccggcaataaaaaattacggcttactgtcgatgccaatattttattgcgtaatgcgttaagcaatggcgaaactattggttga

SEQ ID NO: 4414 - protein, 319 aa, Unknown
  Obtained from environmental sample
  misc_feature (1)..(319): Xaa is any amino acid
MLHRVILSIGNPNHSMNRKLQTVYCKFIRLAKLKHLLAAIYFLTTFCTAKAQSYSVYYKTPEGDTLLQQKLALQRNFSSQTEAVLYIVQLPSLLQGKGYITASVDSVQYDSLLATAVVYLGEQYKWARISTGVQDAAVLQSIRWPDKLEGAIDFNTIQIWQKKILDYLEENGRPFGKVYLDSIDIAGNEVNAVLKIEPGPLYKIDSIRVYGDAKISNEFLQRYLEISNGSIYNKKKLERVSKRISEISYVQQEHAPTIDYLGTGSVLNLYLKPRKNSQANALIGFLPNSDVASGNKKLRLTVDANILLRNALSNGETIG

SEQ ID NO: 4415 - DNA, 588 bp, Unknown
  Obtained from environmental sample
  misc_feature (1)..(588): n is a, c, g, or t
atgaaacagatgcttgctgctattttttgcttttgcttttttataagccattcacaattcaaagcagacaatgtaaaatacaaaacagttttcccggaagatctctgcaaagccctgcaagctaacccgggttatgttttgcttgacgttcgcagcgatggtgagttttatgatacaacttccggctcaccggcattgaatatcgggcacatgcaaaatgctcagcacattaatatcacccagctagcacaacgctggaaagaattatcagaatataaagacaaacctctttttgtttattgttcgcacagccaaagaagccgcagagcatcaagactgttggcagacagcggcttcaccaaaatttttaacatcaatggaggtctcactaatttttatgatgaaggaatccaatctgatccctgttcgggttttaaatcgaatcatctgttccttataaattgtttcaccaaaatcgttgctcgatgcaaaacacaaaaggcgtattacatagttgatttgcgtagcgatttcatcttcaggggtattggtaacgaacgctcaaaaaacgaanggaaggttttgtga

SEQ ID NO: 4416 - protein, 195 aa, Unknown
  Obtained from environmental sample
  SIGNAL (1)...(18)
  DOMAIN (32)...(135): Rhodanese-like domain
  misc_feature (1)..(195): Xaa is any amino acid
MKQMLAAIFCFCFFISHSQFKADNVKYKTVFPEDLCKALQANPGYVLLDVRSDGEFYDTTSGSPALNIGHMQNAQHINITQLAQRWKELSEYKDKPLFVYCSHSQRSRRASRLLADSGFTKIFNINGGLTNFYDEGIQSDPCSGFKSNHLFLINCFTKIVARCKTQKAYYIVDLRSDFIFRGIGNERSKNEXKVL

SEQ ID NO: 4417 - DNA, 477 bp, Unknown
  Obtained from environmental sample
  misc_feature (1)..(477): n is a, c, g, or t
atgaataaagaaattctacaaataacatccttgctcaaagattctttttcaggggatccctggtatggaagatcagtaaagtctttactaaaagatgtaagtgaaattgatgtttttgaaagaccgaatggccagcatagtattttagaattggtatggcatatgattatttggcgggagtttactattaacagtttgcgtaatgacaataaaaaaacgaccggctattttgaagaaaacgattggagagttttagatcatgatgataatagcctgtggaaaaaaggcctgcaacgattagaggaaacgcaagctgaattgattgaaatgatggaacaaaaacaagataatattattaatgaaacagtgccgggcagaaaatataatttcaaaaaactgctttatggaattattcagcacgatatttaccacgtggggcaaatagcttatctcgtaaaactgtttcataatacttaa

SEQ ID NO: 4418 - protein, 158 aa, Unknown
  Obtained from environmental sample
  misc_feature (1)..(158): Xaa is any amino acid
MNKEILQITSLLKDSFSGDPWYGRSVKSLLKDVSEIDVFERPNGQHSILELVWHMIIWREFTINSLRNDNKKTTGYFEENDWRVLDHDDNSLWKKGLQRLEETQAELIEMMEQKQDNIINETVPGRKYNFKKLLYGIIQHDIYHVGQIAYLVKLFHNT

SEQ ID NO: 4419 - DNA, 408 bp, Unknown
  Obtained from environmental sample
  misc_feature (1)..(408): n is a, c, g, or t
ttggcaatcctaataaaaacttctttccaggatgcaaagttcaaagaatgtaaaatgttaggccttcattttgaaaactgcaacaaatttggtctctcgttcatttttgaaaattgcctgttagatcattcttctttttataaaacaaaaattaaaaagactgtttttaaaaacacgcaattaaaggaaacggattttactgaatgtgacttagccaactctgtttttgatcgttgtgatttaaccggcgctaaatttgaaaatacaatattggaaaaagtagatctccgttcttcctttaactattctattgacccggagataaataaaataaaaaaagcgaggtttgctttagcagggttacaggggttgttacataaatatgatatcatcatagagcacatataa

SEQ ID NO: 4420 - protein, 135 aa, Unknown
  Obtained from environmental sample
  DOMAIN (59)...(98): Pentapeptide repeats (8 copies)
  misc_feature (1)..(135): Xaa is any amino acid
MAILIKTSFQDAKFKECKMLGLHFENCNKFGLSFIFENCLLDHSSFYKTKIKKTVFKNTQLKETDFTECDLANSVFDRCDLTGAKFENTILEKVDLRSSFNYSIDPEINKIKKARFALAGLQGLLHKYDIIIEHI

SEQ ID NO: 4421 - DNA, 357 bp, Unknown
  Obtained from environmental sample
  misc_feature (1)..(357): n is a, c, g, or t
atgggccagataatttgtcagaaggaaaaacctttcaaagataatcctaaattagtggcgttagaatttagaatcgatactttcgatcaaatttcaattactacaatttccggtaaatggaattttgattctggaatcgagcagacaagtcagacaggaatgctatttgctttggagaaagataaagagttcggattagcagttatcggacaatcatatttaccagcccaagtgtatgtttccgcacagaatctacaaaaacctggtttattccaaggcgaactcaagcgcatggattcggaactcaatcctgacactcaaagtatttcctgctcttataaagtttataacaattaa

SEQ ID NO: 4422 - protein, 118 aa, Unknown
  Obtained from environmental sample
  misc_feature (1)..(118): Xaa is any amino acid
MGQIICQKEKPFKDNPKLVALEFRIDTFDQISITTISGKWNFDSGIEQTSQTGMLFALEKDKEFGLAVIGQSYLPAQVYVSAQNLQKPGLFQGELKRMDSELNPDTQSISCSYKVYNN

SEQ ID NO: 4423 - DNA, 480 bp, Unknown
  Obtained from environmental sample
  misc_feature (1)..(480): n is a, c, g, or t
ttgaatatgttctcaaatttaaaggtttcattttttgcatttaatattttatttttttcccaaagttgggcgttttctgaaaattatgttgttgatcgaaatttacttaaaaaaggaaattattggacttggttttatccggaaattgaaggggagcgacccagaacctatactataaaagttgagaatgagtcaggtgagcggataacgcttgcaaaatatgaggacggaactccttatttaaaaattgaagtaaattatgatgagttgttaaaatattacgaacccggaggccttgatagaatcgtagttcgtgaactctggatgtgggacttgtctcaatggaaaagttatggacagaataaaaaagaattcaatggagtcttaactcaatttgataaatatctcaattttgacgactttttaattaagataataaaaagtaaatcttcctattttcggggagttattcttacataa

SEQ ID NO: 4424 - protein, 159 aa, Unknown
  Obtained from environmental sample
  misc_feature (1)..(159): Xaa is any amino acid
MNMFSNLKVSFFAFNILFFSQSWAFSENYVVDRNLLKKGNYWTWFYPEIEGERPRTYTIKVENESGERITLAKYEDGTPYLKIEVNYDELLKYYEPGGLDRIVVRELWMWDLSQWKSYGQNKKEFNGVLTQFDKYLNFDDFLIKIIKSKSSYFRGVILT

SEQ ID NO: 4425 - DNA, 1122 bp, Unknown
  Obtained from environmental sample
  misc_feature (1)..(1122): n is a, c, g, or t
atggtgcggatctggaagagatctggaagagatctggaaatagatacattaactgcgttacagcatagccaacaaaagattatgaaaaaccaaccaagccaacagaaaaaaataaagtcaacatttctcatgagcatcctgatctcatcagcacttttcttttatttacccggagcggcatcaggcatagctaattccaaagtgctttctcatgcttttggccaagaagcaaatactagtaaagatacgggttcaatgaatgttacaaacgataacgccatgatgatgacgatgatgaatgataccaagagtcaaaaccttgaaaagacaaatgtgccagtaacacttcctctaatcaaaggatatgtaaatggaaatgaggtcttttatataacgacagaagtatctgatgaaagagtagcggctcatttaacaaatctgactgattctaaagttgtatacacagctgcattaaagttcacacccgaaaatgcattggcaaaaatctatgaattcaaaaacggtattaatggatccggtcctcaaggatttcaacccaatgtagcagattcccaaccaggtgaccctgcgtatagtccgctatggagaattcagcttgtagaatggaaacctaatgctagcgctacagaactcaaatcagaatcagaaataattaaagctncagaagatgggctattgacaataaacttcacagacataatcgttaactgtccatttgtaaaatggaatggtggtgaactacatgtaagagaggataaaacgctcaatgatacaactgcttatggtggntggccaagtataaatattgcactgaaaaatacaaagtaccttctaggtcaacttagtttgctcccatgnngatgcatctactatatagcactgatgctcaaaatggatgtaccacagacttggggtagttttgggaataaacagaaacaacttactcttgtcaccccgacttttcgattcaaaggcaaacgaactggacttgggattcagcccattgctcagaaatggaacaacaacagcctggggaaccaacgctccgaagccttgaagaaattaaaaataaaaaaaccgcccaagaaaaaaaaaatatag

SEQ ID NO: 4426 - protein, 373 aa, Unknown
  Obtained from environmental sample
  misc_feature (1)..(373): Xaa is any amino acid
MVRIWKRSGRDLEIDTLTALQHSQQKIMKNQPSQQKKIKSTFLMSILISSALFFYLPGAASGIANSKVLSHAFGQEANTSKDTGSMNVTNDNAMMMTMMNDTKSQNLEKTNVPVTLPLIKGYVNGNEVFYITTEVSDERVAAHLTNLTDSKVVYTAALKFTPENALAKIYEFKNGINGSGPQGFQPNVADSQPGDPAYSPLWRIQLVEWKPNASATELKSESEIIKAXEDGLLTINFTDIIVNCPFVKWNGGELHVREDKTLNDTTAYGGWPSINIALKNTKYLLGQLSLLPXXCIYYIALMLKMDVPQTWGSFGNKQKQLTLVTPTFRFKGKRTGLGIQPIAQKWNNNSLGNQRSEALKKLKIKKPPKKKKI

SEQ ID NO: 4427 - DNA, 858 bp, Unknown
  Obtained from environmental sample
  misc_feature (1)..(858): n is a, c, g, or t
atggatcagatgatctggcatgttggactacttgacttgacaaaaagagccacgataaaactaaaagaaattcgagatgcaaaggaagaagccgagcgcgaatccgatctagaacgaataagagctaagacagctaccgaggagttaagagagcgggaatctgaaaatctttttctacgatccgtaaaatctcaagatttggatgaggtggtgagctttctgcatcatattggaatatccgctggaattattgataattatttaactggaatacacagtaagctaactcgcggtcagaacataccaaccgacaagcttctggaaatcattaatctcgttgtatttgagaataaaaaagttcaaagtattagccggtttgcgacaaaggcaaactttaagctatacactgatgccattgatctcaatattgtggaatatctaaaggaatatgttggcaatattgtgaaagtggccaacggcgaaatcgatatcaggttcataaataagattggatcggagggctttgcgggtaagttccgtcccatcgagttgaatattttggtagataaccttttaagcaactcaaagaaggcgggggccacaaagtttgatattcaattagaaaaaattgagggagaccaactcctaatatcctttatagacaatggcaggggtattcgagaagagaaactaagagacctatacacattaggttatacaactaataaagaaggaacagggatcggattgtttcacgtacacgaaatattgaagcgtattggcggaacgattaatgttatgagccaagttgacaaaggcactactttccaaatcatattgccccatgcgaaaacttaa

SEQ ID NO: 4428 - protein, 285 aa, Unknown
  Obtained from environmental sample
  DOMAIN (179)...(283): Histidine kinase-, DNA gyrase B-, and HSP90-like ATPase
  misc_feature (1)..(285): Xaa is any amino acid
MDQMIWHVGLLDLTKRATIKLKEIRDAKEEAERESDLERIRAKTATEELRERESENLFLRSVKSQDLDEVVSFLHHIGISAGIIDNYLTGIHSKLTRGQNIPTDKLLEIINLVVFENKKVQSISRFATKANFKLYTDAIDLNIVEYLKEYVGNIVKVANGEIDIRFINKIGSEGFAGKFRPIELNILVDNLLSNSKKAGATKFDIQLEKIEGDQLLISFIDNGRGIREEKLRDLYTLGYTTNKEGTGIGLFHVHEILKRIGGTINVMSQVDKGTTFQIILPHAKT

SEQ ID NO: 4429 - DNA, 525 bp, Unknown
  Obtained from environmental sample
  misc_feature (1)..(525): n is a, c, g, or t
atggtaaataaagagaaaatcaaacatgttgcaagaaaagctcatcactactcacgtggtccgctttggtttttggtaggattttctatagctggactcacaatagcatcagtatgcataattctattccaaaatatttacaaggaggcaacaattcccggtgtttatatagattctctaaatgtaagtggtcaaacagaaaaacaaatagaacaaacctataacaataaaaactcacagatagaaaatactactttcactttctcttatagtgatttggtggcaaccgcttctgctaagcagcttggtattgngtacgattcagatctcattgctcagcaagcagtangacttggtaaatctttcaatctanttactaacatcgtaatagtaattaactcttatanttcagggacaacacttcactcttcattcactttcgatactgaaaaaatttgcacaatttataagaacctttacagnaaaagagcatataaagaaacccgntgnatgccacatttgtag

SEQ ID NO: 4430 - protein, 174 aa, Unknown
  Obtained from environmental sample
  misc_feature (1)..(174): Xaa is any amino acid
MVNKEKIKHVARKAHHYSRGPLWFLVGFSIAGLTIASVCIILFQNIYKEATIPGVYIDSLNVSGQTEKQIEQTYNNKNSQIENTTFTFSYSDLVATASAKQLGIXYDSDLIAQQAVXLGKSFNLXTNIVIVINSYXSGTTLHSSFTFDTEKICTIYKNLYXKRAYKETRXMPHL

SEQ ID NO: 4431 - DNA, 552 bp, Unknown
  Obtained from environmental sample
  misc_feature (1)..(552): n is a, c, g, or t
atgaatggatgcagcattctggaaaaggctgtaaaagagtttaaaaataaattgactgatgatgttattgaaagagctgtaaaaaaattgcntggagaagtgtatgatataaatggagcgatgcttgaatcacgacttaaaagccggcgtaatactttattggaaggtgttatgaaatattaccggtttattgctggcaccgttgatatttccggaacagaagaggaggagctttttgaaataaaaaataatggcgagctattaagtataagtgtataccgtttaaaagaaaataacgaaaaagataagaaaatatatgagcggtcttttgatccggaggatacacggcgcattaatttgacaggccttggaggaaatgatcaatttcttgttgaaaaaaatatttcatcagaaattaaattaaagatcagtggtggggaggggaaagatgtttacgaactaaatggaaaaataaaaaccgttgtttatgattctttatcggataaaaatgaaattatcaataagtcaaaagcaaaaattattcttaattga

SEQ ID NO: 4432 - protein, 183 aa, Unknown
  Obtained from environmental sample
  misc_feature (1)..(183): Xaa is any amino acid
MNGCSILEKAVKEFKNKLTDDVIERAVKKLXGEVYDINGAMLESRLKSRRNTLLEGVMKYYRFIAGTVDISGTEEEELFEIKNNGELLSISVYRLKENNEKDKKIYERSFDPEDTRRINLTGLGGNDQFLVEKNISSEIKLKISGGEGKDVYELNGKIKTVVYDSLSDKNEIINKSKAKIILN

SEQ ID NO: 4433 - DNA, 324 bp, Unknown
  Obtained from environmental sample
  misc_feature (1)..(324): n is a, c, g, or t
ttgtttaatgctgccatatttctcttgagcaactataacttcaaaatctccttttctaaggtttcgctttttcttctttggcttcggcgtctttacaggaaattcttgatccgactgctgcaagatttcgcgacgattttgataaaagttttgaaaggagtggttcagtatcgattgtctgatctcccgcatgagttgatgataaaaatacaaattgtgtacaccaatgagatgccatcccaaagtttcttcagttttgatcaaatgatgaagatagcctttagaataagtaagacatgtggtgcaattacattgagaatctaa

SEQ ID NO: 4434 - protein, 107 aa, Unknown
  Obtained from environmental sample
  misc_feature (1)..(107): Xaa is any amino acid
MFNAAIFLLSNYNFKISFSKVSLFLLWLRRLYRKFLIRLLQDFATILIKVLKGVVQYRLSDLPHELMIKIQIVYTNEMPSQSFFSFDQMMKIAFRISKTCGAITLRI

SEQ ID NO: 4435 - DNA, 384 bp, Unknown; identical to SEQ ID NO: 3287
  Obtained from environmental sample
  misc_feature (1)..(384): n is a, c, g, or t

SEQ ID NO: 4436 - protein, 127 aa, Unknown; identical to SEQ ID NO: 3288
  Obtained from environmental sample
  misc_feature (1)..(127): Xaa is any amino acid

SEQ ID NO: 4437 - DNA, 384 bp, Unknown
  Obtained from environmental sample
  misc_feature (1)..(384): n is a, c, g, or t
atgttaatttttttttgtagttttgttctgcaaatgaaaagcaaacccttcattaaacattacatcaggcgaaaactagtgactgcagtatttattactgcttcgttagtaacgtttgctgctttgggtgatgggaaaaaagataatactaaaaaaactcagaaaaatcttctttctgctaaaacaaacccttacaatttcaagaacttctctttaagatcccgttataattaccgaggtagtaccattctcaaccagtccgaacaaaacaaatacattacgttaaacaccgtggctacctatcaaaaaggcaacattacttacatattgcccttaaagaaaaaagttttattagataaaattaagttcaaccccntgtcataa

SEQ ID NO: 4438 - protein, 127 aa, Unknown
  Obtained from environmental sample
  misc_feature (1)..(127): Xaa is any amino acid
MLIFFCSFVLQMKSKPFIKHYIRRKLVTAVFITASLVTFAALGDGKKDNTKKTQKNLLSAKTNPYNFKNFSLRSRYNYRGSTILNQSEQNKYITLNTVATYQKGNITYILPLKKKVLLDKIKFNPXS

SEQ ID NO: 4439 - DNA, 660 bp, Unknown
  Obtained from environmental sample
  misc_feature (1)..(660): n is a, c, g, or t
ttgagatttagaataaaatctgtgaaactcaaggagttattgaatgagaatcattcttttggaaaacatatttattatggtagtctntggggggtgggaacaggttatcttttgccgattttaattggagttttcaatttaaataattcagcagttggaaactatagccttgcgttaaattttataatacctctaacttttttaccaagtattcttggtacctcttattataaatcctttataaaagctgaggcaatcccatttaagactattagatttacaatcattatttctattattttattacttctcgttttatttggaattgatatacttataaaaatatttttagatcaaagatttagtgaagttggtgtattagtgaaaatcggctctatttctgctatatttcatggatttggagattttattaataaatttctaagtgcaaaaggtcaaggttcttatataaaaaaagttgcaatttatgtaggtgttattcaattagtggcttcactttttttgattcatttattttcatcaactggtgctatgatagcaaaaagtattggttcattagtatattttattgccctatttattttttattataataattatcaaatcagaaaattcaaagtctttttcaaattgtcataa

SEQ ID NO: 4440 - protein, 219 aa, Unknown
  Obtained from environmental sample
  misc_feature (1)..(219): Xaa is any amino acid
MRFRIKSVKLKELLNENHSFGKHIYYGSLWGVGTGYLLPILIGVFNLNNSAVGNYSLALNFIIPLTFLPSILGTSYYKSFIKAEAIPFKTIRFTIIISIILLLLVLFGIDILIKIFLDQRFSEVGVLVKIGSISAIFHGFGDFINKFLSAKGQGSYIKKVAIYVGVIQLVASLFLIHLFSSTGAMIAKSIGSLVYFIALFIFYYNNYQIRKFKVFFKLS

SEQ ID NO: 4441 - DNA, 303 bp, Unknown
  Obtained from environmental sample
  misc_feature (1)..(303): n is a, c, g, or t
gtgaaaatcggctctatttctgctatatttcatggatttggagattttattaataaatttctaagtgcaaaaggtccaggttcttatataaaaaaagttgcaatttatgtaggtgttattcaattactggcttcactttttttgattcatttattttcatccactggtgctatgatagcaaaaagtattggttcattagtatattttattgccctatttatttattattataataattatcatatcacagaattcgaagtctttttcaaattgtcttacaaattaagtaggacgacaaattag

SEQ ID NO: 4442 - protein, 100 aa, Unknown
  Obtained from environmental sample
  misc_feature (1)..(100): Xaa is any amino acid
MKIGSISAIFHGFGDFINKFLSAKGPGSYIKKVAIYVGVIQLLASLFLIHLFSSTGAMIAKSIGSLVYFIALFIYYYNNYHITEFEVFFKLSYKLSRTTN

SEQ ID NO: 4443 - DNA, 441 bp, Unknown
  Obtained from environmental sample
  misc_feature (1)..(441): n is a, c, g, or t
atgttcggtctttttcctaatancagttgncaggtaatttatatatggaaagatgctgcaaacaataaaacgatctcttacataatgatcgggggagaattgcgcagcaaaagctctgaagcatttgaaaaagctattgaaatgaacaaatggcgttcaaagcagggtgtttatttaggaatgagcttaagggaattagaaagatttaatagtggccctattaaattttatggttgggaaactgatcaacctggaattgtgtacccaaaaaacaagggcaacataaactttaaaaaactaggcgttcaattaaattgccttgattgcaatgaggacagttattatagtaatagcagtttaattaattctacagacgttatacaacaaaatggcagggtatatgtatccaccttgcttttaatgcccaatgacgaagagtaa

SEQ ID NO: 4444 - protein, 146 aa, Unknown
  Obtained from environmental sample
  misc_feature (1)..(146): Xaa is any amino acid
MFGLFPNXSXQVIYIWKDAANNKTISYIMIGGELRSKSSEAFEKAIEMNKWRSKQGVYLGMSLRELERFNSGPIKFYGWETDQPGIVYPKNKGNINFKKLGVQLNCLDCNEDSYYSNSSLINSTDVIQQNGRVYVSTLLLMPNDEE

SEQ ID NO: 4445 - DNA, 492 bp, Unknown
  Obtained from environmental sample
  misc_feature (1)..(492): n is a, c, g, or t
atgactttttttatgaaaaggctaatactcgtactatttctcatccctattttgactgtatccgcacagaaatcagaattctccatcaaggatttggtattctttacaaacattcccacgaacaaatttaatgcgtatatatccagaaaagggtataagctgtatcctgatgatacagttgaacgaattttttcgactgcttatcgtaaaatatcaaaggataaagcaatagaaaaattagttggcaggtatgataaaaacgacactgccgcaattttttatcaaaccaattcaaaatgngagtttgatgaattaagattggatttacaggaagatggatttgaacatgaaccgatagatagcggtagtaataaactcccggcattttttcaaaaaggaaatgtgactattatacccgtgataaataaagagggtgaaacaaatatttatggttttacaatagaaagaaagcaggtgccaaaaagcaaatga

SEQ ID NO: 4446 - protein, 163 aa, Unknown
  Obtained from environmental sample
  misc_feature (1)..(163): Xaa is any amino acid
MTFFMKRLILVLFLIPILTVSAQKSEFSIKDLVFFTNIPTNKFNAYISRKGYKLYPDDTVERIFSTAYRKISKDKAIEKLVGRYDKNDTAAIFYQTNSKXEFDELRLDLQEDGFEHEPIDSGSNKLPAFFQKGNVTIIPVINKEGETNIYGFTIERKQVPKSK

SEQ ID NO: 4447 - DNA, 786 bp, Unknown
  Obtained from environmental sample
  misc_feature (1)..(786): n is a, c, g, or t
atgagggcgggaaacaagttgtttacagatgcaaactttaaagtgaaagataaagagtttgtagtacttgttggtccatccggctgcggaaagaccactacactaagaatgattgcaggacttgaagaaattacaagcggagaaatatttattgatggaaaactagtaaataatcttcctccaaaagatcgtgatattgcaatggtttttcaaaactacgctctttatccgcatatgactgtttatgaaaatatggccttcggattaaagctaaagaaagttgataagaaagaaattgaaacccgtgtaaaagaagcagcaagaattcttggactagaaacttatcttgatcgaaagccaaaagcgctttcaggcggacaacgacagcgagttgcagttggcagagccatagtgcgaaagccaaaagtattcttatttgatgagccattaagtaatcttgatgcaaagctacgtgtacagatgagaacagaaatatcaaagcttcataagcagcttggagcaacaatgatttatgtaactcacgatcaaacagaagctatgacaatgggagatagaattgtgattatgaaagacggaataattaatcaggtagatacacctttaaacttatataataaacctgttaatcagtttgtagcaggatttatcggaagtccggcaatgaatttcttaaatggaaagatcttagataaaactgatttaatttttgaaagtagcaattcagaaattacattcaacttttcatcagaacaaaagaacggttga

SEQ ID NO: 4448 - protein, 261 aa, Unknown
  Obtained from environmental sample
  DOMAIN (18)...(199): ABC transporter
  misc_feature (1)..(261): Xaa is any amino acid
MRAGNKLFTDANFKVKDKEFVVLVGPSGCGKTTTLRMIAGLEEITSGEIFIDGKLVNNLPPKDRDIAMVFQNYALYPHMTVYENMAFGLKLKKVDKKEIETRVKEAARILGLETYLDRKPKALSGGQRQRVAVGRAIVRKPKVFLFDEPLSNLDAKLRVQMRTEISKLHKQLGATMIYVTHDQTEAMTMGDRIVIMKDGIINQVDTPLNLYNKPVNQFVAGFIGSPAMNFLNGKILDKTDLIFESSNSEITFNFSSEQKNG

SEQ ID NO: 4449 - DNA, 348 bp, Unknown
  Obtained from environmental sample
  misc_feature (1)..(348): n is a, c, g, or t
ttgacacatggatatgcaaggaaaacaaaacatgattcgcaatatattgcaatagaattatgcaacatcattattttgtgtttacaagatgtttttcatttttttattctttttgaaaaactctcatcaaaccatacaaatgaattattatgttttaatgttgcaaagaaagaaaaatcaataattgaaaatgaatgttggaaatatattgcacgttcttcatatagtgttgaatataataacaaaaataataaatataatatatatcgtattggaggaattggcaatgataataatgttcgttatgaaataaataataataaaataataaaattgccagatttataa

SEQ ID NO: 4450 - protein, 115 aa, Unknown
  Obtained from environmental sample
  misc_feature (1)..(115): Xaa is any amino acid
MTHGYARKTKHDSQYIAIELCNIIILCLQDVFHFFILFEKLSSNHTNELLCFNVAKKEKSIIENECWKYIARSSYSVEYNNKNNKYNIYRIGGIGNDNNVRYEINNNKIIKLPDL

SEQ ID NO: 4451 - DNA, 546 bp, Unknown
  Obtained from environmental sample
  misc_feature (1)..(546): n is a, c, g, or t
atggttaacaaggtaaagtatctacagcttgcaggggaactaaaatctaaaaatgtactgttagttgccgttagtaaaaccaaaacaatcgagagcataaaacaactatatgacttagggcaaagagattttggagagaattacgtgcaggagttggttgataaacaatcacaattaccaacagatatacgatggcattttattggtcatttacaaacgaacaaagcaaaatacattacgccatttattcattgcgtacatggagtagacagttttaagttattaaaagaaataaataagcaggcgttgaaaagccaacgggtaataaaactgcttttacaaatacatattgctgaagaagaaaccaaatttggtttggatgaaaacgaattgagtgaaattattaattcaaatgaattaccctggttaaagaatgtagaggttgtcggtttaatgggtatggcttcttttactgaaaataaagaacaagtaagaaaggaatttcactttttaaaaacccttttcgacaaatacgccaagttttga

SEQ ID NO: 4452 - protein, 181 aa, Unknown
  Obtained from environmental sample
  DOMAIN (8)...(181): Alanine racemase, N-terminal domain
  misc_feature (1)..(181): Xaa is any amino acid
MVNKVKYLQLAGELKSKNVLLVAVSKTKTIESIKQLYDLGQRDFGENYVQELVDKQSQLPTDIRWHFIGHLQTNKAKYITPFIHCVHGVDSFKLLKEINKQALKSQRVIKLLLQIHIAEEETKFGLDENELSEIINSNELPWLKNVEVVGLMGMASFTENKEQVRKEFHFLKTLFDKYAKF

SEQ ID NO: 4453 - DNA, 615 bp, Unknown; identical to SEQ ID NO: 3291
  Obtained from environmental sample
  misc_feature (1)..(615): n is a, c, g, or t

SEQ ID NO: 4454 - protein, 204 aa, Unknown; identical to SEQ ID NO: 3292
  Obtained from environmental sample
  DOMAIN (1)...(198): Transaldolase
  misc_feature (1)..(204): Xaa is any amino acid

SEQ ID NO: 4455 - DNA, 744 bp, Unknown
  Obtained from environmental sample
  misc_feature (1)..(744): n is a, c, g, or t
ttgcgccaggggggaacgtgcaattcaaccattaataaatgtcttacagaacccatcaagcgattatgcaaaatatggtcagtctacagcttacacttaataggtattaacagaactatagctggaagattctatgaaaaatttgtaaaccccaaagcaagaatggctctattgcagtttttgaaagacacatcattgcaagaagatattatgaggctgctgataagagacccgtggcaatcagacatttctactattattgaaactatgaaagtttgtaaatcggattgctggtctttagtaaatggcttgattaggtataaaatcaataacctgccacttcatcaaacaattcctgataacataaaggatatttcagtaaacctaaaatataccaatccgtcagtacttgaagcaaattttgactttgacggacagataaaagaggctcttgactcctttaggcatttaagaaataagaaaattgcgattgaagacacattatttaaaagtaaggtgataggtgatttcagcagtaaatatgaaagccccgtaacggttcaagagtttttcagtttgttagactttgacaattacacaagtttaggaagcagagtacaatactatgttaccgaggacaaattgtttatctgctcacctganactgcaaggcgacgtttgattgaatggtggactaagttgacagatgaagaaaaagcaacttacaataaaaactaccgctaa

SEQ ID NO: 4456 - protein, 247 aa, Unknown
  Obtained from environmental sample
  misc_feature (1)..(247): Xaa is any amino acid
MRQGGTCNSTINKCLTEPIKRLCKIWSVYSLHLIGINRTIAGRFYEKFVNPKARMALLQFLKDTSLQEDIMRLLIRDPWQSDISTIIETMKVCKSDCWSLVNGLIRYKINNLPLHQTIPDNIKDISVNLKYTNPSVLEANFDFDGQIKEALDSFRHLRNKKIAIEDTLFKSKVIGDFSSKYESPVTVQEFFSLLDFDNYTSLGSRVQYYVTEDKLFICSPXTARRRLIEWWTKLTDEEKATYNKNYR

SEQ ID NO: 4457 - DNA, 711 bp, Unknown
  Obtained from environmental sample
  misc_feature (1)..(711): n is a, c, g, or t
atggtatacgcttacgccgcactgaagtcaggaattcccttcgctaacggcgctccaaacctgacggtagatatacctgcgttgatggctctggcagacaaaaacaaacttgcaatctgcggcaaggatttcaaaactggtcaaacgctgatgaagacaatcatcgcaccgggactgaaatcaagaatgctcggtcttcacggctggtactctacaaacattctcggcaaccgcgacggcgaggtgctggacgatcccgattcattcaaaaccaaggaagaatcaaaactatcggtgctcgagtacatcctgcagccggaagtctatccaaaactttataaagacttctctcacgtggttcgaatcaattactatccgccaagaggtgacaacaaagaaggctgggacaacatcgatatcttcggttggcttggctatcccatgcagatcaaaatcgatttcctctgccgcgattcgattcttgctgctccgattgttttggacctcgcactatttctggatctcgcacaaagagccggcatgaaaggtgtccaggagtggttatctttctacttcaagtcgccgcaaactgcacctggcctgtatccagagcacgatcttttcatccagttgatgaaacttaagaataccttgcgtcacttgtgcggcgaggatcttattactcacctcggattggaatattacgattag

SEQ ID NO: 4458 - protein, 236 aa, Unknown
  Obtained from environmental sample
  DOMAIN (1)...(220): Myo-inositol-1-phosphate synthase
  misc_feature (1)..(236): Xaa is any amino acid
MVYAYAALKSGIPFANGAPNLTVDIPALMALADKNKLAICGKDFKTGQTLMKTIIAPGLKSRMLGLHGWYSTNILGNRDGEVLDDPDSFKTKEESKLSVLEYILQPEVYPKLYKDFSHVVRINYYPPRGDNKEGWDNIDIFGWLGYPMQIKIDFLCRDSILAAPIVLDLALFLDLAQRAGMKGVQEWLSFYFKSPQTAPGLYPEHDLFIQLMKLKNTLRHLCGEDLITHLGLEYYD

SEQ ID NO: 4459 - DNA, 744 bp, Unknown
  Obtained from environmental sample
  misc_feature (1)..(744): n is a, c, g, or t
atgcgtgagaaccataaagccatcgcaccatcaatggtatacgcttacgcgncactgaagtcaggaattcccttcgctaacggcgctccaaacctgacggtagatatacctgcgttgatggctctggcagacaaaaacaaacttgcaatctgcggcaaggatttcaaaactggtcaaacgctgatgaagacaatcatcgcaccgggactgaaatcaagaatgctcggtcttcacggctggtactctacaaacattctcggcaaccgcgacggcgaggtgctggacgatcccgattcattcaaaaccaaggaagaatcaaaactatcggtgctcgagtacatcctgcagccggaagtctatccaaaactttataaagacttctctcacgtggttcgaatcaattactatccgccaagaggtgacaacaaagaaggctgggacaacatcgatatcttcggttggcttggctatcccatgcagatcaaaatcgatttcctctgccgcgattcgattcttgctgctccgattgttttggacctcgcactatttctggatctcgcacaaagagccggcatgaaaggtgtccaggagtggttatctttctacttcaagtcgccgcaaactgcacctggcctgtatccagagcacgatcttttcatccagttgatgaaacttaagaataccttgcgtcacttgtgcggcgaggatcttattactcacctcggattggaatattacgattag

SEQ ID NO: 4460 - protein, 247 aa, Unknown
  Obtained from environmental sample
  DOMAIN (1)...(231): Myo-inositol-1-phosphate synthase
  misc_feature (1)..(247): Xaa is any amino acid
MRENHKAIAPSMVYAYAXLKSGIPFANGAPNLTVDIPALMALADKNKLAICGKDFKTGQTLMKTIIAPGLKSRMLGLHGWYSTNILGNRDGEVLDDPDSFKTKEESKLSVLEYILQPEVYPKLYKDFSHVVRINYYPPRGDNKEGWDNIDIFGWLGYPMQIKIDFLCRDSILAAPIVLDLALFLDLAQRAGMKGVQEWLSFYFKSPQTAPGLYPEHDLFIQLMKLKNTLRHLCGEDLITHLGLEYYD

SEQ ID NO: 4461 - DNA, 450 bp, Unknown
  Obtained from environmental sample
  misc_feature (1)..(450): n is a, c, g, or t
ttgaacaagattgatgcgccttcgataagtgtacttagcgttatcggaaatttctcgttgcggtcaaaatggatggaaggagtaaaatcaactggcaaggtaagtcacccgattaaccacgtaggcgtaaagcatagtacggtttttaacaaccgagtaatggtcttttattccagttcattcagccaaaacaatgatttctatttttacagtgaaactgatgaaaagaaaacgatggcaatttattttactttgaaatcgttagaagacaataaaactctggtcatcattgattactacataaaaaaagatccgtttctacaattcttctttccattggttacgaaaaataaattatcaaggcaacttgccaaatcactggataaccttgaggaactatgccggacgcctggcatagcatacccaaaaactcttcaaaaaaccgggtaa

SEQ ID NO: 4462 - protein, 149 aa, Unknown
  Obtained from environmental sample
  misc_feature (1)..(149): Xaa is any amino acid
MNKIDAPSISVLSVIGNFSLRSKWMEGVKSTGKVSHPINHVGVKHSTVFNNRVMVFYSSSFSQNNDFYFYSETDEKKTMAIYFTLKSLEDNKTLVIIDYYIKKDPFLQFFFPLVTKNKLSRQLAKSLDNLEELCRTPGIAYPKTLQKTG

SEQ ID NO: 4463 - DNA, 393 bp, Unknown
  Obtained from environmental sample
  misc_feature (1)..(393): n is a, c, g, or t
gtggaggtaagaattaagcccaccaataatatcaaagtgtttattgacgcggatgaagggataaatttagcagtgctgatcgattataaccggaagctttataagctcattgaagaaagtgctctttatcctgatggtgatttttcgctggaagtttcctcaccgggtttagatgaaccattaaaaatgtaccgccaataccaaaagaatattgggcgttttgtagatgtgcttttgaatgatgcgagcaaaaaggaagggaagcttatagaagccactgaagatgggatcattattgaatatgaaacgggtaaagggaaaaaaaaggaaataaaacaggaaacaattttgtttaccgatataaaacacacaaaaattcaagtaaaattttaa

SEQ ID NO: 4464 - protein, 130 aa, Unknown
  Obtained from environmental sample
  DOMAIN (2)...(126): Uncharacterised BCR, YhbC family COG0779
  misc_feature (1)..(130): Xaa is any amino acid
MEVRIKPTNNIKVFIDADEGINLAVLIDYNRKLYKLIEESALYPDGDFSLEVSSPGLDEPLKMYRQYQKNIGRFVDVLLNDASKKEGKLIEATEDGIIIEYETGKGKKKEIKQETILFTDIKHTKIQVKF

SEQ ID NO: 4465 - DNA, 510 bp, Unknown
  Obtained from environmental sample
  misc_feature (1)..(510): n is a, c, g, or t
atggcaagtattaatctaatagaggccttccaggagtttaaggatgcagagaatatcgaccgtcctactttgatgcgggtggttgaagatgtatttaaaaccctgcttcgtaaaaaatatggcagtgatgaaaattttgatgtaattgtgaatgcagaaaaaggcgaccttgaaattttcaggcgtcgcactattgtagaagatggtgatatttacaatacactcgaagaaattgaatacaaagacgcggtgaagattgagcctgattactcaggtagtgaggagttatacgaagaagttaacctctatgattttgggtcgccgggctatactttgccgcccaaacaaaccctgggccagcccgtattttctgaatttgaagaaaaaatgtattgggccaaaaaaaataaccacggaacagggattgtgccaaaaatccttcaatggccaaaaagtattacccagggttatggaaaaaaaaaaaaaattttttgtttttcttggaattaa

SEQ ID NO: 4466 - protein, 169 aa, Unknown
  Obtained from environmental sample
  misc_feature (1)..(169): Xaa is any amino acid
MASINLIEAFQEFKDAENIDRPTLMRVVEDVFKTLLRKKYGSDENFDVIVNAEKGDLEIFRRRTIVEDGDIYNTLEEIEYKDAVKIEPDYSGSEELYEEVNLYDFGSPGYTLPPKQTLGQPVFSEFEEKMYWAKKNNHGTGIVPKILQWPKSITQGYGKKKKIFCFSWN

SEQ ID NO: 4467 - DNA, 360 bp, Unknown
  Obtained from environmental sample
  misc_feature (1)..(360): n is a, c, g, or t
atgagaaagggtgaatattttgtcgtagccagaaatgatgattcgattaaatatcggggattcagaattaccttattggatattgattcatacatcaccggcattccttatgttcaagattcgatgacgattgccatgaaagacggcaatgcagaaaatcagactttaggatttattattctgaaggaacaaaagacagcgaaagaactaaaaaaagatctggcgcatatccttttggactaccaggttccggaaaagattttctttgtggagaattttccaaccaacatntcaggaaaagtctgtcgtaaaacattaaaagcaaattatattgaatcactagataaggtaaaagcatga

SEQ ID NO: 4468 - protein, 119 aa, Unknown
  Obtained from environmental sample
  misc_feature (1)..(119): Xaa is any amino acid
MRKGEYFVVARNDDSIKYRGFRITLLDIDSYITGIPYVQDSMTIAMKDGNAENQTLGFIILKEQKTAKELKKDLAHILLDYQVPEKIFFVENFPTNXSGKVCRKTLKANYIESLDKVKA

SEQ ID NO: 4469 - DNA, 540 bp, Unknown
  Obtained from environmental sample
  misc_feature (1)..(540): n is a, c, g, or t
atgcaaattagagaacttattcagcgccggctggactcaaaaatcaaagtgtttaaccgtgaagggattcagatcgctgactctcagttcaaacaagaataccagacgattcgccagtatcttttagacttccattctcaagaacaagactgcgtcgccattaaagaagataaagactatcgctactttttaacaatcctcgcctgtcaggaaattgggataccttatgttcccatgaaacacgactatccgatggaccgtgtgggacagattcaggaagactcaaaattcactttgctgattactgatgagaagatgcaagagatcctggcctatggcgggaagaagaacactacccttccgaaagttaacggtgagaagactgcttacattctttttacttccggcagtaccggtcgtcctaaaggtgtgatcattcaacgtaaagcgctggagaatttctaccagtggaccaatgattatttcaccaatgtcacatcttcagaccgcttgcttcaggtaacagaatttaccctttga

SEQ ID NO: 4470 - protein, 179 aa, Unknown
  Obtained from environmental sample
  misc_feature (1)..(179): Xaa is any amino acid
MQIRELIQRRLDSKIKVFNREGIQIADSQFKQEYQTIRQYLLDFHSQEQDCVAIKEDKDYRYFLTILACQEIGIPYVPMKHDYPMDRVGQIQEDSKFTLLITDEKMQEILAYGGKKNTTLPKVNGEKTAYILFTSGSTGRPKGVIIQRKALENFYQWTNDYFTNVTSSDRLLQVTEFTL

SEQ ID NO: 4471 - DNA, 702 bp, Unknown
  Obtained from environmental sample
  misc_feature (1)..(702): n is a, c, g, or t
ttgaagcaactggtaatcggctatgctaaaggcattcctgtgttaagcaatatttctgtttcactcaaaggagggactgtaacaggcctgatcgcaaataacggaacaggaaaatctaccttgctcaaaacgcttgcgggaagcttaaaccctttgagcggacagattgaactgaatggaaaaaatattttaaatttcagccataatgagctggcaaaaaaaatagcgattgttctcaccgagaaaccagctttagcaggatttaaagtgtgggatcttgtggcactcggaagatttccatacacgaacctcttcggtcatttaactcaaaccgatatctccattattgaacacagcattaattcctgtgggatcaatgaactcaaagaaaaaaactgtcatgaattaagtgatggtgaatttcaaaaagctatgatcgcacgagcattggcacagcaaacggacgttctgctattggacgaaccaacggcatttcttgattattcttccaagcgaaatttatttatgctattaaaagatatagcagaaaaagagaataaagtcattctggtgtcttctcacgatattgaaaccttgataaagtatagccacaatgctttaatactgaaaaagaattccgcttcaacctttcatgctattgaagaattaaaaaacagagacccggaagatctttttcaataa

SEQ ID NO: 4472 - protein, 233 aa, Unknown
  Obtained from environmental sample
  DOMAIN (25)...(212): ABC transporter
  misc_feature (1)..(233): Xaa is any amino acid
MKQLVIGYAKGIPVLSNISVSLKGGTVTGLIANNGTGKSTLLKTLAGSLNPLSGQIELNGKNILNFSHNELAKKIAIVLTEKPALAGFKVWDLVALGRFPYTNLFGHLTQTDISIIEHSINSCGINELKEKNCHELSDGEFQKAMIARALAQQTDVLLLDEPTAFLDYSSKRNLFMLLKDIAEKENKVILVSSHDIETLIKYSHNALILKKNSASTFHAIEELKNRDPEDLFQ

SEQ ID NO: 4473 - DNA, 564 bp, Unknown
  Obtained from environmental sample
  misc_feature (1)..(564): n is a, c, g, or t
atgaaaatcggcatagtaagacattttagggtgaatcagcccttacccaaagggtttttaataaactacgaaaaggtggttggctggtttgcggcgtatgacctggctgaaatcagctacaacgaaattgaactaaaagaaaactgggaggtatgttattcaagtccctcaagccgcgcgttaaaaactgcagagcgaatttataagggtaccattattcagcgtgaacaacttaaggaattggacgtgctacctttattaaataaaagttaccgcagaccgctgttattttgggcattattgatcaggaaacgctccatgacgcccaatgcaataaccaatgaatttataattaaattgaatgcttttgtggatgaattactggcatcgggtcaacaggatgtattggtagtgagccatggttttgtgatgatgttattgcaaaaggaattggtaaaaagaggatttacgggcgataaattcaaaacaccggtaaacggaaaattgtatatatttgagaaggagtcgaatagccgggaggatctaagtacagataaaaaatga

SEQ ID NO: 4474 - protein, 187 aa, Unknown
  Obtained from environmental sample
  misc_feature (1)..(187): Xaa is any amino acid
MKIGIVRHFRVNQPLPKGFLINYEKVVGWFAAYDLAEISYNEIELKENWEVCYSSPSSRALKTAERIYKGTIIQREQLKELDVLPLLNKSYRRPLLFWALLIRKRSMTPNAITNEFIIKLNAFVDELLASGQQDVLVVSHGFVMMLLQKELVKRGFTGDKFKTPVNGKLYIFEKESNSREDLSTDKK

SEQ ID NO: 4475 - DNA, 702 bp, Unknown
  Obtained from environmental sample
  misc_feature (1)..(702): n is a, c, g, or t
atgagcgggatcttccttaaagcgagatgggaaaaccttgtccttataacatatgcagttgagcccggattgcttgatgacctattgcctgatggtgtaacagcggatactattgaaggcaaagcatttgtaagccttgtagcttttgattttcttgatacaaaggtgaaaggaataaaattcccgctgcatacaaattttcccgagatcaacctgcggtactacgtgagatacaaagagaaaaggggagtaatgttcgtaagggagtttgttccgccctcattcattcccttttttgcaaacctgttctataacgaaaaatacaaaggtattaaaatgaaaagcagtatttcgaaaaacggaaagatactgctgaatcactcaataaagatcagggaacataactacgaaataagcctggaagcacagaataaaccttacatgccgcctgcggagtctatcgaacattatttcaaagaacacgagtggggattcggaacctcaagagcagggaagacattaatatacagagtagagcatccgttctggaatgtttacccggttgtgaagtttgaccataattttgattttggagctatttatggcgaaaaatggcgcactttgaatgaaaaaacaccgtataatgtgatttttgctgaaggctcaccggttacaatattcagctctgaaaaaattttgtaa

SEQ ID NO: 4476 - protein, 233 aa, Unknown
  Obtained from environmental sample
  misc_feature (1)..(233): Xaa is any amino acid
MSGIFLKARWENLVLITYAVEPGLLDDLLPDGVTADTIEGKAFVSLVAFDFLDTKVKGIKFPLHTNFPEINLRYYVRYKEKRGVMFVREFVPPSFIPFFANLFYNEKYKGIKMKSSISKNGKILLNHSIKIREHNYEISLEAQNKPYMPPAESIEHYFKEHEWGFGTSRAGKTLIYRVEHPFWNVYPVVKFDHNFDFGAIYGEKWRTLNEKTPYNVIFAEGSPVTIFSSEKIL

SEQ ID NO: 4477 - DNA, 834 bp, Unknown
  Obtained from environmental sample
  misc_feature (1)..(834): n is a, c, g, or t
ttgtccccngttgaaaaaactgacgtaaaaatcatatttatatcgcgccgcattgacaataatgcagattggaatctattggcaatgaacctcgatggttctgaacaatctaaactcactgagttgaccgtcagatgtgagcaagttgttgtctcccattccggccagagcgttttgttcgtccattattctgacgattatttttatgaattatattccatgaatgttgatggaaccaatttgcaactgattgacaaagcgaaaaggtactgtggctctcctgattggtcgatggacgattcaaaaattatttattccaaaagcagagatgagtcaaccgatgaaagagatttgattttgtttgatgttaaatcaaacgtcaggcagattgtggtcgacgtagatgataatttcttagggaggttctcaaaggataataaaattgctttttgccgcgggaattataacacaaatgatatttatctgatggatcaggacggttcaaacaaacagaagatcatagcgaatgcaggtgctcctgtctggtctcctgatggaaagaaaatcgcatatgtctcgaagggaatgacgaatactcctcaaatatttgtatcatctttcgacgggagtgaggtgaaacagttgacaaatacagcgctcgaggggtgggattcaggatatccggatttcgggaatcatagtccgcaatggacaccagacggaaaanaggtcgtttacgtatcggaagttaatgacggactgcccgaaatatatataatgaacagcgatgggttccggcacgacaagacttaccgacgcagcaagaagaaatga

SEQ ID NO: 4478 - protein, 277 aa, Unknown
  Obtained from environmental sample
  DOMAIN (165)...(204): WD40-like Beta Propeller Repeat
  misc_feature (1)..(277): Xaa is any amino acid
MSPVEKTDVKIIFISRRIDNNADWNLLAMNLDGSEQSKLTELTVRCEQVVVSHSGQSVLFVHYSDDYFYELYSMNVDGTNLQLIDKAKRYCGSPDWSMDDSKIIYSKSRDESTDERDLILFDVKSNVRQIVVDVDDNFLGRFSKDNKIAFCRGNYNTNDIYLMDQDGSNKQKIIANAGAPVWSPDGKKIAYVSKGMTNTPQIFVSSFDGSEVKQLTNTALEGWDSGYPDFGNHSPQWTPDGKXVVYVSEVNDGLPEIYIMNSDGFRHDKTYRRSKKK

SEQ ID NO: 4479 - DNA, 561 bp, Unknown
  Obtained from environmental sample
  misc_feature (1)..(561): n is a, c, g, or t
atgaagctgagagtagcacttgattcaggaccgctggtgggcggacatgcaataaggggtattggtgtagtagtcagagagtacatacaagcattagagggcaaaggttcaaaaaataaaacacaaatttctgttgatgcgtttgacttcagccaagatgccggtaaaaagaagctacttgttggtaattacgatattgtacattaccctatttttttcccttacaacctgtatttaccggaaaataagccggcaaataaagttattgtcactatacacgacttaatacaattaatttaccctaaaaattatcctcccggagtaaggngtaagctcaattttattaaacaaaagcgaaggcttgcttatgcagataaaatattaactgtatccgaaacatctaaaaaggatattgtcaggcttttaaatgtacctgcttcaaaaattgaagtagtttataacgcccccagtaaaatttacaaagaaataactngatacgagcgtctaagggaggtacggaagaatataatctacctcaagaattgtattttatttaggtga

SEQ ID NO: 4480 - protein, 186 aa, Unknown
  Obtained from environmental sample
  misc_feature (1)..(186): Xaa is any amino acid
MKLRVALDSGPLVGGHAIRGIGVVVREYIQALEGKGSKNKTQISVDAFDFSQDAGKKKLLVGNYDIVHYPIFFPYNLYLPENKPANKVIVTIHDLIQLIYPKNYPPGVRXKLNFIKQKRRLAYADKILTVSETSKKDIVRLLNVPASKIEVVYNAPSKIYKEITXYERLREVRKNIIYLKNCILFR

SEQ ID NO: 4481 - DNA, 423 bp, Unknown
  Obtained from environmental sample
  misc_feature (1)..(423): n is a, c, g, or t
atgagccatccggagcataaacattacgaatatttaattgaaaagttcgagcataaagaaaaaataatcaggttgggatttgtgccgaatgaagacatatccgaagtaatgaatttagcaagcgtgtatgtacaaccttcatactatgaaggtttcggattgtctgttgtccatgcatttgcctgcgggacacctgttgttgtatcaagaacaaacgccttaacagaaattgcagacggtgccgctttagtagccgatcccaagagtccggaagatatggctgaaaagataatggaaatattgaaaaacgaaaaaactaaaaaacaattaatcgacaaaggaagaaaacgggtaaaggatttcagttgggaaaaaacttcagaaaatttattaaaagtttatcaggaagtaataaatagttaa

SEQ ID NO: 4482 - protein, 140 aa, Unknown
  Obtained from environmental sample
  DOMAIN (1)...(117): Glycosyl transferases group 1
  misc_feature (1)..(140): Xaa is any amino acid
MSHPEHKHYEYLIEKFEHKEKIIRLGFVPNEDISEVMNLASVYVQPSYYEGFGLSVVHAFACGTPVVVSRTNALTEIADGAALVADPKSPEDMAEKIMEILKNEKTKKQLIDKGRKRVKDFSWEKTSENLLKVYQEVINS

SEQ ID NO: 4483 - DNA, 504 bp, Unknown
  Obtained from environmental sample
  misc_feature (1)..(504): n is a, c, g, or t
atgagaaccatagtaattctttatttagttatgttttctttatcgtgtcagcagcaaaaaaagtatgacagagagaaaaaccttaaagcactgggagaaaaatttccaatagaaattaattccactttaataggagatacagtgcatttagcaatttttaaagaagaggaacacgattactttactctctattctcgttttaaaataccccctgattattttgaaaagatcgtaaacgaattaaaagtggttaagtacggcgatactacctctaattacaaagtaaaagatgctaattttaatgacccctattatcaggaattatggcttccaagttccactaagtctggtatcaaactggagcaagataaattatattggtggaatgttaacatcaataaaaccgatagtctatatgccaattattataaaggcactccagagtcaggaaacataaagcttctctatcagaatggttatttttttgtattgatcgaaacttaa

SEQ ID NO: 4484 - protein, 167 aa, Unknown
  Obtained from environmental sample
  SIGNAL (1)...(18)
  misc_feature (1)..(167): Xaa is any amino acid
MRTIVILYLVMFSLSCQQQKKYDREKNLKALGEKFPIEINSTLIGDTVHLAIFKEEEHDYFTLYSRFKIPPDYFEKIVNELKVVKYGDTTSNYKVKDANFNDPYYQELWLPSSTKSGIKLEQDKLYWWNVNINKTDSLYANYYKGTPESGNIKLLYQNGYFFVLIET

SEQ ID NO: 4485 - DNA, 441 bp, Unknown; identical to SEQ ID NO: 2005
  Obtained from environmental sample
  misc_feature (1)..(441): n is a, c, g, or t

SEQ ID NO: 4486 - protein, 146 aa, Unknown; identical to SEQ ID NO: 2006
  Obtained from environmental sample
  DOMAIN (3)...(70): SmpB protein
  misc_feature (1)..(146): Xaa is any amino acid

SEQ ID NO: 4487 - DNA, 558 bp, Unknown
  Obtained from environmental sample
  misc_feature (1)..(558): n is a, c, g, or t
atgatttcaacgagtgattttaagaacggaacaattttcgaatgggacggccgcatttggcaggtcgtctggtttcagcaccacaagcccggcaaaggcggagcggtcatgcggttgaagctcaaaaacatgcacaccggcgacatcatcgagcgcacgttcaaatccggcgaatcgtttcgcgaaatcgaagcttcccgccgtaagaagacgttctcctatgtcgacggcgacaagtaccactttatcgactccgaatcctacgaagacatggaaatttccaaagagcagttgggcgacgcggccggattcctgcaagacaacatggaagtccaggcgctgtatctcgatgacgctttcctgaccattgaaatgcccgcgtcggtgcgcctgaaagtcgttgagaccgtgcccggcgttcgcggcaacacggtgtccaatacgatgaaacccgcgaaactggagaccggcatcgaaattgcggttccgctttttatcaacgagggcgatgtggtgaaagtcgatacccgcacccacgagtacgtcgagcgcgtatga

SEQ ID NO: 4488 - protein, 185 aa, Unknown
  Obtained from environmental sample
  DOMAIN (1)...(185): Elongation factor P (EF-P)
  misc_feature (1)..(185): Xaa is any amino acid
MISTSDFKNGTIFEWDGRIWQVVWFQHHKPGKGGAVMRLKLKNMHTGDIIERTFKSGESFREIEASRRKKTFSYVDGDKYHFIDSESYEDMEISKEQLGDAAGFLQDNMEVQALYLDDAFLTIEMPASVRLKVVETVPGVRGNTVSNTMKPAKLETGIEIAVPLFINEGDVVKVDTRTHEYVERV

SEQ ID NO: 4489 - DNA, 906 bp, Unknown
  Obtained from environmental sample
  misc_feature (1)..(906): n is a, c, g, or t
atgcagagtgttttcagagggtatttgctgacaaatgatgagacttttctggactcttactttaaggggcgcaaaattgtaccaggcctgataaaagaacagcagtttagaattggtaatcataataaacagcgggaaatattagattcaatcagcaaccttcacaacagctggctgaactattctgctcagttaatagactcgcgcgaaaaatttcctaattcgtatcaaaatctttttgataattcattgaaaagacacgttggaaaaaaaataaatgatgctattaatctcaaatttgcaagatttgataaaatagaatataaaaggagaaaattacatacagacagattattgatttccttaaaaaatgcgcatacattttcttttatcttcctgacattaacaattgtggtgggagtttttagtacagcattcattttggtaattacaactaaaagaattagctcgatggtgagtcttgcagaaaatatttcgaaaggcaattttaccagtgttaaggatacagggaatgatgaattatctgctttggctgtttctcttaatacaatgtctgaaaagttagataaaaatattcgtgaattaaaaaacagaaatgccgagctaaataaatttgcttacgtagtttctcacgatttgaaagctccaatccgggggattcataacgtcattacatggattgaagaagatcatgctgatgaactttcacccgaaatcaaaagatatctgaggattatacctcaaaaaacacaacgtatggaggcgcttattaatggtttactggactatgcccgattaaatcttaaaactccgccggaaagcatcaatactaatgctctggttcaggagattgcagactcgattgttccaaggactttgccctga

SEQ ID NO: 4490 - protein, 301 aa, Unknown
  Obtained from environmental sample
  DOMAIN (1)...(117): CHASE3 domain
  misc_feature (1)..(301): Xaa is any amino acid
MQSVFRGYLLTNDETFLDSYFKGRKIVPGLIKEQQFRIGNHNKQREILDSISNLHNSWLNYSAQLIDSREKFPNSYQNLFDNSLKRHVGKKINDAINLKFARFDKIEYKRRKLHTDRLLISLKNAHTFSFIFLTLTIVVGVFSTAFILVITTKRISSMVSLAENISKGNFTSVKDTGNDELSALAVSLNTMSEKLDKNIRELKNRNAELNKFAYVVSHDLKAPIRGIHNVITWIEEDHADELSPEIKRYLRIIPQKTQRMEALINGLLDYARLNLKTPPESINTNALVQEIADSIVPRTLP

SEQ ID NO: 4491 - DNA, 873 bp, Unknown
  Obtained from environmental sample
  misc_feature (1)..(873): n is a, c, g, or t
ttggaagaaactccctgggtgctcgaagcaaaaagtgaagagcagcaaaagaaaaacatagcgctgctgtttgatatggtccgcatgagcggagaactcgaatcttcgcttagcaaattaaaagatatgcagtcacctaatggtggctttgtttggttcaaaggaggtccggatgatcggtatatcacccaatatattctaaccggtattggtcatctgaaaaaactaaacgcaatcacaaaagaccaggatcaaaaattattatcaatcgtaaatactgcatttccttacttagacagaaagttgaaagaagattatgacaacttaaaaaaacataaatcagatcagaaagtaaacaatacaggcacaatagccatccagtatctatatatgcgaagtttttttcccgaacacggcattgcaaaacaatcccaggctgcttataactattatatcgggcaggcaaaaaaattctggctttcgcaaggtaagtttatgcaggcaatgacagcgttgtttttgtaccgaagcggtgatagaataactccgcaggcaatcatgcgttccctaaaagaaaattcaataaataacgaagaacttgggatgtactggaaggaatggaacatccatggatactggtggtaccaggcgcctatagaatcgcaggctatgatgatagaagcttttagtgaaataaggaacgatcaaacagtaataaatgatcttaaaacctggttgctaaaaaataaacaaactaataactggaatactactaaggccacagccgatgcatgctatggcgtatttatacagggaaatgatccgacgccgatcggttggttaagcgaacaaaaaatgttgttatcaagttag

SEQ ID NO: 4492 - protein, 290 aa, Unknown
  Obtained from environmental sample
  misc_feature (1)..(290): Xaa is any amino acid
MEETPWVLEAKSEEQQKKNIALLFDMVRMSGELESSLSKLKDMQSPNGGFVWFKGGPDDRYITQYILTGIGHLKKLNAITKDQDQKLLSIVNTAFPYLDRKLKEDYDNLKKHKSDQKVNNTGTIAIQYLYMRSFFPEHGIAKQSQAAYNYYIGQAKKFWLSQGKFMQAMTALFLYRSGDRITPQAIMRSLKENSINNEELGMYWKEWNIHGYWWYQAPIESQAMMIEAFSEIRNDQTVINDLKTWLLKNKQTNNWNTTKATADACYGVFIQGNDPTPIGWLSEQKMLLSS

SEQ ID NO: 4493 - DNA, 846 bp, Unknown
  Obtained from environmental sample
  misc_feature (1)..(846): n is a, c, g, or t
gtggattatttatctcctgagtacgacgtggttaccttcccttttgattggcgtcttcaattaaataagtgtgcagatctttttaaaaacaaaattgaagaactattcaggtacaaccagccaataaaaatcattggccattctatgggcggtgtattggtaagagattttattgtcaggcatccaggtacatggaaaacactaaatgaatctcctaaattcaaattattatttctgggcgctcccttgggtggatcatttagaattccagccgttctctttgggcaggatgccatcatcagtaaacttgctaagatcgatatttttcataccaagaaagagctccttaaaattttttgcaggatgcccggcattttaagtttgctcccacatgccactgaccaggaaaatgatttttccaaccctacgctatggaaaaagatgggagatgtttatgaagattggcccttgcctctcttaacagatcttaaagagtttgaaaattacagggataagatcattagggagatggaaaacattgactacagtaatattatttatatagcaggcaaagacaaggccactccttgtggttaccgcatagataatacacctgcaggaaaagagttagtcatgcttagtacagccgaaggtgatcaaagcgtaacctgggaaactggcattccaaaaaagatgatccgcaatgactctgtgtattacgtaaatgtaactcatggtgccctggcaaatgaccctgctatatttaaagggatttctgaattaattttcagcnggtgctaccaatctttaagaaaacaagacccagcgacgcataatccnnnttaa

SEQ ID NO: 4494 - protein, 281 aa, Unknown
  Obtained from environmental sample
  misc_feature (1)..(281): Xaa is any amino acid
MDYLSPEYDVVTFPFDWRLQLNKCADLFKNKIEELFRYNQPIKIIGHSMGGVLVRDFIVRHPGTWKTLNESPKFKLLFLGAPLGGSFRIPAVLFGQDAIISKLAKIDIFHTKKELLKIFCRMPGILSLLPHATDQENDFSNPTLWKKMGDVYEDWPLPLLTDLKEFENYRDKIIREMENIDYSNIIYIAGKDKATPCGYRIDNTPAGKELVMLSTAEGDQSVTWETGIPKKMIRNDSVYYVNVTHGALANDPAIFKGISELIFSXCYQSLRKQDPATHNPX

SEQ ID NO: 4495 - DNA, 810 bp, Unknown
  Obtained from environmental sample
  misc_feature (1)..(810): n is a, c, g, or t
atgctgaaaaagtactatcagctcgataaaaaattccaggagaacctgaaggatataaaacaggaagttgaaaataatatttcgtataaattctatgcgctcattgataccttttacagctcgcttcaatataaaacatttaacgctgccaccttttttaatgattcagtgagctcatttgggaggttaaaaaatatagtgcccctggatattcaatcgaaagtagatgctttgtcaaaaacaaagatcacaaacacagtggtggatacaaccttaaatttcaaaaccgactccatgggatttattgtcagctacacggaaaaaggaaatgtattgttagacctattgcaggaatataaaaccattgagaacaacactacggttgcctttacagaaaattttcgcatcaaatcatttgattacactacaaagaaaaaagagggacagttggtaaccataacacctggtcctgtacaaacaaggatagatttgtttagttgtggtgatgacagaaaccagcaagctgagttcaacaggattatgttgttgttaaagaaacagaattataatgtcgttcgcagaagttttaaaaatccatccgatcaactttcaccttattttgtcagcggtaacgagatccgttataatggaggagatgaattaggaattgcaaacaagttaaaagcactattggagcgaagcaccaactcggctttttcgataaaaaaagtaaggactgttacaccaaacatcttaagcatatttatttgccaaaancacaggaccgataataaacagatagatatttag

SEQ ID NO: 4496 - protein, 269 aa, Unknown
  Obtained from environmental sample
  misc_feature (1)..(269): Xaa is any amino acid
MLKKYYQLDKKFQENLKDIKQEVENNISYKFYALIDTFYSSLQYKTFNAATFFNDSVSSFGRLKNIVPLDIQSKVDALSKTKITNTVVDTTLNFKTDSMGFIVSYTEKGNVLLDLLQEYKTIENNTTVAFTENFRIKSFDYTTKKKEGQLVTITPGPVQTRIDLFSCGDDRNQQAEFNRIMLLLKKQNYNVVRRSFKNPSDQLSPYFVSGNEIRYNGGDELGIANKLKALLERSTNSAFSIKKVRTVTPNILSIFICQXHRTDNKQIDI

SEQ ID NO: 4497 - DNA, 1077 bp, Unknown
  Obtained from environmental sample
  misc_feature (1)..(1077): n is a, c, g, or t
ttggaagtttcatcattttgcctgcctttttgggtttcggtggtaaaagggatcaaacccttattttcggttttttccaccattcgncgatatgaaggaaacttgaaaaattgcagactggattttctcgaagagcaattaaaaaagaattatatcaaagctgtgatggatggtttgctcaaagtgtttcaaaaatggggatttcaacattgcagtcgtaccaggggggcacagatatttgaaatactcggattaaataaagatgttgttgaaaaatatttcacgggagccatttcaagaattgaaggaatgggtttagatgaaattgcaaaagagacgttggtaaaacattttagtgctttcactaaaacaagtaatggagaagaaagattaccatccggtggaatttaccaatggaaaaagaaaggggagtaccatttattcaatccacagactattcacttgttgcaacaatcaacaagaatgaatgattatagcatttataaaaaatttgcaaggctcattaatgatcagtcagaaaacacgtcaacgatcaggagcttgcttcaattcaaaaaaaaccgtccatcgatttccattgataatgtggagccggcagaaaatatttataaacgctttgctaccggggctatgagttttggttctatttcctgggaagcacacaccactttagccattgctatgaaccgccttggagcaaaaagtaatacgggtgaaggtggtgaagatgaaagaaggaatgagcctttgttgaatggtgattcaaaccggagtgcgatcaagcaggttgccagtgcaagatttggtgtaacgagtttatacctcactgaggccgatgaactgcaaataaaaatggcgcagggagcaaaaccaggcgagggtggtcagttaccgggacataaagttgatgagtggatcgggaaagtgcgtcattcaacacctggagtaggattaatatcgccaccgcctcatcatgatatttattctatcgaagatttagctcaattaatttttgatttgaaaaactgcgaatcngtgatgcacgcattagtgtaa

SEQ ID NO: 4498 - protein, 358 aa, Unknown
  Obtained from environmental sample
  DOMAIN (146)...(358): Conserved region in glutamate synthase
  misc_feature (1)..(358): Xaa is any amino acid
MEVSSFCLPFWVSVVKGIKPLFSVFSTIRRYEGNLKNCRLDFLEEQLKKNYIKAVMDGLLKVFQKWGFQHCSRTRGAQIFEILGLNKDVVEKYFTGAISRIEGMGLDEIAKETLVKHFSAFTKTSNGEERLPSGGIYQWKKKGEYHLFNPQTIHLLQQSTRMNDYSIYKKFARLINDQSENTSTIRSLLQFKKNRPSISIDNVEPAENIYKRFATGAMSFGSISWEAHTTLAIAMNRLGAKSNTGEGGEDERRNEPLLNGDSNRSAIKQVASARFGVTSLYLTEADELQIKMAQGAKPGEGGQLPGHKVDEWIGKVRHSTPGVGLISPPPHHDIYSIEDLAQLIFDLKNCESVMHALV

SEQ ID NO: 4499 - DNA, 993 bp, Unknown
  Obtained from environmental sample
  misc_feature (1)..(993): n is a, c, g, or t
atgtccctttcaacattcgtcgggaataatggcaatttattgaaagaagatccgcttgcttgtcatagtgtcgccttgaaacaacctgttcttacaaattttgaattggaaaaaatccggagtattgatacaggaattttccaggcaaaaactttgcaatgttatttccgtgctgatggaaagcccggatcattaaaggcgggacttgacaggctttgcaggtacgctgtagatgcagtggaggatggatttgaagtattgatcttaacggaccgcgcaatcgattcagatcattcgccgattccgactttacttgcaacagcagcagtacatcatcatcttattcgaaagggcatgcgcggccaggtgggaattgttattgaagcaggcgatgtttgggaagttcatcattttgcctgccttgttggattcggtgctacagcgatcaacccctatctcgctttctccaccattcgcgatatgaaggaacttggaaaattgcagactgaattatccgaagagcaattaaaaaagaattatatcaaagctgtgaatgatggtttgctcaaagtgttttcaaaaatggggatttcaacattgcagtcgtaccagggggcacagatatttgaaatactcggattaaataaagatgttgttgaaaaatatttcaccggagccatttcaagaattgaaggaatgggtttagatgaaattgcaaaagagacgttggtaaaacattttagtgctttcactaaaacaagtaatggagaagaaagattaccatccggtggaatttaccaatggaaaaagaaaggggagtaccatttattcaatccacagactattcactttgttgcacaatcaacaagaatgaatgattatagcatttataaaaatttgcaaggctcatttatgatcagtcagaaaacacgtcaacaatcaggaactttgctttcaatcaaaaaaaacccgtccatccattttcatttataa

SEQ ID NO: 4500 - protein, 330 aa, Unknown
  Obtained from environmental sample
  DOMAIN (1)...(216): Glutamate synthase central domain
  misc_feature (1)..(330): Xaa is any amino acid
MSLSTFVGNNGNLLKEDPLACHSVALKQPVLTNFELEKIRSIDTGIFQAKTLQCYFRADGKPGSLKAGLDRLCRYAVDAVEDGFEVLILTDRAIDSDHSPIPTLLATAAVHHHLIRKGMRGQVGIVIEAGDVWEVHHFACLVGFGATAINPYLAFSTIRDMKELGKLQTELSEEQLKKNYIKAVNDGLLKVFSKMGISTLQSYQGAQIFEILGLNKDVVEKYFTGAISRIEGMGLDEIAKETLVKHFSAFTKTSNGEERLPSGGIYQWKKKGEYHLFNPQTIHFVAQSTRMNDYSIYKNLQGSFMISQKTRQQSGTLLSIKKNPSIHFHL

SEQ ID NO: 4501 - DNA, 309 bp, Unknown
  Obtained from environmental sample
  misc_feature (1)..(309): n is a, c, g, or t
atgctgaaacgagttgtcatgtattcacttaaattcctgaaggtttgcaggagtttgccttttagcaagggccattcagctgagaaagctattatctggttaaccagtaacaatacaaacacagataccaatagtaataacaatgtaagtgcaattaatatagcaaagcttcttcccatgcctttctccctcagccatgcacaaattggatataatataaaactaatcaggaaagcaaaactcaggggaataaaaagcagctgccaaagtataatatggcacctgccagtaatatataaagcatattaa

SEQ ID NO: 4502 - protein, 102 aa, Unknown
  Obtained from environmental sample
  misc_feature (1)..(102): Xaa is any amino acid
MLKRVVMYSLKFLKVCRSLPFSKGHSAEKAIIWLTSNNTNTDTNSNNNVSAINIAKLLPMPFSLSHAQIGYNIKLIRKAKLRGIKSSCQSIIWHLPVIYKAY

SEQ ID NO: 4503 - DNA, 480 bp, Unknown
  Obtained from environmental sample
  misc_feature (1)..(480): n is a, c, g, or t
ttggaacttaccaatggaagggccgaaaaacaaaatgattatctttcttttatgaacaaggcttctccttttcaacaggcaatctggcgacggtttaagaaaaacaaaggtggagtttttggattggtgatgattgcagtttcggtacttattgccttgttttgttatttcatagctcctgattcttcgccgtatgctaatagaattattttagaaataggcggagaaaaaccaggcttcaaacagccttttttactcgttaaaagaccacaacggccaacaaatatttttcaacaggcactgaatggaaaaagagatcaggtggaatatattcccattcaaagctggagtgaaaaagcagatagctttattgtcgaaaaatatattgatgaagatgttactgaaaaaataagctttgcgaaatcttctttagcgtcaaaacctgttacaaccgaaaagttttttctgggcaccagataa

SEQ ID NO: 4504 - protein, 159 aa, Unknown
  Obtained from environmental sample
  misc_feature (1)..(159): Xaa is any amino acid
MELTNGRAEKQNDYLSFMNKASPFQQAIWRRFKKNKGGVFGLVMIAVSVLIALFCYFIAPDSSPYANRIILEIGGEKPGFKQPFLLVKRPQRPTNIFQQALNGKRDQVEYIPIQSWSEKADSFIVEKYIDEDVTEKISFAKSSLASKPVTTEKFFLGTR

SEQ ID NO: 4505 - DNA, 495 bp, Unknown; identical to SEQ ID NO: 1167
  Obtained from environmental sample
  misc_feature (1)..(495): n is a, c, g, or t

SEQ ID NO: 4506 - protein, 164 aa, Unknown; identical to SEQ ID NO: 1168
  Obtained from environmental sample
  misc_feature (1)..(164): Xaa is any amino acid

SEQ ID NO: 4507 - DNA, 504 bp, Unknown
  Obtained from environmental sample
  misc_feature (1)..(504): n is a, c, g, or t
ttgccgtatcaccaccataactttcagccgttattaaacatctttgagacaaaacttaatatggaaaacttcctattacacgatgacataaaagtattttacgtaacagcaacttctttccccgatggcgtaaaagaggcccatgaaaaattgcactcacttattcctttttcaaaagaaagaaaatattttggcgtatcccgtccggaaaacaatagcggaattatttaccatgctgcagcgcaagaaatggaagacggcgaaggggaaaagttaaactgcgacacacttgttctaaaaaaaggaaaatatatttcattgaccattaataattttatgaaagacctgccgtctattggaaaagcatttaagcaactccttacctaccccggtatagacccacaaggttattgtgtagaatggtacctaagtgaaaaagatgtaagatgtatgatccgtttatacgattcaataataaaaacggttatgtatgagaaacgataa

SEQ ID NO: 4508 - protein, 167 aa, Unknown
  Obtained from environmental sample
  misc_feature (1)..(167): Xaa is any amino acid
MPYHHHNFQPLLNIFETKLNMENFLLHDDIKVFYVTATSFPDGVKEAHEKLHSLIPFSKERKYFGVSRPENNSGIIYHAAAQEMEDGEGEKLNCDTLVLKKGKYISLTINNFMKDLPSIGKAFKQLLTYPGIDPQGYCVEWYLSEKDVRCMIRLYDSIIKTVMYEKR

SEQ ID NO: 4509 - DNA, 876 bp, Unknown
  Obtained from environmental sample
  misc_feature (1)..(876): n is a, c, g, or t
ttgattctttggatcagattcttcacgagtgtggcatacaatgatccgctccgaaagcctctctcctattacatcgaaaagtatgggtcgatgtacgcagtcaacaagatgtatatcttaatggagaagcagcacaaccggggtcaggacggcgccggaattgcgaacatcaaaatcgatatcgattcaggccaccgttacattagccgttaccgttcaatcaaatctcaacccgtcgcagcacttttcaagaagatcgccaaaaaatataagaaagcacaaaaggaaggaaaacaaaaatataagaacgaacgatggcttaaagaaaatgtagcttttacgggcgagctttggttaggacaccttcgttacggaacacatgggatgaacagtattgaaaacgttcatccttttttacgtcagaacaattggagaagccgcaatctggtaatggctggcaacttcaatatgaccaacgtggacgaactttttgacctgttggtcgacctgggccaacatcctaaggaaaaagttgataccgtgaccgtgatggaaaagatcggccactttctggatgaagaagttcagggcctattcgacaagtacaaagacaaatttacaaaccgcgaagtatctgaaatcattgagaacgaattgaaccttgcgcggatgcttcgaagggcgtgtaaggacttcgatgggggttataccatggcagggttgaccggatcaggttccgctttcgttgttcgggatccaaacggtattcgtcctgcctattactatgcaaacgatgaggttgtagtcgttgcttccgaaaaaccggcaatcaaaacaggtttcaatatcgactacaatcaaattgaagaaattaag

SEQ ID NO: 4510 - protein, 292 aa, Unknown
  Obtained from environmental sample
  DOMAIN (33)...(189): Glutamine amidotransferases class-II
  misc_feature (1)..(292): Xaa is any amino acid
MILWIRFFTSVAYNDPLRKPLSYYIEKYGSMYAVNKMYILMEKQHNRGQDGAGIANIKIDIDSGHRYISRYRSIKSQPVAALFKKIAKKYKKAQKEGKQKYKNERWLKENVAFTGELWLGHLRYGTHGMNSIENVHPFLRQNNWRSRNLVMAGNFNMTNVDELFDLLVDLGQHPKEKVDTVTVMEKIGHFLDEEVQGLFDKYKDKFTNREVSEIIENELNLARMLRRACKDFDGGYTMAGLTGSGSAFVVRDPNGIRPAYYYANDEVVVVASEKPAIKTGFNIDYNQIEEIK

SEQ ID NO: 4511 - DNA, 501 bp, Unknown
  Obtained from environmental sample
  misc_feature (1)..(501): n is a, c, g, or t
atgaatatcaggccaaattttttagattacatcaactataggatcttggacgttttgagtaaaaactcctctttaccatttgtagaattggctaaacaaattgggatttcggatgcaactatccataccagagtcaaaaaattattgaccttgggtgttataaaaaaatttactatttttgtagataatgatttgcttggatacgaccatctagcatttattaatttgaaaattgaaagaggaagaaccgaggaaacgactaacaatctcatgaaaatcgatgaaatattagaaatacatgaaatttacgacaaatttgatttgctaattaaaattcgaacaaaaaatttggacaatttgagagatataattgtaaataaaatattatcgattaattatataaaagagacagaattaatgacagttttaaaaactagaaaagaagaacagatgatctcattacaaaaagaaatgagtgaaaaaaccaaagaattcttttaa

SEQ ID NO: 4512 - protein, 166 aa, Unknown
  Obtained from environmental sample
  DOMAIN (32)...(132): AsnC family
  misc_feature (1)..(166): Xaa is any amino acid
MNIRPNFLDYINYRILDVLSKNSSLPFVELAKQIGISDATIHTRVKKLLTLGVIKKFTIFVDNDLLGYDHLAFINLKIERGRTEETTNNLMKIDEILEIHEIYDKFDLLIKIRTKNLDNLRDIIVNKILSINYIKETELMTVLKTRKEEQMISLQKEMSEKTKEFF

SEQ ID NO: 4513 - DNA, 948 bp, Unknown
  Obtained from environmental sample
  misc_feature (1)..(948): n is a, c, g, or t
ttgattggacttcgtcctatcaataatgttgtagacatcaccaattacgtattgcacgaaacaggncagccattacatgcttttgatttcgatgccatcgccggtcaaaaaatagttgtaaaaaaagaaaagacagatactgtttttctaacgcttgatgaaaaagaaagaaaaataagcagtgaagatttaatgatctgtaacgaaaaagaaggaatgtgtatagccggtgtttttggcggtcttcattctggcgttacagaaaaatcacaaaatatttttttagaaagtgcctggttcgatcctgtgtctattcgcaaaacctccttccgccatgggctgcgtaccgatgcagctattcgttttgagaaaggaacggatatttctaatacagtgtatgcgcttaagagagcagcattgttgataaaagaaattgccggtggccaaattgcatcagaaattatagatgtatatccacaaccagaaccaaagaaacaggtcggcttaaggtttcaatacttaaaaaaactaagcgggaaaaattatcatcctgatagtgtaaagaaaattcttcagtcgttaggttttgtcttggtaagagaagatatcgatgccctttcggtagaagtgccttaccataaaaacgacgtaagcctttctgcagatctagtggaagaaattgtccgtattgatggtttggataatattgaaattccaacatccattactataagtccttcgatagaaaaaaacatcagcgcagataatttaaaagaaaaaatagcgggcttattgacgggattaggatttactgaaatacttacaaactctattaccaattcaaaatatcttagcgaagatcaattagccaacaaggtaaaaatgcttaataatttaagcaggaaatgggatataatgcggcttccatgttacaacggaatggagtaa

SEQ ID NO: 4514 - protein, 315 aa, Unknown
  Obtained from environmental sample
  DOMAIN (164)...(233): tRNA synthetase B5 domain
  misc_feature (1)..(315): Xaa is any amino acid
MIGLRPINNVVDITNYVLHETGQPLHAFDFDAIAGQKIVVKKEKTDTVFLTLDEKERKISSEDLMICNEKEGMCIAGVFGGLHSGVTEKSQNIFLESAWFDPVSIRKTSFRHGLRTDAAIRFEKGTDISNTVYALKRAALLIKEIAGGQIASEIIDVYPQPEPKKQVGLRFQYLKKLSGKNYHPDSVKKILQSLGFVLVREDIDALSVEVPYHKNDVSLSADLVEEIVRIDGLDNIEIPTSITISPSIEKNISADNLKEKIAGLLTGLGFTEILTNSITNSKYLSEDQLANKVKMLNNLSRKWDIMRLPCYNGME

SEQ ID NO: 4515 - DNA, 591 bp, Unknown
  Obtained from environmental sample
  misc_feature (1)..(591): n is a, c, g, or t
atgtacaccggaccagaagatatggacatcattgcccgtgttttgaatggcgatcatcaatcgtattcaatactggtggagcgttaccagaactttgtttttaccattaccctgcggtatgtaaagggccgggaagatgcagaggaggtttcgcaggatgtgtttgtaaaagcctaccggtcgctggcggattttaaaggaaattcgaaattcagcacctggttgtacaccattaccacaaccacttgcattacatttttgagaaagaaaaaactggaagtgcattcgctggataatgaaaaggtttttgaggtagcggatagtgtggacagcggcatgagggccaatcaaattgagcaaaagagtaaagtgaacatggtgaatgaggcgataaagatgttaagcccggatgatgcgcagatcattacgctgttttataaaggagaacaaaccctggaagaaatagcgcaaatcttaggtaaggaaccgaatgctgtaaaggtgcagttgcacagggcaagaggaaggctgaaagacacaatggaccaatattttaagcgccgaagtaagagacatttattaagcccctaa

SEQ ID NO: 4516 - protein, 196 aa, Unknown
  Obtained from environmental sample
  DOMAIN (130)...(179): Sigma-70, region 4
  misc_feature (1)..(196): Xaa is any amino acid
MYTGPEDMDIIARVLNGDHQSYSILVERYQNFVFTITLRYVKGREDAEEVSQDVFVKAYRSLADFKGNSKFSTWLYTITTTTCITFLRKKKLEVHSLDNEKVFEVADSVDSGMRANQIEQKSKVNMVNEAIKMLSPDDAQIITLFYKGEQTLEEIAQILGKEPNAVKVQLHRARGRLKDTMDQYFKRRSKRHLLSP

SEQ ID NO: 4517 - DNA, 351 bp, Unknown
  Obtained from environmental sample
  misc_feature (1)..(351): n is a, c, g, or t
atgtcggtagttgtcaaagtagagaatatttctaagaaatatcatcttggaaaaacggggacccgctccttaaaaggagattttcaacgttggtgggcattaaagcgaggcaaagaagatcctttttcatccgttgtggatgcctctcagatgcaaggggaggaattctgggcattaagagagattaattttgaaattaagcagggtgaagctgttgggattgttggcaaaaatggagcaggcaaatctactttacttaagattctgtcacaaatcactttaccttctacaggaaatatcaacataaaaggccggattgcccagtttgttagaagtaggtactgcatttaa

SEQ ID NO: 4518 - protein, 116 aa, Unknown
  Obtained from environmental sample
  misc_feature (1)..(116): Xaa is any amino acid
MSVVVKVENISKKYHLGKTGTRSLKGDFQRWWALKRGKEDPFSSVVDASQMQGEEFWALREINFEIKQGEAVGIVGKNGAGKSTLLKILSQITLPSTGNINIKGRIAQFVRSRYCI

SEQ ID NO: 4519 - DNA, 489 bp, Unknown
  Obtained from environmental sample
  misc_feature (1)..(489): n is a, c, g, or t
atgaatagaagcttttttcagtcattatatccagaggtaatttttgttatccccgaatcaaatagtaatgggtccacagttgagacagtaaaggaaaaacaatttgaggtttcctttttcggcggtaataagcaaaagatactgatacttgtagaggatgtagaagcggagtttatcaacgaaaaagacaaagagtttttagggaaagtgttgggagcaataaagcttacttataacgacgtggctttggtcaacacatttaaaaaccaatccgtaagtttcggggattatctggataagattgatttttcaaaagcaataatattcgggaaagagccaaccgggctcacagagtcggggattttaaaatataagatctctacagtagaggcgatagagattttgcacgctgatattctatctgagattcaggacgataaaaacaaaaagattaagctctgggaggagcttaaaagaatgtttgcttga

SEQ ID NO: 4520 - protein, 162 aa, Unknown
  Obtained from environmental sample
  misc_feature (1)..(162): Xaa is any amino acid
MNRSFFQSLYPEVIFVIPESNSNGSTVETVKEKQFEVSFFGGNKQKILILVEDVEAEFINEKDKEFLGKVLGAIKLTYNDVALVNTFKNQSVSFGDYLDKIDFSKAIIFGKEPTGLTESGILKYKISTVEAIEILHADILSEIQDDKNKKIKLWEELKRMFA

SEQ ID NO: 4521 - DNA, 489 bp, Unknown; identical to SEQ ID NO: 3789
  Obtained from environmental sample
  misc_feature (1)..(489): n is a, c, g, or t

SEQ ID NO: 4522 - protein, 162 aa, Unknown; identical to SEQ ID NO: 3790
  Obtained from environmental sample
  misc_feature (1)..(162): Xaa is any amino acid

SEQ ID NO: 4523 - DNA, 894 bp, Unknown
  Obtained from environmental sample
  misc_feature (1)..(894): n is a, c, g, or t
ttgggaaaaaatatacagtgtggcaattcgttgattggtccggattactatgaagggcgccagttgacgatggggtttataaacgatgaagaacgtttccgagttaatgcatttgactggaaaacccagttcccgcaagtatttatgcagggtggatttgatgcagtaattggtaatccaccatacatccgcatccaaaccttacaagagacatcttcgattgatgttgactttttcaaacaaaaatatcaagctgcaaataaaggcaattatgatatttacgttgtgtttgttgaaaagggtctggatattctgaatcaaaagggacgtttaggtttcattctgccacataagtttttcaatgctcaatacggagcgccattgcgcggtgtgatctcgaaaggaaagcacttggctaaagtcgtgcacttcggtgatcaacaggtttttggaagtgcaaccacttacacctgcctgatgttccttgataaatcaggacctaaagaattcgacttcgaaaaagtgcaagatttatctgcatggcgaactcaactgtctgctacatcacctggcaaaatagacagtgctcgtctgactgaaagagagtggaatttttctgttggtgccaacgccggcttgtttgaaaaactttcgcagatgcccataaagttaggcgacataagtcacttatttgtaggactacaaactgatgcagatgatgttctnattgttgaagaaattaaacgagcaggcaaaaaggtcgtttgtcggtccaagtacactggaaaagaacacgtgtgggaaaagaacatctcaaaccgttctcaaaggatcatgactatacgcgatttactttcgaatgtaacaaagtctaaatttcctttaacaccttaa

SEQ ID NO: 4524 - protein, 297 aa, Unknown
  Obtained from environmental sample
  DOMAIN (49)...(166): Eco57I restriction endonuclease
  misc_feature (1)..(297): Xaa is any amino acid
MGKNIQCGNSLIGPDYYEGRQLTMGFINDEERFRVNAFDWKTQFPQVFMQGGFDAVIGNPPYIRIQTLQETSSIDVDFFKQKYQAANKGNYDIYVVFVEKGLDILNQKGRLGFILPHKFFNAQYGAPLRGVISKGKHLAKVVHFGDQQVFGSATTYTCLMFLDKSGPKEFDFEKVQDLSAWRTQLSATSPGKIDSARLTEREWNFSVGANAGLFEKLSQMPIKLGDISHLFVGLQTDADDVLIVEEIKRAGKKVVCRSKYTGKEHVWEKNISNRSQRIMTIRDLLSNVTKSKFPLTP

SEQ ID NO: 4525 - DNA, 651 bp, Unknown
  Obtained from environmental sample
  misc_feature (1)..(651): n is a, c, g, or t
gtggtctttgacaaacatgaaaagcgtaaaaaagaatgccataatgttgttctttcttttataaaagaaaagctacctacttcactaaacaaagacagcgttgagataatactaagagacacacagctccatgaacgtaaatttgaatattttaaattcttttatagtttacctggtgagttagtgaaatactactatcttaataatatttttactgcacctttacctatagcttatggagtcggttgggctaatgcgtataggtctttctctacaaaaaggctcctccctaaagaagagttttttaaggaaatgtttactctttataagaaaaaatgggatgaggggggaataaataccaatacaggagagaatgctataataagtatagatgaagaaaggaaggcacaaaataggaaggaaatttgtgatacaatcgtagatattaatttacctggtgttactgaagaggaaaaaaagaaacgttgggaccgagtattttctataataacaagcgatccggcttcatttaataagcaaagctatggctcgcaatataatattgtacataacgctttatccaactattttcttaataatcattatgattgcctcgaagtttttttatcaatgccctataaaaacgggtag

SEQ ID NO: 4526 - protein, 216 aa, Unknown
  Obtained from environmental sample
  misc_feature (1)..(216): Xaa is any amino acid
MVFDKHEKRKKECHNVVLSFIKEKLPTSLNKDSVEIILRDTQLHERKFEYFKFFYSLPGELVKYYYLNNIFTAPLPIAYGVGWANAYRSFSTKRLLPKEEFFKEMFTLYKKKWDEGGINTNTGENAIISIDEERKAQNRKEICDTIVDINLPGVTEEEKKKRWDRVFSIITSDPASFNKQSYGSQYNIVHNALSNYFLNNHYDCLEVFLSMPYKNG

SEQ ID NO: 4527 - DNA, 555 bp, Unknown
  Obtained from environmental sample
  misc_feature (1)..(555): n is a, c, g, or t
ttgattattgaagttgacggtaatgacctggatgcactgttcaaggattgcgaaaaaattaccgaggttatgaatgcatatggagcatccgaagtgctattcgccgatactacgcaacaaaaagctgaattgtggaaaatgcgcagggcaaccggtgaagccataaaatcgcattctgtttacaaggaagaagatacagttgtaccacgcgcagaattacctgagttgcttgcaggtgtaaaaacaataggaaataaatatggcttcaggtcggtatgctatggccatgccggtgacggtaatcttcatgtgaatattatcaaggaagaaatgagtgatgacgactggaataataaggtgccactcggtatccgtgaaatttttgaattgtgtgtgcgtttaggcggaaccatatcaggcgaacatggcattggactggtgcaaaaggattatatggatataccattcgatgaagtgcaattaaagcttcaaaaaggaatcaaaaaacttttcgacccgaaccatattttaaacccggggaaactctttaattaa

SEQ ID NO: 4528 - protein, 184 aa, Unknown
  Obtained from environmental sample
  DOMAIN (2)...(182): FAD linked oxidases, C-terminal domain
  misc_feature (1)..(184): Xaa is any amino acid
MIIEVDGNDLDALFKDCEKITEVMNAYGASEVLFADTTQQKAELWKMRRATGEAIKSHSVYKEEDTVVPRAELPELLAGVKTIGNKYGFRSVCYGHAGDGNLHVNIIKEEMSDDDWNNKVPLGIREIFELCVRLGGTISGEHGIGLVQKDYMDIPFDEVQLKLQKGIKKLFDPNHILNPGKLFN

SEQ ID NO: 4529 - DNA, 306 bp, Unknown
  Obtained from environmental sample
  misc_feature (1)..(306): n is a, c, g, or t
atgattttcttaaaaaagtttttcaaaaataaaatattgatgatccagcgatcctttgaatcaattatgaagaaatttttatttactatatcagtaagtcttttagcattattagtgcacgctcaaacttcatacgtttcaaaagtttgggtagcagataatggcgacggctcttataaaaatcctgtgatcaatgctgattattcagatcctgatgcaataagagtgggggatgatttcatcttggtttcgtccagttttgacgatgttccgggtttgccaattttacattccaaggatttgatt

SEQ ID NO: 4530 - protein, 102 aa, Unknown
  Obtained from environmental sample
  misc_feature (1)..(102): Xaa is any amino acid
MIFLKKFFKNKILMIQRSFESIMKKFLFTISVSLLALLVHAQTSYVSKVWVADNGDGSYKNPVINADYSDPDAIRVGDDFILVSSSFDDVPGLPILHSKDLI

SEQ ID NO: 4531 - DNA, 738 bp, Unknown
  Obtained from environmental sample
  misc_feature (1)..(738): n is a, c, g, or t
ttgaaaagaacatcgtatctcatacaaagatatttaccccattatatatttcacctgcccgctaattccactacaaatcacaatagcctgtttgaaaatcatgaaacaataagcacaggcactctcaatattcttgaatcagtaaaagaattctctccactttcaaaggtctttatttccggcagcgggcttcaatataaaaatataggtaatccaataaaagagacagatgagtttgaagcaagagatccatactccgttagtcgcattcagtcggtatatgctgccaggtattataggagcctgaatattaaagcttacgtgggatatttctttaaccacgaaagtccccggcgttcagaaaggcacataagtaaaaaaattgcagaggcagcaaagcgtatagctacaggaagcaatgaaaaaattcaaattggcgatatttcagtaattaaagagtggacttacgctgcagatgtcgtcaagggtattttaaaactcgttgaacaggataatgtctatgaaacaaacattggcactgggcttggttattcaatagaagagtggttaactctatgctttgcccagataaaaagagattggagaaaatacgtaaccctaaatcaagattttattaccgattacaaaaaacttatttgtgatccatcgaaaatatttgcattgggctggcagccaacagtaagtatcgaagaactatctaaaatgatgatggcgtaa

SEQ ID NO: 4532 - protein, 245 aa, Unknown
  Obtained from environmental sample
  DOMAIN (4)...(242): NAD dependent epimerase/dehydratase family
  misc_feature (1)..(245): Xaa is any amino acid
MKRTSYLIQRYLPHYIFHLPANSTTNHNSLFENHETISTGTLNILESVKEFSPLSKVFISGSGLQYKNIGNPIKETDEFEARDPYSVSRIQSVYAARYYRSLNIKAYVGYFFNHESPRRSERHISKKIAEAAKRIATGSNEKIQIGDISVIKEWTYAADVVKGILKLVEQDNVYETNIGTGLGYSIEEWLTLCFAQIKRDWRKYVTLNQDFITDYKKLICDPSKIFALGWQPTVSIEELSKMMMA

SEQ ID NO: 4533 - DNA, 453 bp, Unknown
  Obtained from environmental sample
  misc_feature (1)..(453): n is a, c, g, or t
atgatcttattagttgatgacaagtccgaaaacctgttttcattaagcagtgttcttgcacagcatggcttttcttcggatactgctcaatccggagaggaggctctaaaaaaattactgcggcatgattatgctcttgttattttagatgtgcagatgcctgtgatggatggctttgaagtagctgaagccatttccggcctaaacaaaacaaaagacattcccattatttttttatcggccgttaacacaagcaagcattttattgcaaaaggttttgaatccggcgctgttgaatatcttaccaaacctgtcgatcctgatatacttattttgaaagtgcgcaacttctaccgnctttatgaaaaaacccttgcactaaaagaaaacagaaagcacttaccaatacggttaatgaattatactcaacgctggaagccttgccgcaattag

SEQ ID NO: 4534 - protein, 150 aa, Unknown
  Obtained from environmental sample
  DOMAIN (2)...(122): Response regulator receiver domain
  misc_feature (1)..(150): Xaa is any amino acid
MILLVDDKSENLFSLSSVLAQHGFSSDTAQSGEEALKKLLRHDYALVILDVQMPVMDGFEVAEAISGLNKTKDIPIIFLSAVNTSKHFIAKGFESGAVEYLTKPVDPDILILKVRNFYRLYEKTLALKENRKHLPIRLMNYTQRWKPCRN

SEQ ID NO: 4535 - DNA, 723 bp, Unknown
  Obtained from environmental sample
  misc_feature (1)..(723): n is a, c, g, or t
gtgctttcattttttaaaagagaagagaagagagactatctgcccttgggaacagacattcattctcatttgcttgccggcattgacgatggtgtgaaatcacttgaagaagctggaaaaattattgtggagtttaaaaaactagggtatgcgaaattaatcacttctccccacattatgagtgatcattaccgaaacaatgcttctattatcaatgggaaattagaagagttgagaaatcatcttcaagccagaaaaatcgaaataaagatcgaggcggcggctgaatattatcttgacgaagttttttatcagcaagtcaacacacttcagcccctgctcacttttggatcaaaatatcttctctttgaaacaaattatttatctgaaccttaccaactgaaggattttatttttaaatcaactactcagggataccgccctgtattggctcatcctgaacgctaccaatatatgtcaatggcgaaggccgaggatttaagaaatcgtggagttttgtttcagatcaatattatgtcgctggtcggatattactcaaagccagttcgattaatggcccaggaatttattgacaaaggatggatagaatttctgggcagcgactgtcataattttcttcatgtcaaagaagttcagcgtgcccataagaataagtattttagaaaagctttagagttacctttactaaatcgcatgatctga

SEQ ID NO: 4536 - protein, 240 aa, Unknown
  Obtained from environmental sample
  misc_feature (1)..(240): Xaa is any amino acid
MLSFFKREEKRDYLPLGTDIHSHLLAGIDDGVKSLEEAGKIIVEFKKLGYAKLITSPHIMSDHYRNNASIINGKLEELRNHLQARKIEIKIEAAAEYYLDEVFYQQVNTLQPLLTFGSKYLLFETNYLSEPYQLKDFIFKSTTQGYRPVLAHPERYQYMSMAKAEDLRNRGVLFQINIMSLVGYYSKPVRLMAQEFIDKGWIEFLGSDCHNFLHVKEVQRAHKNKYFRKALELPLLNRMI

SEQ ID NO: 4537 - DNA, 450 bp, Unknown
  Obtained from environmental sample
  misc_feature (1)..(450): n is a, c, g, or t
ttgcagaaaatgatttgggaacgcgatcgtctgggcctttcctacaatgaaaagacgtttgcctttcgccaaaaagaaagggaattggataacttgaaaaatcaggtattctcacaactatccgaagtaaaaaaggactggctcaagcttgcgctggaactggctcaaaaaaaacaaagacttgaaaaagaatttgcttcgatgccagataaaaatactcagctttcaaaaaacaaacgcttctataaactctatgaagagttctacctgtcgatgatgaaatctaaggcggaatttgaaatcgctcaagcgggcagcactcccgattttaaaattctttcatctgctacgtttcctaaaaatcccatctcgccgcagcacgttatcattatgggcatcgggttagtcgctggcttggtgcttaatattttcttcattggctttctataa

SEQ ID NO: 4538 - protein, 149 aa, Unknown
  Obtained from environmental sample
  misc_feature (1)..(149): Xaa is any amino acid
MQKMIWERDRLGLSYNEKTFAFRQKERELDNLKNQVFSQLSEVKKDWLKLALELAQKKQRLEKEFASMPDKNTQLSKNKRFYKLYEEFYLSMMKSKAEFEIAQAGSTPDFKILSSATFPKNPISPQHVIIMGIGLVAGLVLNIFFIGFL

SEQ ID NO: 4539 - DNA, 837 bp, Unknown
  Obtained from environmental sample
  misc_feature (1)..(837): n is a, c, g, or t
ttgctgaacagcgtatcctctcataagaaactttcacatttttttatgcgtggacaaaacggtatttatgaaataagcactgcaactattcacccgacaagtgatcctgaaaggcttagcaggcccaatggatattttgctgcaggaaggctttggaaaaatgaacggctcgaaaagatctctgaattaacaggtacaactatagagcttgtcggcctggatgcaagggattcagttgaaaaagcagcagatcctcataattttgtttctaacagctttcacctgctttatacctgggataaaaaacctttggcttacgttcggtctgaaaaacaggctgaaatgataaaaataatgcatgatcaatctgataaacaattcatcctgataatagtatttgtatcagtactgcttgtgctgatgagcgtatcactttattacattgttaacaaaccgctcagcaaattatcaaggagcctgaaagaccatgacccttccggaatccaaaaccttcttcacaaaaaaagtgaatacggtgagatggcaaatcttgtaaatgagtttttcgttcagaaagaaaaacttgtaaaagagatcgaagtgagaattgagactgaacaaaagatcagagtatcggaagaaaaactgaaaaactcgctcaaagaaaaggatgtcctgctcaaggaagttcatcacagggtaaaaaacaatctccagatagtaatgagccttatcaggctgcaggttaacaggatggatgacaaatgtaccataccagcatttgcagaccagtttaaacagaatacgttcgatatctctcgttcacgaaatgcttaa

SEQ ID NO: 4540 - protein, 278 aa, Unknown
  Obtained from environmental sample
  DOMAIN (229)...(274): Histidine kinase
  misc_feature (1)..(278): Xaa is any amino acid
MLNSVSSHKKLSHFFMRGQNGIYEISTATIHPTSDPERLSRPNGYFAAGRLWKNERLEKISELTGTTIELVGLDARDSVEKAADPHNFVSNSFHLLYTWDKKPLAYVRSEKQAEMIKIMHDQSDKQFILIIVFVSVLLVLMSVSLYYIVNKPLSKLSRSLKDHDPSGIQNLLHKKSEYGEMANLVNEFFVQKEKLVKEIEVRIETEQKIRVSEEKLKNSLKEKDVLLKEVHHRVKNNLQIVMSLIRLQVNRMDDKCTIPAFADQFKQNTFDISRSRNA

SEQ ID NO: 4541 - DNA, 645 bp, Unknown
  Obtained from environmental sample
  misc_feature (1)..(645): n is a, c, g, or t
atgctttatgaagatcagactctggagcagcaaattgaatacgttttgcagtgcccgccgcaaatgattgacgcaggagtatgtaatgaaaaactttttttgaacggagtaggaattggttttgacggtgctattgtttatgatcttttgggaaagaaaaagttgggaggtaaagcctcctatcttctctcgatactaaagcaaatcgttggctaccacgaaaagccttgcgtattgcaaatgcccaatgaaatgatcaaagaagattgttttttgatttccgttgccaatggtaaaagatatggcggtggattcttagttactcctaaggcttctgtttctgacgagatgtttgatgtgaatatcgttggaaaagtttctcctattaagcgaataaagtatttatcggttattgaaaaaggagagcatttgaacctcgactttgttaagtatagaaaagcagataaggtcattattcattcttcatctatgctgcatgcgcacatggacggagaatattttaagagcgattatttcgacgtagagatcttaccaaaaggcttttctttcctgtgcttaaacaactcttttttctcttgtaaacattttactaagaatcatcctgcaataaaagctccaatgtga

SEQ ID NO: 4542 - protein, 214 aa, Unknown
  Obtained from environmental sample
  misc_feature (1)..(214): Xaa is any amino acid
MLYEDQTLEQQIEYVLQCPPQMIDAGVCNEKLFLNGVGIGFDGAIVYDLLGKKKLGGKASYLLSILKQIVGYHEKPCVLQMPNEMIKEDCFLISVANGKRYGGGFLVTPKASVSDEMFDVNIVGKVSPIKRIKYLSVIEKGEHLNLDFVKYRKADKVIIHSSSMLHAHMDGEYFKSDYFDVEILPKGFSFLCLNNSFFSCKHFTKNHPAIKAPM

SEQ ID NO: 4543 - DNA, 756 bp, Unknown
  Obtained from environmental sample
  misc_feature (1)..(756): n is a, c, g, or t
atgctccaggtgtcagtagtgattatcacatttaatgaagaaaaaaatatcgggcgatgtttagattctgtaaaagatgttggagatgatattgtagtgatcgactcattttcttcagacagtacagaaagtatatgcaaagtaaaaagtgtccgttttgtgcagcataaatttgaaggacacattgaacaaaaaaactgggcaattactcaggcacgatttccgcatattctttccttggatgcagatgaaacgctttccgaggaattaaaaaaatctattgttcatataaaaaataattgggtcaaggatggatattatatgaatcgtcttaccaattattgcggacaatggatttatcactgcggatggtacccggacagaaaacttcgcctatgggattcaagaaaaggtaaatggggaggaactaacccgcacgataaatatcagcttttcgaaggagaaaaggcaacaggttttttgaaaggaaatattttacattacagttacaattctatctcggaacattatagacaggctgataaattctcaactattgcttcgaaagagatgcatttgaaaggaagagccgtttctgtgccaatgatttatataaagaccgcatttaaatttttacgcaattattttattaagcttggatttttggatggtaaatacggctttattatctgtagaataacagcttgggaaacctatctgaaatacctaaagctttatcaattcaacaggaaatga

SEQ ID NO: 4544 - protein, 251 aa, Unknown
  Obtained from environmental sample
  DOMAIN (5)...(178): Glycosyl transferase
  misc_feature (1)..(251): Xaa is any amino acid
MLQVSVVIITFNEEKNIGRCLDSVKDVGDDIVVIDSFSSDSTESICKVKSVRFVQHKFEGHIEQKNWAITQARFPHILSLDADETLSEELKKSIVHIKNNWVKDGYYMNRLTNYCGQWIYHCGWYPDRKLRLWDSRKGKWGGTNPHDKYQLFEGEKATGFLKGNILHYSYNSISEHYRQADKFSTIASKEMHLKGRAVSVPMIYIKTAFKFLRNYFIKLGFLDGKYGFIICRITAWETYLKYLKLYQFNRK

SEQ ID NO: 4545 - DNA, 810 bp, Unknown
  Obtained from environmental sample
  misc_feature (1)..(810): n is a, c, g, or t
ttggcgaaagttcaaacctcattttgtgaagcaaagttcatgacggaaaattcctcgcaaaaaagaattcttttcttgtctggagtcgatttcaaagaaaaatcaattcaggtaatccgtaagacgccggaagcatatgttaaagccggatggcatgtcgattatattgttgggagggacaattctttgaacggcgactatttctatgaatcaattattaatccaagcggagttacagtacatcgcttttcgtggccctttacaaagatagacggtcttttaaataacacctattggaaggctttttggtttagggtaagaaatttggccctcgtggtaaccctcgcgttgaaagcaatgcgacttataaaaaaaaatgatttccatatcatttacggttatgaaattcccggcgtactagccattcggttgcttcgcgcaatgcttgtcagaaccaaagctaaatttgtaacacgatttcagggcgttttatatgtcaaggagtggctgcgcaagaaacagaaattcagggttcttactaattgggatgccttcctggcattgagaaccaatgcggacttgtgtataatgacaaatgacggttctcagggcctgagtgttttaaagcaaattgcgtcacctttgaaaaacatcctgttttgcccaaacggtgtagatgaagaaaacctcgataaggataaactggccaaaatccgaatggacttctattctgatccacaaaaaaataccttctttcatttcgagattggaccatcaccaaaaattgacagacgctccgataattcctga

SEQ ID NO: 4546 - protein, 269 aa, Unknown
  Obtained from environmental sample
  misc_feature (1)..(269): Xaa is any amino acid
MAKVQTSFCEAKFMTENSSQKRILFLSGVDFKEKSIQVIRKTPEAYVKAGWHVDYIVGRDNSLNGDYFYESIINPSGVTVHRFSWPFTKIDGLLNNTYWKAFWFRVRNLALVVTLALKAMRLIKKNDFHIIYGYEIPGVLAIRLLRAMLVRTKAKFVTRFQGVLYVKEWLRKKQKFRVLTNWDAFLALRTNADLCIMTNDGSQGLSVLKQIASPLKNILFCPNGVDEENLDKDKLAKIRMDFYSDPQKNTFFHFEIGPSPKIDRRSDNS

SEQ ID NO: 4547 - DNA, 339 bp, Unknown
  Obtained from environmental sample
  misc_feature (1)..(339): n is a, c, g, or t
atgaatgacatttcattaacaattaacacccctacagaaaacgggaatacgcttaaagtagatttaatgaatctaaaaaaagcatcgctcgttttaagatcggttaaccataagctcaggcagcaaatcctcaagcttattgacgagcacggaaagatgaccgtaacggaaatctatgtgaagctaaggctggaacaatcggttgcgtctcaacaccttgctatattgcgaaaagctggttttgtaaaaacggaacgggatggtaagttcatttattattctgtgaatacaacaaggcttgaagaactgaataaatttgtggaagagttgcttagttaa

SEQ ID NO: 4548 - protein, 112 aa, Unknown
  Obtained from environmental sample
  DOMAIN (32)...(110): Bacterial regulatory protein, arsR family
  misc_feature (1)..(112): Xaa is any amino acid
MNDISLTINTPTENGNTLKVDLMNLKKASLVLRSVNHKLRQQILKLIDEHGKMTVTEIYVKLRLEQSVASQHLAILRKAGFVKTERDGKFIYYSVNTTRLEELNKFVEELLS

SEQ ID NO: 4549 - DNA, 339 bp, Unknown
  Obtained from environmental sample
  misc_feature (1)..(339): n is a, c, g, or t
ttgcaggaaagatcttctgccccaggcaaaatgcgcatcgctcaaatgggcgaattccttccttacattttttacatactgcatatattcttcgcgcggagctgccagtatggaaagatcaaagtcaagaaaatatttcagatcaggatcggttacttcaccggagtggtgaaacttggtggttatgataaattcttttacctcctctatggttgcaggcggcacattcagcttattgagactgacctctgccctctcagcgctaagttcttcattatcgcccatgcccggcctgtaaacaatatcatgataaagaatggagaagccgacaattcttga

SEQ ID NO: 4550 - protein, 112 aa, Unknown
  Obtained from environmental sample
  misc_feature (1)..(112): Xaa is any amino acid
MQERSSAPGKMRIAQMGEFLPYIFYILHIFFARSCQYGKIKVKKIFQIRIGYFTGVVKLGGYDKFFYLLYGCRRHIQLIETDLCPLSAKFFIIAHARPVNNIMIKNGEADNS

SEQ ID NO: 4551 - DNA, 561 bp, Unknown
  Obtained from environmental sample
  misc_feature (1)..(561): n is a, c, g, or t
gtgatgaaagttcaaaagattgttcccgttatgaagctgcaaaagcacacagaattaaattcgagttatttgtcgacctgttttactgtccgtctgaaggtaaaatttctgaagcaaaagttgtcgcagttgttaaaaaaaatgaaagctcttggagtttatgagatttcgattggagatacgattggagcggctgttccttccgaagttgaatccctttttaaaaaactgaaaaaaattattccggtaacaaaacttgctggacattttcacgacacccgagggcaggctttagccaatattttggcggcctataacaccggcgttcgtacctttgattccagcattggtggtctcggaggttgtccctacgctcctggcgccacaggaaatgtggccactgaagatgttgtttatatgttcaacggcatgggaatcaaaaccggtttaaaacttgagattctgattgagaccaacagatggctgcagccaatgatgaatcatcctctgtcatctaaggtcggccatgtcggccttcttcttgctaaacctcgtatgtga

SEQ ID NO: 4552 - protein, 186 aa, Unknown
  Obtained from environmental sample
  DOMAIN (3)...(168): HMGL-like
  misc_feature (1)..(186): Xaa is any amino acid
MMKVQKIVPVMKLQKHTELNSSYLSTCFTVRLKVKFLKQKLSQLLKKMKALGVYEISIGDTIGAAVPSEVESLFKKLKKIIPVTKLAGHFHDTRGQALANILAAYNTGVRTFDSSIGGLGGCPYAPGATGNVATEDVVYMFNGMGIKTGLKLEILIETNRWLQPMMNHPLSSKVGHVGLLLAKPRM

SEQ ID NO: 4553 - DNA, 417 bp, Unknown; identical to SEQ ID NO: 751
  Obtained from environmental sample
  misc_feature (1)..(417): n is a, c, g, or t

SEQ ID NO: 4554 - protein, 138 aa, Unknown; identical to SEQ ID NO: 752
  Obtained from environmental sample
  misc_feature (1)..(138): Xaa is any amino acid

SEQ ID NO: 4555 - DNA, 381 bp, Unknown
  Obtained from environmental sample
  misc_feature (1)..(381): n is a, c, g, or t
gtggatcaagaatgcacttctgactgtcccactatatcaatcaaagggaccgactcctattcatggacacttgataaaaatttcatccttcacgaagtcgaagtgatgatgggtgaagaaaaaacgatcgtgaccgaactaataggctatgacgaaaaatccaaactctattcaatgcattcgtttgacaaccagggacaggtgaatgccatgtttggaattattcatgatacaaatattctctacatacagggaccaaacatccgagctgttttgaaaatggaagaaagtcaaatggtagctcgctgggaaaaaacagaagacaagattaactggtctcactggatggatatgcagtttgaaaaaatcccaaacaaataa

SEQ ID NO: 4556 - protein, 126 aa, Unknown
  Obtained from environmental sample
  misc_feature (1)..(126): Xaa is any amino acid
MDQECTSDCPTISIKGTDSYSWTLDKNFILHEVEVMMGEEKTIVTELIGYDEKSKLYSMHSFDNQGQVNAMFGIIHDTNILYIQGPNIRAVLKMEESQMVARWEKTEDKINWSHWMDMQFEKIPNK

SEQ ID NO: 4557 - DNA, 372 bp, Unknown
  Obtained from environmental sample
  misc_feature (1)..(372): n is a, c, g, or t
atgttcagcttttttttactattggcgatttctgaatcccaggaaatttataaagtagacctggacggaaaaataatttcttccaggattgtaaatagtagtccaacctacattgaatatcagttatttgccagaaaaggggtaaactttttttctgccagggatgggttcagcagttaccttgaagtaaacgattatattttgaaagaaaaaaataccctggtctataaagttaacggaagaaaaaaaattataattaatcggttaatggagggttttctatatagtttgattccaattatcctatttatactgatcaggacctatatcgtattattccctcccgaaaaaaaatggaacaagtatacctga

SEQ ID NO: 4558 - protein, 123 aa, Unknown
  Obtained from environmental sample
  misc_feature (1)..(123): Xaa is any amino acid
MFSFFLLLAISESQEIYKVDLDGKIISSRIVNSSPTYIEYQLFARKGVNFFSARDGFSSYLEVNDYILKEKNTLVYKVNGRKKIIINRLMEGFLYSLIPIILFILIRTYIVLFPPEKKWNKYT

SEQ ID NO: 4559 - DNA, 321 bp, Unknown
  Obtained from environmental sample
  misc_feature (1)..(321): n is a, c, g, or t
ttgatctttggatcatttccggccctgtacgacgacaagtcggagctctacatgggcgttgacgccattgtgaagcagttcgtcgaagtcgattacgagaaggacgaaaagcagaaaagcatcgtcctgaccgaagatggcaccgaaaaggccgagcgcatgctcgagaccgctggcctcatcgaggggcaaaacctctacgacatcgccaatacgcaggtggtccaccacctcaatcaggccctgaaggccaacaagatgttcaagcgggacatcgattacatcgtcaaggacggcaaggtgatcccgcgaacggtatga

SEQ ID NO: 4560 - protein, 106 aa, Unknown
  Obtained from environmental sample
  DOMAIN (9)...(102): SecA preprotein cross-linking domain
  misc_feature (1)..(106): Xaa is any amino acid
MIFGSFPALYDDKSELYMGVDAIVKQFVEVDYEKDEKQKSIVLTEDGTEKAERMLETAGLIEGQNLYDIANTQVVHHLNQALKANKMFKRDIDYIVKDGKVIPRTV

SEQ ID NO: 4561 - DNA, 426 bp, Unknown
  Obtained from environmental sample
  misc_feature (1)..(426): n is a, c, g, or t
atgaaacaaacagtttatgttttaatacttatcctgaccgtgagttgtaacaatacaaaacagtattcaaaaacacactacccgaatcctaaatatcattttgccccggttgacaaaaaagctttcaattcaatacaacaatattatgttcctgtatactcgagcatttatggtcatacaggtaaaaatgaatttcttttatccgccacattaagtatcaggaatatcggtttttctgatagtctttacatttctaaaatcgactattatgactctgaaggaaaactgcttaaaaaatatcttgattccattgtactattanagccgatggcttcaatggaatttgtagtggcatcaggcgaaaaagaaggcggtgccggagctaacttcgtagtagaatgtttagcgcaccatattttaaattga

SEQ ID NO: 4562 - protein, 141 aa, Unknown
  Obtained from environmental sample
  misc_feature (1)..(141): Xaa is any amino acid
MKQTVYVLILILTVSCNNTKQYSKTHYPNPKYHFAPVDKKAFNSIQQYYVPVYSSIYGHTGKNEFLLSATLSIRNIGFSDSLYISKIDYYDSEGKLLKKYLDSIVLLXPMASMEFVVASGEKEGGAGANFVVECLAHHILN

SEQ ID NO: 4563 - DNA, 615 bp, Unknown
  Obtained from environmental sample
  misc_feature (1)..(615): n is a, c, g, or t
atgtcgattgaagtaaaagccctcactaaaatttatggtgatcaaaaagctgtaaacgatatttcctttaatatttccaaaggtgaaatagtaggtttcctgggaccaaacggggctggcaaatcaaccaccatgaaaatgattaccggttatctagcgccggatgaaggtgatattaccgttagtggtattgatgtgaaaaaagatcccctggcatcaaagaaaaaaataggatacctgcctgagtccaatgccttgtattacgatatgtatataaaggagtacttaggttttgtagcagatttacactcaataaataacaggcaacaggcaattagcaatgtgatagaacaggtaggattgacgccggagaaaaataaaaagatcgggcagctttcaaaaggatataaacaaagagtaggcattgcagccgcattgttgcataaccccgaagttttgattttagatgagcctacaagcggccttgaccccaatcaaattgtggagatacggcaggtgataaaggaccagggcagggataagatggtttcattttcttcgcatattttacaggaagtagaagccatttgcgaccgtgtaattattataacttaa

SEQ ID NO: 4564 - protein, 204 aa, Unknown
  Obtained from environmental sample
  DOMAIN (28)...(204): ABC transporter
  misc_feature (1)..(204): Xaa is any amino acid
MSIEVKALTKIYGDQKAVNDISFNISKGEIVGFLGPNGAGKSTTMKMITGYLAPDEGDITVSGIDVKKDPLASKKKIGYLPESNALYYDMYIKEYLGFVADLHSINNRQQAISNVIEQVGLTPEKNKKIGQLSKGYKQRVGIAAALLHNPEVLILDEPTSGLDPNQIVEIRQVIKDQGRDKMVSFSSHILQEVEAICDRVIIIT

SEQ ID NO: 4565 - DNA, 546 bp, Unknown
  Obtained from environmental sample
  misc_feature (1)..(546): n is a, c, g, or t
atgagtaaaagcgtaagggaaaaagggggcaatgacccatttatgttaggagtagatactcctgcaaaaaaaaatggaacgccaaaaattgaaaagactacagaacagcagtccgatcccttcatgcttggccttgaagtaaaaaaaaaagaaactacttcgcaagagcctgttattacttcagagcaagatgttacagtttcgcaagatggtacagaagatattcccccctcatcatcaccattaaaatcggagccgaaagagacgaataaaaaaagatatgccagaatagaagaagccgatgccaaagcattggctgatgattataaggacaaactatctgagattgatgtacaaaattcactctctccattcaatatagttggtaatgccagaaaacgaactgatttcctgcaatccagagaaggcaagataggaaagattatttccgatattaccgatggtaaattcaacagggaaaatttaattacttgtcaganttgcccccgagcagtaagaaactattctactgtactccaaatctaa

SEQ ID NO: 4566 - protein, 181 aa, Unknown
  Obtained from environmental sample
  misc_feature (1)..(181): Xaa is any amino acid
MSKSVREKGGNDPFMLGVDTPAKKNGTPKIEKTTEQQSDPFMLGLEVKKKETTSQEPVITSEQDVTVSQDGTEDIPPSSSPLKSEPKETNKKRYARIEEADAKALADDYKDKLSEIDVQNSLSPFNIVGNARKRTDFLQSREGKIGKIISDITDGKFNRENLITCQXCPRAVRNYSTVLQI

SEQ ID NO: 4567 - DNA, 330 bp, Unknown
  Obtained from environmental sample
  misc_feature (1)..(330): n is a, c, g, or t
atgaatatgacaaagagaactatatctgcacttgtacttttcctcgggttgatttgcctggctttcacacctgaaaaacatggtgtgtatgtacagctacatcctggaaacaataaaaaaattgtcatccagatattacccgataaaacatacgcaaacgttgtggcgtatataaatttttattcagctgacaacaagcgcgtgggacaaaaggcgttcgacctgtcagatgacacagaaaagtatattcgaaaagatacatgcactacacgcgtgtntaaattctcattcgacaagcctgttgcaccgcgttacgatcgatcacattaa

SEQ ID NO: 4568 - protein, 109 aa, Unknown
  Obtained from environmental sample
  misc_feature (1)..(109): Xaa is any amino acid
MNMTKRTISALVLFLGLICLAFTPEKHGVYVQLHPGNNKKIVIQILPDKTYANVVAYINFYSADNKRVGQKAFDLSDDTEKYIRKDTCTTRVXKFSFDKPVAPRYDRSH

SEQ ID NO: 4569 - DNA, 327 bp, Unknown
  Obtained from environmental sample
  misc_feature (1)..(327): n is a, c, g, or t
ttgattgcagccaaaattcttaagaatggtttaccggacaggacattgctgaatgttaatcttcctgatctttccctgcaaaaaataaaaggcattaaaatctgccgccaggcatatgccaagtgggaagaggaatttgatgaaagaatagatcctaataaaagaaagtattactggctgaccggtaaatttgtaaacatggataaaagtgaggatactgatgaatgggcattgaagaatggatatgtgtctgttgttccggttcagtttgattttacagcacatcatgctattccacatctcacaaaaatttcatggaatgattga

SEQ ID NO: 4570 - protein, 108 aa, Unknown
  Obtained from environmental sample
  misc_feature (1)..(108): Xaa is any amino acid
MIAAKILKNGLPDRTLLNVNLPDLSLQKIKGIKICRQAYAKWEEEFDERIDPNKRKYYWLTGKFVNMDKSEDTDEWALKNGYVSVVPVQFDFTAHHAIPHLTKISWND

SEQ ID NO: 4571 - DNA, 576 bp, Unknown
  Obtained from environmental sample
  misc_feature (1)..(576): n is a, c, g, or t
atgaaattcctgatcgttggccttggaaatattggaaatgaatacgcccatacccgtcataatatcgggtttgacgtggcaatggcatttgcatccaaacatgggggccagttttctaatgaaagactggcgtataagtcggaggtaaaatggaagggcaggatctttgtttgtatttgtcccaccacctatatgaacctcagtggcaaggcagtaaagtattggcttgataaagaaaagattgacattgaaaacagccttactatcgtagatgaggttgcgcttcctttgtcgaggatcaggttgagacctggcggaagctcaggaggacataatggtttgaaaagcattgaagagttgttgggaacccagcaatatcccaagctcaggtttgggatcgggaacgattatcccaagggcatgcaggtggattatgtattaggcaaatggaggaaggaagaagagccactggtcaaactaaagatagataggtgcattgatgtgatagagagttttgccaccattggaatagccaatgccattaataaattcaacaatgtggaaattacgttatga

SEQ ID NO: 4572 - protein, 191 aa, Unknown
  Obtained from environmental sample
  DOMAIN (4)...(185): Peptidyl-tRNA hydrolase
  misc_feature (1)..(191): Xaa is any amino acid
MKFLIVGLGNIGNEYAHTRHNIGFDVAMAFASKHGGQFSNERLAYKSEVKWKGRIFVCICPTTYMNLSGKAVKYWLDKEKIDIENSLTIVDEVALPLSRIRLRPGGSSGGHNGLKSIEELLGTQQYPKLRFGIGNDYPKGMQVDYVLGKWRKEEEPLVKLKIDRCIDVIESFATIGIANAINKFNNVEITL

SEQ ID NO: 4573 - DNA, 420 bp, Unknown
  Obtained from environmental sample
  misc_feature (1)..(420): n is a, c, g, or t
gtggatcaagaattgaattccaaatgggttttagaaaaaggtgcaaaggataaggtaattgaaaaagtggtccgtgatggaaaaacgtatttcgtaattaatgattacaataaattgcgtgatctttttggtcaattactaaaggaaatccagcgtattaagtcagaaggtgattttgaggcaggaaaaaatcttgttgaaacgtatggtgttaaagttgaccaggatattctgaaagaagttcataagcgttatgaaaaattgaacatcgcaccttacaccggattcattcagccaagacttgttgcagtcatggaaggaaattcaataaaagatgttcatgttgaatatccttcagattttatcgggcagatgctggaatttgggaagaagtatgcttttttaccggtggcgaattga

SEQ ID NO: 4574 - protein, 139 aa, Unknown
  Obtained from environmental sample
  misc_feature (1)..(139): Xaa is any amino acid
MDQELNSKWVLEKGAKDKVIEKVVRDGKTYFVINDYNKLRDLFGQLLKEIQRIKSEGDFEAGKNLVETYGVKVDQDILKEVHKRYEKLNIAPYTGFIQPRLVAVMEGNSIKDVHVEYPSDFIGQMLEFGKKYAFLPVAN

SEQ ID NO: 4575 - DNA, 642 bp, Unknown
  Obtained from environmental sample
  misc_feature (1)..(642): n is a, c, g, or t
ttggaggtagaaaatgcaaaacaaaaaaatgagcgcatttctaaaaaggttggttcattaaaacctgatgaaagagagcagtatttgaaagagcatccttatgaaaagatttctaaagagtccaggtacttgcataaatatgtttctcggcttataacctctcgtacatacttcatgttgggcattcaggaggaagcaagactttataataaaatcacagttccttataaatgtaatacagctcaattttcaaaaacattgcaccggctttgcctagataaattaattgagttcattggtgagtttcagataaaagagctaccggaggaagataaggttaagaaccttattgaccaatacaatgccattcataatactaagcttcctgaaatagagatgacgaggttttatacaaagcttaaagaggtcggatcatttaaagagacggcaaggttttataactattcaagagcgtctctttacaggtataaagcatggtttaagaaagttggaataacagaaactaatgttttaccagtgacagatgtaggcgttccaagtgcaccaattgacatggttcaatatcattccattgttagttacaatcccagttttataaaatcaaattcattaatcttctaa

SEQ ID NO: 4576 - protein, 213 aa, Unknown
  Obtained from environmental sample
  misc_feature (1)..(213): Xaa is any amino acid
MEVENAKQKNERISKKVGSLKPDEREQYLKEHPYEKISKESRYLHKYVSRLITSRTYFMLGIQEEARLYNKITVPYKCNTAQFSKTLHRLCLDKLIEFIGEFQIKELPEEDKVKNLIDQYNAIHNTKLPEIEMTRFYTKLKEVGSFKETARFYNYSRASLYRYKAWFKKVGITETNVLPVTDVGVPSAPIDMVQYHSIVSYNPSFIKSNSLIF

SEQ ID NO: 4577 - DNA, 864 bp, Unknown
  Obtained from environmental sample
  misc_feature (1)..(864): n is a, c, g, or t
ttgaattaccacctggagaacagcgttctaaaacacctggtaaccatgaaaaaagcgatttattttttattcatttttgtattcttacccttcctcgttcttgcgcaggatgagaaatcgcagcttgaaaaagaaaggcaggagatacagaatgagatcaaagagatccagagccagtttaacaaggtgaagggaaggaaaaagcagatcgttgggcaatacaatctgatcgaccggaaaataaaacttcaaaacaggtatatcagcaatatcagcaaggaactccgctacattgacgatgacatttatttaagcaatgttgaaatctatcgcctttctaaattgctggataccctgaaagcacaatatgcccgcagtgtgatctatgcttacaagaacaggagcaattatgacttcctcaattttgtcttttccgctaacagttttaatgatgctgtaaagcgggtatcttatctcaagagttaccgcgcatatcgtgaacagcaggtgacaacaatcaatgaaacccaggcattgatcgccaaaagaaaacaagaccagntgaacaagaaacgcccgaaggacgatgcgcttaaaaatccaacccgaacaggcaaagggcctggaagccaaaaacaggaacaagatgggtataaggcgagtcagtcgcaggaaacgatcttcaaagcattggcggcaaaagaaagagatacgactgagaaattatacagtctatcactgggaattgagcacaaaagaaagcggagcaatcgtcagccatatcagtgtttggcgccgagtaccttgaaaactctttcacaatacggttatacggcgctatcgagatttaaaccgcaatcggnt

SEQ ID NO: 4578 - protein, 288 aa, Unknown
  Obtained from environmental sample
  misc_feature (1)..(288): Xaa is any amino acid
MNYHLENSVLKHLVTMKKAIYFLFIFVFLPFLVLAQDEKSQLEKERQEIQNEIKEIQSQFNKVKGRKKQIVGQYNLIDRKIKLQNRYISNISKELRYIDDDIYLSNVEIYRLSKLLDTLKAQYARSVIYAYKNRSNYDFLNFVFSANSFNDAVKRVSYLKSYRAYREQQVTTINETQALIAKRKQDQXNKKRPKDDALKNPTRTGKGPGSQKQEQDGYKASQSQETIFKALAAKERDTTEKLYSLSLGIEHKRKRSNRQPYQCLAPSTLKTLSQYGYTALSRFKPQSX

SEQ ID NO: 4579 - DNA, 540 bp, Unknown
  Obtained from environmental sample
  misc_feature (1)..(540): n is a, c, g, or t
ttgagataccattggtttgttcaattaaaggaagaaaatggtttttccttcaccctgcttgcgcatcatgctgatgataatattgaaacacttttgatgaattttttccggggaacaggcatgcagggattaacagccatgcctgaagaaaatattgatgacaagtttttcctacggcctttgctcggtgtaagaagaatagaaatttttgcatttgcaaagcaaaacaaattggaatgggtagaggattcttccaatctttcttcaaaatatacccgcaatttttttaggaatgaattattgccagcgataaaaaaagtgtatccacaagtggaagaaaatttgttagataacattgaccgcttcaaaaaaatacattcgctctatgagacatcagtgcaggatttgaaaaagaaagtttgtgagcatcatatatctgaaatccgcattcctattttaaaattgatgaagtaccgcaatacttcattgatttttgagatcatcaaagattatggcttcagtgaaaagcaggtagattga

SEQ ID NO: 4580 - protein, 179 aa, Unknown
  Obtained from environmental sample
  DOMAIN (1)...(121): PP-loop family
  misc_feature (1)..(179): Xaa is any amino acid
MRYHWFVQLKEENGFSFTLLAHHADDNIETLLMNFFRGTGMQGLTAMPEENIDDKFFLRPLLGVRRIEIFAFAKQNKLEWVEDSSNLSSKYTRNFFRNELLPAIKKVYPQVEENLLDNIDRFKKIHSLYETSVQDLKKKVCEHHISEIRIPILKLMKYRNTSLIFEIIKDYGFSEKQVD

SEQ ID NO: 4581 - DNA, 354 bp, Unknown
  Obtained from environmental sample
  misc_feature (1)..(354): n is a, c, g, or t
gtgaaagcagaagtaagaaaaaaactaatattaaataatcttccttctgcctcgggcatagaaatagttgggaagctgatttatatcatcggggatgattctccttttctgtatattcttgacaataattatcagcagctggataaactggaattatttaaaacaacagattttattacaggcaggattccaaaattattaaaagctgacctggagtgtattacatcaataaatataaatcaaaaaaaacacctgtttatttgcggttctgcttcaaatgaaaaccgtgaaacagctttcctgttagaaacaggaaataatcttgcaacaggtaaaatcaatacagtttggtga

SEQ ID NO: 4582 - protein, 117 aa, Unknown
  Obtained from environmental sample
  misc_feature (1)..(117): Xaa is any amino acid
MKAEVRKKLILNNLPSASGIEIVGKLIYIIGDDSPFLYILDNNYQQLDKLELFKTTDFITGRIPKLLKADLECITSININQKKHLFICGSASNENRETAFLLETGNNLATGKINTVW

SEQ ID NO: 4583 - DNA, 429 bp, Unknown
  Obtained from environmental sample
  misc_feature (1)..(429): n is a, c, g, or t
atggaatattattgttcttaccaagatcgttgtcataaagaagtagaacagaaacttcgcaatttgacacttatttcagaattgaaagaaaaagtaattgttcatctaatcgaaaataaatatatagatgaagaacgttttgccaaaagcttcactcggggcaaacataactataaaggttggggtaaaaaccgaatcattcaagaattaaaatccagagaaatctctaaaagaaacatcgatttggctttaaaagaaatttcagaagaagtttatttagaaaattttcacactcttgctgaaaaaaattggaactccataaaagaacgaaaaggtcaaaagaaaaataaaaaatttgtagatttcttacttcgaaaaggctatgaaacgaatttaatttttgaaaaactaaaagaattagataaataa

SEQ ID NO: 4584 - protein, 142 aa, Unknown
  Obtained from environmental sample
  misc_feature (1)..(142): Xaa is any amino acid
MEYYCSYQDRCHKEVEQKLRNLTLISELKEKVIVHLIENKYIDEERFAKSFTRGKHNYKGWGKNRIIQELKSREISKRNIDLALKEISEEVYLENFHTLAEKNWNSIKERKGQKKNKKFVDFLLRKGYETNLIFEKLKELDK

SEQ ID NO: 4585 - DNA, 444 bp, Unknown; identical to SEQ ID NO: 2079
  Obtained from environmental sample
  misc_feature (1)..(444): n is a, c, g, or t

SEQ ID NO: 4586 - protein, 147 aa, Unknown; identical to SEQ ID NO: 2080
  Obtained from environmental sample
  misc_feature (1)..(147): Xaa is any amino acid

SEQ ID NO: 4587 - DNA, 519 bp, Unknown
  Obtained from environmental sample
  misc_feature (1)..(519): n is a, c, g, or t
atgataagagttggcctcctgagtgatacccatagttttattgacccaaaaatatttgaggtctttaaagaggttgatgaggtatggcatgccggtgatttaggaaccattgaattgtgtgatgaactcaaaaagtttaaacccttttatgccgtgcatggtaacattgatgggaaagatattcgcgcagattatcctctgaacctgtcgatagaaagagaagggtttagaattctaatgactcatataggtggttatcccggtagttatgagcctaaggcaagaagaaagattgaagagataaagccggatatctttatttgcggacactcgcatattcttaaagtgatgcgcgatcctaaatacaacaacatggtagtgatgaacccgggggctgctggcgttcagggttttcataaaataaaaacggttttgcgatttaccctgaacaatgcgaacattgaaacctcgaagcagttgaattgggtagagaggagaataacccggaatgagaagtaa

SEQ ID NO: 4588 - protein, 172 aa, Unknown
  Obtained from environmental sample
  DOMAIN (2)...(114): Calcineurin-like phosphoesterase
  misc_feature (1)..(172): Xaa is any amino acid
MIRVGLLSDTHSFIDPKIFEVFKEVDEVWHAGDLGTIELCDELKKFKPFYAVHGNIDGKDIRADYPLNLSIEREGFRILMTHIGGYPGSYEPKARRKIEEIKPDIFICGHSHILKVMRDPKYNNMVVMNPGAAGVQGFHKIKTVLRFTLNNANIETSKQLNWVERRITRNEK

SEQ ID NO: 4589 - DNA, 351 bp, Unknown
  Obtained from environmental sample
  misc_feature (1)..(351): n is a, c, g, or t
ttgggattcggacagacgatgcaacaaccttcttctggtatcaagaacttctggtttgctactcaatatctcacaggtcgtaaagatgacgccaaaatgaaaatcttccaagccaaacataccatcactttcaatttccaaattcgagtggattatgttgtccctcaagtaaatatttattccctttttcttaattttttttttgatcttcttttcaaaataatcaaaaaacagacaagtgctccaggcaatttagctggtggtgaagccataaccatcttctttcaaggaaacttgttgcaagtaacaaactcaatcaatgatattcagtgtcgaattggaactaagtaa

SEQ ID NO: 4590 - protein, 116 aa, Unknown
  Obtained from environmental sample
  misc_feature (1)..(116): Xaa is any amino acid
MGFGQTMQQPSSGIKNFWFATQYLTGRKDDAKMKIFQAKHTITFNFQIRVDYVVPQVNIYSLFLNFFFDLLFKIIKKQTSAPGNLAGGEAITIFFQGNLLQVTNSINDIQCRIGTK

SEQ ID NO: 4591 - DNA, 474 bp, Unknown
  Obtained from environmental sample
  misc_feature (1)..(474): n is a, c, g, or t
ttgtccactaattatcaagttatgaaacggatggttcttattctaacaggtgtccttgccctaatttcgtgtgaacgtgaggaggcaaaggaagaaaaaattaccgaagtcaaagaaatcagaaagcatgaaaaaaatatttccgaacgctttttaagattagatggtcagaccgataccctaagaagttatgaattgggaaaaaatctatttggtaaattccataaaaaaagagcggagttctatgtgattgaacatccgaacaaaaccatttataaccggccagtgaaatgtatcacattatactttctggatggtacattggcaaaaacaaagtatgaattagaggaagacatttctgatgatctgattcatagctacggtaatttcacgatcaaaggttacgatacgcttacacgcaatttattaaaatccgaaaaaatcatccactccgaaaatcaaagaaagttttaa

SEQ ID NO: 4592 - protein, 157 aa, Unknown
  Obtained from environmental sample
  misc_feature (1)..(157): Xaa is any amino acid
MSTNYQVMKRMVLILTGVLALISCEREEAKEEKITEVKEIRKHEKNISERFLRLDGQTDTLRSYELGKNLFGKFHKKRAEFYVIEHPNKTIYNRPVKCITLYFLDGTLAKTKYELEEDISDDLIHSYGNFTIKGYDTLTRNLLKSEKIIHSENQRKF

SEQ ID NO: 4593 - DNA, 468 bp, Unknown
  Obtained from environmental sample
  misc_feature (1)..(468): n is a, c, g, or t
atgagctatgattattttgaatccttatctttatcacaaagaaaattaattcaacgttttaaagattttttagatgaagaaaataatgctggtagagttgaaaatcaatatgcaatatgtcgtaaattacctattttagatgcagaacaatatcaaataatagtaaataattttgatgcaaagaaaaatgatgcaatccttgctccatttttttataaagatgaaccattaactattactactgaatttgacgaaccccaacaagaagaagaaaaagaagctgagataataggatttgaaacaataaaaagtaacaactatgcaataaacgaacaattaaaattcagtaaacaaatacatgatatagaatgtgatattcctgcaaatggattaaaattctttataaaattacagaacaaatttaatataaaaacaataggtataaatttaatgacggtatatatctag

SEQ ID NO: 4594 - protein, 155 aa, Unknown
  Obtained from environmental sample
  misc_feature (1)..(155): Xaa is any amino acid
MSYDYFESLSLSQRKLIQRFKDFLDEENNAGRVENQYAICRKLPILDAEQYQIIVNNFDAKKNDAILAPFFYKDEPLTITTEFDEPQQEEEKEAEIIGFETIKSNNYAINEQLKFSKQIHDIECDIPANGLKFFIKLQNKFNIKTIGINLMTVYI

SEQ ID NO: 4595 - DNA, 630 bp, Unknown
  Obtained from environmental sample
  misc_feature (1)..(630): n is a, c, g, or t
ttgggggggccttttttttggaaaaaacagaagcagcaggaacatgttccgaaaatatatcttacgtattcttatttctacaacctgttgggtgaccatcaaaagggcttgtcttacggcctgcaggcggctgaaggatttgagaaaagcgagcttcctgaaattaatatccagtcggtatacgcctggcttgaagtgggacatatatttcgggaaggacagcaatacaacaaggcgcttagttactataataaagcacttgccaaggcaagactaagtgataaagattggtatcgacggcccgccatggtaagtgttgccaatatatatcgtctgcaaaaccggcttaacgaggcccgaggtttatatgaagaggtaattaaaatagataagagggatggtggtgtggactatgttatcagtggtctttcaggtttgggtgatatagcgatggtgcaggaaaattatcctctagcgatcggttattttaaacaaacattaaagctcggcgctaaacacaatatgaatacaancattgatgattatatgtgccgggttggaaacgctttccttcttgataaaccagttcgattcagcaaattatccatcttcataaggcgtattctttaa

SEQ ID NO: 4596 - protein, 209 aa, Unknown
  Obtained from environmental sample
  misc_feature (1)..(209): Xaa is any amino acid
MGGPFFWKKQKQQEHVPKIYLTYSYFYNLLGDHQKGLSYGLQAAEGFEKSELPEINIQSVYAWLEVGHIFREGQQYNKALSYYNKALAKARLSDKDWYRRPAMVSVANIYRLQNRLNEARGLYEEVIKIDKRDGGVDYVISGLSGLGDIAMVQENYPLAIGYFKQTLKLGAKHNMNTXIDDYMCRVGNAFLLDKPVRFSKLSIFIRRIL

SEQ ID NO: 4597 - DNA, 711 bp, Unknown
  Obtained from environmental sample
  misc_feature (1)..(711): n is a, c, g, or t
ttgcagtatcaacgtctatataaaaacgcatcagacactatatacaataaagaaaaagtaagtagcctaaataaactggaagttttgtatgaaacgggaagaaaagagaaacagatacttgctctgcaggcggaccaggcaagaaaacagttgttactacttaagcaaaaaaggtggctacttataatagccatatctcttggattcatcacaatgggttttgttctattctacaaaagcagtattaagaatagggtaattgcccaacaaagacagcaattacaggataagaaaattaattcccttgaacaggagcagaaggtaattgcactgaaaaacatgcttgcaggccaggaagctgaacgttcccgcatagcgaaggatttgcatgatgggcttagtggattattctcaactattaaaatgcatctcagcacacttcagcatcaaaatgaggaacttaaacaaaatgaactgttcaggaaaagctataccctggttgatactgcatcagaagatttgaggcgaatagctcataatatgatgccggaagttttaatgaaacttggcttgatacacgcgcttaatgacttttgtaatacgatcaatcaaaaaaaatccttccatgtatcactgcttaattatggtatggagaaaaggctgaatataaatattgaaatcatcctatatagagttgtgcaggactgctaa

SEQ ID NO: 4598 - protein, 236 aa, Unknown
  Obtained from environmental sample
  misc_feature (1)..(236): Xaa is any amino acid
MQYQRLYKNASDTIYNKEKVSSLNKLEVLYETGRKEKQILALQADQARKQLLLLKQKRWLLIIAISLGFITMGFVLFYKSSIKNRVIAQQRQQLQDKKINSLEQEQKVIALKNMLAGQEAERSRIAKDLHDGLSGLFSTIKMHLSTLQHQNEELKQNELFRKSYTLVDTASEDLRRIAHNMMPEVLMKLGLIHALNDFCNTINQKKSFHVSLLNYGMEKRLNINIEIILYRVVQDC

SEQ ID NO: 4599 - DNA, 732 bp, Unknown
  Obtained from environmental sample
  misc_feature (1)..(732): n is a, c, g, or t
ttgcggaaatatttcaacgacacgacgccgtatgtcatcacagtccaagatggtgatacgcccgaacatattttgggacgacgtcgtatcaaaccgtttgcggcattgatccaagaaacattcgcaaacgcgcacgctgtgcaggccatctcaaagtttcttgcggactttgcaaagcgtgttggctacaagggacagccgattgttgttccaaacggtgtcgattctgcacattttgcggataagaaatggaaaaaggatccgcttggactcgtataccgattcgacaagaagccaaatgacatttatgtcatcacaacctcacggcttgttgagaaaaacgccgttgatgacatcatccgtgcattgcccatgatgaaagagcaggtaaagctcattgttgttggcgatggtcccttggggtacgagctgtgggaattggcaaagacgctcaaggttgagaagcgggttgtgtttgttggacaggtgccgtacgaagacattccgggctaccttgcaattgagatggaaggtattgctgcaatgtctggaccaagactggaaaccaaacctgatgagctagatttcaagtcagatgatgatgacgacattatagaacaaagttctagtaaaaacttttaccaaaacggtaaaaataaaacaaaatcagatatcaaaatacccaaatacttgaatgattcagaaacaacaaaggtagtagatcacatgtga

SEQ ID NO: 4600 - protein, 243 aa, Unknown
  Obtained from environmental sample
  DOMAIN (90)...(224): Glycosyl transferases group 1
  misc_feature (1)..(243): Xaa is any amino acid
MRKYFNDTTPYVITVQDGDTPEHILGRRRIKPFAALIQETFANAHAVQAISKFLADFAKRVGYKGQPIVVPNGVDSAHFADKKWKKDPLGLVYRFDKKPNDIYVITTSRLVEKNAVDDIIRALPMMKEQVKLIVVGDGPLGYELWELAKTLKVEKRVVFVGQVPYEDIPGYLAIEMEGIAAMSGPRLETKPDELDFKSDDDDDIIEQSSSKNFYQNGKNKTKSDIKIPKYLNDSETTKVVDHM

(The sequence listing continues in the following parts.)

What is claimed is:

1. An isolated or recombinant polypeptide comprising: (i) an amino acid sequence having at least 90%, 91%, 92%, 93%, 94%, 95%, 96%, 97%, 98%, 99%, or more or complete sequence identity to SEQ ID NO:26,486 or, (ii) the polypeptide of (i) encoded by a nucleic acid as set forth in SEQ ID NO 26485.

2. The isolated or recombinant polypeptide of claim 1, wherein the polypeptide has a sequence as set forth in SEQ ID NO:26,486.

3. A protein preparation comprising a polypeptide as set forth in claim 1, wherein the protein preparation comprises a liquid, a solid or a gel.

4. A composition comprising the polypeptide as set forth in claim 1.

* * * * *